United States Patent 9,328,346 (POLYCOMB-ASSOCIATED NON-CODING RNAS) - sequence listing, part 44

SEQ ID NO: 7769 - RNA, 227462 nt, Mus musculus
cucgcgggcgccaagugaugacgcagagcgcgcgcgggucguuucagccacagaagugggcugaggaaaggagucggggucugggcgugcgacguucggcuagauaucaccgagcuaggugggacagccagguaagauccaggaggaaccgugauaggggucuagccggcguugucgccucccucugugcucuggggaccugggccugagccucuucacccgcagcaacuagacggaggcggguuaugcucacauaugaucacagguuaugugaucaaaacaaaacaaacuguuuagaacugacuuuugaaacugaggcaugaacagguagcucagauggacucaaggccacaggugccauuucacuucugcaggugaagggaugugguagccucggugugaaaaaagaggggggaagcggggcgggaggcaaccuucuugggcacgggcauguugguggugacccggaaaugguaguaguuuuuauuauuacuuugguaacuuaacggauuuaguccugcucauuucauuuuugugaggcgacguuuuauaucuucuaaugcauguuccaguuuaaggagaucccagcaugaaggaaugguagaagucggcaauuagccguauuaaguuauauaguagagauguguguuaggaacugagaaggcguguggaagaggaggagccgugggcgagggaagguuucagagagaaggguguaugcaugcugaaaacggagacacuucaacucuugucguaugagaucaccuuggauuuaaaggcggucgaacuuuugguuugcucuaugccuacuguaaugcugugcagaaacguguuuuccuauuuaaaacuggcuuaacuugacagcaacucuuucaugaauauaagggaagcaaaauagugugcugagcccaauaacuuggugagacuucaggaagugcuuaacuuuguuguagauugucuuggaggcuauagguacugguaacaaaaagaucgguguuauuggaaagaggauccaagaagggguugguguaaaucaguguuucuuaacuaaugugaugauuacgcuuugucuucagaugauuccuuguggugagagacuguacuguacuugcuagaauucuaucaauuccauagaugcuggucugugacaccccccaaccccccuccagugccacagucaaaaaugcccccacgugauguuagaaguucccugggggagguguuaaaccuccaaacccuagguuaaaccaauccccaaggaauaguguuagaauguucagaugucaauaaaugaaauacuauaucuauguaguuucaaaagcaucagaaacugaugucguagaggcugagaauucccgaggccaacuuaccaucagauucagugucuggugaaggcaugcuuucuggcuuguaaauggcaugcacuugcuguuuucuugggugguagaaaagcaagagagcccuuggagcacccguuauaagggacuaauaauguucuggaggguguagcuagucaccucgccaaaggccuuaucuucuaaaaccaccaguuuggacauuaggauuucaguauguaaaguggggauggggacccaaacauuuagaccuuagcagacagaugagacuggaggaggcggggaagugaagaguauguguuggggaagguauggggaggacuagcaguuguggauuggggcucuagacagcucuuggaagagauggaaagagcuaagagcccaaaggagugcaaacggaaauauuguucccugaugucuuagucgugguuucuauuccugcacaaacaucaugaccaagaaacaaguuggggagguuuauuuggcuuacacuuccauacugcuguucaucaccaaggaagucaggacuggaacucaagcaggucaggaagcaggagcugaugcagaggccauggagggauguuccuuacuggcuggcuuccccuggcuuucucacccugcucucuuauagaaccaagacuuccagcccagagauggucccacccacaagaggccuuucccccuugaucacuaauugagaaaaugccuuacuguuggaucccauggaggcauuuccucaacugaagcuccuuucuuugugauaacuccagcugugucaaguugacaaaaaacuagccaguacaccugaggaaggcauacagauugcaguaguggccuugagagcaggucccgugaagugggagaggugggagccuggcagacucccaggccaggacuggaggacaggacuuugaaacaaauggaggcacgccuaugggagaguuuugcugccaggaugaaggcagaagcaugggaagucauggaagaggaaggugggggagaugcuuuucuuuaagauuagagaaagauguccuugguuugcuauggagagugguguggugugggcgaggagaaagcugcugauugaggagagcaggagagcagggaggaauacagagagaaggaaaggagaucugauguggaauggagguggucucaguggacgugguuaguucauucaaccugaaaagaaaggagaacauaggaaccgaggcugcugggcggggagggaugcccuuccguggugguuuaugcuuccucagugaaauagcaaucaaggucuuuuuacuuuuuacuuuuuuuuuuuuuuccaaagacaggauuucucuguguaguccuggcuguccuggaacucacucuguagacuaggcuagccucgaacucagaaaucugccugccucugccucccgagugcugggauuaaaggcgugcgccaccacgccuggccucaaucaaggucuuuagcucuggucuuuagugcuaauggaugaggagaugucaggcgucuguaguaucagcugucacggaguauuucuauguuaggucuggagggugggucaugccuguagucucagcauuugaguggcaaguggguugccaugaguucgaggcuuguguggacuaccuagugagauccugucagaacagcaaagacagaaaaggguccauuaucugucagcaggaaguagcuccuggagaguuguaugcucuuucgaacuguuguugcuguguauuuuuauacgucuuuuccucucuuugagggcuaagugggacagcucaucugucccuucauuuuacaaguaaucucugcuguuucaauaauauauuugugcgucuggucccuaccaacugcugagcuccugggaaggagaggcugaguaugucuggugccuagaauacugccuggcauaugagaguuucucauugaauuagaauaaaccaaguagcauuugaaaacaaaagucuuggguuauuuaccaugaaagccacuaugcucagagaaauugccugguauuuaagaagauacuaaauguuuguuacccaagcuauuugagucagaaguuaaugauauuuugaauauugauguuaagcugaugaccucagagauaaaagaccuuagcccuuuccuauccuguauuuuuucaugagccuaagaauuuacuugguaagacauucaauaccuauuuguggaaaaaaaugaacaucucuaacugaaagcaauacuagagaaacagcgagcgguaggagcccaggugucaaauaaagcuaguguuaugggaggaggaagugcuggagauaccacaugacucccugcgcuugaaggaagaggaugagucggaugcagaccauggaccagaagcuggaccacaccaagcauauggcuccuuuuuuuuuccgaagagguucugaaggacuugccaaucagcuugugggucucaugagccuaggcucacgugauagcucucugauuucaaaagaccauucuccuuuauggggccacacagcuucaguagcagccugcuugacauuuuaaaaccacuucgaacuuugcacuuuucuaguugcuuucaauggcuugaauuucaggaauuuccuuacuuaaauaugucuagagaugcaagggguacaaaacuuaaagaguuguuguuuaaaaguguaaacaaaggaguguuuaacaugagaguaauaacuucagcuauaauauauaagccaccauaagaagagaggucuacauagaaauucugcuuuuacugaaccugggauaacuacagguauaaaucuauuagaacucaggaaggcuaucagaaacaguuuuuuuuucuuuuuuaagacuucaaaaugcacauauauacauacauauuuuuuuucauuuaagacuucaaaaugcauauauauacauacuucaaaaugcauguauauauaucuguauaacacuaaaagcuauaguuuuuuuuuuuaaucuuauuaaacuuuauuuuuuucuuuuucccccucuuuuucuauccucuauauguguuaagugucuaagaacuggguuuuggagaguugaagcaucagaaaaaaggguauucuuuuuaaaaaaugaauaugguuaccuucccuauguuacacugaggguguguuuuugauguccagaugauggcacagugcuuggguguccucuggguauugcaugcaggaacaguguagcacuggauauugaauauagucauuauugauugcuaugcucuuuuccuguacaguaauuauucugacugagaacucuuacuguuguguuugaaauuuuagguaacaauuucaagaugccaggacgguccaguacaaguucagguucuacccguuacauauccuucaguggcauagagucagcucucuccuccuuaaaaaacuuccaauccuguaucagcucuggaauggacacaguuucuaguguugccuuggaccuuguggagacucaaaguaagucauacuuacauuugugugugugugcggcuguccacucugagguaacagugugguugguugcauuacucugagggugcccuuugagcauucuugggauaagaguucaauuacacuggacacauuuucucaucuuauucuguaacaucucagagccaaguagcacaguaauccuccacucagaacugcccuagaaagcugugaacacagauauugugguuccuugcugcaaguaugcagucuaaagugugugauacgugugaaccggaaggucuguaagugugcugggacaacacucuuuuccauuagguuaacuauauguuguucgugcuagauuacucugcacguagacuugacagaugccagggauaccuaagcagggaaaaccucagccaaaagaaggauucagcuuuggugaauucucacuuuucaagcagaagauugagaacaagggucuuugcuuuuuuugaguuagagguauuauuacuuucugacauauucagagccagggaaguggcauaauaucccccuucccccuuuuaaaaaugguacuguuuuugaacaauuugugaugugcauuuuuuccuuuacuuauccugauugaguuuuaaggcucuaaaaacguaauguuuaugucaaguuggaagaauuucuguacuguuucuucccauaguucccugucuccagguuccuuuccuuuuaggauuucagcuacaguuucgagagcuguaugugcucuacugcccaaagcagcuuucugucuccccucugcagucuuuaaaaaaacaacaaaaagagugugugugugugugagagagagagagagagagagagugugugugugugagagaaagaaagaaagacagagacagagagaauauguguguauguuagagagagagugugugugagagagagagaaagagagagaauguguauauguguguguauguuagagagagagagagugugugugugugagaaagagagacagagaauguguguaugaguguguauguuagagagagugugugugagagagaauguguauguuagaguguguguauguacguaugugagaguguguguguguguguguguguguguguguguguguuugugugugugugagagugagcgauggacaugugugcacaugccuugcaguacuguguaguucagacaacacuucuguggagccagcucuuuccuuuccccuuuguguggauucuagggugucagacucaggucaucagaccugcaucguagucugaggcauguuguuggccccggcuucauccucaacucuaugaggcauguuucuaguagcuuuuuaaaaucauugucugucauuacugcccuuuuucucagugucauucuaguuaauuuccuuguggauacaauguugcuaguuuaaguuuuguugccuucugucauagucggcuuccuuuagcugucaacuugaaacaaacuuggugucaccuuggaagacauagccucaacuaaaguauuguccagaugagauuugccuguggccgugucugugaggcauuuucuuacuugcugauugaugcagaagggcccagcccauuguggguggugccaucucuaggcagguaggccugggcuguauuaacaaagugauggagcaugccaggaagcaguguucccugccugguuugugcuucaagcuucugcuuuggcuuccuugacagauggacuauaaucuguaaggugaaauaaccccuuuccuccugagguagcuuuggauugugauguuuaucacagcaacagaaaacaaagaaauaucuguuaaagagaguugaaguuuguuuugguggaaagccaaaaguuuauggaccaguauugauaaucuuuguuaaggguggacauaagguagcuauucuugguugucaacuugacuacaucuggaauuagcuaaaacugaaguggcuggggcuggagagauggcucagugguuaagagcaccgacugcucuuucagagguccugagcucaaaucccagcaaccacauggugacucacaaccaucaguaaugagaucugaugcccucuucuggugugucugaagacagcuacagcgugcuuacauaaaauaaauuaauuaauuaaaaaaaaacaacaacaaaacgaaguggcuggauacgcacaugugaggaauuuuuuucuuaagucauuucaagugggaagacccacuuuuauucuggaucuucugaggugggaagauccuccguuuaucugccggcagccuauaugaaggacauggaagaaggaagcuuauacucuuugccuguugccucucacuuccacuggcaaaucucuacccucccuggcuuuacagccuacuuugggguuccagaguauaguggagaucagcugagauaucuagccucgugaacuggcugauuuuuggaccuucuguugguagacagcuauuguuagacuaguggaccacagcuuauuucucuuucuauagagcuucacucuauaaauucuguuccucuacagaacugugacuaauacagugaacuuuaguaagguuaacaucauguaacaaaguaaggccacuggagccuugauugcuuugagaauucagcaucuuagcuugacucuggguggaugaaauucaagugucucccaguauucucuggacuuggguauuguuugcuucauaguuccucagugucuuaggauucaguaucggacucaagggaaucccugugcugauucauagcucacugccagcauucugucuugcaagcuccugccgcugcaagccuccugauucuucucauucuguuaggcugcuguguuccauguggacccuuccccucuagugcuugcaggaagggagggacugaaggacuagucuccagccagauguuuccuaucuguacuuauuaucauucuggucugguuauuguagcauagucugaaaguagucauagcauauauuuuuauccagcucuuguaauuauucuggagaagaugaccaucucaaucccaguuauucauucaugauuaagcagcagaagucaccuguuaucuucggucaccugugaccucuuaagugucuuaacccugccucgucugaugcagaaccugcucuuggugaugauggguauuuugcuuuuugcugaaaucauaauagaaccuuaagccaaaagagaagagcgagaauacaauccuggagaguaucugaucaaaaguuucuagauuuaagcuaaaaguuuaaauauaccgggcgugguggcacacaccuuuaaucccagcacucaggaggcagaggcagguggauuucugaguucaaggccagccuggucuacaaagugaguuucaggacagccagggcuauacagagaaacccugucucgaaaaacaaaaaccaaaaaaaaaaaaaaaaaaaaaaaaagcuuaacuauuuuggcuccauccauccaccuaugugguuuuuuuuaagacaugauuucucugcguagcccagguuguccuggacuuaguuuauagucaagcuggucuggaauuuacagagcuucuccugccccuguucccaagugcugggauugaagguguguacuaccacccagucagaauucuuuauuuuugccuuaagugagaaguauaguguugguauaaaaaugcaguuccugcgguuuucuuuuauuugagaaagaguuucauuguugccaagucugucuugaaacucccuauguggaggaggcuggccaugaaaucuucccuugucuuccuacuccuccuuccacaggauggcuuacaaguuugcaucaccauacccagcuacuucuuuaucauuugaaaagaaaugcuaacaacuuuuucaaaaaaagguucauaauguaauuugggguugguaaauuuuuaucugugacgggccagauugcaaauauuuucaaauauuucugagccaugaggucucauaaacucugguaagugugcuauuguaaagaccgcccuagacaaugcauaaaggugugguagacugagugagaguggccuucauaggcucauauguuugaauacuuggucucacuugguagaauuguuugggacgcuaagagguguggccuuguuggaggaagugugucugucacaggggaugggcuuugacguuucauaagacuugugcuuucuggguaugcuuuuuguuugugguucuaggugugcucucagcugcugcucuagcccccugccgccuuccuucugccaucauggacuguuauuccucuagaagaauacacccucaauacauuuuugccaacaaguugccuugguuuugguguuuugucacaauagaaaagaaacaaauauaaaugggaaugguguauucuaaaaaacuuuauuuauaaaaacaggaaguggaccaguuuggguuauagcuugccaacccuuccuuuagagccacaguuuaucaaauauucauuaaaauuuauuuuggggcuagagaaguggcuuaguguauaagaacauuuguucuuguacaggacgcagauuugauucucagcacccacgugcuaacucaaaagccaccagaacuccaguuccagaucugacccugucuucuaaccuucaugggcaccagccauacaucugguggacauacaugaauguagauaaaacguucaugcaugcaaauaaaucuauuuuuauuuggauuaauuuugcagcaaauacuuguuuucuuaauuaaaaaucaaacuuaagauaaauuuugacuaaguuguauggaaaagaaacacaugagcugaagagucucaguagaugcacaugcagagugaagaguagccuggaguaccaaauuugaaauguauauacggaagcacacuucauacguuaguuaauaccaagguaguugaugcacacuuacaaagaaacuauucugccucuaauucagugcugugauuuaaaaaggacacagaggauuauuaagugguucuucccuucacaggauucacagucucaauuggaaaacagacauggauuaaaauuccaaaagggauacagguaauuugcuaucacuagugagcucucaauaagggugcccauagauuauucaagauuggaauuuuuguuuaaaauaaucauuauuagcaacaaaagcugauagguguuguccuuucaauucagacucacauucucuauuuucaguagaugguuacgacucagugagccuaguuagccuauuauagcuauucuuugcaauuaaaggaaccguggaaacacagcuauauuagccuguagcacacccaaagcacauuccuauucagccagcaggguagagguguuucauacacacuuacuaccugauugcaaaguaugaaugaauauauauauauauuauuagucaagauauaguagauauaguaagcugugcuaguugaucacagacauucuuaagugaaagugacauuugcuauacugucaguucgugagggagaguggcacauugacuuucauauuagugaccuucggugccauugcugaguuuauucuaaggcauggccaguauuuuccuauaaggcuuuuguguaaucaagaauaauuuuguaugaauucuccacaugauuagaacacauguacacacauccuccaauuacuaugagcaugguuuugaucuguggaccugugguuucuaagccauagucugucagccucugccuucugaaacugaguuugaaugcuaaugagcaagaggcagauggcauucgaaaguguuuuuggacaaaaaaccucugggcaacuguuccccauaagaguugguuaggagagauuuuuuuuucaauuaacauuuuggcuuaauauaauuaaauauaaagcauauguugucuauuaaaauguuaccuaaaauucaaggaaauuuugguauauuuccaaauuguuaguguagcuuuccauuuucacaggcauuuuccagaauauagaauagccucaaaggaaaaucauagucuguuguauguuaagucaguuccucauggcccaaauuauauaaaaauagaauuacaagcccucucaaaauuuuuauagaaaaauguagguuuuaauuuaagauauuuuuuucucaguaccuuuuaaaaauuggcaaauaagaguacauauuuuugggguaucauaugguucacuacagaccuauacuguacaauauucaaaccguuuuaugcauaucuuagacauuaugaucguuacuuauaacuugucagguugauacaacaugauaucaucugauauuuauuggauuaugcauacuauauguauaaugaauacauauauauauccagucagacauuagaaaggauauuagaaaggauagaauuguguuaacuaugagaacaugggugggucuggaaugcauaguauuugaaugaaauaaccagguugauagauacuucgguugaguauuuguauuuguacguuuuaucuguuucccucggauucugaagcucugaggcagaaagaucauaguuacucggucagacaguaugguuuuugaucuguguccaaguauaguauuauuaaugguaguggccauaaccauaaagucaguaugcgauuuguuuuagacuuugaguaugcuggguaggguauguuuuuacuuggauucucacuugaucccaucagcagucucaugacauagaaauaaaguuaucauaacuuucugaaugagagaggucuggcuuaaaaaaguuaauuacuguuucuaaagccacagaauuagaaauuaauaugguucagauuuaagcauagaaaaaugaaccauuaugcuuugucauaaaugcuuugugguugcacauaccuuuaaucccaacacugaggaaauagacgggcaaauuucugugaauuugaggccagccuauucuauagagaguucuaggacaaccagggcuauauaguaggacccugucuaaaagaaaaaauaaaaauagaaaaaauaugauaaaaacacacuguaugaaauucuccuaggggugaaaaauguaaguccagguuggccuuccagucauuuugcuuaccccacaggcagaguugacccaugaauacucugcaccugagccuagaccuugaacacacaagaccucacacaguguauggaaugauugugucaguccuaagaggaaguuuacuauaaauuuuuuccuaguuaucuaacuccuucauuauauuuauaucuaugucaauggagcacaaaugccauuuucauguacuuuauuuaacacacacacacacacacacacacacacaaaaugagagaaugugagaaaauaagaaugagagcaagcagugggccauuuuguccuuuaggaguugccauaggcgcuuaaaaaauuggguguuauaauuugcauucugugugguacugcccucugcuggcuuuuaguugucauuuccaacaaagggagccaauaggaaaauacauuacauacaucuuaacauucuaaaauuucuccaagugcaacugccuaauauaagaacaaaauuauuucugaagugauuauaaaaguuaaaucaagauaaugacauggauaugcauggauagcuccuccacaauaaagacuaguaagucgcugcugccugggauguguguauacacacacacacacacacacacacacacacaccccuacgccuacacauacauucauaccuacgugcauguguccacauguuaaugaacuuugggguuuuggaaauuuggaaauugguacaggcaguguucaggcuucuuuuggcaaacaauuacuugaucuuuuguugcucugccuuuccuuguauucagagggucucaguucuguagcuggccuguguugucaugucccugaggguaggguucauguagaggcauguacuuccugcccagugccugguccuggacuuauauguuuuagguucucugugaaugcuuauugagugacucagucagucaagcauuuaaagcauuuggguguuggagucuaaaagcugugguuggagaagugacuuccccucuggauacaggcaaguauugcucuaacacgcuucugcccaggaagcugagagcuggcuguugagcagguauuagcacucuuggacauucuauagcaacuuuuuauccaaguucagcaaaaggccaaaaaagcuaguguuuaguguaguauuagaguugccuacuuccugugcugguggaauuucccuacauugugauauaugucuuagaaacgugugaggugugcauuuaacugugcuauuagcaucuuucuuaauccugcccugggauauaccuccugguguagccauuuucaaagcuucuguugggagagaagcaaaggagcuacauagauaaguuaggcccauucugccaggugagaagguucaggaagugaccaucgcugagugagagaaauagccuuauccuccaucugucaguagggaacugagucucacggaguugaaguaaguuaagccuaggaugcagaaagagaauuugaauuugaacccaauuaccugucucuagcucacacacaccucugaccccuuuuuaaccucguaguagcuguugguggacagcaguaacccucaacaacugugucagucagcuuugugucaccauuacagaacaucugagcuaauucaauuaaaacaacuuuuuauuguuuuggagguucccaucuaugaucucuagggaccugugguaagcagcacauuguggcaggagcucacagucccugccagcaaacaagaaaagaggaagaaagggucagcaucucaauucccauucaagaccauagcacuagcaaccgaagcacuucacagucuuucaaagguucuacagcuacccaugaugccuuccacgugcacccauuuaaaacacaacagcuuuugggagcauugauuauccaaacuggagcaacugcucuuagugauuugcccagcacagucugcugugcuuucuguaguucuuaaucaguuuauggaguuuguaguauuuuagguuaaaaaugagaaaaccuaagucaaaaugcuauuuuuuggaugggcauaauggcuaaugaacagcuaacguguuugagcuagcaaagauggcaaaggucccuacacuguccagcacagagccuugugagucuugugaggacaagaggcagugggggaagguguuagagauuguuaagagaagguuugaaaaggaaaagagaaaagcuguuggaaauaucaguguaggccguucuuaaaguguuggauuuaacuagcuguuuccugcgagucugggcauaugcauugauaggaaaaauagaggcaaaguaguaaagcaagucucugaugcucucguguauuugaggugugggcuauaagccacauggcucuucacaguuauuucucuccacagugaccuucuuguucuguaccaagugaauuaaaacagugggaacacugaaguacacugugggccuuguuuuacugaaccuugauguuuucuaaguugauauuuaaggaauugugaagauuuauguucugcccucauguaugccugcuugccagaagagggcaccagaucucaguauagaugguugcugggaauugaacucaggauucuuaaccuccgagccaucgcuccagcccuguuccuuguguuuuuagccacaguaaugggcuaccuauccuuucauacugauagcaguuaaugcuuugcuuuuguuccauguagcucuuuaauuuaaaugauuucuuuguagguauguugguuauuuuaaugguaggaaccccuuaaaauggacuuucuggggacaaagcccucuggugcucauuaaguaccuuaagaguuuggaaccacuauaaugcauaucaggugucgaacuauguaaauagggugguagauggccuggggagggggagagggcagcucuagcucucuugaaacucacucuguaacccaggcuggccucagagugagaacugccugcuucugccucggagucccaagcacugggguuaaaggugugcacuaccacacuggauuuguaaauggcuuuugagguuguuccuuaauaagauauguuuggaucuauaaugaaaaaugaguuacuguuuacaguuagaaaaugagcucauuuauuaaugaauaaaaaucauuuuagagacuuugcacuugaggaccagaagucucuaacuugagagugcaucagaacuaccgagaggccucaugaaaguagaugacugguauuuaccuccacaguuucaguaauucugaauagugccggaauuugcauuuccaagauucccaggugcugcuaauagucuagggacuacuacaguuugagaaaguuagaccagucagucugucccaugcuguaggagaccugccugccacuagauggcaucagagcacuuuuuagagcauagucauugaccuaagucuuaagucucuugaucagagugagugaguuaguuaguuaguuuguuuguuuguuuauuuauuuauuuauuuauuuauuuguuuauuuugguuucuccagacaggguuucucuguauagcccuggcuguccuggaacucacuuuguagaccaggcuggccucgaacucagaaauucaccugccucccgagugcugggauuaaaaggcaugcgccaccacgccuggcgauuuguuaacuuuuauaaucacuuuaaaauacauacauauucauaauuuuguccuuuuuucaguugaaacaauguagaagguuaaaagugugaaacacacugcccguuggcuuuuuuuuuuuuuuuaauggagauuuuauuucccuuauuugagaaucuuaaguguuggguacaucaaaaccaauuucugggaugagggaaaaaaaacagaacccacaauagaaaaaaaaguuauugucugggucacaacagaacccagagaauauauucuuauaauugaaaaauuauaggugcuucauaaauugaccuucugauacaaaaugaccuauugaauuugcaacuugguucuugguguggagguccacagacaacuaggcggucuucagaccuuagcuggaugccacgagcgguuauuuggcuuuccacucuuuuuuucuugucuaagaggcagcagcagcaacagugcuucuuuacaguguugaucgguucccuuuuaaagggcucucggaaaaguguuuuugacuguuuuuuugccucuccucuuucuuaccuuggagucucacuccauacauuccagcugugucaccaccuccagauguuuuacucacugaugaccuaagagcuagaugguucucuacauggugguucuggggagagguacuggcuugcucuguucugugugcuaagcucuccuguucacaguagcauguuuuauuuugaaauagcaaaacuuccugauuuuuuuuuuuuuuuuuugguuuuucgagacaggguuucucuauauagucuuggcuguccuggaacucauuuuguagaccaggcuggccucgaacucagaaauccgccugucucugccucccaagugcugggauuaaaggcuugcgccaccacgcccggcucugauuuuuuuuuuuuuuaaacagacuauguauaguaccuaaauacuguuuggauuuuucuagaccuuugacaaugcuuuugcuauugauucuuuuguuuucuucucagcuuuuuuuguuuuguuuuauuuuguuuuuguuuuuuuuucuugaccuuuggagcuggggcuucaguuagauuucagugaucaaacuucggauaaaaaggacuaaaacagauaaaaagaagaaaaaaaaaaagaaacaaacaaacaaguaggagucacucaguaaaaagccaggccagcaccaaaucaugucucuggccauuggcaagaacugaugcuggcuuaaugcuaugcagagaugacaacagaggcagaaguagaacugacaugaggagccuuuugugaagcacuguaguccucuuuuaaugacauaaaguuuuaaugucuuguggucagagggaaggagcuuuuaugaggacgacacguagcacagcugaaagcagcuugauucuucuagagaucauuacccacacuguucuuuccccguuacagacgaaguccuguauucaugcugugcguuucuguauaccauuacuuauguguacacgugcagccugauaaaacuacaguguuugccacauguguaauuuaaaauuuucuacugcccuucuuucauaaaauauggaggaaggagagauuuguaauguuuuauuuaaccuaguguaucugaaacuauuuuucgggaccagagagauggcuuuauggguaagaggauuggcugcuuuuccagaggaccuagguucaauuccuauaacccaggcuauaccacaccugcuucuacacuagacacuacucauguccauaguauauccguagacauaaugcagucaaaacaucuauacacacaaauauaauuuaaaaaguaaauaaagauaaaauauuuuuaugugucauaaauaugaaagcuccuaaggaguucuuuugacacagcgugggcacugaaaucagaauccuacaguacacuagacuccagacuagccacacugcuuaugcuuauuggucacauauaacacuuuaugagaugacaaaagacacauaaggguuauuucacuucucugugacagaguaagaaauaagagauggccaaaucagcuagaucugcagcucuuuagcaguucuggugagucuuccaaucaaaccgguggaagaaugagacacucaguuucuccugcacucuccucugcugaaacuguggcuaguauuuuaggguuuuccccaaauuguuuagccagcuuaaaauaaaaagugcauuguuucugaggauccuguuacauuugcuucuguauaaaauguuguguguucauuugaauccacaucuacaguucuucauauuuuguagcugaugugguaaaucaguuucauaugcuguugggcaagcuggaagguuaagccucuuaacuucggcagccagcauauucuaguugcuguaaacaauuaagccugucagcaguugaccuugggaaugcuaauuugcuugucccugggugccgccucaggcccuggcuuucucucugugggugggaguugugaaccugguuuggagaagaacuagaggcauuugaggccagcuccaaacagaugugcuucuugcuucacuuuugcaugugaccacaguugcaagaggcauauucuugcauguuuuuuuuaaggccuguggaaucagagagcaaaguugaaaggcagcuucuuuaccuuuggaucuguucuugcccuucaguagaguccucaucugucauggcgaagguugauuuaaaaccagcagucuuuuucauugggguucacugugcgucuuaaacuuacaagaagaguugaaagccaccuuuuaucacacacacacacacacacuccuugcuuugugauuuuuuacugacagggucuuaccauguaacccaggcucgccucaaaguuacuacccuccuaccucauccuccagaaggcugagauuacaggaauccauaagcacaccugguuucguauucauggcaguuauuuugugucuggucaagaauaaggcgaauaauugaggagaagggggugcuagcugggaaguuauacucacugagaaguucuucaugggcucucuguaagugugcauaccugagagaggaagguugagaguauuuauucaauucuaaauuaauuacugccauuguaaacuggugacggcagcagugaccacuuuaaccugaagaugaagauuucacuuuucuucuggacugcguguuagguuuuugggagugagaagagaaugguauucaagaaagagacguauugaguucaguugucuuuaggacaggguauuuauuaacagcacagccuguccuguggucccacccugaugccauagcuuuaguccugccagacaaaggaaggugccuauacuuaaagguuucagagagaugggggaaauccuauacuguguggaaggaggccucguuaauaugugacuugagcuagaugacucggaccacagucaggguguuuuagauugugacuagcauuggggaagaggcagauuuggcucugugugagggcuguguaagggcaacaacuuacagggcuggcucauuagcucuuagcuauagcaucugcaccuggagacucuggguucugauauagugcuuaggcaaaguacaacaugauacuguacaguacaguacaguacuguagaguaucauauaaaacuuauuuaaauuguuuauuugaacuuguuugguuuucauuauuagguaauuguuaauuuuuuaaaaaauugauugaucaccaauuacuucuuggcccaugcuuugaaaagguuaauuagcagcuacggcaaauaagaauaaaugcaaagauugggaaagcuacgugguaguaagcaagguauuucuaauuaguagauuauugguaugugugacagaaaaaagaaucagaccucuuccuuuacgacagaaccccggucuauaugucaggaugcacacaucucuuacaaaagauguauaggugaucuaugauuaacaauuauuuguaugcaugagugaguaugaacauggguaagugcaugugcaguguuccagaaagaacacuggccccucuggagcucugugaggugauugucagcuguguaaugugcgugcugggaaccaaacuuaggaccucugcaggagcagugugugcucuuacccacggagcaacccccucucuagacucuguauuuaugcaucucaguuaucaauagcuaucucaauagauuguccauguuugaucauuucuuuccccaugaccacagacagcacuuggcacuuccucuccaaauaggccguccaucugugcaaaacugcugaccagcgcuuacaggacuguggugucacuggcuacauccuuccauaugcacccuagucauagagaccuccucaaggggcccugugugugcucuguggacuuccuuuuccucucccugagguguccucucccuucugagugcuggugguaugccuguuggucacgcucggcugagguucagugccacaucuuucuucuuugcuuccucuguguaugcuguacacuuacucagccgagcagccgagcacuucuuuucuccgaguucuuuucucgugcccauucacagcacuagacagacagggaggcuugaaaaggccacuuaguuauguucaguuuugcauguuuuggcguuguguuccaaaguauauuuuguacuagacucagcugaggaguaccuguaaacaaccuacaaacagaugcugguuggucagcagugaacugggcuugguugauuccuguucuagaugaacauuuuucuguuauagucucuucucauaucuguaacagauuaaaauuuuguagacugaaaauauaaaauaguuuuggagagaauagcagaaauguuccuauggaccagcagaauggcuggaugcacuggccaugaagccggacaccugaguuuaucucuggaaaccccauuguggaaggagggaacugguuccaacaaguuguccucugacauccacaugugcaauccucccuccaccccccacaguuguuuuuacaaagaaaugauuuuuccauguucauauguaugauuuacuggucgguuaauuucuaguagaaauuauuuuuuacaaagagcauuauagcugcugccaugccauagauuacugacaaaucuuacuuuugaaguuaauuuagauucagguauauuuauacugaagcuuauguguguuaaugcuuuauuuugcaaaaaccugcuacaugucuguaguuucacucuuauuuguuuacucucuaucuggcaagggcuauucuaguaauauaaaguaauuccacugcuuuuagaccuuauuccagacuuauucucucuuaacaguuugaugaaaauaaccugacauugauggaagagauagcuaaagucagagggguaaaguggcuugccugaagccacagaguacguucauauuccauuagcuucuguugugcugaauugaauguauguauaacaaauucacacacauguauguguguauauaucagcuugcucuuuauuaauccuaauugccuuuguauaaacaguuaaguuaguaaauaauaaauuuauaaauaugguauguagauucuuuuuugaagaaauuuuaugggcagaguguuuguuuaaaauuuguuuuaauggaauuuuccauaagcuuaauugucuuaauuaggguuuuauugcugugaagagacaccggaccauggcaacucuuaugaaggaagacauuuaguugggacuggcuuccaguuuuagaagcuuaguccauuacugucauggcaggaaaaauggcagugugcagcggacauggugcuggagaaagaguugagaguucuacauccagauuugcaagcagcaggaaguguauugaucuauuagaccuagcuugagccucuaagaccucagccccacccccagcaacacaacuucuucaagaccacaccuacuucaaggccacaccuccuaauaaugccacucccuauaggccaugcauucaaacacaugcauguauggggccauucuuuauuauuauuuuuuuauuagauauuuucuuuauuuacauuucaaauguuauccccuuuccuaauuuccucuccaaaaauccccuuuccucuccccuguuccccugcuccccaacccacccacuccugcuuccuggcauaggcauuccccuauacuggggcauagaaccuucacaggaccaagggccucuucuuccauugaugaccgacuaggccauccucugcuacauaugcaguuagagccaugagucucucuguguguuuucuuugguuggugguuuagucccagggaguucugggguuacugguuaguucauauuguuguuccuccaagggggcugcaaaccccuacagcuccuuuaguacuuucucuagauccuucauuggggacccugugcuccaucuaauggauaacugugugcauccacuucuauauuagucaggcauggcagagucucucaggagacagcuauaucaggagacagcuucuugcuauuauaaauaaggcugcauugaacauaguggagcaugugucuuuauuacaaguuggggcaucuucuggguauauacccaggagugguaucucuggaucuucugguagaacuauguccaauuuucuaaggaaccaccaaacugauuuccagagugguuguaccagcuugcaaucccagcucgccagcaucugcugucaacugaguuuuugaucuuagccauucugacugguauaagguggaaucucaggguuguuuugauuugcauuucccugaugauuaaggauguugaacauuuuuuuaggugcuuccuagccauucaguauuccucaguugagaauucuuuguuuagcucuguaccccauuuuuaauaaggguuauuugguuuucuggaguccaacuucuuggguucuuuauauauauuggauauuagcccccuaugugaauuaggacugguaaagaucuuuucguauggggccauuccuacucaaaccaccauaucagucuauuuuuccuuuagucuuuccuccagccaucuaacaguccauuagccuuuucguuuuuguaauuuguccauuuuauuaucuacccauguaaaauguauaauguagugggguuuuuaaaauuauauucauggauacacauaaccguuaccacaaucauuucaaaaccacaaccccuggcaaggugugauauuauauacuuauaauuucauuacucaagagacugaggcaggaguauugugaguucaaggacagccugggcuguauagugaugagaggagaggagaccaacaagaaaggaagugaggaagggaaaagaaaggaagcagacccugcguccuuuagcauugcacgccagucucuccaggagccacugaucuacuauggcucuauagcuguggaguuaccuguuucagacauuucauauagaagugaauuuuauauaaaaugugguuuuuugugguuggaguguucuuguuuucaagcaagguucaucuguguuguuagauccaucagcauuuaaucaguuagcacuucauuuauuuuuauaguuuaauaauacuccauuauguaguauguagcuauaccacauuuuguagaucuaccaguugguggacccuggguuguuaauauuacuaaauuauucuuggaugcuugugcuuugaacgaggaaugcccucacuaggcucagguauuugcauuacuugguccccaguagguggugcuguuuggagagguuuaggaggugcagucuugcuggaggauggaugucucagggcuuccagauuuuauagccuaucccugcuuccaguuugcuuucucuacuucucucuugcaaugugagcucucaccuucuuggcaccaugcuugcagguggcucccugaugucaugccucccagccgagauggauucaaauccucugggaccagagcccagauaagcuuuuggucacauggugcuguguguagcacagcagcaaauguaacuauuaauugugcugcucagcauccauucucacguuaguaucucagcaugguuucaguuggcauuuauguaaugaugucauaugcuuuugggcucuuagagaaaucucuggagaagugccuauucauauccugugcacuuuuaaauccagugucuaaguucuuuauauauucuagagaaaagucugauauaagacaugaucugcugguauuuuuccuauugugugcugcauuuuacuuucuugauaguguucauugaaguaugcaagguugugaucuugcgggaguccagcuguguggauuugcuguuuucgugguaugccuuccccugauagagcuuagcaucaagcuugaagcaguccuauucaugugugcugaguaugaguuuugagcugggacucauuugaugacuaguucucuaaaggugcugugaugaaaaccuuuucccagcaaccauguggaacccuggaguuggugggaauuguagaugagagagccuucaggacaggcuucacaugggcuguugcagguuaaaggugaguagcuguuucauguacuagaaacagacuggaaaagauugaugaguauuuguccugauaugaaagcugacaaaccugccuguaagcuucauggcugcuugagagguaggaaaccccuaagucaaagacagcagcuuuuguuguuauaccucagauaguaugccuguucugguuuaccuuccugucuccaugccucaugguuucuggagcugauaugggagagcccaggaggguugaggucacaacuaaggaaccucaggcucagggguccaguuuuuggaaguagacgccaucuuagucuugugagaucuugcucuuacauaagcauccuuguaaagauggacugggacagaagggcacauggcaccuuugcucccaagauguucagaaugagugagaaaugacuugcucccuagaaccugacacauucagggagcugcaagugcuucagggugaagauuaacuucagcugaggccuuuccaggcuguugccaccaccaguggugaaagcuucagcacuuuucuuuggagaugaacuuuguccaagaugcaggagaggccaggugagaugaagagagggguccuccucuguccccagagggaacauaauccuuugguugucuggaugggguaauguugggcuuucagaacuacagaaucaugcacuggcugcccacuuuaguaucauugugacuuuaacuuucagguuauuuuccuuuauaaguagugaugauguaaaauagcagugaaugucuuguaggguccuuaaccauccacccauccacaucucccuaacaccugccguauuuggaguugcuguaaaguauuaaggaauguaucuaaaaugcucuuuacagagcugguacauaauauucauauuggucaguugcuuuguuuuugcuguaauuauuugagcauuugaaaagauggauccuguagagccuuagggucagaauugacuuuguacaaaaauacauccgugaauuaaaaugcaaauucucuauuagccuagaugauugcuucaucucuuagagcuugcuuuuuccugcaugugaagacuugaagugacugccuuuuugugguuauucuggguuugagacaguuauuuccuuuguuguuuaggguuuacuuugaacuauggucuugcuguguugcccagguuagccuccaaagcuacguaggcucaagugaucuucuuucucagcuaccuggcuggaguacagacacaugcuacucugcuguauuaagcuccucacuuuaaaggcggcccugggcagagacuggcuacauguguguguguuucauugguauucugcugaguacuuaguuuuaagucacugggugcucucuaaccagugucuuauuuacaugcaaacaaaauuacacuaaauaacagauuuuuuuuuugcagucucuuuugucccauuuugcagacuguucuuuuagaaaguauccuuuuuaaauuuuggaauaauaauagacuuacaaacacuuggaaugagaguucccaaaugucucuacccacugcccuuacuugcucagaccuuagugcauaguacauuuaucaaagcuacauaaaacauugguguguuauugcagacuaaacuucuguuuuaguaacauuuuuucaguggcccuuuuucuuuuuuuuauauuuauuuuauuuguaugaguacacugcagcugucuucagacacaccagaagagggcaucagauuccauuacagaugguugugagccaccaugugguugcuggaauuugaacucaggaccucuggaagagccguuggugcucuuaaccucugagccaucucuccagccccagugucccuuuucaauacauuguccaggaugcaguccuggcugccacauugcauuuagucacuucuugaguuguauaaccuuuuucuuuucccuuaaaaaaaaaaaguuugacuuugugugaaaugucccucaguuggaguuuaauguuuuucuuaugaguuaagggcaauuuuauguuuuuagaagaagaugacagaagccaaacuccuaaucacauuccgugagggacucagcaugcuacccuacaccacuuggcucuggcaguguuugcuaggugucuuuacuacauacaugaguaguguuuuuguuuaguuggaauucuuuaaauuguuuuuuucuaagaccuuggaacacacagcuuuaaacaagaugucuucaucaaauccuuccccucagagcucaggaaauccugccaaagaggagacugaaggagugggggagacaguacacaggauaccaggagaacaaggcccuuuaaaacaacugagcaaggcucauaggaacucugagagacugaagcagcagucacagcgccuacaugggucugcaccaaguucucugcguuauauauauaauagcuuucaguugagggcuuuuaugggaggccugaguguguaaaagaauaggccuucuugugccuucucuugaggcucuuuaauuuuuuuguuggcuugccuuauccgacaaguaaaucaaguugguguuuguuuuuucuuauuauauuuuauuuugcuauguuuuguuauccuuuagaagccuguucccccccuccagcacugccccccccucccgcacgccccccuccaccccccaguaagagacagaaaggaaguggaucuauauggggaaggagguggggaggaacugggaagaguagaggaaggggaaacaauguucagauuauguuguaugauacaaucuauguuuaauaaaaggggguguggguauugucuucuuuauacucugggcacauuaucaacgacaucuccaaagaguccuaguucuccuaauuggaaauugacauuuugaaaauaagaucugggcccuggguuugcuucuaccaaaacaucacuuuucagcaaaguugguaagugcaugcuaguaggcugacauccugucuucaucaaccugucauccugcagguagccaucuggaucugaccucuucaacuguaggauuguauggcuaaauucuaguauucucuggauagucucucauaucacucuccuaauaguaaaaaacauggcucccaccaucccccauccauuuauuuguuuagcuccacuauaauaaacuaaaucaguuuuagagucauuaacgucugugacagcaacuugaacuugcucacaggguuugcaugauucuuuuugcuuuuagucuuacagucucaaacaccauugucugugguuauguaggucaguucuuuuccuuucaggcgggcuugucauaugguuuuaugauuuuuguaucuuuguuuucuuucugguuuggcagugcuggugaucaaacccugggucucucccacauuaggcaaguacugagcuauccuuggccucagacauuuauaagaugauuuaaagcuuuugccauagucaagucucuccaaggagcuucucaguccugauuguugccauccuguuguucuucaugcuuuauaggcacugugauggcuagucuuagucgucaacuuaacuacauccggaauuaauuaaaacucagggccaggcacaccugugagggauauuuuuaagugacuagaagcucaaggacacaccaguggaucuugaagguugaaggacucaccuuuaaucgagaucuuuugagaggggaaaauauauuuuuaaucugagccacaccugcuggcagccuauauaaaggacacgcagaaggaaacuugcuuucugucugcuggcuuuugcccuuccuagcacauccacuccuucacuggcauuggagccugcuucuuugggauucccauguauacugaagaccagcugacauaucaauguuguggaccaaacaacugcuggguuuuuugacuuucuguuggggaaagcuauuuucaaacaauuuggaccauagccuguaaggcauuguaauaaaucacauacacacacucaacaccacacacacauacacacacacacacacacacacacacacacacacacucucauucacucuauaagaucuguuccucuauagaacucugacucaaaaauuaacugaaguucuucaugggugaaaucucucuguguuuggacagauuguagucucuuuuugauaguacauauacuaaaguccugcuguuuuccaguagcagggucauggguauaaagcugaggcuaggccugcuaaugaggcuauagucaccuucccaggucagcgaugagcauaaagaacuuucuguuuuuuagagaucaggguuagcccuuauguuagguaggaaccuuuagaaauggauggauaagaggugugcaggcuucuccaacacaagguaaaagagcuaugccauuguguugggaugugauucugacaaguggaauggcucuagugcugaaagcuagaauccagacauaagggcugcguaagauaaguauggugcuuggccaacauggccaacacuguggaaguuacagugaacucucaagugagaagaacaaagacuuagaggguuuuuuaaguuguucuucuucuuauuuauuuacauuccaaauguugccucccuuuuugguucccccccccccacgaguucuucacccuacccccuccucuuugcuucugagaggguauuccccuacccacccacccauucccaccucaacccacuagcauccccuuucccuagggcauuaaguuucuauaggauuaagugcauccuuucccacugaggccagacaagguacauauguacgaaggaccacgaacaagcccauguaugcucuaugguuggugacuuaguuucuuggagcucccaggggucuggguuaguugaccuuccuuugaggaaguuguucuuccuaugagguugcaauccccuucaguuccuucaguccuuccccuagcucuuccauaggaguccuugaccccagucuaaugauuggcuguaaguaucugcaucaaccucagucagcugccaguagaaccucucagaggacagccaugauagguuccugucugcaagcacaucuuggcaucagcaauaguguugguguuuggugccugcacaugggauggaucccaaguuagggcagucucuggaaggccuuucacucauucucugcuccauuuuugccccugcauuuccuuuagacagaaauaguucugggucaaaauuuuugaagauggguggguggccccaugccucaaauagggaccaugucugucuacuagagauggucucuuuagguuucaucuccccacuguugggcauuuuggcuaaggucauccccauuggguguugggagccucucacauuccugaugucugggacuucuuagggguuccccacacccuauacuguugcauauuucuauacauucuccuggcccucugggcuucucuccugucuccccccccccccacccccgaccuccauuccugauccugcuaccccuuuucccuccccuucuccucucccauccagaucccucccucccucugcuuuccaugauuauguuguuccccuuucuaagagggauugagggauccacacuugggccuuccuucuuguuaugguuccuauggucagugaguugugucauggguagucugaacuuuuuggcuaauauccacuuaucagugaguacauaccguguguguccuuuuaggucuggguuaucucacucaggaugauauuuucuaguucuauucauuugccugcaaaauuuaugauguccuuguuuuuaauagcugaguaauauuccguuauguaaaugaaccacauuuucgguauccauucuucgguugagggacaucuggguuguuuccagcuucucacuauuacaaaugaggcugcuaugaacauaguagagcaugugucccugugguaugguagggcaucuuuugggggauaugcccaggagugguauagcugggucuuaagguaaagcuauuuccaauuuucugaggaaauuccagauugauuuccagaguggcuguaccaguuugcaaucccaccagcaauggaggaguguuccucuuucuucauauccuugccaguauguguugucgcuugaguuuuugaucuuacccauucuguuugguguaagguagaaccucaagguuguuuugauuugcauuucccugaugacuaaggauguugaacauucuugaggggagagauucucuuugaaauugcuauagaacaaugccucugacuguggcuuuagcagcacuugggauauuuauuuuaaauagagcuccguaauguguuugaaacaagcauccuaaguaacucugacauuuaagaacccuauccccugacuuuggguauguaacuggccaaaaguaguuuacuaaauugaauugcagaucacuucugguaauagucugguuaaaagaucaauacuguccuuugguaauauuaguaagcuagcugaugcuugcuguuuagucuauucuggguucugugcuaaaugcuuuuuuccuuuuucauuuuaaagauuauuuauuuuauguauaugaguacacuguagcuguacagaugguugugagccuucaugugguuguugggaauugaguuuuuaggcccucugcucgcucuggugggcccugcucacucuggcucaaagauuuauuuauuauuaaaaguaguugucuucagacacaccagaagagggcaucagaucucauuaugagugguugugaagccaccaugugguugcugggauuugaacucaggacauucggaagagcagucagugcucuuaccugcugagccaucucaccaacccuuaaauuauaauucaauaauuuauaauugaauuauaauucacuuuuuuuuaaacuuauuuauuuuauguaugugaguacacugucacugucuucaggcacaccagaagagggcgucagauuccauuacagaugguugugagccaccaugugguugcugggaauugaacucuggaucuuuggaagaacagucaaugcucuuaaccagugagcuaucucucuaguucuaauuuuuaaaauuuaaaguauagauaaauacuuaaggaaaacaauuuuauaauagcucuucaauguagaagugcaacaguuauagaacaucagaguaggauugcagcuuuuucaguaccucagcuugaaauggacuuuuuaggccauuuauuucaauuccuucuuuuuuuuuuuuuuuuuuuugguuuuucgagacaggguuucucuguauagcuuggcuguccuggaacucacucuguagaccaggcugaucucgaacucagaaauccgccugccucugccucccgagugcugggauuaaagguguguaccaccacacccggcuucaauuccuucuuuuuaaaugaggggacugagccccagaaagagucaguguuuaacccacagucucagcgcacaucaccgacaggcccagauguccugauuuagccuccuguguuuccucauucucuuuguuuuuauacuaucuuuaugaaaagcuucagaaauuaacuagauuuuuuuaauguauccauuugugggaggcuaauuaaaagccucacagauguucacuggaaagugacaauuuguagcuaaaacuagaagcaaaucuagagacuuuagaagaaugcugggugcaguuucaaaaauagauaugagugaauggcuaggguauuuaggagcaaagcuuauuuuaaaacaaacacuuuuguagaaugcauuauuuauggguuuuuacacccaauuuuaguuuucuaguuuaauaaaggccuaaaauaauuuaggagcacaaaaauagagaagccgcugauugaguucuagguuuguugaaaacaaugguuuucuuuucuuuuuugucugagauucuauuaagaaaagaaucucagacaaaaggcagugugacuccaacucuaaaucccauauuagaacaauggcccucacaucuuccucugccuuaggacagacugccaauaggacuuguccauaucuguccucaacuguaccccaggcuugccgucagucucuggucuaggacugugauuguuguuucuaacaauuucauaggcagaaaucauagguaggagcuccugugcugcugguccucagagccacugaauuacagaagguggggcuggaaagcagccgugcaccagcgagcugacacgaggcucuuaacugcuggcuuuuguuuauauccuuauuucauuguuugcuuuuuuuuuggcgggagguagugaugauauuuguuuuauuaacaaaucauuauuuguuaauaauaaauauauugauaauauagauuuauacuuacuauauauuaauaauauaaauuauuauucauuaaaagagaauguuuccccauuuuacauaaaauugccaugaugagugucagccauauacacucuaauucuaccacagaguaggccaaggcuggaggauccugagagugaggacaguuuauuguacuuauuaagacuuucaaaauccaguagaaagcuugucagaaacauacugaggacacugagacaguguccucuaaagucugggagucauugugauaaggauaaauuauauuaaaugugcuuuuuuaauaggaucauugccuaggaguuagugauggcauuguggaagagaguagagcuguaauucuugcucccucugcaaagccggguccaagcagaccucagaggacuagccaccucaguggcuacugagcgguggcuugcucuucuguuuuugacauauuugucuaguuuuuaauaaaacuggagaucuuuucaugugcuucauugacauucaucucuggugguguugcuauuguguuuugucccuauuuguuauuggacugucuuuuuucuuuauugcacucuaaagauauuguauauucugaguauagauucuucaacagauauauaauuucuggagaagauucuuccagucuauauucucaacagguuauuuuaaagacaugcaauuuuauuuugaugacaugcaguuuaccaauuuguucucauaugaauggugaacauaucugaaucuaaagguuuuuccucuauguguuuuuucugaaaguuuuauguuuugcacuuuguguaaggugugcaucuguuucauuuuuccccuuucuguccucuguacuccucuuuucuucuuugcccuuugccccccuuucuccccacuccucuuucugcuucucuuuuccuuuuaguagcccaugguuccagcaccacuugcagaaguuucccucuggugacuuggcuuuguaccucuguuaggucaguugucuauguaugugugucucugcuucuggacucucuucuguuggugcuucugccaauacugauuauccugauaccguaccuccuuauuguagcuuuauauuauaccuccaucagguaguacuggagcugcaguggguccuuugcauacccugaggauuuuauaauccacacuuuauacaaaagucaguugagacuuugguugguuuccuauuccugcagccugaaagcuuccucaagagacuaaggucuacuggcguucaucaaaggcuucuagccacccucuucccuuucucuuugcacacgaucagugucuuaaacaccuucacaacuuuuuuuuguacuuuuuuuuuuuuuaauuuaguugcuucagaccagagaauaaccugcucacccauugguaaaaaguaagaguauuguagcagauuuuugauaaacaucaaagaaagagaauugauuaguuggaaaaaggauuagagagaaaagauauuggcaaaguagaucacgccggaagaauaacaguaacuggaaaaaacaaucaagacagaagcagcuucaguuagagaugggaguagcagccgcagugaucaagauuuaagucuugaaauugcucuucucucuuuuucuaccuucucuccuuucucccugccuuucuacaauaaaggucuaaaaccagagagagagagagagagagagagagagagagagagagagagagagagagagagagagagagagagaucguucuuguucuguuuggugcuguagcugggugcuugugugugggcugugauauacuacauucucucauuuuauaaauacugcucaguguuauaauugguaccuuggaggucagaaucacuugcuuaguaaauauuaauaauucuuuaguucuuauuuuagauuugauuauaauuguuuccccaaacuagacaccauaguaggugaucauauuauuauaggaauguguuucacuuaacagcaaauucccugacaaguuuuuaguagacuuaagugucuauauucauuauuucuuugauacaagguuuuuaaagaagggaagacaaacaguccuggauaacugauuuagggcugauuuauugcugauuugcggcuauuacauuggaaacaaauuauugugccuguaguagucccauggcccacauagagcaagaauauaaucacuguauauguuggcuugagguguaaaucauucaauguguagcgaguucagauuuauuguuaucuuugccuggugcuaaccuagacucuucugggaggguuccaauaaucagaguagcuaagcuguggagcagacuuucucaucacgccgagaaucagacagaguccuagugguugugucagugcucuugaggacauucugaaugggguaaaaauuugucaaugcucuuuguaagacgauacagcacugcccugcugaucgcucuucaggauacagcagaggcuaggcauggagucagugcuugguaauaaucacuguuggaugacugaguggaaacuucauuaccacugaacuugcuuagcucaauuacuaaacucguguuccugccuaaagcuauucuugcuuuucuguggaacuugguuuuguuugcuuuuauguugguacuguagaguagcuauccuggaguuaaaagaggcauguucucagucuccguguuccugcacgugaagacuaggccgcuaaagaacacugggauuucacugggagacauggaagucauuuuuccuaacacaucauacuuugaguccuuguuuccauucugucuuuuacuauuuugaugugucuguagucaucuuuagaagguggcaugaaauacacagaauagcucuauaagauuacagucaggaacccaauagcaguguugacucuaggcagagagcuuugagggcuguagacaccacaguaguguaucaucucaguuuucagccauaugcuuuauuaaucuuaaacauugcuuuuaaauauguggguaaaccacaugauucagcauuuacuagcuuaagugagauaaauuuauauugagaauauuagaaaguaugacuaauagagaaaaauagccuucaguuuucccaggucuuccguguuugagguaucggguuggaugauucaccaguauccucuuuaaguuucucaggaaccauuguaggcuuuuucagaagagauuccuuuucgucuuucuugccagaaauucaugcaggagcuuuaguguuggaccagaaucaaagccaaacccuguuccuuaaaccuccuuccugggucugcaagucucacaguauagauaaggcuaggcgcagacagaagcauuguuaguugggaagugcugcugugaauauugcuuccagccuugaacucacaauuuuuuuuuccagucuaguaggaagaaauugaugguugggauauggggaauguguuugagucaaaucaaagaccugacucucaaaacucgagggaaccaagagagucuaaggguguguuuuaagaugagaagagccuauggugcuuuaguaacuggcagcauucauuucugugauuuuugugacaccuuugccaugguaguuuauggagugccagcagaugucucacaaagguagcugucuguagagugaagggacgccaaguccgagggggagcacagugacuagucucuuuccccuguguccuuuccucuuacgggaaagcaaggcaacaaaagcccuuagaaaaggaacaacacacucauuacugcauggcuucuguaucaguguguuugucuaugucugugguaguucauacacugugcuuugugccuggugcugacuucaagucauaacucuacguuuauuaacuccaugaccugcccgaugauuucaccucuccgggaguuaauuuccuuaucuuuauuguaugcuuaauagugcccaaauuauguuggagcagagguaguguguucacagguccucguacuuaguacucauucaagguuguucauuuuuuccauccauggcuuucuuuguucaucaucaauguuuuccuuugacuaggacaacucugaaucagucaguuucaggggagcccugaaagcauuuguuuagccuccaccccaguguggugaacagccauggccuucugcuaagguucuuugccucgugugguagugguggcugcuguucuugcauuaaggcaucucccccgccugauguguaguaagugcucaguaaccauuggcagguaaaggaguuucugaacuuggaaaggggugucugcaacccuucucacugaggucugaauucuguggguucggcugguugcuuuguaaguuaauauauaccugaaacuuuuuaguucugagggcaagaugauuuuaggauuuggacuaguuauauuugcagaugaacuaucuacucuguaauggauuuaguuaaaaauauagcugguuagugcuuaugccaagccaggcucuucuuugagcacuguaccuacaugcuaacaacuuuaugaauuugguacuauucuuuaucuuuuucuuguuuuaaaagguuugcauuuuauuuuuauggguaugaguauuugccugcauaaaugaguguacacuacaugcauuccuggugcugauggaggccuacgaggguaucagaucuccuugaucaggcguuauaggcuuuccugaguugucauaugggugguaggaaucgaaccuugguccccugcaagaaucacaaguguucuuaaccacucagccaccucuccagccuucaguacuauucugauacccauuauagagguguggaaacagucuuuccaaagacuacacaguccacaagaaagaaaucaagcagacugccccuucaauuauguggugugcagcuucccacgucuggguuauuaugugaugggagggcuguggggaggcagauggcaggaagguggaaaguccuccaggauuucuccuggacuuugggaagaaaccagcugcugacugguuauaucauacaccugauacugcacacuuacuucuagugggaggcaguuauaacaugggcauucaguuuuaauuuuaccacacuaauaucuguguggaggaauaauuacaacuuugaaguucaguguagugagaaguaaccaaguuucuauuaaacauugcucaagcacugaguaagucauuaaauucaacuccugaugaguguagauugcuuaauaucugucugucaggagacacacagauagacagauagaugucacuagauguagguaauuggaucugaguuuacagagaauucagguuuugguuugauuuugacacagaaguugagaauauuguuuauacugucaucuguuuguauuucucaaaaaaaaagguaaaugucuuuuacagaaaauauggaagaaucaaguucucauauaaagagaucuggaaauaacuuauucccagucuuuagaaaauaaacuuuucuggcugugugugccauuuagucuaaggaauuuaaacuaaagucaggcaacccuugccaccauccuucuucuucgccaaaauggucuguguauuuaaugacauuucguguuuaucagauucuucuaagugugugagucauguugacucacagucagcaauccuuagcaacacuaaaugucugcuuugucuuagcuugguaagucacuaauaaaauacaugcugcugaauuuaaucaacuccauguaauugguuguuucuguucagacaugcuuguguguggcuuuguagaauagaaaaauuaaccugaucccacaguuuucuuguuguuuguuuagaacaaaacuuuagaaagcagcuugacccuggacaaagccgugcagcugauuagauaugcaggugggaagaauaaguaggugacauuugucuugagggugugucucucuagugugugugugcacacauguccuacuuguaaaaguaaagagauuuuauggguugauaagagcuggaauacuagguccucuucuggacaguagagagauguuagagaggggaccuuauaucugagaucauagggagcuuucaacaagggcaccucagaaauccaugugagguguagugaaguucaaggucuuuguaugugguuugcuuggagagacaaggagggcaaagccuacauuuugauguuuuagugaaggcugggcuaguaaaggccuagagacugugagugacuuucagcucuauuucccaacccccagagcuggaccucagggaaguuuauuccaugggcugcaggcacagcaccccugugguuagggaaggcccuguuuagaauaaguagguccagaaguguaccucuuacccccccucccucacugaccugguugccggucuggaauggcaguuggguugcucuguugaucaugaccagguggacaaggauaugccaugauaagaacugcuucccccaccugcuucugcuuuucaaccaguggcuuagaaaauacugaacaaacaggcaugagucaacccuggauaguacugcaucugaauggggaaaauaaauaucucaugcucccauacugcgcuacauaaagacagcauauugccaugcuugucaccuaguucuuagccacaaguuggaaguuauuccuccuuaagaguccauguccauaaaagcagcuuacuugccuccugcccuccuuucucagaccagucucuacuuuugccacgcucuucuacaccgggacaacuggcaucaguggcuaugguuucgccuucaacauucauauuuguucccgccucagcccauuaucuuccucucauuaaagccuauaaauuuuguuugaaguuggguuugauucuagcacuaagucacccauuucugcuuaauauaccuucaaugcucuuucagugcuucaaagcagggaauaguaagaguuauugcuguuggugcauuuuagcauugaguaacagaugacgugucuaaugaauagcguggcugcugagauugcauaauuauagguuugucugccuuuaggaaaaccauaagcaggccagcuucauccaguuagagacuucuccaauuauguaagcaugagaguauuucauucuaaaaugaagccuucuuccagugauucuguuauucuuugucuugggguggggguuguuuuguuuuauuuuguuuuuuugggaguuugccccugaguaggaaaaacaaaaacaaacagaaacuguccucaagggaugaguuguuuuguggcucuuucuggacuaagccacacuuaauaauguacaugaggucgugcaggcuacagugguucugcauaguguuagaaauaggucugauuggcauuguuggguagguuuguagaacagccuaaugcuggcaugcuuacagacagcuagaauuuuauagugcaaagcagggauuaucugugcccucuggacuugguuugcugggguggagguagggggacauauuucagcuaguuguacuaacuuuaacuucuuggaacaauuucuuaauuaaugugccaggugacagguuucccagaggccuugaguugcucccgugggucuucuccaugugugcauuggcuuggaaaucaauauucauuaaguucauguagauucauucaguuacugagagaaaggguuggaucuaauacauuuguaggaugacauauugaaggaauuucaauauucccacuucucucagaccuuguuuaccugggggagagcaauuagauauauguaauaaaaguuauuucugaucaugagugcugcuuagguuuuuuuguaggacucuuguuccccaccauuucucuauaguucucuuugugaccugacaggaaguuuguaguaguuucugucugugugcuugguugcuaguguuuagacucguguacccuugauuuuucagcaucuggacuuggcugauguucuccuagcauucagucggugacgugacuguugucauagcacuuuaaacuacaugugaggaugggaaaagaugcuuucucuguguuaaaacuuaguguaugucuaaccugggggaagcauuuauuuucuuacucauuucuucuauuugagaaauuuagacagagccuuucagaguagguccccuaagccuccaagucaaauucccaguagccuacuuagaaguauaguucuaagggucuaaacuggaagcucagcugacgcucacagauugccuuaaauccuugugaaggaguuggagucuugaucauaaucuguuuuguccaacagaguagcaucuuuguuuugccauuagaaagucagaguuuggaaguuucauucuucugcuugguaccauuguugcuuagaacacgguaguugagcuuucuucuguauauaaagcaguaaaaucuucccaucucugguuggucugugguaugagccuguaauaccagcuauguuggaagccaaggcaagaagagcccgaguucaagacccauuugaacuacauagugaauucaagaccagucagggaaauuuaagggggcuggggauguagcucagugauaaaauucuugccuaguauguguaaagcccuggauuuaaucccuaguauugaaaaaacaaaguaaccaaccaccggucucacuuagccagauauggugcuguaaguuguaccauaaauacaaucugcugugcauggugcuggugccuaaugaagcaugcacuaccguugcugcuguugguaucacggugcguguauguucuguuuccucauggccauuacuuccuguucuuugucaucuacaccaaccucucuaaugcugguccugaggggaggguuuuagcaucuuuaugugacucugccuccuacccuacccagcauugguagcucuuuuuuuuuuuuuuuuuuuucugaugaaaaaaaaaaaaacacagugaaaauagaguagacaaaugaguauauaccauaugcuuucuugauuuuaauucaccagaauaucauguaggacacucccagauuagaaaauaaugauccuaggaaacauuaauucugcaacucguuguuggcucucagagcacuaacacaccguucuuguccacgaagcagugagaaagacgggguaagaaaggcaugaguauuuauggugccaaaauacgaaaugaaggugcuaagauaaauuaagcaaaucguuucuucuagguugguauacuuuccgaacagaugggauuugagcucaguucuugaaggauguucagauuuagucugguaaaucguagagaggguuuugugaaacugugugugugugugugugugugugugugugugugugugugugugugucagaugccacggccuaggaaagccauuggaauuugucucauucucgaagaacagcggugaggaaagaagagcaggaugucacaugaaagaggcaaaugcccagaaauugcucucagacgccuggaaagcucugggaagggagggacagacaaauagacaaaguugauguugaagggcuuuugaagaaaaguacaguacuuuacaaguuagccuuuggaugauaguguuugaacuuuuuccagauguggcaucugaaguagaagacaauaauggugguuucuuuuucucuuucagcugaagugaguagugaguacaguauggacaaggccaugguugaguuugcuaaaauggaucgagaacuaagccauuauguuaaggcugugcagucuacaaucaaucauguaaguuuacuccacuucccuuccagugcgcucacagcucagucaucuagaaauggaagcacagucuaaauucuuuucuacccuuaaugucuccuuguccuuacugaagcagauguugaucagcacucucauggagcaaagaaucugagguauuuucccagcuaggcaccuaggcuaauuagcauaugaaaagacuuuuagauuggcuugcauuuuuaugugaagaguuuuaguuuaagcucccucaaaugaggagauuuucauuaaacuguuaagaguguguacaguguguuucuguugucauuugacuaagcagauaacucagaccagguuuacuuacucauucucuagcuuuaacuaauaugcaucucuugcaaaauuuuuagaaucagauaauuuggaagcauuuauaguaacuuuaaaaauaaaguuggcauuucaguuguuucagaaggcagacuuaccucuguugacuccagcugucacaggaacaacacauaaggcaguuaaggugggaaggcagcaacauccucuuuaguagugccauguugaguaagaagugagcaauaagauugcaguaaugguucugagaaacccuuugucucuggaaacucccugccgaagugacuuuggauaccuguggaacagggugccuugcacuucugguuucuuuauuuguuuuuuauucuuauggcugugggaaaauuccaaaaugccacuauucagaugaagauaaaauuuuauguugucuaauacuuaagccacuacuaugagcauuaaauauagauauuuuuccugcuuuucaaugccuagucuuuuguguaauguaacuguaauuaagaauaguuguuuauagcuaaauaauaaacucacucaaauuauaaaauuccagugguuuuuggcuauugugacuuaugguucuaguuuuuugaauaauuuuugaugugaaaauacaauuuggccgggagugguggcacacaccuuuguucucagcacuugggaggcagaagcaggcugauuucugaguuugaggccagcuuggucuacagagugaguuccaggaacagccagagauacacagagaaacccugucucgaaacaaaacaaaacaaaacaaaacaacaacaacaacaacaaaaaggaaaauacauuuugguggcaucaaauuugaaaauggguaauaaaguaguaggcccccaguugcccucacacuuuugaguuucuucugaucuuuggccaacacuuuacugcaugcagaguggauggauuuagagauucugaugcuuguuacaguguuccugggcuuucaugaaagagaaaacugucuuucucuuuugagguaccaaauuacacugugauugcaagugucacgcaagaccacaguagucacaaccuguaaaggcuuuugagacaugcagucgggaacucagagggcaggacugaaauuugaggggaaaguuuugacaugacuuucuggacuugaagauauggcauuacugcauuguugcuugugcugagguauaaagaaugaguagcaguuggggagggaccgaggcugccagcgcuguagaaauugcagcagucugggguuggaaauggcauaguucucccacuuccucagguaccauccuuggucacaaaaaguuacucuuggaaccuuauguucuugguuucaucauaaaggcauugaucugccaguuucaccacuguuaagugaaccagauuagauaaccuguaucaaaacaguugggcauccauagcucuugacggagcugucaaauacuguguuguugcaaacccagauuccuaaacagaacuuggaaagaugggacacacacuuucuagaacaccaguacguuguucuguuuacugcaguuugggauacuuuccaugaccuuggcuuacucuaaaauuuaugucaugcaggauuagcuuuaagcucauugagguaauauguaaaguguucaugaucuaaaauggaguuguaagucagguuggaugaugggaaacucuggguucugucauagacuucugaagacauaguacucucacuuaggagcuugugccaaaugcuaccaugaccuuucugauuaugaacuuuuauauaauaaggcacagauaguuuuuuuaaaaagauguuacuucagucauugaaguacuuaucauuugaacagacagcucucuuuucuacuccccucuuagaauuugaaguucauguuugggagguuuacucugcguuuagauaccuggauuaguuuaccaguaauuccuugggaagucccuuuaacaguucacagaagcucuuagauugccacccauugucuugugagaaguugguacuacugucucccauaggucugaaaguuuaauuaggagucaguauucauuaccuaacgggaaaaaggauccugguuuuagcaaguuugcuuguagguggaauauuaauauagugugugcuacaaaaugaccaauucccaaaacauuucugaagacuuucagaaugcgugaguuuaaugccugugagcuauuuggauggagacuuuucagucaugagagcacacguguuauaaaaguguuguggaaggaaugaggguacacugauaaugauaccugucaucaucacuguuuacugccuuugaaaaaccuguuuucaucuucuguggagagauuuaaauggcucugccugccguaccuucccuugcuuucugagaacuccauuagauggcuuucccuccacaugucuguugauuuuuuuuuuuuuuuuuaauguauaacauaccuaugugccaggccuuugucuuucuagggcauaaaaagucagugagcaagaccuacaugacuuuaccuaugauuucugaagucuagaacagaacaaagacauuuagugagcuguaguuguuauuuuauuacugucacugugggccauuuaaucacucuaagcauaguuuugguggcugguuagaagacuccuuccugaagagauauuacugauaagaguaaaaugagucuuuuuuuuuuaagauuuauuuauuauuauaucuaagaacacuguagcugucuucagacacucgagaagagagagucagaucucauuauggaugguugugagccaccaugugguugcugggauuugaacucaggaccuuugaaagagcaguuggugcucuuaaccacugagccaucucuccagcgcuaaaaugagucuuaauauggagaaugcaagguaguuuauuucuuuuuuuuuuuuuuuguuuuguuuuuguuuuuguuucgagacaggguuucucucuguagcccuggcuguccuggaacuuuguagaccagucuggccucgaacucagaaguccaccuguuucugccucccaagugcagggacuaaaggcaugcgccaccacugccuggcgauaguuuauuucuuaaugugacuuuugucagaaaugaaggcaccuuauuuaugauggucuuuaauuuucuuuuuaauuuaauugagacagucuaauguagaccaggacauuugaacuugcagugugugagauuacaaauguguacuacugugcccaguuuuaugggaugguggggauugaacccaggacuuuuucaugcaugcuagucaagcacucuaguaauugagcuacauucccagcccccauuucugauggucuguauuuauuuauuuaaccuaucauuauuuguuuuauuuccuccaugauuuuauucaauuuacaucaugaucacugcccccucucuuugguuucccccucacacagucccugccccuccccgugccccuauccucuucuaugagagggugaaggccccucuggguaaccccgcacccuggcauaucaagucucugcagggcuagguacaucuucucacacugaggccaggcaaggcagcccaguuaagggagcuuauuccacagacaggcaauagcuuuagggauagcucccucuccaguugcugggggauauacauaaaaacugagcugcacaucugcuacauauuuguggagggccagcccguguaugcuguuugguuggcucagucuuuaagagcccacaaagguccagguuuguugacugucugaguguuccuguggaauccuguccccuuugggacccccaauccuucccucaacucuucucuaagagucccuaagcucuguucaggguuuuacugugggucucugcaucuguuuuagccagaugcuuaguggagccucucaggacaguuaugcuaggcuucuguccgcaagcauaauagggucagggauuggugguugcccaugggaugggucucaaguuaggcugguuauugguuggucauucccucagucucuguucuaucacugucccugcauuucuuauagacaggcuaaaucuugaucaaaaguuuuguggguagguuggugucccuaucacuccacugggguucauuccuggcugcaggagguaaccccucagguuccguaucaccacugcugugagucuaagcuaaagccagccccauugauuccugggagucuccuucauccuaggucucuggguguucucaagaugcccuccgcucucuaccccugccagcuacaaauuuccauucacuuuccugacccuuucuccuggcucuccccacacuuguuccugacacacacaucccaacucuguuccccauguauuuuuuuuuaagauguauguuuuuguuuuguuuuacaagacagaguuuuucuuuguaguucuggcugucuuggaacucaacuuuguagacuaggcuggccuccaacucgcagagagccaccuguucuuccucuaacucuugaaugcugggauuaaaaguuuaugcuaccaccuccuggcuguuggguuuuuaaauuugugugugugugugucuuugaguuucuguguaccacaugcaugccggugcccauggaaucgaaagaggucaucagauccccugggagcagcauuugggagcuguucucugcaagagcauuaaguacucuuaaccuucacuaggcuuucucaucuuucccuuuugauggucauuaugucauaguuuagagucccuuaauuauuccaaauucuuaauaucagaaaagcagaggaaaggugccuacccucauagguaagaacccgaaguacagcgguggcauaacccucagagguuggucaaugauggguuacgccagccaugcccgcuacugugccuggugauguacaucacggcaauagcaauuuuuuuuccagagauuaacuuuauuuuuggauucugguauaaguuaagucuuuuuuuuuuuccauuuuuuauuagguauuuagcucauuuacauuuccaaugcuauaccaaaagucccccauacccacccacccccacuccccuacccacccacuuccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccaguuggggcaucuucuggguauaugcccaggagagguauugcuggauccuccaguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucuaccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuugccaaucuguugguggucuuuuugucuuauugacggugucuuuugccuugcagaaacuuuggaguuucauuaggucccauuugucaauucucgaucuuacaacacaagccauugcuguucuguucaggaauuuuuuccccugugcccauaucuucaaggcuuuuccccacuuucucuucuauaaguuucagugucucugguuuuaugugaaguuccuugauccacuuagauuugaccuuaguacaaggagagaggaauggguagauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuguuccauuggucuacuugucugucucuauaccaguaccaugcaguuuuuaucacaauugcucuguaguaaagcuuuaggucaggcauggugauuccaccagagguucuuuuauccuugagaagaguuuuuguuauccuagguuuuuuguuauuccagaugaauuugcaaauuucuccuucuaauucguuuaagaauugaguuggaauuuugauggggauugcauugaaucuguagauugcuuuuggcaagauagccaggcaauagcaauuuuaagggugguuucacuacucaccaucguauuuuucaaguagaugcuacuccuggaguuagacugauaaaaucaauccaguguucgucuucugugcuucucauuguguuuauuaguguuugcaucuacaccuauaaauuggccugugaccuuuagauuagugagaguagaccaguucaaaggaucccccagucuguccucaaguauguguucuuucaaagacacagcaaagaugucuugggcugcuaugccugggugaggucaaagggcaguuggagguuaguucucuccuucuaccaagugggucccagggauuagguucagguuaugaguugggcuuggcagugaguuaaccuuuacccgcacuaucuugauagcccuuacaaacuucugaaugaucacaguucuaauguucaaaaugaaucggaaccuuaaagcuaaaugacagaugauaacugguuuguauuugucccuuagauuaucagucaucagcgauaaaauauauuacuucauauagucauagagcuuuugaaagggaaaguuuuugaaaagaagcuuacgauucacuuggaccugcccuuucagagcaagcugcagcccuuaggagaggcauccaguuucgcuugugguguuugcugcacugugaagugcuugggaaauccagagccugcguauucucuucacuuuacacaaaucucuguuuuguccuacuuauaccuugcagguuaugcaaggcuuuaagcauguaagucggauugcagucacauagcugcuuuuguuugcaggcaguguuuaaagcauuuuuacugcaagccucaggggcuuuuuggcuccuuuugucuuucucgaagaucaagucuccuuaaccuauuaugcuuacuguguuuuuuauuugauaugcuaaccugaaaugcuaucucucauuuauaguuaauauguugagaguuagaugaguagaaauguacuucauauguaguguugaagaacagguaugauaaaaguacaagcugggucaaaguauacuuuaccucagucuugucauuaugcaaugaauuggccacuucugaugugucacuucccugugcccucucacccuucacccuucacccuucaucaacugguaagcccagggcauuuguuuguuuguuuuuaagauaauuaucuacuacuuuaacguguggccuuauagguaaucccccaccucuacagcuccccaccacccaccccagggacucacuauguagacuuacuguccuguccuggaaaucaccguguguaccagauggccuggaacucacagagauccaccugauucugucucucaagugcuagaauuaaaggcaucuaccaccaugcucagccccuguagguaaucuuaccacuuuaaugaaaccaaauuggaacagaguuguuuacuuagaaagcuaauaccuuauuucccagcaucuaaaggaaguucuaggccaggggaugcugggugugauuuucugcugaggggauguacaaauguaccucacuccucuagacauucugagccccucacuaaaggaaggggaaguaucuugggguuauaaaccuaaagcuaaaaauuccuaagccuagaagaaacuagacuggacuagcaagguaagaugaucgaagagagaagcagguaagaagcuauuggagccaaauggccaaguccugggaucccacccuuucuucuacuuccugugucccacauugaacuccccggaacgggaugcugccuccuaacaguucaguucagaagcuuugcaugaaucauaggguaugugauuuguuucuucucuaggaacauugcccugaaguagcaguuucaaggggaauaaaaagcaccgacuugaggauuuacucaucagcugcucggccuugggauauaucuauuucugugcuugcugguuccuauguugguccuuuagaacuuacucuguucaaguugcauuuguguuugggacuuuuugucuuauacuuggaguuaggccuguacauacaggucacuaauaagauguucuauagcaaagacuuuagauaaaucuuuacuuaucaagggaauaugcugcuagaggugaacauucuuacacugagauucauuucauaguuuacagaaacuccucuuaguguuuuguuagguauuaaguguugaauuuuaaucagaauuauaaaaugcuuaaugcucuaguaggccuugugcucuauugcgguauuuucaaaacuugcucuguaauacgaauuaauugggauguggauaaauauaaaaggagaauaggauuuugugguuaaguaagcuuggggaaugcuugaugaaagaauuucuuuaaauacuccaaagccuuuaaugugcuuuuaugcaaugugauucuccagaggaaaaggauauuuagaaauauccuaaacugagcuaacaagaaaacaguuuggggagggcugacaugccaagaauccacucugucaaauguuuguagucauagccucuucaucuuuuuaaaauaagauuuaaaauauauguaggaguguuuugccugauuuuacguguguauaucacauguguacagugcccauggaggccagaagagggcauuggauccucugaaguugaagucccagguaacacucacuaccaaguggguacugagaauuguacccagacucucuuaaggaauggggauagcauacaggcaagacauagcugcuagaguuuccugguaucaugguggauccaucaggauucgacacuggaagaaucagauuuaacagggcuuacaggauaagguuuugguuguugcgcccagagauuggguugccauuguuucugagcuaaguuugugugguguuuuucuucucgaugugauucaacuggguuccagagagaaagauaaggcagcaaagcguggguucaccugaugugcaccccaaaggcccuggggguuugugcauggggcugaugugguaacggcccaccagugggaaccuagcaagcuggguggagacauuguggaguucagagucaguucuccacaaaauaaaaacagguuggccauugccugccaguguauggcuggccaggccgccguggcagaggcacaaaagcaggaacaugccuguuccuuuuuuaauauuucccugcaacaggugguaagccaucuuuucgcucuuggcaguucccugauuuuacaaaggaaauuuguauugucuaggaaacugggaaguaagcagagcacaccagauucagggcaggaggugacccuuagugauuauuuugugaagugaagggaaagggccgggcuuugggggaaugguacauuauuccaccagggaggaaggaggagugaagaagcuuuuaagaacauucaggcaguguggcuaucagagccugcuggaaacaaccaaggccccccucagugauuuaugacggggaguguggaaagaaggggaaaugacagugaacaggaaaguggggaaguuacagaguaggccacagacggcuuuuacuaagagcgaaggguagacucuggaagguaaccucaaaggcccauggguuuggauccuugagccucccuggcagugcucuuuggggagauuguacaaguuaagaggugaggccugccuguugaggguagauugccgggagagguccagauguaaccagcagccucaugcuuccucugccauagcugggggucacucccacuuaccugccucaccuucccuaccuucauggacuguauccccugaauuaagggcaaaagacagcauuuccccuucacuucuuaucaagaauuuggucauuguaacaacaaugagucuaauauagggauuaucggauuggcaggcagggcaugggaaacagaccuuugaacaaccaggguuaccacacacuccaguuaagcacugggguacagguaugaugauugaaaaccuuagucuugguagcaauagguaaccucaccuauaacaacaugagcuacuuacauggcagaacugcucuuuaguauagcagucucuguugucuucaccuuggaugucgucugucagacauagccaaccuuguaacauuguggcaugauuuugucauuuauaaaguucacauuuaagaccucugugaucaaauuacagaaaaaaaaaauccacaucuaagaaccucuuguuuuaaguaaguuuacaaauuuauuuuagguuaaauucauagcuaucauggggugcauucagccuuuggacuacagacaagacacaccuggaccuacauguagcauggguaaccacuuacuuccagaaucaccuuuucucuauaauugacaagaacuaagguugagauucgggcuuucucuuaccaucuggcagugguggugaguggguaagagaaaggcaggcaagccgauugaccuggggaaugaguccccaaguguuuaauucacuguaagauagauacagacugaccugcggaguugaaaacaguucuuuauugaccucauaauuaaguuauucaguuagcgaucauaauguacuucaacuaguucagauacaaaaauccuauugauuugucccuagggcagcuacaaaauaauuuuaacagugauauaguuuugauacaaacauaucuaugaagucuggacaaaggacagacuuaguaaauucugcgguauacauuuagaucuugagccucaguuucuacuggguauggggauagcagugcaggucaucuaggaaggaugagaagugacauccugaaaacacuuaaacacucugucacugucaucagguuguacaggaacuuccucaaagaagagucaucaucuccauuggccagugucagacagcauucugaagggaauucuagcucacauguagacuggaaugggcagugggaaacuguuccaucaccuuucuauggaagggaugucuccagaaaucugaguggagagcuggcugggguagagcucagugcucuugucagcauugugacucggaaggauuggguaggaaccagggccugggccuagugcacaggccagggagcaguaugggaucuggccaguugaacugaaguugccuuauuuuuauccaucgaagccaggguaaacuaguguaugguaauggggguuguccuaagauaagcaccagauaauuauguaaacaugauuucuagucuaagaauaauguguaguauuugcuuagauauuuuacauaaguaccagaaaugaaacccuaaauauguuucucugcguauacagaauuauugaaucauucuauuuacugagcuauauguuacaucuuuaaaucuuauuuuguucauaaaacuccuuugaaaaacuguaucaauagccuuuuggcagugguauuguauuagccagaaaaauguguaggauuuauguacuuauuuauuauuuauaugaauacuuaguuauguauuauaugucaauugcauuucagauagaaucucugcaagcuauuuacaagcacgagaauaauagggagaguauggggaauuacauucccagcucuagugaguuacccugguacugcaaaacuuacuuugugaaguggguccagugcucagcaaacucacugcagguccagagagggcgucucucggguuugcccucagaacauugagcugcuggcaaaggugcuacuuuuucuuuuguuucaugaccagccugauaaauuaagcacuagauauuuuugaauuucauaucuuugugccacuuaucaauggcuuuaaaaauuauuucuuuacuccuuuguuuucaucuuaaaauaaucauuuaaugauauuuaacacgaaaaugcuuguuaggaaggccugauccuuguucuugucacuggaaacaguaaccggaaguaguugaaugugguugcacacacaaaugauucccagacaucuggacauacuugcuuuuuaccuuccucucagcuggugcauguacgaucucacauguucuugagccugccaucagucaacucaaccacuugugguccuuggaaugcugcugacacugagaagcaagcccugcugaccccgugucccgccccugguuacccuaagguugaauuuaguuagcccuugacaggaaacagaagccuaaaaugucccauaaaaucauaaaugggacuucagaauggacugaauccuaggugugcucaaagaauccccucuuacaaaaucagaaaugaaucugacaacuaaggcauaaguaaauuaugauuuuaaaaauaccaaaaacaucaucuguucauuucuuucuuggcagaaacucuugagguacuacuuggaacaccuauaaauaguguggcagcauauaagaugacaugaugaagucagaacauguuuauguauuauauuguguugucuuuaacagaagugacauuacucagugagaacaugagguuaaagugcuuuccuguccuuuguaccgagccauacacagugcuguucugguaguguuaacagauuucgguccuaaugaucaguguaaugugugaccuucagcaagucucuuagacuuuaugcucauuugcaaacucagcuucgcaauagcugcccuuaccuaucugauagugguaucuugauuuuuacaaugagauaaccugugaaaguccuuagaggugaaagcgugucugacuguucuggccagccccccuccauuuuccuuuaguucuguuuuuaagcacagagcaucaugcaugcuggcuaggcaagcuguagcaccaguccuuaacuuuuauuucuuccugaaagaauagcuaccaugugcuuuaaugagcguuguccucuaagccaccuaagccggaguaaauggcagcugcagaucacuuuccuguguuuguuuuccugccacacggcuuuagcugagaggaaggaauguguacgaacgacccacguuuacuuuuugccuucagugcugcugccuuuugguagagguuuauuucuguccaccagccuaccacgagaaguucuaggagaaucuccucuaacaguuaaaaagugucuacugcagaucagcuugcucggucacugguucucaggauugugaaacuuuugaagugaacaucuccgcgugacaaggagaaacagugguuaaguuaaaacaguuuacacucucugaucagaugguuuuaguggcuagcucauugugcaacaguaaagaauagaguuagugaaaauucauaaagccauauauaauuagucuaaaaauaaauugaauaaaccacagucagucacuuuucugccccuugcuuuuuuugcugacuaguugccaucugacugauaagggagauuagccugagaaauaaaaaucugccuuccuauccuagcccugccagacuguaacuuugggccagucucgcaacuuuugcacuuuggucuccucauuucuaacaugggacauuaguaguauuuguccuguauagcucagugagccauuguacauaaagcaacaaguauagacagagaucugcuugacacagucccagccccaugaagggugauuguguaccugcuagagacuaauggcccacccuaacucuguaugauguaacuguguauggaaauggcccggagcaggucugcugcuuccccagaggagauggaggaaguuucugagcucuaggaccugggaagagaaagcuauguccuacuguuuggguuuuuaaauggaagccuggaguacaauuucucacagaaauaaguucaauagcagaguuuccagaccagucucuuaaggaacauuuaagcauaaguaguuuguuucggucuacuuucuguuaagcauugaaagagcucauugguuguauagguaucaguuuguguagugguuuggaggacuuaggugagagauacagaagucauuucucuucggcuuuccaugcuugccuaccaugugcaaggcuugcuuaggccacauuuguaaauaccagcucacacuuuaguccucugcccugugaguaagagucugaaaccagcuuucuuuaccccgagcgagacacccuuuugagucuccaaccuucuuagugagccugggaaccuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagcacuauuggcucugcacuugugccauuagacacagugaacacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuugugccauuagacacagugagcacuauuggcucugcacuauuggcucugcaaaccaagccuccuggcugcucucaagggguagcacuaaagcugcccuuuuccuucugcagaccagcuaagccuuuuuuaugauguuucuguguucaagagagaugugguuuguuaaauucauauaggauguagcuaucagcuaaaauaaaauauuuuaucuuaguuauaaaguauauuuacaaucuugccuaaagcucucaaaaguaaagguugaagaaauucaaucuauacaaaaguggcccuccacacugauuugccaucuguacaagagggauugcagcaguguuaucuguuugaggaaaaaauauuguuauguaugugcaaccuuaaaauaaaacauuuauaauuaacucuuuuaaaaccacuuauauucuauuuugaaauagcagucuugugaauauaagggaacuuuagggauuuaaagucaagaaaaacugagaccgacuuucucuacucugugagaugcuucgugcuugaguuuacuaaaauauucgguccuuuucauaccaagcggagccuagccuggcugacguuccuccagugugugccucacaguaucugucggcuuuuguuaauggaggcugaguuugcuuuucccuuugguacuggggauuggccagggccucacgcaugcugagcaugcccucugucauggagcugucccccacuuccugagaaucauuuccucuuuguuaugucagccuggagccuugucccugauugcauagaggcaacagggacagagucuauucauggaagacaguggcaauguugucucucugugugugaggcugugugggacguguggagagugguugacugugggaagucuggaggacaagccuuacugcugcuucuccgcuaccugaucaugugacauucaauuagcaaucgauccguucucccaguuugcuucucucuguuugucaggaggauaauggcaccucauacggugguuucaagaauuaaaugagggucaugggcuguagagauagacacugggaagguagucauugucucuuucaauuucugaaccuaaggguuugugaagugaaauugaaagaaaaacgggcuggugagauggcucagaggcuaagagcacugaagguccugaguucaaaucccagcaaccacaugguggcucacaaccacccauaaugagaucugacgcccucuucuggugugucugaagucagcuacaguguacauauauauaguaauaaauaaaucuucaggccggagcgagcaggaacugaauuaguggaguugacuggagccaguggggcagcugacuggagcaaacagagguccuaaaaauucaauucccaacaaccacaugaaggcucacaacaaucuguacaguuauaguguacuuacauauauaaauuaaaaaaaauaacuggggaaaaaacagaaauaaaaagcuguuuugggaacuguuauaauaucagguggcucccccccacacacacacacugucuugaaccacuucuggaguaaaauaaucaggggcaaauagguuauagcuagaggacuuggagaaugaggaucaucaugacaaugggaaaguugcuggguaggucggucgcucaggugggccaugaacucguagugaucugucugcuucugccuccugagugcugagauguguauguguguguguguaugcgcacacacauaugugcaugagcacacaaauguguguaagaaccaccacaggucuggagaguuugggauuuagcaagguggucuuauagugcguuaggauauacaggcugagcacucuugucugaaacaccugggaggaauuauuucagacucgagaauguuuuagaguugaaguauuugcuuacauagugaggcauuucaggaauaggaccuaggucuggacaaauucauuuguuucauacagaccauauacaaaggcugaagauaucaugcauuauuuuaauaaaguuucuguugugccugcauugugacuuugaucuacuguauaaaguuggcugcggagucuccugccuuggcaucauguuguugcccagaagguuccgauuuggaagcauuuggaaacugaaucuccaggauagggauguucagccuguaacaggauagggcugcucagccuguaauggcguauuuuucugguuuuguagccucucuguagucucagcuuaucagcuaucaggugucuccuucagugguguuaucuaacuccuguaaguaaugauagacagagugcauuauucugaaagguauuccacaggucgcaaagcaccuaggcggagggcuuugcuuaguuaacuaaugcagguuuaauuuuccuguacacagcuguuacuguauccugacagggagacucaagcaaagggcaguagugggaagugguuuuaauggaagaaagcuguguucauuauguggccgcuuuaucagagugacuguccuggacugaguggagccuucggaggccgagcaacagccgagagcucuuggagcaccaguccugcauccccugcacuguugcaaugggaggcuugaaagccaaggagaggcccagccuuucauacuugcauugcucucacccugcacugagacacagccagacugaaaucagacuuaaccauuagaaauuguauauugcuguagaugauaguuuauagauucaaggagaaauguuaaauuaccugauagauaagcuuccuugguuuuuuaguuauucuagucuaaguagguucaccuuagaacaauaggaagaggcaaaacagcauuuccuugucuuuuaggucauaauagaaauaguucuucugguuaagaccucuugacuuguaaggcuguggcugagaucgaagggagacaaggaauauggucccauaaguacuccccagacugggcuuccugugcuaauacucagaaagaauaggcuuucuugcaguucagcaccaguccuuuccccuuccacguuucugcuuccccaguagacagagcacaaacgugugucccuaggccacgaccuccugcccuugugugcacagucauacauaguucaucccaugcccuggugcagacacugacaucucuuacuccaugccucuccguggauacacucugacaucuuuucccccgugccccauauucccuauguacacucagguaucuuucacacucugaccucucuaucccacaccucucaugcacacaaucucaucguuuauuuguuuaguuuuuuguuuguuuuugaguuagguuuuuuuuuuuuaguuuaguuuauuuguuuaguuuucauuuuguuuuugaguugggguuuucuuauguagcucagacugaccuggggcucacucuauagccuucugcuuuagugcaccgagugcugggauugcagguggguuccagacgaacaugagacuucuuucuccguguccucggugccuuauucgaagauuccaaugcaaggugguuccucaccaccacugcugaguuauggagacaaaagaagcuuaucuaaguauguguaaguuugaggucuuucauaguuagaacuuugaaugcucagaacauucaauuugaugcaguauagaugaagggaaggaagcauaagguucaugugugcugagaguauaauggaaaaagcuagggaguugugcuggcuaaucucacgucaacuggacacacacaccggaguaucugaaaggaggggaccucagaugagaaaaugccuccgagguagacuggcuguaaggcauuuucuuaaugaaugaucaauuggggagggcccggccuauuguagauggugcuauuccuagaauggugguccuggcuuuuauaagaaagcaggcugaguaauccagugaacagcacuguucuauggccucugcauuagcuuccagguuccugcccuguccugacuuccuuuaauaauaaauagcaauguggcaauguaagccaaauaaacccuucccuucacaacuuaguuuuuggucugguguaucguugcagcaauagaaacccugacuaugauagaguccaucuuaaaacaauaaugcucuaaaggaaauuaugcuaaagagauaggaaaagacuagauaugaaaagaguggaauaauuuuauuuccuuuucaggaauuauaccaguuauuuuucuccuuauuaugacuaugccucauaagaagcaacuuaagggaggaagggcucuuuuggcucaugguuuaauaagaagggauaugguuuaccauggcaaggaaggcauggcagcaaaaaugugaggcaggagccuggcacgugugucugcagucaggagacaaagagcagacaggaagcgaggccaggcuacuaauacuaaggccaaggccugcccucagugacccacuuccccaaggcucugucuccaaacagcuccacuaacuggggaccaaguauucacacagugugagccuaugggcgacauuucacauucacacugcaacagagacauagucuuuaaucuuauuugaggaaauauauguucuacaauagaaguggaagcauuggaggacuagcucauuuugguauccuugaggaacugagaacaaggaaggagaggagggacuuuagucuuugauagaaaugugugugcugagugacgccuagaaguaucugcugaaacuaagcuggaagucaguaugguuguucaaaggucuccuuagucauguaguuagaauauuucacuugauaagcaguaccuggcuuaucauuuuaaaagacuuagaagaauuuuugaaaucacugauugaugagucugacuugugugcagcauguuuugugugaauaacuuguggguuaaaagguaucucuuaaaauaccugcaucacaaauucaucacaaggaauuggaaaacagugguaacagcuuaaguucucuggguaaacgcugaguuaugcuugaguaagcccucuugauaggugcccgagaauuucugcaguuuaggcugcacuuacaggaugggaggaaggagaagaagagggaagguauugguccucugcucccagcugcuccuuccucuucaagguucccgccauaugugguggauguuugucucaguucuuuugagaugcucuaacagacucccaucaguauacucaugcacagcagacgugugcugcacagcuuuggaggcugggaaguuaagauuaggacagcagcaugucaguguccagugagaguccacuuuggucagucucuguucauaagguagaagggccaaucaggcuccuuaagagcucuggguuccuuuuuuaaggacauaaaucugagcaugugucaguguucugccguuaccacagcaccuucuagagguguaggguauaauaucagcacacaccugcaaaagucacaaacauccagaauuugacaacagcaauuccuugucauccugugauguccaccuuaguuauccuuguuaguugggcuuccuugucucauauaaauaaggguggugauacuaacauggcaguguuuugugguaccuucuauuucuaaguggccuuaugaauauaagcauauaacuuauaucauaaaaccucaccuuuagcauauaaccucaccucagaguucagcagacagaagagcaaacuuucugguacagaugagaagcccaagauugacaguuaccuugguuucccaggguaacacuccuagugauacaugcagagguuguagucucuuguccucuuaugugacaugucaguguugauugauguuacuucauuccauuccuuuaacuuucauaucauaagccugauuuuguuggcuagcuuuuggccacuccuucaaacccauuuuuuuuuuuuuuuuuguaaugugaauuggugugaauguguuagaucuccugaacuggaguuacagacaguugugagcugccaugugggugcugggagcugaacucagguccucuggaagguccgcuggaaggaagccaguguucuuaaccacugggccgugucuccagccccucaaacccacgucuggugcaucucuccagacccaucaguucuugguauucuuacuuagucucuuguauuucacacugugcacauuuccugaagauggugccuugcucauaacuaacauuuguaucuuuaugcugcugagucccccauccuuguuucgggaaauauuuaaaaagaacagcaaguuccugugguacgccuagcuacucucagccccuucagucuccucggccaguucuuaucuuguggagccucucugacucaaaguuccaaaaucucuccacccagcucgcuaaauuccuacuggcaaguugcuaccacgccagccccaugcuuuaaacaccccauggccuuuguggugcacaucaggaaaacccacgcuuugccgcaguaccucuugaacucagaugagccgucaugugaaggaaaacacaacacaaacuuguucagaaacaacgguaacucaaucucugggugcacaacgcacaacuagaauccuaaucuuguaagcuacauuuuaucuaaauccucugguggggaaucuugauggauuugcccuugaaauggggagacacuuguagcuacaucucaucugcacacuauccucaucuaaaagacccuuucuccuuccugcuuccucucguccccccuuuccaacccugaagucccuccuacucacccagugauuggcuccuuuauucauuaggggaugguuuacaagaacucaccugaguacacuccuuguccgaagccccucccaggagauggaauuagcagcaaaauaccaauagcacauccacaacacagccuaaccucuaguccagauuucuuguaugaaaacccaauacaugaagucacuaauacagaguuaacauuucuuuauuuuauggagcucuaggcuucuuauugucaacauucuagauuuuaaaauuccccuuguuuugggggagggaggggugaauagcuuuccguuaguaguaccuucuaaucaguagguauuucucauaucagaaaucuggcuuccucacuccuuuuagaucaucuuaucuuacuucccacccccuuaagcuauacacucaccuccaccccugcuuucacaguuucaagccccucccagcguaagcuuguuuucucuagcagcccaagagcucuuuggacauuugaaaauuugccuugccaacaauuuccugucuucccuuauuccuuauuuccuaggcuucaaauucaaacuccuuuguguggcuucuguugcuuaccuauguggucccaauuacugucccuuuaggccaguucugagauaaacucacuccacuugccccagcaagugcuuauuguaggguucuuucuucagcuuguucuguuuuggcagaccuaucugaggucaucugauuccucggaugaagggauuucccuguaugcuuuccuaacccucuuucauuauuuguagccaaagccuacugcuuucuucaaaacugccucuuagauguggauguguagcucuggucuuuucauuuccacaucauagggcauaugauuuuccagaacuaaauuuaaaugguuuccuuccagauuaucuacuucucagacucucacaucaauuuaaucaagcaaagcuccagaguuguccaguuucucagcccauaucuaaaccaucaacaaaguaauuuggucuuuucucagcgaauaaauaguucuuucuccuuucucaaaugcagaacugggaucugaccaccucucacuguccucagccuaaaccgugccuucaucaccuuaugcuuagacagcuguuacagccuacuaaguggccgccuucugcuagcuuucuuaaaaccauccuaaucaccagagugagaagcagaucuucucauuccucagcucccuaguaaaggcugaugcauuccaucaucugcugugccccacacucugaccuuguuuccugucugucucuauaacugcuaagacuccaggaucaccgcccuaauuucuuuagcucccuguagaacauuauuuuaaagccgucucugaccgcccaucacagaagaguuuacuguuccuaccuuauuugguggauuauuuuccauucaaccagaguauauacugcaccaggcuagggacuuggucucuccauugugucuucaucuuaccuugagcaguuguggccccuccuaggcucuugggacauaguugggaaaguccacuguagaaauuaaguuuuaaccuuagugauuuagcauaccuuccagaaugagggcccaacagcaacacugagcucuuuggguacuuguacuuagacuaccccuuagcuuugacuucuuguccuggacgagguguugguuuagugcuuacuuuuccuucuguuuguuugaaggaauuaagugggacagugacuaugaaguaccuucauaucucaguacaguacagauagaaaaaaaaaaggucuaaagcuaaaaccauguggcugaagaugcuaaguucugcuuguugugacuggaaaaugacucccucauucaaauauaucuucauccacuuucuacuuucagugauuuccuuuauugccuaagcuuggcuguccugaaacaugcucuguagaucaugcuggccuugaauuuagagaucccuaguucugggauuaaagguguguaccaccacaagugggccuaagcuuuucuuuaaaguuggagcuuagcugggugggauguugcccacucucauauuuuacuuaccaccauagcuuucuuuacuaguuuaucuccuugaacacagagcuuagcuccguuccauuccccggugcuccccuuccccucagcuguacaguuucuauuuuuuucuuguucaucuuguuccuuuucauuguagaucucuuuaagaacaaauacuaauaacuacaugacagagucaaugcuaggcuguuuugagauuuuuuucugucaaauuaauaaaucagaacucuuuaauuuagccucaggccgacuuuuuggacaaaggcagaaagcagcuacauucuucaccgaaguaucacaagaauagucuccaggcuacaugcuaauauuauucuccucugagaucucuugaaccagaccucacaguucaaaucacucucagcaccacugucuuccauguucuuacuaggauggcccauuaagcaccauuuaaagcauucaacuaauuuucuaauccaaaguaccaaagucuacauuucuccaaacaaaagcauggucaggccuaucauagcaauucuccagucccugguaccaacuucuuccuuaggguuuuauugcuguaaagagacaccauguccaugguaacucuuauaaaggcaaacauuuaauuggggcuggcuuacaguuucagaggcuuaguccauuaucauggcgggaaguguggcagcauccaggcggacauggugcuggagacguagcugagaguucuaaaccugggucugcauacagcaagaaaggugacauacuucuuccagcaacaccauaccuacucuaacaacuccuaauagugcuacuaccagcagaucugugggggauauuuuuuauucaaacgaccacaacuguuuuucuuucucaauaauugaagugucacaagcaagggccaggaugacaucuguauuuuugcuacaaagaauuuaugauguuuccaagugaaguaucacuaccaagauaagaaacuucugaaaccuaaguauguuuaggaauuccagacagaugaguucagcugcuuacucucuggacagauacaccuuucuuuaaggcuuacauuuguagaaacaguagcagcagcagcaaaauguauaaacuauuaggaaaaaagaguaagaaaguauaagagauuaguuaaacacacacacacacacacacacauacacacacacacacacacacacacacacacacacacgcggaaauaugaauagagcuggccuugaauuugucuagaaucccaguguuccagaugcugaggcaagacuagcacaaguuugagauuagccuauuaagaaaauaguacccccuccgcccccccccacacacacaccccucccuuccucccuuugcccuugauccugauccauuguuaguacuucgcucuacuguucauucuaugaucuuuuggcccuugccauuucucagcugaugaugaugcuuugucgccacacauacggcccuaagauccugguugcucugucuguauguaguggcuucugucauccauuagcuuuuaccacuacauauuacaaaacuaagagauccaccagaaucacaccuguccuuuuuuacucuacaguagcaauaauccugauuaccuuugacagucacaacucauugccucaaccauuuuuuuuccuucuuucugucugugccaugagggacucagaauuacuaggcuuuuacuugaacuuccaagucaguagagguauuguugaguccuuggacaaucauucuuugcuuggguucugggacuguccaaccaguagaaccagaguugcuauaaaauaugguagggugggggugugaacuggucuucaguuaugacagaggggaagaguugugaaacuaguucuuucccccucugccuguccacucuggcucuaggagaaacaagaucuguuacucucugguuuccaguaucaacagaauuccaccuuaccuaaucucaugaggugcuagaacugagucuaucagagaugacuuccgcugaugauccuugguuucuaacuaagaggacacaagucuuauuaguauuaacccacaucuuuguacuguuucacuguccuuaagugagauaucauggcaacugauaaggcaugguucauucagugggugagagaggcaugguggauggcaaagacaguuccaggucagagugucucuucauguaagaacucacauaugaccacaagugguuuggauauuugccuggagucuuuuaugcuuucacaguguuguuggugugaaagggagacuugaaugaguugguucuuucugucacugccacacuuugaccucgugcaagauauuuaacuacugugagcuaucuauuccucacaucugugaaauugagauaaaguugcuuuuuuaaacuuaaggcuuugggccacuuggaguuaaaagugcagauguucacuagcaauagcuacagcccucaucccacccuaccuuagggauggacuuuguuagcugagcacuuaaaaacguugucuaaaauggcacccucaauauuuacuucauuagaugcuccccuaacaucugagaagcuuucuucccagugcuuacuuagcacagugugccauaagcucuucugacuaguaaagaaugccuggcuccccagcuagacccacaccccgugagagcaguaggagcaguuacuuuguuaauccauaagucuuccaaugccuaggacagguucauguguaaaagauauucaguaaaucacuacauuacugaguggaugaauacauaaaccauauauguuucuuuaaauauugucaaaaaggauuucucuaaaacaaacaagcaaacaaauucugauaggugagauuagcauuuucauguguucucucuggaaaaugagaauccucaagccauauacugagugcaccaguguuccuguuguucccaguauuagaguggguauggugccaugagcagcguacucgggugauuuuucagcaucaugagugcuuacaugcacugagcagcagaugcuuaaaggugguaagcuaccuuacuuggcugccaucuuuggguguauccuaacaggacugaucauuaaaaccagaucaauagcauaccuacauauuuggccuuacucuuucucaauuuuuaucuaagcaccuugaaggaggaaagguguucaugucugauuggaacugcucaguggugguguuacaacaccuuggcaaacuguaaaguccacuuggugugucauagugaaccacaaggaaguacuuuuuucuccaggguuuaguuagaagucagacucuugcuaacuaaugaugcuugaaaacauaucaaacuauaaauaauuugguccgguagauuauacaacagaaguuggcaugagauaagggggacaaaaggucugugcuggccaucauuaaauauauauggauauuucuuaagcauggaagcaguauaggaaaauauaaauuauagcauaucuccauaugugcauguaacaaggguaucuacagugaaagcacagagauucucuauugaaacaccuuuuuuaaaaaaaagauuuauuuauuuauuauauauaaguacacuguagcugucuucagacaccccagaagaggguauuagaucucauuacagaugguuguaaaccaccaugugguugcugggauuugaacucaggaccuucggaagaacagucagugcucuuaaccacugagccaucuuuccagccccugaaacaccuuuuaauaaaauuuuuaccaaguccuuuugcuacaucuagguggaggcaguguuggcuuauauugguguaccuguguaugaugaguuuguuuggugguaugucauaaaugugggccaacauccauaaaugcuucagugcuucgcagaaugccuagcguucugucgggucucagugccuguuuguugaaggaguguucugaggacauuugaggcagucucuguagauuuuuaggauuagccaggucccauagcuuuuuuauugagcugaccacaaauuagaaauuagaauacugaaucuucuuacuaagcagaauaaaagcaaacuguuccgcuaauauaugcuaagugugcuuaacuuuuaaaggaagacuggaaagcauuggguguuuuuuauuuaccuaacuggucaucugaaagucaaucaauuuaucugagacucuggguucaguuacaagaaugacuaauuuuauacuagauucucacaugauucaagaagugugugaaugacucagaccauuaauaucuuucacuccugugaucuccccucccagugcgauguugccuguaaggcaguaaugauaauugcaggaggaggagaucuugacuuugcccaguggcaauaaaaugacacacuuuugaguaauuacauaugcauacaguauuuuacagaagaaaugagcuauauuaucaucucauaacuauauuaauauuguauuuguauguugugaaaguagugcgcaguuucaguagagguugaguuccaccuuuugcuucuacucguacccuccccuacucccuccccaaaaagcaaacaaacuggcuuuuguucaguggaaagacuugccagcagaauaaguaagugagcucauuguaugucccuugcugacagaggaaacacugcagucacaagcguccagguuugaguguuaguuaaaauguagcuaagugaccagagagauggcucagaagguaaagguacuugcuaccaagccugaugaccugaguucagucucccagacccucacaguggaagggagaaaacaauacccaaaguuguccuuuggccacuuuacauggucaguguagcauguacaugcccacaugcauacaaaucaauaauaaaauaaaaugcagcuaauuacucacaauugagguuugagccuaaacugagcagcucauugaagacuguuuggugauuuguguguuuucugcauuacugccucaucuuuuugaaaugaaucauugaauaaggucuggguauuuggcaugagcuucugugcuuugcgcuacucuugccagagucccagaugacucacacugagucggauaggcacuucucagucuguguuuagcucaaccucucugagacauuugacacaucuaaaacauuucuucccaaaauuuugggguacuugcuuuuguugccuuguuaacucuuauggguuuuuaacucuucuagcugccuguuaaauguaauauucuccaaaguucuauccuagucgucuuugugcuuccacuuauucagucuccuuggugaucucauucauuuccaugguuuccauuaaaaucuauucguggaggccuccaugugggugucuccagucuuaacaguguagaccugcgaauccagccuccuugcagauccgccucuauaaugauaaucacaauaauaaucaugacaacaauagcagcuucuuauuauagaacacugugucagguggcuaagggcuuuauugcuuuguuccauuuauuuugagcaacuaugaaaaauuaauacuguuauuuucuaccacuaugaguggaaauugguguuggauguauaaagugccuuuucuaagaucauagcagaguuuuauauuccaagaucaaauuuuuaaucuuaacaccuuagauuagccuguccagguggauucuauauugucuucuuguacacacauaccuucuauugcccucugcuguacaugaaaggacacuugagagcuggaaauggaauucgaugguccaucucuucccuagccugagacagauccuggguuuaucccaagcacuagacauucaaauucugcaggcacagaagcacuguguuuacuuauuguugcuugguuuuuuguuuuuguuuuuucagacaggaucuuagucaacauaccuuggcuuuaaacuguguggccaagggaugcccaugaacuccuugaucuuccugcuuucacuuucucauacugagauuucagggccaacaugagcaugcaaccaugcccaguuucaaaauucacacacacacacacacacacacacacacacacacacacacagggggggggugagggagggagguuaguuauuuuacaaagcagaaaauguuccuuguaaauugaauuucuaauuuaaaguccauagccugcauucuucugugcagcagccaucuagagcaaauagcagcucuuuuacaucaauuugcacugucuuggcuauucccuaagauucuguacggaucuuugcuaauccaguucugagcacuccaguaugugguaaagaccacuguucacagcugggcaguaguggcacaugccuuuaauccuagcacgcagaaggcaaaggugggcauaucugugaguucaaagccagccuaguuuacaaacaaguuccuguguucccagcucauaucuucaugauucuugauuuuuuuuucaagugcaauccauugcuugcucuugguauuuucauuuauguuucccuguugcuucuuucucuaucuucagacaugcuaaagcagcugugcucuuguugacagggaagaaauccaacuuuugaucauccaaaguuuaaacauaaguagaguuuuguuguuucaacaucacugaaguauauacuucuggccccuaauaaagaaaugacaaaaaucuaagcuuaccagagauugucugagaccauagccugaaguagaaccaggucuguuccaagguccaugccauguuaccuaucucacuugaagcugcugucauccucuguacaaaugacaugacugccucugcuucccaugacuugguuccugcugcuuggcuccuccuucccacuacagucucagaauucucuuaguucuggcuagccuggcaaaagaagaagggagggaaaggaccaggagcgaggaaugccacagaaggaaggaacaguuuuucucaagauaauacuuguuuuagcaaaagggaaacaaagcucaagguagaaaucauugaaggcaacacugagcgucccugccaggcgcuuacauaccacagagcagcuacugacugccuaaccugcuggccaagagccgucuuucaugcaagggucaucaugaugcuagcuagcucacaggugcucaaccagugccagggaagauggauuacaaaaaugccaaaugggagaugaguaaaggaaguuaucuuugccaagccagccauaacuacuaaucaagacgugcuugagauaaaggggaagaugucuggugcaggcauguaaccuaugcuacuugggaagcugaaguaagaagauuccagacuuaaggucugccugggcuucagagggaguucaaggccagccugggccauuuagugaggcccugcuuuauaauaaaaaggauaaagagggcuuaaaauguagcuuaguggugauauuggucuagcaugugugagacccugggugguuccccuaguacuccaagugaaaaaagaaaaaggaagcauaaauaggcucuacugccuuuuguuauauaucuuuguuguaauucauauauucauauauauaugaguacauauauauauaugaguauacauauaugugaguauauauacaugaauuauauauaauguuuuagaauggguggauggaaauagaugaaugaaaggaugaagauagacgauagagagagauggauggauggaugauaaugcaugugcuugugcuuugaauauuugacaaguuuaauaaauaccaauaaaaugaauauuaucaguuuugaaauuuugcuuagcccugaaaggguagaacaguuuauucuacaaaguauuuacuuguuuguuuguuuguuuguuuguuuguuuucuuucguucauucauucauucguuguuuuugaaucagucucccuuuagcccaagcuggccuucaacuuacuguguauccuaaaccuauccucaaacuugagguugucguccugccuuagucuuccaagugcugcgguuccacauggugccauugaguugaagaagcaggaaugagguuacuucugugcagugcuguggauuggaccuuguaccgucuaggcaaauaaaugcucuacuuaguucauagcuccagcccaagcuucagggauuuacaaaaguuccucuguaaagaaguuauuucuaccaccaacuauucaauuuugucugauuuuaaauuaaaguucaacuuuaacuugaauauuuaucauuagaggaacuuguugauaugccauguggagaauccauuugagaggcuggagacaugacuuagcaguuaagagugcuugcugccuuuucagaggaccugaguucaguuuccagcacccauaccuggcagcuuacaaccgcauguaguuccaccugcagcgggggauccaggacccucuucuggccucugaggguguuacucucauauguacaaacccacacucaaacacacauaaugacauuaaaaauacauaaauaaauagauaaguaaaauuuuuucaauauuaaacaagaauuauaaacaugauuuuauauccacaaaaaaugaauaaagagauaacuuaagcucacugccgugccaucauuaguagaccuuaguccaguaugacuaaugaccgaagaggagauuaauacauaggcacaucugcuggaaggaccaugaguuggugagggagaagacaacguuuacaucaagagaccguguagugacacagaaaaggggaagacuugugucaugagaaaggacuaccucguauaauaggagggcguuucauagcuccagagaagaugaccaaauacagugagaaguccacaucauggcguggaagaagauggacuaucagcccaguaaagaaaccaaugcuucugucucugugaucuuaaauuucuagacuucauaucuguaaaagugaauuccuguugcuuaaaccaccuaaaaagccuuguugcuucaucauaacaguuuugucaaauugacacauauguggugaccuauuuaauguaauaccucuuaucuaucuguuagguacuaguaauaguuagugauaagucagacauuguuuaaaaaguuucugucuuauucagagaaaaagacaauguugcaaauauguguagugacugucaacacaauggugagcaagcaggagaagcagggauguguuaaggaagcagcuagaaccuacgggugaagaauaggaaguaagaccuggagagguggcugcucuuccagaggacccgaguuugauucccagcacccauguuagaucucucacagcugucugugguucuagugcuggggcagguagggguuggagagacugucccacauuuguagccuccguggacaccuguacucauaugcacauacccacacagagacacauauuauaugcacauaauuuaaaaucauaaagauccaagaaaggcgauaagagugucacaaaacuggauaucaagaccuuuuucuaaaaucagauuauaugaacacuacugauaggccaauagccauaucucacuggugcuuaagauuuuccaggagaggcugggguauaacuagugguggaauauauguuuagcaugaaacagguccaacccccaugacuaaaaugaaaccagugcuaauggugguagccccagugcuguguacaagaccugcuaugucuaauuuuucacuuucccaucuguaauauguaagguuaugucaucucugguggguucugagaagaugaaauguuggcuauucacacuaacuuucccacuguuaagcccuuccucugcagcccucuaccaucaggcuccgccccugggcuacucugauggccaggccugaccucuccaggugugaguggccaggcucggccccuuaggagcuccacuggacaacuccucccagacuucccaaaugguuguaacagcuccuccucuccuggguaggagaauggccaggccccagccuacagaaaaaaaaagcaaacaaacaaacaaacaaaaagcuaccaaccccugagcuuacccuaagaucaaccacaaaauccuucuaaugcugggccacucuggaaagcucuacuacucccagcuuccaaagagaauacacacacacacacacucauucauucauucauucauuccugucaccugcuuggcuuucucugccauccuucuggguuuucccuucccaguaacagcuugcuucuuucugagguuuguugugugcaugacuuugugguaucgcuugacuccccacugcuaggguacuuucucauccaugcucuaacacuuaauugugaacaguuagcuuguucuggcagcagcuccauuaguuugucaucagagaguuugcagguuuacucuucacgagccaggcaguugcuuugccagcuguccucccugccuuuguccuacaauuauuccuagaagucugcguaauaaaggcuaaauugcuuauuguuuucuccucacuagaaaucuugcuguuuggauggaacuauuuggccuuaaaaagcuuuugcagucggaaauuggugaggaaugagugggagugcagguagugaaaauauuuaagacaucaaguaaaauuuauaauuacucagcuuugccuagccaauucuuggaagaguagacccaaccucagaggucuccaacugcccuauugaugggggggcaaacuguuuaaaccaaggugcugucagccauuccaucaaaacagaguggaaaccacaaaggcaugggcuacgcucaaaaaacaagugcauggaaggaagcgccagacuucuaauagagugcuguuguuagugcugcugcugcugcugcugcugcacguguguucuaaagcaccugagggucuagggaaguuaauuaagacagacucaagagcacgauagaugggaagagauguggaggggcaaacacagucgagugguaacugcagcagugaugacauacauaguguucacaauccaguaccuuuaauguuuccguguggcugaacuuuauaauacuuagggagaagaacauacauugaguguuuggccuugaacagaacaagcaggacacucaacuccuuguuagaccagggaacuguagaaagucaaaaccuuaguuucucuuguuaauguagggaucacugucacccacagaucaagggcugcaagaggaugcugaacugaagauggaauaaacacuauugcauguagagaugggcugagcagauccaggugaaagaagaggggugaaggccaggucugggccagucgccucuucugcaggguuuaacaaguucauggacuuagugacaggcuguguagagcaggaaggcagggugggcgagccugucacuuuuucugaguagucucgugagaggaucuguucucucucauacugucuuuugaauuaaaugagauuaagacaguuguauagcccuuguugauacucauuaucucuaacgaacaugaauuuauggucuuucuuagguaaaagaagaacguccagaaaaaguaccagauuuaaaauuacugguagagaagaaauuuuuggcuuuacaggauaagaacucugaugccgacuuuaaagagaaugaaaaguucgugcaguucaagcaacagcugagggagcugaagaagcaauguaagucagccgcuucgcucuggcuucuugagaugaggggccugaccugugagcaguguccgcuucucugcuugcuccauccucugccugaauggcuugucuuguugcaguuucguguuugucuaauacugauuccaauugccugucuauuucugaagccaacaguuuccacaaagugucucacugcuggggaggggacuugggaaaacaaaauaaaacuaaaaaccauuuuauuaagauaacaaugguaauucuuucaaaacguaaacugcugugccaagcucugaaguacauuuguucccauuugcugcuguggggcagcguuggugagguuuccucggggauuccucccaaaugcuuaaaagucccucugauacuguacccuggguacuauaaguuccaugugauuuuaaaauuggcuuaaaugcuuguuaacaguuaggguuuugacuugaaaaugagagugaggaaaauaauucauuuuacauacgcacaccccuaccuuacagaguguaccagaaauaauauaucuucuccacagugaggaaaauaauccacuguguacacacacagacacggacggacggacagacagacagauagacagacagacacacacacacacacacacacacacacacacacacacacacacacacacaguaccagaaguaguaaaccuucuccaugugguccucagagcaauguuagugaguuagaucuuuuuuuuucuugucuaggcagcuguuuaguuguauagggauuuguuuguuuguuuguuuuauuuguuuuaggauugagacacgauuguuccuuaaagaauugaagaggaaagugaaugacuuuuuucccuuucaaacguuagccuucuuucacacuuauguguacacugacagagcaggauguuaugugauguaaauucauuuugugucuuucuauguacuuaguguagagauucauguuuugaaguuggcuuucuuuugguuuuuuugguuuuguuuuuuuguggguuuuuuuuuuuuuuuuuuuuuuuuuuuagguuuuuugagacaggguuuucucuguguagcccuugcuguccuggaacucacugugcagacaaggcuggccucuaauccgccugccucugccucccaagugcugggaucaaaggcgugcgccaccaugcccggcugaaguuggccuucuuuuaaguaaaguauuucuuuaaauuggugcugagaucucaaaaaugacugaggaagcugcuucacuuuugucuauuuuacaaauaacuuaaguuucacaauuuagaauguuuugcaauccugaugagacuauugcuguucuguagaucuaaacaguaagcaguuucccucgauuugguucuugauugagcauugucacuaucacaaucuuucucaaauaauuuuaugcaguuccccaguagagcagaauccccagaagagagaaaguggggcuuucagguuuuaugucugccauagcagacauguuuguaacuuuagugcccuugaauucagucuuacacauuaugacagaccuaaugccucaccucuuauuuuaaagauauuuuauaauaaaaccgaggaauaaauauauaaaaaguauguuucuuccuccuuuguuacuuauucacaaaguuauuguuccauaaaagaaauuauagggaauuuuagaauaaauggucuuggggaaauuucuaaucagaagcauauaaugcaaccaaauuaauguuuaaauugugauuauuacuuuuuuaauauggggaaagagaaagagagaggagagagaagagagaugugcuuccccaaguccagccauauacaucauuuggauaguuaaaucuaaugacaaguaaauuuauauugaaaagaacacuuccuuauguaagaguuccccaugcguugcaacacugggaauaacagaaguuucccuuuaauuuccccugaaauguuauuuuaaaagguccugaucuuaaauagcagagcaaacaaaauaucaauacucuuuuaaagugcuauauaagauacuuuguggcgcuugcaaaauggaauuguuagcuuaguguuuugaguacugccaguuacuucuguagcaugucugauagguuuuguucuuuagauuucacucugcugugacgguccugauggaacaggcuugugcagugguuauguguccagauccaagguacacugugacuuauuaaaggggcuaauggauccauccgcuuugaaauauguucuggaguuaaggaguuguuguaauuuguaguaauaauauuugguuuuuuuuuuaauuuggaaaauauaagugagagggagacacauacacaaacacacacagacaaagucccucaucuguaguugccuguuuugaugaaguaaaagcuauagugagaacccugcaggcaugaugacauguaccuauaaucccagcacacaggagguagaggcaggaggaucgcugccccgugaggccagcuuggacuacauaguaaguuccaggcuauccagggcuauaugacaagacucugucuuaaagauaaaaaaugacugaaguauguauauaaaggguuguucuuuuauguaaacaaccauaauauuuucuccauauuccucaugugagcuacaguugcagggaauuuaaguuaucaaaucauaauucaguuaaagaaaugucagguaguucuugaaugggguaaggucaaggugggggugaaggugguugagucugguggacaguguucuccacugcacucacaguugacccugcuaagcagcugguucucaugccuugugauccugugucccuuuaacauacugaaaauagaccucucaggguucuaggucacauggugugugugccuuguaguauuuguccuauuagaaaccagaacugaggguuaaaauaauaauaaucuauuuuaaaaacuaugcccauuauguguuaaguauagauaacauuugacaugaaauauuacuguuccccaaacauaaggaaaauguacggagauuagguggcauuguuucuuauuuuugcaguucucaacuucuggcccaaaaaguagaugaguccuuucuugcuuuugcauugcucuauagcaaugccucguuuugguugaagggaagucucauaugcugguauaguagucacaauuucagaccaccagaaauccccauuuugaaaacacuagaucugggcugucuaugguacaaauucagcuuacagcuugggaauaguuuuuauaauauuagggggaggguucaaucauuggugggaucaaaacagggaaagauaacaugaaaaucugcuuuguaucuagguugguuagagcccagacgugcucacuaaguuaaguauggucuguggcagcuuucccagugucaaugcagaacccauguuacaucacaaaccacuggcccacagaacuuauaauauuuacuaucugcuucuuuacaggaaagguuacugauuccucaucuaaacuacauccacagauucuuggggguuuguuuguguguuugguugguagguuuuuuuuuuuuuaacuguagauuugcccauaaauaccaugcauuuaguuuauauauacucagaacacuuuuaaauagcuguucuauuucauuuauguaguugauacucuuaaaugaauacaaauaagaaacuuagcacuuggaaaaaacaaucuuauuauguuuauuguguauuauguaaugugaggagagugagagcauuuuaucuuuaucuagcuugcucauguguucugucaucaauagaggcucuguggaccagaguauucagaaacucccugagguggggucuaggcuuagcaggaaagaaggucuaaugugaaagagugggaaagaggaggcagugcaggugcuagcauuuaccaucgcuagacuagaaaccgacuggaugagcuaugcuuguuuaaggguagcauuucuccaaugguagcaugcuuuauuugcgucuaaucuguagucacaacaucagauucuuugaagacauuauuuuuaucccuuggacaccuacucauuguugugguaaaagcacccggcagaaacagccucagguaggaaagauuuauuagguucacaguuuccgagguuggaguucacacuggugcacauagaaaccaugccagcagcagccuauggagaagguguucacuuauugccugauagggaggugcauggcaggaaaggccgcagacaaaauacaccuccagaucugacccuggugaccuacuucuucaagcuagguccgaccuccugagguuucaagaaccucacaaaaaguugagauaaaaguguucaacacaugagccuuuggggaaauuucauaacuaauccauaaugcuuguauacuagagaaaauuauaucuaccccaguuuauuucuuagcauugcacccagauuaaaugagaugcuggauccuugcaaacucuccaacuuauuauugaaggagcccaguauagggcacagcagaaaguauccaaucuuaacagccagaacuaaagcuccaccccagcccugacacaguucuucuucuucuuuuuuuauuaauuuacuuuuuacacuccguauuccauucccugcccccucauccacccuccaacugcuccacaucccacaccuccucuccaccccccugucuccagaugugugcccccaccccccaccccaccugaccucuaaacucccuggagccuccagucucuugaggguuaggugcaucaccucugaaugaacacagacccggaaguccucuacuguauguguguugggggccucauaucagcugguguaugcugccuuguuggugguccaguguuugagaguucucggggguucagauuaauugagacugcugguccuccuacaggaucgcccuucuucucaucuucuuucagccuucccuaauucaacaacaagggucagcuguuucuguccauugguugggugcaaauaucugcaucugacucuuuucagcuguuuguugggucuuuggaggggagucaugauaggucccuuuuugugagcgguccauagccugaguaauagugucaggccuugggaccuucccuugagcuggaccccacuuugggccugucgcuggaccuucuuuuccucagacuccucuccauuauccugcaguucuuucagacaggaacaaauuaugggucagagaugugacuguguuauggcaaccccaucccucacuugaugcucugucuuccugcuggagguuggcucuauaaguucccucuccuuacagucggacauuuccucuaaggucccucccuuugauuccugagagucccucaccucccagguaugguggauucuggaggguccccacaaccuccuauuuccugagguugacuguuuccaugauuucugcugacccucaggacuucaguccuuuucccucacccaguaccagaucagguuccccuucccucaccccaccccaccgugccccagccacuuucccucccagguccuucccucucugcuugugguuggcuucuucucucuuccaagugggacugagguguccucacuugggcacuucagcuuguugaccuuuuugaguucuguggacuguaucuuggguauucuguaccuuuuuuugggggggggggggcuaacauccacuuauuagugaguauauaccaugcacaucuuuugggucugaguuacuucacucaggaagguauuuucuuuuuuguuuuguuuuguuuguuuuuucaagcaggauuucucuauguaguccuggauguccuggaacucacucuguagaccaggcuggccucaaacucagaaaucugccugccucugccuccuaagugcugggauuaaaggcguguaccaccacacuuggcaggaugauauuuucuaguuccauccauuugccugcaaaagucaggauguccucuuucuuaauagcugaguaguauucuauuguauaaaugaaccacauuuucuguauccauucuucugucguggaaccucuagguuguuuccagcuucuggcuaucacaaauaaggcugcuaugaacauaauggaacaggugccccuguggcguggugaggcaucuuuuggguauauucuccaagagugguauagcugggucuucagauaaaucuauuuccaauuuucugaggaaaaauuguuugauuuccagaguaguuguaccaguuugcaaucccaccagaaauggaggaguguuccucuuucuccacauccucuccaacauguguugucaccugagguuuugaucuuagccauugugauuaguguaagguggaaucucagagucguuuugauuugcauuucccugaucacuaaggacuuugaacauuucuuuaggugcuucucagccauuugagauuccucaguugagaauucucgguuuaguucuguaccccauuuuuugauuggguuguuugguuuguuuggugauuaauuuguugaguucuuuauaauuuggauauuagcccucuauuggaugugggguuaaugaaguuuuuuuuuuuuuuuucccaaucugucuucuugacucuguccuuugccauacugaagcuuucaaguuucaugagguuccauuuaucaauuauugauaguagggcaugagccauuggaguucuguuuagguaauuucccccugugccaaugaguucaaggcuuuuugccacuuucucuucuauuagauucaguguaucugguuuuauguugagguccuugauccacuuggauuugagcuuuguacaaggugacaaauauggucuauuuucauuccuacauacagacagccaguuagaccagcaccauuuauugaagaugcuuucuuuuuuccauuguauauuuuggugucuuugucaaagaucaagugacaaaguuugugugguaagugugugguuuuauuucugggucuucaauucuauuccauuaaucaaugugucugucucuguaccaauaccaugcagauuuuaucacuauugcucuaucguaaaguuugacgucagggauggugauucccccagcuguucuuuuauuguaagaauuguuuucgauauucuagguuuuuuugccuuuccagaugaauuugagaauugcuauuuucaugacuuugaagaauuguguugggauuuugauggggauugcauugaaucuauagauuaccuuugguaggauggccauuuuuacuaugcuaauucugccaauccaugagcaugggagaucucuccauuuucugagaucuucuucaaugucuuucuugagagacuugaaguuauuguuguacaggacuuuaacuuguuugguuaguuacccccaagauauuuuauauuauuuauggcuauugugaagggaguuuuucccuaauuucuuucucagccuguuuauccuuuguauaaaggaaggcuacugauuuauuugaguuaauuuuauauccagccacuuugcugaaguuguuuaucaucuggagaaguucucugguagaauuuuuggaguugcucauguauacuaucauaucaucugcaaauagugauaccuuuauuuguucuuuaccaauuuauccccuugaucgcuuuuuguugucuuauuguucuagcuaacacuuagaguacuauauugaauaaauauggggagagugggcauccuugucauguccccgauuucagugggauugcuucaaguaugucuccauuuaauuugauauugacuguugguuugcaguaaauugcuuuuauuauguuuagguauuggccuugaauuucugaucucuccaauacuuuuaacgugaagggguguuguauuuugucaaaugcuuuuucugcaucucgggaaaugaucaugagacuuuuucuuugaguuuguuuacauagugaauuacauuaauguauuuucauauauuaaaccaaccuugcaucccugggauaagccuacuugaugguggugaaugaugguuuuaauguguucuuggauucgguuugcaagaauuuuauugaguauuuuugcaucgauauucguaagcaagauuguucugaaguucucuuuuuuguugggucauugugugguuuagguaucagaguaauuguggcuucauagaacaaguuagguaguguuccuucuguucuauuuuauggaauuguuugaggaaaauuuguaucaggucuuccuugaaggucugguagaauucugcacuaaauccaucugacccugggcucuuuuugguuggaagguuuuuaaugauuucuucuauuuccuugugugagaugggccuguuuugauuuaacuuugguaugugguauuugucuagaaaaccauccauuucaucuagauuuuccaguuuuguugcauauagacuuuuauaguaggaucugaugguuuuuugaauuuccuccauuucuguugucaugucucccuuuucauuucugauuuuauuaauuuggauacugccucuuggcccuucaguuaguuuggcuaggaguuuaucuaucuuguuuaucuaucuucucucaaagaagcagcuuuugguuuugcugauucuuugccuuguuuucuuuguuucuguuugguugauuucugccccgaguuugacuauuuccugccuucuacuccucuugggugaguuugcuucuuuuuguucuagagcucuuaggugugcuguuaaguuguuaauguacgaucucuacaguuucuuuaccagggcacuaagugcuauaaccuuuccucuuagcacugcuuucauugugucccauaaguuugaguaugaugugucaacauuuuuguuaaauuccaggaagucuuuaauuucuuuaugucuuuccugaccaagaugucauugaguagagaacuguucaguuucaauguguaugugggcuuaucuguaguuuuugcuguuauugaagaccagccuuaggccuuggugaucugauagaaugcaugauauuauuucaaucuucuuguaucuguugaggguuguuuacauggucaguuuuggagaagguaccaugaggugcugagaagguguugucgucauagucgucgucgucgucuucuucuucuccuucucccucucccucuuccucuuccucuucaucuucuuucauuuuuuuagggugaaauguucuguagauaucuguuaaauccauuugauucauaaucucucuuaguuucacugugucucuguuuaguuuaugucucaaugaccuguccauugguggcugaaaucucccacuauuauugugugggguucaaugugaguuuugaguuuuaguaaagcuucuuuuaugaauuuggauacucuugcauuuggggcauauauguucagaauugaggcuuucucuugguggaauuuccccuugauaaacacgaaguauccuucaucauacuugauaauuuuugguugaaagucuauuuuauuggauauuagaauggcaacuccugcuuguuuuccuggaaccauuugcuuggaagaccuuuuuccauccuuuuacucagagauagugcuugucuauguuuuugagguguguuucuuguaugcagcaaaaugcuggaucuuguuugcauauccagucuguuagcuuaugucuuuuuauaggugaguugaguccauuaguauugagagauauuaaggagagacgacuguuguuuccugauauguuuguuuuuguagguggcuuuaugugcuuguggcucucugcuuuugacuuuguuguacaauacuuaauaucuuguccuuucuuugguacagguaucuuccuuguguuagaguuccaggauccucuguagggcuggguugguagauagauacuguuugaauuugguuuuguccuggaauauuuugguuuuuccaucuauguugauugagaguuuugcuggguguaguagccagauuaacuuuuauauggcuccuauuugauggccuauguguucugcacucaccuuugacuuuguguccucuuccuuuuacuaugacaaaagucaugaccaguuucuauauuauacccacuauaagaaguucuuagcacuuguagauuaauagaugccaacugccugugcaugagcacuauauacacauugcucuuuauuucuuaccucucuucaggaggauuggagagaggcgauacaaguugguugugacagugguaaaguuuaggugcaggaugacaccaaagccuguaaggauauuuuggcuaauggugauguuuguugcucuuguuuaucucuaauuauacugacccgugaaaguaucuguuuuccuuucucuuaacuucucccuuuuauuuccugagagauggacuauaaaacugucaaguaguaauucaugugggucaccagauuguggaucugaacugauauauucugaugacucugaggaauuugucuagcugaugggaaacuguuccuagcacugccauuuagaaagcagggaggcagagugcagcaaacauuguguauuucucuuuuuuccucacgcuucugaucuugacaguacauucgauacacaguaccuaggacuggcguuuccuuugugaauaguugcuguguuugggcagaggaaugggauacucauuccaucacaaguuuacagcaagcucugugaaauucauuucaagcauaacaaacaguaaccuggcuggugucucaucaucccgauguugacagcauccacauggggaaagaaaugaaaaacugcugcagguucuguuuuuagcagaccugacaccauauaaugagaaccacggaggugacacauuuacccaggaucccugucaggaggcaacagagcuggcagauacacucacaaggaggagagaaguuuuagaaggugagauggcuaugguuaaaguuaguaaaggaaggcuccauuguuaaggcacuagugagucagccgcaaguuagaacaacuaaacuguggguguuucucucguugacuuagaugagggugcuguuguuuauucuaggaggcagcuggaccuaggaagaccaaagccccaguguuccagagcugacagauguuauacugaagaaaauaauuauauugucaaauuguaauuccagaaauuaguagaaagauuuaagcuuuguaaucuguauguaauuaaaaugucaagcaaauuauuaagcauuucuaguaugucaggauuuuuuaaagacaugcauauauuuggguuucagaaagauuuuuaaauagaaccuggcagcuuaguguauggaauguuacuguguuugcauacagcaaauggauaggaacauucagguagucugugcauauucuaguagucaugcaggucagggcagaggguguggagacugcagcugagccaugugcuguacaaagcucuuaacggagugcacugcuagugacaacguuugaaaucaagucaacuggcauaauuuugcacauucagaacaacagugacuugcuacauuaauuucagcugaaggguuuagaagcuuuuauuugugugauacaauaaugaagacaugcuauugggaguaaaacagcucuguguccccucuggccacucagugucuauccucuguguccccucuggccacucagugucuauccuaucucuggaucucagcucugcacuucuugaagguuuuuuuuuucuuugaaaugauggagugugacaugcuugguugucaacacgcaaauuaccauuugacuauuuucuuagaaacucucuaucugagacucuucccuaggcagaugcucagaaaaagagaaacaaaauugacucagugauacccuuuauaauaucauuuauaauuaauauauaaauaauaauaugaaugacuaacaguaggcuagcuaaauaaaauauucugcacugauaauacagaauauucauguuuaaaaauaaccuuaagaauuaaaugcguaugguauuaacaguuuuuagaaguaggauacaaaguucaauauuagcuccaggccuguuaagucaugccaggaugccaggaugccagcacuugugagacggaggcaggaggauugccagguuugaaccagcuugagcuacauaaugaguuccaggguagcaugcauuauagugagagaccugucucaaaagaagggagggagagagggaggagggagggaagaagagaggaaauaaguuaguugaaaauguuuaccaugccggguagugguggcgcaugccuuuaaucccagcauuugggaggcgggcaaauuucugaguucgaggccagccuggucuacaaagugagauccaggacagccagggcuacacagagaaacccugucucaaaaaaagaaaagaaaagaaaagaaaagaaaagaaaagauaagaaaaggaaagaaaagaaaagaaaagaaaagaaaagaaaagaaaggaaaauguuuacuaugcuuacaugggaaacaggccuugucuuguuguacugucaccuuccuguaaugccagcucauggcuaaggccaguaaccaccagaagaguuggaaugaaaaacugaaaaucaagauugugucuaaccaaguaguaguuuguauuuuuuuuaauuaaaugguagaauuuuauucuuggaaaauauguguauaugauaauaacacuaauaagaaugauacuaacuagcccauagagauauagaaggauuaaacaagauacuguguaugaaagggcuucauaaacuguaacagacucccugaguauuaguuuucugguucauuuacuuugauuuuuauucauaucuaaaauguagaaggauaaacauuuuaagaaguuuuaucaguagcaagaauucuuaaguucaaagaaacaaauugagaacggguuagucauuuuccuacauugcggagagauuuuaaugaaggguaaaauguuguuagacuguaaaguaaugagaaaugcucuguaauuggcaggaugugaacaaaaaauguugauaaggggagagaucauauuuucaguuaauauugguguuggcugccuuuucuugauagggaaacagagacugggugcuuaacaguauuauuaaaugggcauggugaaccacagccauaaucccaccaaguggaaggugaggcaggaggaucacugugagcucaaggccagcuggaccauauaauguaguaaguuucaggucagccuaggcuacacaguaagauccugccuuguaagagaagagaacaaaagaaguaaucuuauucauauagugagccagccugugcucagcaugaaaacaauuauaaauaaauguagagcuguaucucuguugugugcucugugagucuucaguauauuggggauucucuggaagauacacauuagauuggacccgagaacguggacuuuacugucagagcuugauuauuaaugaacuucauuuuaaagaaaagauggcuuagaugcacacugugugugcaugugugugguuauguauucauguguguguguguguguguguguguguguguguguacauacauucucaucuuauaucaggcuuuggcuuuugggggugggguagggguuaggccaaggacccaguuuuugcuagacaaguguuauauacugagugaugucuccagcccacaucuguuaaucuccuuuccaggcuauaucuccucccacccccacccccagcgacccugcaucgugagaucuagaauagagaggggaaggaggcagaaaugucuuucuggaaaaguggcuuugcugaaaagcagcuuccauggccuccacagucggccuagcauaccaugugacacauauacccugaaugcuuccuccuuugggagaguuugguagcucacuuagguuuauaaaagauuaauuuagguucagaugagcccauauuucccuuaacucucacaccuuacaugcauggauuccuuguuguugguuuuuuugguuuuuuuuuuuuuuuuuuuuucagugaauaagcucucuguagcuuaggccagaaauagaaacaaggaaucuccuuugccugucagaggcaaaggagauuguucagauaaaauuuuggagucuuagaacaccacauguaaaaaucuguugaagaaaagcuagguagaguagcaugcucuuccaaucuuagcauucaggaaacuauagcaggagaaucaggacuuugaggcuagccucaacuacacaacaaguuugaggccagcccaagcuacaggauaauugaucucgaucaaaauaaaacaaaaacccagagaagagauuuaaaaucuaauggauuagagagaugaaaaaucuuuaauagagcucucuaaaaugaaauauuacuagauuguuuuaaguaaguaaaacagucaucuuuucagguucagauaaauucaucaaucuucucuucugugagaucucucuccgucuuuagcuagcagcucauauuugggugagcugucaggcaggugagaacagacuugucucccuugauacucuggaccccuagggauuggcagagaacuaggacccaguauuuauuugagggaagaagaccuggaggggauuaugugucuguaaguucaaggaugcucucccccacucccuuccauggagauguuuugacucauucuaguccugagcaugagaaguuaagacaaagcguuaugucccuuuuuaucaaggucaccuuggcagaucugagcagcagucaccuuuuaguacagugugggcugccaaauggcuggacaugccagacuuucugguacacuccucauccaauuugacuaagucccucuugguagaagguucuucauccuuuucuuagguaucacuaaacuuugauguaauuucaauuguauaaaauagaaaacuuauaacuuaagguucaagaacuuuuguuucuuccuucagcaucacccuugauugacaguguccacuguuucuguuguguuguggcauugaucucuccuccagaacaucaagcuggcuguggugguuccuacauuuuguagaauuacagccaagaaacuguaguagcuauucauuuauauuuuccuucuguuuuaaacacagugguuuuguuuuacauguacuugggggggggagaagagaagaagagaagaagaaaccccuccugcaaaagauagguaaaaggacuggaaagauggcuuaucaguuaagaguguuaguggacuugaguuuaguucccagcacccauguggagcagcucacaacugccuauaacuucagcucuguagaauuuaacacucucuucugaccuccacgggcauugauacacacacacacacacacacacacacacacacacacacacaccacaaaaaucaacaacuccaaaacccaaaaugucucuuuaaagagguuauaagccacuuaaagucuucaaucuaguuuuguuccuggaacguucucuuuccuguucauccuguuccuuuugcuacuaaccauauauacccucagcucagcuuacagucuuacagucugccaggaugacugaugguugcacaguauaccuggcauugcuugcauuggggauugguucuaacgcuuugucuuaauugggcucccagaaucacgcgggaauaugcaugcucagaugcuaaagaaagccugccucuaguugacuuugggaaguaaaguugccagcggccaguggcugggcaagaugaaaggggcgggacuuuuagauugcacacauaaggagagaaagaggagaagaggagaagcaccaugacucagagggagaagggucagacuuaagagcuacaggagagaagccauccagguggaaagggaauguggaugggggagggggcgggggaaggaggcuccccagaagguaaugggguagcagagaugauugagaguuuagaagguauuaagccaggaguacuggagggaaauguaugcuagccauggggaggauuagaaaugcccagccauugaccuagacaaggcauaucaaaauuaagccagcauauguguguccuucauucucaaauccagagggcucuggugggugguaggaggugugacccgccaggagcauaaagcaguuuaacaaauucacugcuacaugcuuguacucggggaacugccagaaauugaguaauggucuucugguugcucccaucaacccuccagaauaguaaaggcuaucuguccccuuucccauuuucuccucuagucuuucaucccagacacucauagucccuagaaaguucuccguucucuuucaacuccagacuugcucaucucagcaugguacauuccaucccucuuucuuucuuugcuuguaguaaauccacccuucugucuuuuaacagacaccacagacuuuagcgauguccuccuaauacagaugaaaucacaucuguaaagugagacuuuuaaagcagucuuacucugaagggcagucuaacaacacagauuagggaaaauguaagcuaggguuuuuuguuuuguuuuguuuguuuuguuuuuguuuuuuuguaagcuagguuuuuggaaagaaaaggaaugauaguuaaacuuuauggaagcuuugaaugugcuaauugcuuuguuuuagacuguguugaauggaacucaauauuaaaauauccaacuuacaauauuugaaugaacagaauucugcccucuaccuaucucagcaagcuauucuccauccuuugcauuuaguuaccguagaucccaguagauacaggaacugaaauauaccauuuucuucucuugcuugacucauuuuacauaaauagcaaauuccccaugaccuagucugguaaaauagaaaaugcauuauuauauuuugaguacaagcuuuaaaaguagugaggguauucuuuggccacuggccugguuauaacauagucugggaacuggauauaccauaucgggaauaugauaugggaacuggauauaccauaucgggaagaggagagaggaccaggaacagaggguugagaggugaauuuucaagucacugaucucaaaaucaucccauaguuaauaaaagacacuagcugcaucugaagcuuaaacuuaacauaauccagugauaauuuaagagaguuguauucagcuauuauagauucaaaaguguaucaauacuauauuuucugauaaauaauacuuugggggugaaaugcuaaugugauaauuccagaucaaauacccuauauucugauacuccucuauaguguucaauaggaaaauucaagaacaaucagagcuuggaaaaaauuauucacuuacaaaauguuuuauuaugucaugauaauauuuaaauuaguauacagcccuuggguguaugugcgaacauguguguguguguguguguguguguguguguguacauguguacauaacguacaccuggugaucauuaaccuaugaacagaaauagaagaaaaggcacgaggagcaaguaaucuauuaaauaaaauucugaguauaugagagaagggguuacaaguguacaucgagcugauugaugucacuauugccuuaaguaagccaauuuaaucaaauaauggagagaguucauuuuucaugagcugugucuugugguugaacuugaacuugaaaaaggugacacuguuguggcauauaggauagacuggaauggaaagaguucuugcuuacagaagcccgcuggaguguuggugagguucugagcuacuggagacuaccuggggaagagagaauaauacaagaagugucaugcagaugggauacugccugaauauaaucuuggaccuccaaaaauaaggacuuagagguggcucucagaccacagcuuagccauuugggaaaauaucauuacaaauugcaugggagaauuuggaagaaggaaagggaagauuaaaugauguaauuauaauucccaaaaauauuucuuaaaagaauauacccuaaaugaaaauguaaaaugauaaacuuagagaagaaaaccuugugaguagcaggauggcuguugguagugacacaggccuggaaucccagcaguugggaugcagugggcagaaagagcucaaguucgcggcuggcuuugguggcauaacaaauuggaggucuuuagucucccacagcagcucauguuuauuaguucauuuuaaaaauacuguaauacuuguuuuuaacugcuaagacagcaugcucgaguguuuguucuucauccucuccuggcuaucuuaccccugaagagcaggggggucuuuaaaggacucuucaaacucaucugcuuagucugggacguggaucuucauaaagguaucccagcaaacuugaaccgagagcaugacucaaguagaauuuggcuucuguugcuucuccuuuacagcauuuguuagcucuuuucgaguaucucucucauaccugagcucaaaccagguauuuaguaaaauaaaaagaaguguaagcauauuccuuauuugcaagagauuuuuauccuuucaagauaugccuuaauagaugauagggcauauugaauaugcuauagcccuuuaaacagaauaacgaagauacuuaaugaacacaaauaauaaagucugggaaagaaaugagaguguaguguugcugagauagaaccggaggagacaaaugcuagugugcuagcacaugugucucauguaaucaccaccugagaaaggagccaucuuugaaacgagugauggcuucauagacagaaugagguuugaguaagacuuagaagaacuuugaauaagaagagagguaagaauccugcucaauuuagaauggagucauguuuucucaagaagguaauuauuuaauuacagauagucuucaguggcaccuauuaaagagcccgagauaauacagcugcaacaagccugcagccacacagugcuaggagcacucuuagcaaguuguuccuuccauggagcccacacuucauucucucuccucugaugugugugugugucugugugugugugugucugugugugugugugucugugugugugucugugugugugucugugugugugugugucuguguguguguguguguguguguguguguguguguguguguguguuacagaugaagggcccaucucagugucagugaguagcacucaccuagguuuuguuuggggaaaaucagaaacagguguuucccuucugacauggaaacccccauugaguaacggcagguggcacuuuugacaaguauauccagaucuagguaacgccuaagcuggugggaagaauuggggaauuuccuuuucugaauuugaaagauaagucugcucuauaaacuuucuuuccuaacugguucuuacugaguacauuaaacuuuuuggagaugacuccauaaagauacaucuucuuuaaugcaguuugcauaguacauaguaaggugcuuagccauacagcaaaggccaaugugcuaaaaacaacuauaaagucaguaauaaaauauaagauccuaauuuuaugccuauaaguucaagggagccuuuaugauuaagauagcuuuuaaaauacuguuaugaauaaaugucauuuuucucacucuuacuucugaaguggugcuacuuagcuaauacugucuagccuccauguuaccaugugaggaauuuccacacaauauuuuuuugcuugauuuuaagacaauaucuuacuguguagccagucuagcuuugaacuugcaacucuccugccucagccuccugaugggaucguggguaugcacuaucacacguagcuauccuuuugguuuugacauguacaucuuuguaaaccgcucugauucagcuuugugguauuuguucaccuccagcauauuucugcugucuccgucaccuccaucaaugacacuggcauccccucucauuccucaguucuaguuccuaguauuucucaccguugacauauacuucuaucccaauuuguggugugaagggagaggcauuauaucuaucauucauccuguagucucccucagauacuuacccauugacuguucuauagauagucuuggauugauuauccaaagauuuuuuuuuuuuuacuaguuccugccuuuguugcuagauuguaauuaacccuaucaccauaccacauaaacacacuucucagccucuuugguauguacuuuuuuacaugcuaaccaaagauaguuaaggguauugguuagauguucugacauguuuccuaguggugcguaguagaagugucuggauccacccugcagagcuggcugagguagguacagguaggaagagccuugcauaugccuuuacuucacacaguagaccugcuucgaagaaagaucauucuccauuccagucacaaaucguaggacccaugugucaucauaucuaaugauccagaaauuacacucacagugaaugauaauuggucagagcuuaaguucccauuuaagaauggggaaagggaguuuagcuguuugucuuugaaaaaguauaauaugaaaaauaaaucuugaacauuuauacccuuuuuccucccuaaauuauuauucucuaccuugugcuuucccuuugagggcaccaaaagcagaaggagucaugccacugaagaagacauccucuugaucuauccccaucccuuaguaccaucagacccucaugugguauauaaccauucucagggucgcuucacugcccguaccuugcugugccuaagcuuuucuuuggguguuuuaguaaauaccaguuggggugaugccacucaaauguauuguuuuaauagaagagcucacacaaggcccucagucuucuuccaucuccagacugcaguauacaugugacauggagccugaaugcuuuauguuugacuuacacagugauaggguugauuguuucugaauacauacagauaagugccaccucuccauuagauuccacuugaaacauuuucuuuuguaucaauuucuuuuugucuuucccuguagacauccauguuuaccauucuuuaugucuagacuacucugaaugucagcuuaaagcagaaaauucgaagguagaauaaagagcugcuuugagaacuuuacaaagaagcaguuuacauugaacaaaaauauuauuuguagaauaaggaaaugucuagaauauuauaauuuugagccaguaucaucuaucuaacuguucuuccuauuucauuauugccagcaugaauugugccuuauagcaagauaaauaagagguuagaagccagaauuagggaaccgugucuggguuuagaguaccaaaggccaauaguaggccauucccaucaagccaaaauaaacacaaggcagaagucgagagaaguuacaggucagagcaagauaugcaaccuagggagcauuagggacaucaagggcucaaggaagcagggaaaucuggaacccuggccuccaggacugagagauccguggguguuagagaugaggucacauuguaagaaaggaagcaagaagggugcauuguggagacucgguguccuuaggagauaauggauuaguggaggucaguacaagacacugcacagcagacaggacuuggacacagauuaacccccuuugcuuuucuuaggauuuuuauuuaacuaauagacucucuuuuuuuuuuuuuaagagcaucacuggaguuauagaaccaagcagucagugcagaguucacauuuccuacacucaaacacuaguuccccuguuuuuaaggagaucauugagagagcauaacaguauaugagcuauugcuacuaacacuuauuuccacuuggacuuauucugcuguguguuuugauaugugugauggauuuuauguucucuaaaauucaccccuuuaacauucuaagucuacuguuugguggaauuaaguauguucacauugugcaguugucaccaccaaggcugggacuuuuuuuagcaucccaaacagaaaucugauacggguuaaauaguaauucuucaccuccuccuccucauuggcuuccaugaacuacuuccugccuggaugcauuugacugucuguguguguauacaagggcaugcuccacacuggcuugaauguuuuguccaccaccuauaucacaaguucgugcauuaauaaggccagguaguuuuucaguuugcaucacauuuuuucaagcauucaucuggugcaucuuugaguuucuacuuuucaauuaucaugugaaucauucacucgugacuauugggcuauaucugucugaguucauccuucaauucuucuguguauguguccagacuagaauuguugaguaagauagcuuugacaacugcauuauguauagcaucauaaagaauguuuccacucucuuuaaaacucacucgaccuguuucucuuucucucauauacuccucugcuuagcuuuaaguauauauauauauaauagauaucuauuuuauaucccucuaacccaaaacuuccagguagaguugaguuagucagcccaguggucaagugagucagaaaguuauuauaaauuacugcuaguccucagggccuugagauuuugaaaguuacauacacaguuacuacagguaacuacacauuuagaaagaaugaguuucaaguaaaauguuuugcaggcuuaaagugugguauauuccuuuucauccacauguuuuuuuaagcaccugugcuauugccaaggccuaaccuagauaacuacauaggaauuaaagaauccacucaagugaguuuuaggaguuucuaccguuucugucaccuaaguacuuuagaugguuguuccuuugagucauggguuucaaaagauccugcuuacccuugcaaagcuucuuccaaauacugaacuaccaugaauaacugacauccugcuugucuaaagaugaauauuuuccuuggaacaugacucuccagugaggcugcuugugugacuguugcuguguccaguccugucaucacagccgugccagacccuuuggcuguucuacacacuuguucuacaugguugcaguuucucucuccucuugggugugcugaccagcucuugcccacuucguugucuuuauaguagagcacugcacuaggaaggaagauaaggaacacucguccugcgucuugggaauuuuggccuuuagagcaggggucuccaugcuuuuuucauuguucacugcauauuaauugcauuuuguugguuugucuguauauaugcuguaaguaauuucagcauuuacauugguaaugaaaccuuuuuucuuuccuagauaaaaguuaauuauaaaaaguagucauaugguuuuguguauauucuaagguguaugcaacguacuuuaaauaccucugcugggaaaguuaacauuauuuuuccugagugaaaucuagagaugguccuaggaauuccagggaugaguagauuuaguuaaggaauugcucuaguaucuguuccuccaucuucccaauucauuugcuacccaagcacaaaaguccuauguguguugggaaucgaaauaguauauucugaaaauagggguuuuuaaagaacauuugguagauuuuuauuuuuacaagaugaaaaguccuagagaaauguuuuuauaauaaugugaauguauuuaauaccaauugugucagcuuucugauuuaauaacccaguaucggagacaaucaaccuuugauaaguuuauuuuaguucuugguuucagaggccucaguccauggucacuugacacuuucuauuguugcaggauuuucccuguccaaucacauuaggacaguggggggccugugauuggacaggaaaagggaggcggagcuaggaguuggggagacagagaggucgcagaagacagaggucgaaggaggaggaggagaagccaacauggaggcagauagucaggaagaagaucccgaucccaugugguuuuaaacagcaacuaguagcuaagauuuucacaagguuagaauaauugggguaaaacuuuuaucauuaucaauuggcucugaaauuauuguauuggcaucuuguaaauugugaucuuauuguuauauaaaucuacuuggauaauuaagcuuuaagagugauguuucuacuggauaauuagguguugagauggcuuuucauagggugugugggguguugcauggaagugugaggaacuugugggggacaucuuagagauggcccagugggaacccuguggcccuguggggcgaagaguugacugccaagagacugagcaagugagaucaccugacauggggguuagcccuagagaguugguagcggcaggcaggagcauagccuggccuggcugagaauuggcguguucauuuuauaauauuucccucaacaaucuauugcuuugggccaaaugguaacacaguauacuaugacugaaacacauagaaggaggcgaauuuaccuuauggcagccagggggcaaagagauagaugggaaugggcucagauccccuuuaaggguacucuccuagcccccagaugacagauuuggggcuagauuuccuccacuagauuccacauuagaaacauuagaccucacugcagcaucacacacuaggcaagcuuuugcauuauuggccugugagggacacuuagaauuggaacuguagcacuaaugaaugaaggcuaagauggauugcugguggcucuccugucuugcugccagccugcugcccugucuaguguagggaguacacuuuucuuucuguugcaaaaacaauaagggcaucaagaugauaaauuuuauguuauguggaauuuuuuucuucuaacauaaagacaaucagaucuuacuuacucauugccuguaacuaauuuauuuuaaaaccugagccacauaaccagacugucacugucugugauccuguguaaagauuccaugucguaccuguccuucuaauuuucuacugcuuugcuaaguccuuuaggcacuuuagucuguuacaccgccacaaccagagaauggaguuuugauuuguaauacaaaccaaguaaaaccuaugacuagcagucucuggagcuccuucagugguacagacuugaagaggggccuuuaaugaugcccugccugccauguugcugucugggauccaggaaggcagguagacagcagucugaauugcauuugguauuuccuguguuccaaugccuggauguaaaugagagaugagcauuucaauuuggaugaucuggcuggguuccuaagccgaauggcugcgcauauaccauaaacaccgugaagaagcaaccauggaaacacuuguuuucuuguugagcuaaauuuacucuggguugaauauuaacacagcuccuggcaggacuuuaaaagcaaaaauagcuuaagcgugauucacucugagucacugcuggugcugagcugccuggugcuugacauugaacaaguuggcagccugcauugcuacauuuuuucuaggaacucugaacacauuucauucuugugaauuugcuugugcaaugauauuaaauagaguaauauguuuacuuuguuucuaagucaaaugaauuugagaauggcgaaacuaaaguauuuuucuugggcuuucuggaaaagcaagcuucucagaauucugugguuucuuuaacaguuuauuuuauaggagauuaguaaaauauggaaauuuuagauuagauacuggggcuucuggaaguuuuguuaaaaagucuaguaguacuauuaagcaggauucauuaaucuucuguccuuaccagacaaggugauugugccauucacaaagcucuuuccuuuucuuucuuaccaggggagggagggagggaggcaggcgguacugcagccugcuguacacucagcuaggcgguuaacuuaggaaauacuuuucuuauuugagauuauauaaugggaaguucauggguuuugaaaggcagaccagacccacccaggggaucucuguuggcucuuuaaaggccucccucacaugccuuucccugagucaacccaaguggcugcuaaaucgugaguagccuguuggcugacugugggaaaaccuaggacagagcaacucgccucauccaugaucagcuagggcugagucuagaacgcuauaugagaaugguuuucccuugauguugcaauuucuauuuuaacauguuuuuguuuagcuuuuggaguugcccaacaguguaauuucaauugagguuuaguuucagcucuuccaauuuuuuuuuucuaauuuaaagacacuaucauuuugucuuagaacuucaaugacuuauauaaaaaaugguuuuccuaugauagucuuaaaaccaaaaggagccuagccuaauuuuugauaguauuuugaaauuauuuuaccauaaaauuguacauuagaagaugcaacucugguagagaauuucaacauaguugcauaaauuguguuucauauuacaacuuguucucugcuugacuucacugaaauuaauaaaagaacccuuucagaaggaucuggugaguuagcuuugguuuuuuuuuuuuuuuuaaagaacuuacucauaguguauccuguguugcuaaguuuucaaaguuacccauuucaaccacacccaaacccuuucagaggcuugaaaucucuuuacucagaugucuucccaguaaagauuggggaucucugugaguuccaggagaugcgugaggacuguguaagagcuaaugcuuggugauggagcugcugcugagucuuggauacaacacacaguuccuuauucugcagucagagaucccuuacagcuuucugacuccggccuuguggcugcugggaauaucccugagguguuuugucucaaaaggauccaugccuuggagcuagagaagggagaauggguuuuuaccauagcauucuccuggcccacgguugugcauauucugcugauagcuguguuuuggaggcaggugaauuuuuggcauguccuuaaaguaaguacuacaggguuuagguaaaucagcccuuucagauuguaaacuaaaagguuauuagccuagcugagucucagcauaacccgauaguacucuguuacugcagaucagacacaccccugucccucugcccccaaguacccaccgcgugugugugugugugugugugugugugugugugugugugugugugugugugugugugguguagaaaaggucuuagguguaagaguucaggcaagaucccuauaagaaagaacuuguauacucauuaaaucuggguuuuacagacuggguaacuguuaaauuuauuuggucagugcaguuucauuuuucugcuucuguucauuuguguaguagccauuuauugaaccuuacuaugccagaaauuaggauauuuuuuaaaagucggugcauuaacuuagaggcagucaagcaaauuauuaaauuaucuauguuuuaaagggccggugacaaccaugucauaauuuuguucuaguaacuauuuucaaauguuucuaauuuucaaaaaaaaauaugcaggcauauaguaacuuuuuggauaggauuuuagauucuacaaugugggaugacuaagucaaucuaauugacaugcuuagcacuucaucuacuuucuaauggugaaaacauccaaaaucuacuuauaaacuuggauuaugcguccuuaucccauucugccaucacucuuggacaaugcacacacuuuugguaaauuguagucuugacuaccuugaagucagcuuuuuuagaucuuacacagaagugaaucugcucucuuuaucuuucaguacugauuuaaauguccuccaggcucauccauguugcugcaaaugacagaccuuucucucucucucucucucucucucucucucucucucucucucucucucucucucccucucccucccccucccccucccccucccccucccccucucucccccucucccucucccucucccucuccgugugugugugugugugugugugugugugugugugugugugugugugacacagagagauagagagagcgcacaucuauuggaagauaugcuggcuaugcagauaguguuguauuggaccugggagaacagcugaccuugauuuuuauacacagaggugagauugcuggaucauauaugguaguucuaccuuugggccuguuuuauuuuuaggaagcuccauacuagcuucuguaaugacuguacaaguucucacuccuaugaacagugugcaagaguauccuuugccccacaugcucacgaauacuggcuacuuuuucccuuugauaaugacuccuuuaaguggagcaaggugauauccucuugugauuugcauuugcauuucugucgugguauuuucauauauuucuugcucauuccuguaucuuaugagaaacacugguuugagucuuuugucuauuuguuauugaagguaaaaaccuucauuauaaaugauucaauuggugaaguguauuugcaccauuuuuuucuauguguuacugguguuuggccuacauguguuuguguacuacuggagugucugauauacacaaaguucagaggagagcuucuccagaagagcuggagucuuugaaacuggagauacagaugguugugagcugccauguagguucaagaaaucaaacguggguccucuggaagaacagcuaacgcucuuuaccauugagccaucucugcuggcccauguuuacauaguuaaugcuaaaaugcuaugacuagggacacacagacgucacuccuaccccagcccuuacugacuaccaccccaaccccauuauaaaaaguaauuauuuuuaauauugaaauuacuuuaaaaguacuuuuuaacauauacuauuguucagcuuaaugaguuuucuuguucuucuuccaggcaaagggcauagccauuuaccuuucuuauacccagucccuucuacugucuagccuuccucuagcccccuuuuuucuuaguuucccuuguaagucucucuuuuccuucuguaacucuagugaucacuguaccaucauacaagauugaauuccugguuuucauaagugagucauaaggugguauuugucuuucuguguccuuguuucauucagccuacuaaagaucuacccacauugugcaaaugacaggguuuuauuuguuucacaguuaggaauuauuccacuguuguuuccugguacuaagaagugaacccagggcuuuacccaugcauuguaaguguucuccacugagcuaugcccucagccucccuuuuacaauuuuauuuuauuuuucauucuacuaacuuacuuaauuacuuacagacagggucucucuacaugauuccuggcuguccuggaauucacaauguauguagaccaggcuggucuugaacucacagaguucugccugccucucccucccuggugcugggauuaaagggaaguaaaacagaguagcuccauccagagagguagugugguucaccucacaggcagcaugucuuuagcaggcuguaucuguugauccuguggugagucugagaauuugauauucuuacauuuuuuccuccaaaccugaagucaggcuuuauuacacauugggcuuugucacuugaagaggcucagaggccaguuucaggaagcaaauuagccaaaagaaagguuugcuuccaugaacagcaauggucuucuguccacuguuucauuauuuuaaguucucuaagaacuucuuuccguccugagccucucaccuccaucccagccacucugguagugagcaccacugaccagcuauugagagucuuccuuagccuggcucacugucagcugucaggauucccagagcuacagaagaggggagaagggaagucagugcugagaagaaggacaaggcauccccuagggcaguccauccccagcaacauguuacugggucaccuuucagaguauguuuguuuuauuuagcaagggauucacuuaucauuucucaguuugauuuccaagaaaaauuuuacgugguagcaaguuaaacuuauuuacugagcaaaacugucuccaaagacauuuucuuuucucucucggggaguguaguagaguuuuugacaguuguagacagaucaucauagugcuuggugugguguaaaauaacacacuuuaccugaaggcguuuccagaucauuacuaggcuuuuuauuuuucaaguaauaauuuucaaaagaugaguuuugauagacuuuuaauuaacugugguuuugguguugucucuauauagcaugccccaguguauuugggcuccauucaguuuuuaugucuacaaauaaaugaauauaauucagaauccagaauuuuguccuggguuuuuuucuuggcauguuaaguugaccugcuagaaacugagcuacugcacucuggagacagcauguuccugcccaaaggccuccugugaagagagcucagacuuugugguccaguuguucugugcauuuacuuucaaauauacccaggccuggagcuuuaaaagaacuuuuucaggaaaggaagguccuuggcuguggagagagcguguaacuaaagguggagacacaguggcagagcacagaaggccggagugccgcaggugcuuuccugcacugugucccccugccuccagauagauagcccaggucagcugagaucucagugugggagcuugagaggccaggcugggcuuugaagaccgcccuugcuucacacuuagugcggugucaagcaaagacuguguucauccagaggcugggaguacauuuuuaaaaugaagaagguggggagaagcugggagagaaauggggaagcagggauuggggagugaguuuggaagagaggaaggaggaauuucuuccuccuugacagucugacuguuguuuguucucucuuagcuucuuccucucuucacugcucucaggccuguucgcuccucccucaucucuguuuccuuccuaacccuauccucgccucugugagcacuuccuuuaaugaccgcacuccaucuacagaggacuauaucagagagugccacgcacagccauguucuguagaggauggaguaacugaggauacaacagccuaacaugacuuuuaaguucccuucaaguuagagugagccccucugauuugacaaguccauucuuaaaaugaggugagggugggggauuagucuagagaucugagucacaaacuggaagcagucuccagauaugugagaaaagaccugccaggucauugccagggugguagaggggcuuuugcuuugcuuugcuuugcuuugcuuugcuuugcuuugcuuugcuuugcuuugcuuugcuuugcuucgcuucgcuucgcuucgcuucgcuucgcuucgcuucgcuucgcuuuugguguuuugagauaggguuuugauauccauccuaggcugcccuuaaauucacaacaauucucugcuuccccauagugccaagaugacugguguguaacagguaccuccaugucugcugugguagacauuugauagaaggguauuuguguugcuuccucagacaauagugaguguggacauguuccccagucucuaggcacggaaccugucacucagagaggugacagucacacagcagguagaagaggcacagagcuagauuccagcagcucacccaguccagagccgccagguuacccacagacaucuguucacaccacuuucuccuuagaacuggggccacuuagauuaguguccuugucugugccgcagcuuagcuccucaccucaguucagauauuucaccaugucaacacaguugcacuaugaguaauguuaagacucuagaagccucugcuuugcuaccaaacccuuggaugcuuucaaauccaguuaagcuuuaaucagaucuuucuugaauuacuuuuguggcuauaagaugucuauuauaaaaaauuccauuuaagaaaacaaaaagaugcuuauaauccccuuacuuaaaaauagcaauguuaacuuguauauuuccuuagucuguuucugggaaguguguauuuggaaaguugguaucagcauagugucuuguucguuugguggucauuuaugguaacaauuggugucaucagauucuuuaaguuauuuugauaguuuuagaacaauaucuuguuuuaugcauuaagucuuaaguaucaaacauuacaaaauuuuagauaauuucuuuauugucuuauacauuguuaaaauuaaauaaaaucaauaauauuuuuagauuuuuuucuaaaaauuacuucaaagcuugacauaagugauugguacuuuacauugguaaaauuuuauuccuuuuggaaguuuuuuuaucaaacauuuguauacucaaacaguugauauuuaugauauccuuucagugcaauuacugagaauaaaacuaagggaaacuccuaccuuggcaaugcuuacaguucagugcagguaauguguaacagguacugaaguaaggcagcaagcacuguacuaagaagacacaaaggguacaugauggaguuuugagcaaagaaugaagggaagacuuccuagcaugacauaugaucugggccucaaaccuggauaggauugcaugggagaaagcuagaaagggcaccugaggcuaaagaaaugguguauauagucagccaaagagagcugagagcaucuguuaucuuugucagucauggggcacaucugagggaacaacaggccaguuguggcaggugaccuccagcaugauuaccaaucaguguguaccuggcuccaugcuaaacuccuucucuuauagaaccuuugaggucaccuaacagucuuuugagcuguucacauuuccacaagcaggagacugaagcucaggagacuaagucacaagcucaugugaggcaggaccaaaacucaagcuagaucugaagcccaugcuugcuuugcucccacauuucuguuccuugacgaaugcuauucuuuaacuaguuagagccccauaucuugcucugcacgaaagucaacugcagauggaucaaaucuguuaauauacaaaugcuaagacuguuagaggggaaaguagggaaaacacuugaagaugcaggaaugagcaaggacuuucugaaauaaagccagcaauggaaaguaaaaaguuucuccacagcaaaagacacaguugaucaagagacauccuacggaaugggaggaaacuuuuguuagcuauccaccuuauagaagauuaaaaccuagaauauuucaaaagcuaaaaaaaaaaaaaaaaaaaaaaaaaaccaaaaaacuaacaggaaaccaagcagccaaucaacaaacgggcuaaugaaauuaacaaacagcucucaaaagaggaaauacaaauguccacuaaacaugaaaaggggagaagaagucuacuucacuggcuaccagagaaauguacaucaaaacugcauugagauuccaucuuucccagucagaaugguaaucauuaggaaaacaauuaacaaaugcuggcagagggacaaaggggacccuuagucgcugcagguaggaauguggacuuguccagccacuggagaagugaguauggcgguuucucaacacuaaccgucauccuaugguucagcuauaucacccagcaugguuacucaaaggcuccuacuuuuuccaaaaucagaccugcuuuugaucagauaaaagaagcacauuuugaucauuuggugcuggauuacagcucagugacagacacuuaucuagcauggguuggguucaguucccaacacugugagguguggguguguggagagggaaggagagagaauaguugaauaguuuaaccucuuuccuaaugaauuuccuuguguaugcauucuaccaauagugagaauuagaauguggagagggucugacaggagggaaagaaugaaaacaagucagcuuugguuugaagcagucuguguuugaggccccuauagaagugcuucucuuugaagaugugucauacaaagcuaggggugcugggaggauuucagggugccaguggccccaaacuagauaaaguagagcaucuccccagacuacuccagcguuuucucucuaguucuacuuucucugucugggcacuuaugguuuaaaaagccuggaucaaaaaaaucaggagccuccuuucuguuauaguuaguuauauauuuuaaguugcugaagcauucuauugcuugauuauccuuggugaucuaaauuaaaauagguugguguguaagcucaguggaagaccacuugcuuuauagcacauguaugccucuaggucugauuccacaugaaaaccuggcgaugcuagaaacuacuucaguuaccuguucagacucuuauaacaguguuaucaacuccaaauguagcuuucaggcagaguuaucuaaguaucagaaugucuuuuggugggugugggugugggcgugcacgugugugugcgaugugugauguguguauguuuuguuuuuugaaacagcgaagcugaccuccuuccaccucucaagugcugggauuccaagcacagcucagaauaucuucguacuuuucagaaacuuucucaaaaaugugauucuccuuuccucccggccagcccuccccuaacaaguccuucuaguuuuaugaggcuccuuaauucuauaaagacagaaauccugacaucucuuuuuccucucucucccuucucucucucuuucuuacuguugguuucccuucccuugccugccuuccauccuuccuccuuucccucccucccucucccucgcccuaucucucucucucccucucucucucuuucucccccucucucuuucucccuuucucucccucucuuucuuucucccuuucucucucucccucucucucuuucucccuuucuuucucucucucuuucucuuuuucucucucuuucuuucucucuccucucucuccccccuccuuccuuccucucucucucucucucucucucucucucucucucucucucucucucucucucucucuuucuuucuuucuuucuuucuuucuucagaaucucaucguguagcccagacuggccacaacuucaaagcauccugcccuagccuccagagcacaggacagaugucugccaccacuuuggcccaaagaguaccauuuucuaaauugcagccaguuaaaucuucugucauagaaagucaagucuuguuuccccuuggguaacuguggauaagaacaacuauggcucuucuagcucauaaaaaucuaaacaacugucuugcuuuugccuguuuuuuuguccuuauaugaauauugaaugacgaauaaugugacuauucuaaacugcucauuaacacuuuuuucuuuauuuuguauuaaacaaugaagaaaagacaaagaaauggccagucuagaucaaauucauaaauuaaaucucagugcaguagggcaaaaugaucugaaacgaguaccuaaaacuaaagacauuccaccagugggagaagaggcagaacaaaaucaaggccuaugucugcuggaucuuaccagccaucuuucuuagggaguugagagcagcaaguaugguuauuaauucuaguagaggaauccacauuuacuaacuggucacugagccuauacauaguaggucaacauaucuggaucagcagcaaaauuaugagacuuugaaauagaggauuaagcauugaauaaaaucaugauuuaaaguggugguugauuacaaauuauaacaucuuagaguuucagauguaguucauuggaggcucuggacuccauagcacagaaaaaaauuacaacaucugauuuugcauuuaauaugcacuguccuggccauuaacuuuuuaagguauuauuuuauagcaucuuugcgaagguagauguauagaacuguuccauagaauaaaccuguugucucagggaagaggcaugggucauaggauauguuagggaaagauaccauuuauguucuauaggcaggcauuggugaucugauccugaggucccaagccacaugguaaagauuuggcagaggaaugauagccuacaucauccauauugcuguugugugguuugaccagcacagaacaaaacugcguuuuaggagcaguuauuaauguaugugagacuuuguuguagcucuucuccuucaguguuggcaagcugucagagaccagcugcuuauucacagccugcccuccccaccuagaucagaaaccauguucccuuuguguugcugcagggcuuccaucaaguuccucguugcuuguuuguacccugagucuaaacccacucacagcuaaugaguguaagaagcuguggccagcauuuuguuacaggagaaaggacaagcugcacucuagccaaacccagugcuguguugugcaucaguguggucucauaaagcuccagcuugcuucucuguagcguagcucucaccucucacgaugggauuaccaacugugccuaugccucugcccugcuguccacugcugacaaaaggagccacauuucccucuauuucuuaacaccuaggacugaccuucuggcauaaagaagguguugaguaagugccagagaaauaaaugaaugcacugaacuguguguuucuucuuuacaaaucagaauguuacccauuucccccccucaguuugaucaugaagaucaguugagcuaauggauaugaaagugccguguuuaaacauagcaccugguaggauuauugucugcuauaaaguuuguuauugucaagcaaguaagagucacaaacucuugacagcucaauguuuugauuacacauuuaggucaguacuguuaauagccuugugauguuccuuauuagguacaaaguuuagcaugugcccauuuuuauuauggaggauuucagacacaaccaaggcacaguagccuuguguccuuuaucuccacugucagcaguucacaauucauagacagucuucaucaucugcaccgcacacaucuucuuuugcuacacagaaguguguguucccgcugcucugcuuuaaaguauucuguguagaaauauucuuaacauucuuuaaagaaagcagucuugggcuggugaaauggcucauagggaaaggcacuugcugccaagccugacagccuugguuuugaacuccaggacucaucugauggaaggaaagaacugauuccuacaaguuguccucagaucucuucacaugcacuguggugccugugcacaaugguacccacguccuucccuucucccuaccacccuuccacacacacacaaauaaguguaauacaauuuccagaguuuauugauagucgagacugaaagacuaacucgaagguacaugagauucucucaugauggugaccagcuacauugcagaaagccuuuccagaguuguaacuaauucuggagucuaagugguaucacuugcugucccugugaucuucuaggagaauaggaccuuacagaaaaguacagagccugcaguguggugcucacuucuaugucauaguucuugagcuuuuugauaucuggaauucuuuaccacuuuaauggccucugccuguauuucugagaaguuagauuuucucauuuucuauacaaacuacuccuaagcauuccuguuauauccuguuacucccuuguaucaucucuaguuuccuuuagcugguuauaaaacucuaauuuagaaggauucacauuuuauauugugacuguuaaauccucuucaucaugauuuuuauacaaauuggaguuagcaugaaccagauggguuuguuuaguauugauugguugauugauugauugauugauugauugagguacugggaaugcuuugggaaugcuuuguagcuuuucagguuccauuuccauuuccucucuaaugucugcuccuugccuccugucuucucaguucaucucugcuagucacacagcugcauaguucuacuuucccucaaaagcuuuccccaauaauuucuauuuucugguccauuuuuauuguagacaguuccccuuugagauaaguuauuaauuugcuuuuuuuuacauauagaaguaauauacuuuaggagugauguuucaagucucacuauguaacucaggcaguccuagaacucacuguguagaccaggcuggccucgaacucagaaccgccugccucagccucccaagugcugggauuaaagguaugcacuacugcacuugccaauauacauuuuaaccagauauuauacagaauauuucaaacuggaauuucccaaauccaguucauaaauguggcgacugcugugugcucucaccgucauuucugaguaugaacaggaauaugcacaggcaugucuacauacauacaugguagaaaaauggaugggugcacagacagacugcuauuuuauauauacacaccauuucacagccuucccuugucacuugacaauguguuggaaauuugugucaaagaauuuaaauuuuaucuuuuuauuaccucagacuccucauguuuucuauguaugugcagagaagucgauugaaacucuuccaggaaaggacuaauuggacacuccuucuccuugcuuucuuuguuuuuauugcauauucacuauuuguacuguggaaaaucaaacugcuuaucucucccaacuccuuaggagcuauaaucacauggauaagaaucuccauuauuccauaguucugacaggaaguucaaagaaguaacaguucuuuccuggagauuccaaauauaggguauuugagcaaccaucuuacugaaagcauugaaauuauuaaauguauguuuauggaaacacccucaacaaguaagcacucucaucuccucaucugccugccauccccagcuucucccugcucagucauagagcaaagaugucuugcuauuagaaucaaaucacaaucccacccuuauuuugggaaaguaagauuuuuuucuaaaagaaagagagcacgcagaagaauaaagcugcuuucucccuaaggacacgcaggcagauguugacuuccugggccuggggaugauaagacugcacagaaagcuggcagaagaucaccauaaaauucaggucaggcauguaggguguuagaagcaaagacucgugagugcuggaauuuucuauuuauucaccugguaguagcuauauaaauaauuuaagcuaaauaaauauuucugaaugcuuuucuguauauauuuacuaucuuuauuauaauuaacaauauauaauucaauguaaaaguuagcaaaaauauggauauaaugugagcuauuuuauguuuuauauaaaugauaaguuuauguuucuguaaguaggaauguaguauaugaaaacugugcauguauauaaguauauacauuuuuguuuauguuuacauaaaaauaaguuuaugcuacauguacauagaaaaauaccuagaacuaaugaacuacuaauggaagcuauucuugaaacuauaguggagaaagaaagacuucuuuuugguauuaugcuuuaaauagucaugaauguuuacuacuuuuuagaaucuaguuuuaaaaaaauuagaucuucuaucucuaccccuacauagaaaguauucccuccccggcuauguaacacaguacuuuuuuucuuucucucuuccucuuccuuccuuuuccuuucuuuucuuuuccuuucuuuucuuuucuuuucuuuucuuuucuuuucuuuucuuuucuuuucuuuucuuucuuccuuccuuccuuccuuccuuccuuccuuccuuccuuucucucucucucucucucucucucucucucucuuucuuucuuucuuucuuucuuucuuucuuucuuuucuuucucccuuucucuuaaauaacuaugcuucuuuguuagacucuaggcccuucaaaggacugagccaaugacauguuuaucucuguauuucuuguauucgauaauuccuaguacaugauagaagaacuguaaauacuagugaaacaggaacaaaugaaugaaugaaccugaagaggaacaaagacacccacacauaagcauucucuuagaacacuuugagauguuacauugcuuuggcacagcagugguaauaaaacugacacaguaaauauuguuuguuugggauuuaaccagcacuuuguggaacuguaggcaaugcaaaguccaccaugugguuaacccucuuucucccagaauacagcgaacugaaaguaugcacuggaaaugauugaacugagaagugaauaccuaauagauuacagagagauuauauggucugggcuugguaguuguuuuuugcuguugcuuauauauguggugcaggcacuuugccaugcaaccauaucaucagcugugcacugaagugaucuuaagagacauugugucacuguaaguaggaaaauuugacuauacucuaaaugaagauguuaacaugugaaacagacacauguacgcucagucacauguauguagaguguucaucagaagagagcuuacuaucuccaaacuagaacaaagaaaggcuauuaauugaagaauucuuaacagcauggccagaccaucagcaccugccagguugagggaagcauucgguuggcugggccagugcgcagccccguuucccagaaccucgugcauacaugcacuguaauuccucgugauucauugcacuugcuuugcuucugugcacuucugugcaccuugcucuggcuauuugccuucccaggaagcuagcucccacagcugauacagaugugccccauucuucuauuguucacuaccgauuaauaaagccaccuucuuuacucuucugaugcaucggugucuuugugaguuuuguuagaguaauucugcauuccuggguccagucaguaauauggcaaacagaaucugcgaggcucuuugaggcaaacauuuccuuguaggaaucucuugguacauaaucucuaucccgucaccacugucgugagcaaugacucucuucuauccaacacuuuaucagaauaauucuucccaaacacaacauguuaagaacgucuuaguugugcuguggugacacccaucuguagucccagcacuuggcaucaacccuugaugggcccaggcaagaagauaagccugggaaaguuaacaggguucuuucagaaugacagcaacauaaguaguguguacauuugaguuauuacuaagucguugucuuggugacaguagcucuucugggugaguauuauucaguuuguaaauuccacaccugugugcaugggucaucuauuguaggugccaucuuaugaagaccuucagugauuuauuccaguucugaucucaccauuucccuggcucucauuucauugucaacacugacccugguguuauggucaagucacuuccuaaccucgucucucuugcaguagugaaacccaaagaagauggaagacacagugaauucgacccgaauaaggauuccaguagagcaggcaauaaacgagguuauagauuuuuuuucuuucacucucaucugucucucuuuccucagaacagcaccaacagaauuuaaaagggauuaaguucucuguguccuucuagaugaagauaaagcacaaggucucuauaacuugcucagcguaucuuugaguacaguggaacuugagccagauuuugacagaucuuuaacaacaauuucuugccaaaacggcacgaguauagacaacagggggaaagccagagucuuguggcucuuagaaaugguugucguguguaguaacuguuauugccuaggauguuaagugucauuguccuccuccguauucccucuccccauaguacccaacugaaaugacucaucauuaaaucucaccauaaguuggucagaagcacaccuaggucaggcagggcucagcucacaccuuccagaugugcgugagagugaggguuacccaggcagggcuuggcucacaccuuccagaugugcgugagagugaggguuacccaggaagugagacuggaagcacugcagguaggacagguaaaugcagucuuagaauuuacuuuguaagaaguaaauucuucaaaacauacuuguuucuuacagucacagugguauugauacaguuggagcccuguaacaaaauaaaccccgcagagcuguuaguggcuguaagaagcugcugaggcgucucuccauccccaugauuaacuacaaagcuguucuaggggacugauggaauugcuaccagauaguuauggaccagucucgauuacuuagaugauaaugagcuacucuaggcccuuugaccaaauuccucauuuuguggcuuccugcuucuguuggauaaagaaugaaacugaggagaagggucuaguuuggauucuuuguagcagaguuugcuucacagcaggacaucugaacuguugaggacaccaggccagguggcaugcauacacuccaggucagucugucagcaccacucagagcggucagugcauuacuuuacaguacagccuucagcaccauuaaaagcaaacuaggcaaugaauuauguuaugugauaguaggagaaauguuccuguuguuugaaaaggaaaauuauggcccuuuaaguaaacgagaaaaugaauacacuguuuacaugcauaagacucuugaaacuaccuggauuuuuuuuagaacuugaauuccuucuuuuuguuaaggugcauacaaaugauccagauccuacaaauaggaaaguaccuaagcugugccauaggagaagaccaaggaguagaaagagacaaaggucaaccaagaggucacauagaugugauacaugcaugucaccacaugccacucuggucucugcuccuuccauccuauauaggggcccaggcaacuauuuaccuuguccugugucucuuuccuucuguugaagauuagggucugaagagggauucccuaaacuuaggacagcucaaguguggaacaggacuguucugaagcugggcagcauuaggacacaugaaaaacaauuucagaauggcagugcuaucuuuagacugacauccuauuuccugacucccaccuggcaugcacagcuucaccaggaccucuauggugccagaguaggcagagggugucucagcucaucuggguuucugaauucuuuuuuggcaucuguuuuuccucagucucccacagcuuucuaucuccucugauuccugcucccuuuugguagagguuuuacuuguaaagucauuaagcaaaccccuauguguuugcuuaugucgcuuauauauauuauaguuaauguauaauauacuuggauaucuccacuuuuaaccaaauaccuccuagcaggagcauguuaaacuuuaggauaagcaauuuuugacagucugaaaaugauucuuuuuaaaaauguauguacacaaaauguugaguaaagugagccuugcauaccacuuguuucaacaaacacuuguugugcuacagaguuagacuccguacuugauguuuaugcuggugaacaaucaauaccaucucuguccuugagacuaguagcagugcaguucuggcuucuguaguaagcagcuuaacggucaaauaguauuauucauuagaagauggacccagucagguuccccggguguaggaaagagcuccaccagcuuccaaugcuccucugagauuuucggguguuccuguaguggagaagcagagugucuggugagagauguuacugacaagaguguaucccucuauaaacacugcacuggagaagacuuugcaaccuacugcuauagaugaugguugccagaagguggaugagguugcccaggaaaugcaacuauaaugugaauacaaugggaaaguagaaugagagagcagggugugagaaccuagccuggcaaacucacaaaaauagaagaagaagcagugggggagccaagaaaguguaaagaauguaaaucguguugugagcuggagacuagaaccuaacaugagagaggccaaugaggcugugacaaucaggagugacuagacuccugaugcaggaguguccaggugaauuuauuaggccaaagucccuaccacugcuggaaaguggggguccugcaaaugcccuucuuuacaaagcauggcuuugacuagaaccuuuacaagguaaacugaggacuuccagucugugugcacugcuacucccugaccuuacaguagaagcagacucaaggcacugaugaauugcucugcaauccuguaggcagaguguguguguguguguguguguguguguguguguguguguguguguggugcucuaaagccagaagcuuuugcaagucacacagacacuaaagaagagauucccccacguuuuauauaaugugcgcucaugaaguggcuaagagcuuauauguccaacucuuggcaaugucaggccacccucaggaggucacugcugacugacuauauuugggacacagugcacacagagagaagaggucuuuacgccacacucaguuguuuuuguuuuuccaagauaugaugaaaaccccacacuuuuucuuaaucuuaacauucuugcauguggacaucaggugagcaaguguuucuaguuuaggugaaaggguggaaucugacuagaacaaaauggcuuacuaucaauugugugagaggacuuaagaacagcaggaagaacagagccuguagcgucccugaaucuucagaaggguuauguauagcuaccucuaaguauacagugagcucuaguuuaauagaguuauuaguacacaaaaagaaaacagugaugaaagguccgcucuuacacauauuucuaauuaaaauguuccauuuuagagaugaagaaaugauaagcaugcaggccugugggaguggaauggggcaaagggaagggggaaugaguaucuggaaagagaguaauagaaggcuauuacucacucuuuacagccagcugagacagcucugccuuauagggaaacaaaagaucaucugacuuugagagccacacagagguaucucacuuacaguggaccagcacuuuaaaagauguauuaggguuuaaggggauaccaaccgugaagccauuuuguagccaaucaaauaauuagaauaauggacuccauguaagugucagagaacugugcauaucagcuguuaacauagcagcaagcagugaugcuccuggcagauugucucagacagagcagguaacagggaucugucugucgucccagcguuuuggucaacaggacgaagacagaaaacugcaugggacuccucagugcucuugucgcacuggcaggaaucaauaggaacuugacagaggaagaugugacguucauccccagaaacuugucccuuuuagaaaaagagacaagaaaauauuuuaauauuuuucuaauuacucugaaaaaaaaaaaggagcagggaagagaagccauuuauaagcaugaaaaacagaauguaguuuaaaauuaaaaccagccauccucaucaccaccuguagcuauccugcucuguuaaaagaccaggaugcaaagcuccuucuagccaaccauagcuaauccaaaggcacuuaaaaaaaaaaaaaggacagcacuagaaauaugucacaggcaacaacagauggugaaaguugggguauauuguuagagaauuuaaagcaaaauauaaggcuaauuuuuuuuuuaacucgugagaauugugaauguuugccaaguggcaaucgugaaacuuguuuuucaucaaaauguguuucagaaguagcagaauuggcaaaaccacagugauguugcaacuuagaacucauuccuuucagagcuaauggacauccacaaauguaaagauucaccacgcuuaauuagcuauaugcuauuaugcuaauaaugcuuuguagccuacagaaacucaccaagucagcacacuggaaucauucuauauuacaaagaaaauuuuaggggcauuuaaaacauugaaacuguacuuaacaaauuaucugaccauaaugcagaaaaauccacucugugucaaauaucaaccaaaguuagagucacuugauugagauauauauauguguguguguguguguguguguguguauaauguauauguauauauauauauauauauauauaaaauaacucaaguugaagauacauugaaaauguaguuaaaacuaauuuuaaaauguacaugauuuaucaaaauacauagauaugacaagguuuacuaaaaccauuucauaaaaggaaguaauuccuucauuaagauaaagagaaaauugcgaguuaagcaaugcgaagcaaaaccggaaguaaagggacagggaacuagaaaagcagugguccuagcugacuuaggagaacaggcaggcaggagacagagaagacucuaggguaaacuccagaacaagaaaggagauaaaagaaacuauggaaagagguaaaaguuagacaauuauagguguggcagaaguuuuaaagcauacauuugaaaggccagccuagauagagcccaguguaagcuauugccuagagcaugugaggccaaggguuggacccccccaacaucagaaagaaaaauuugguguacuucuguacauuuuuaaaaauaaucaagucauaauuuaaaucuucaaaauaaccaaaaauaaucuuaaaaccaaaaaaaucacuuaaaauaccugugaaugguguauugaugagaguagaguuuagaagggcuggagagaagguucagugguuaggagcacuggcugcucuuccaggggacccagcccccacaugaaguucacaaccgucugugacugcagucagaggagacaaaaccagagucacauugcucuaguacauucaaauugguuuuguuuguuuguuucuuuucucaaaaguuaaaaacuggcuuuuaaacuagauauuuugaaaccuucauuugaacuuagucacaagcagugauagaagguagggaacccuaagcauuagcagcaccuugagagaauccaccccagaaacagucccugagaguccaggcagggguuuauuguucauuacucauuacagagccccugcugugauaaucuccaugucaccaguggagaguuugaaaggggccccuugugugcugugugagucuacauuaggacucuaggugucuagagagccagcucucugugaacccuuacuucuuaagggagaaugauaauaaagaagcgggcagccguguaaugagccugucugagaucuuugugugugauagauuuccaaguccucggagaaaugauggcucacucaauaaaaauacuuggucaguguuuugauaaaaauuuguuaagccacaaaacauaaaacaguauauacagucaaaucuaguuuucacaaaguacuuuauuaugugcuguagaggaaaucuacaagaguauaugcagcuauuaaaaauaguuuuauuugaccuuagcacuacagugauuugaaauugugcuuauauguauauaugcaauguuucuauaguuaaaauacauguccauuaaagcaauaagaucccuccacaagcaguaggcauguucauagcacccauaccuauugagaaguuaaauggggaggggagggaaggggaggggaggcuuggggggugggaaauccgaauaaacaaacagaacugaauuagcaaagugaacauacgacauaaggugccuaagaaugaaccaaagaaauauguuaccucuuuucagaaaguggauuucaaaaauuuuaaguauaggaagggaguauacacuuaaugggaaauuuucucaugggucaugcugugauuuuucuuuccuuuuuaagugggaaagacuuguauguggguagcuacguauauguugaugucuuccuccaaugaaaguuaguggaaucaagugccuguauagauggagaauuugaaaggugaauauauuaguguuggcagauccagcugaaguucuugcucagaagaggcucucauaaaacuugugccuauuaaauuagugccuaauauguuuuagggaacaugcuagccauuuuucuugauuaacugaucuaaaguuuauaacagucugcaagcucacaaucccccucccccguuuuuuuuaaauauuuauuuauuuaaauaaguacaccguagcugucuucagccacaccagaagaggguaucagaucccauggcagaugguugugguugcuaggaauugaacucaggaccucuggaagaacagccagugcucuuaccugcugagccgucucuccagccccggucacaagcucuuuauucaguucacuuuuuuaauauugagccugguugggaccuuguuuuuuguuaugguuggguuuuggggguggauuuggugguuuguuuuguuuuguuuuguuuugacauagaaucuccauauaacaugagcuggcuaccagcccaugagccucccagaugcugaggucaccagcgugggccaucacaucuucuugaaagugugguuuuguaagcagugugcaaucaguuguccaagggagcuagauuucagagguucaggauugcagcuuaacccuuaagccguaacuucaucuuaggucucucugcacuccaaugccaccagaagacauggagcccaggaagagagagcuuaugguuaguccucccaguguucuacauuuaagaguugacacaguguugcuuugagaccgggaugggucugaggaaagaagccaguguuuaaagacauacugaaggaagccuguggagacagguaaagccuuagcaggaagaaggcagaccaacaguauggacacuugcuuacaggaggcuggggaggaagcugaaguauuucccuggaaagggaaggagaaaggagaaaaagggaacaagcagguuaaccacacacguguuguguuaucugcuuagaguuguauaccuugcaggcuguagauggcucaguagcuaagagcacaaacuguucuugcagaggaccugaguuuggguucccaggacauauuuggguggcacaaccaccuguaacuacagauucagggagaccuaaugccgcuaccuucuaagugcauacaguauuuaauuaaaaauauacuuggaaaaauaagacguguauacuuccugauaucugauaucucuaaucuuggucuuuuuauguugaauuagugauagcauuugucaucuuaguugugcauaaaauaacaggccguuuaauuugacauuugaugguuuaaaaucauugugugcauauucauuucuaaauuaccuuauuaaugugagcuuuuaucuaauuuuuguaauccauuugagcaguacauagaauaaaaugguaggcaugccagguguuauggaaucuggggaguacucaaguaccacacauacacaaagaucugguagagauuaaaugaaauaaugucuauagauauaaaguccuuaaggcugugauuauagauaaguuaucagugaugccuauucuguauggacauuucagaugggaaagaacuccccucccccaugcuacugcucuuuguguguuguuguuguuguuguuguuguuguguuguguuguguuguguuuugaaaaaguaguucuugcuguguaguaccuggccugguacuugcucaguaacccagauuggcuuuggugccuggccuacauuucucuuuuaguaaauauagauuucacaaaugcaguagguaaguaugauggaaacucacuuuuguuuguauaggcugcauguuaccugaucuugaaauauacugaacugucauuauguuauagacaauuuaaauguagaagcagauucugaacuccacauacucaaacaaagccuugcacacacuagauccacagugugcucuguaaaggaaggguguguucguuuguucuuucuuccucucuuucugucuucuuuuuuuucuucuuuuugcucucagcaaaaaugauacaaucuuuauggauaggguuugggaaauuccugcaguaucucucaaauagacugggagucuuuguuucuucacuuucuacuuuuaaucuacucaggggauuuuguaaguugcuucaguugggcgaugggcaacaaacaguagcuugggaaaugcaggucagaaacuguagauaaaaauccuccuuggugugcaagcuccuaugacuuaucucuacuguggaaucgcugaauuaguaguguaccuuuccucuagaaaguaucagguaauacaggcagucuguuuguaagauaacuauuaauucuauuuccuaacugucucaccaugcaagaagagacccagaaaaagaagaaaguuuucuuugggggaacugauuuugcuuugucuugguaaaauguucccuauacucauuuaguuggcuguuacugacgaguuuucuucuuggagucagaguugcaauggccucugugauugucugguaucugagaaccuccucagaaagccuagaagaaaguaaaugcuuucugccuugauguguguuucucacaacaacggccaggcgacacccagaauuccccuucaucucagcauguaggcacugcccuuuaggggcagaaacaggaggauccaaagcuuaagaccagccugggcuauaggcugaaguuccaucucagugaaaccaggaaacucuuucaucuuacaguugaucuggucauuugauccuucuggauaucugguuacuuuuacuuugacauuaauauuuacacgcaauaguucaaacucugaugccucugcugcuggcaucucuguuuuccuccuuugaggaugucugaaaacagugucuuauguaucccuucagaguaagugcaauggcuguaugaugucuccacacaccauuggaaucaucagugugcuauggaacauuuccccaaaacacgacuccucaucauguaacugaaucacaaggauggcuguaaaugggacccaguuuguacacgugaaccauucccccccacccccccuuacaagaaagaaacucaaaacaugauuuucagauucugaaguucagguaguugugacuggcugaaggaaggucagcaguacauccuguauuuccuauguguagcaaacccugagccacugccguccguguaugaugagaaccaccuucuccagucuccaugcuacauucuuucaucuaugcgccucagcugcuuuugguaaaaauaaauaaauaaauaaauaaauaaauaaauaaauaaauaaauaaauaucauuuaauuagcuuguggauuuugccauuugaaaggugucuuaugccuuuaaucccaguacucggaaagcagaggcaggcagauuucugaguucgaggucagccuggucuacaaagugaguuccaggacagccagagauacacagagaaacccugucucgaaaaaccaaaagaaaggaaggaaggaaggaaggaaggaaggaaggaaggaaggaaggaaggaaggaaggaaaagaaagaaagaaagaaagaaagaaagaaagaaagaaagaaagaaagaaagaaagaaagaaagaaagaaagaaaggugucuuauaagauuuuaaagccugauuccuguugcgccuugugccuauuacuaauugauguggcuagaauaagcuccauugaugcugacuaaugcugggaagcucuuugggggcaauucaguuugguaaugacuccauucaugcaucagacccaugcuaugucagcugaguccuagaagagcucacagccucaagguagaacauguggggcuuuucaaaacaaacccgcuccccauccagaaucugccauuucaucuugacucuuggcucugugacuccaccaguagaacaugacagaagugacgacaugugacauugcugggcccagacuugaagaaacugucagcuucugcucuuguuucauggaguccucauuccuagcacccagcugccaugcuguggugaggucugagcuaaccuuccuuucuucauucuugaggaagaugacaacugaaugguuaauugggugggagaaaaggguggagucugcucagcagcagugaggcacaaaacagggugccaugcagaggaguuaggagcauucagguaucccuggaguaacaagccauacugaagaugcagccagacaaagguugaaucaaggagaccuugucugccaagggaaggcaauguugugggcaguuugggguuuuacuguauuauuguugaaacagcagagcaaugugauaaauacaguguuugucuuacacagauguucugucagcaguaagcaagguggauuugagggaguuaaaacuaaaucugggcuugguggccuacgucuauaaucccagcacuugggagacuauggcuagcaggauuguuauaaauuccagaccagugugaggucucaagaaagcacacagaccaacuggaagcauuaggccgguucugaugauucucccuuaaguuguccaggcaaaggcaagggccugaaccaagacuucaaugaauauagagaagaaaaaguugauuuaaaaaguaucuaauggguuucuuguuguuucauuagagagguucuuauuuguuuggcuuuguaaguuagucccugguaacugauuggaagccagauucugcugccgcuaaaaauggagcuaacguucguucagcuguaccaugcuggacugaaauccauggcaucucucugguggugucagugaggcaguuagaaauguaagucacaagcuaaaggggacuuaugcugcaaauagauuugguggucaaagucauagucgugcuaguugauauccguagcaaauuaacucauauucagugaagagauacaaggauggaacugugcagccacccugaccuugagaagaugguucacaggaaacaagcccaccaaagagauggggcagaaugaaguucaggagacugggcugggagugggggcuugucucccggaccaaugaggacaggcaaaaggccauucuggggcuguuauucaggcugggcaaaggaggagcaaggggcaaggauaaaagcaagggcugccagagaaacuaaagaacacaugccacgagacggggaggagagagaguuggcaaacagguaaauacuuagaucagccaaggagcuuaugccauucaagaagaagucauugaaagaaaauauacugaaaugaaaaaagaaaugaaggaaccuccugcugaaaguagaagggcagagaaucgggggcuccuuggagguuaggaggcuauauuaaggacugguauagauuuaaacaguuuuagaauguggcaggaaauugaagaucgugguuguuggauuuaauuguugucuaugaaacaggacacaaauugucuacugagagaaaagaauaaaguaggacuuuguaguuggguugaagaaagaggugccuuuaaaaauaguccuuuaaggaaguagaaaugagugcucccucauaauaugcaagaaagaaggcaguagguuacccagaagaccuuguugauguugaagguucaguucuguaccagcccccccccccacccccgaguagugugcugccuaaaugcuccucuucaagcaacacaacccacuucuucccuugcuggccucaguguggagaaaaugggucauucucagaaguaaugaggcagagcuuauauaacaacagaguuuuguuuaaaacaaugugugcauagugaaacugaaagauaacuaauuguauuuguuuuuaaaguaacacaagggcuagagagaugucucacuggccaagagcacuggcuauucuuccaguugaaccaagcacucauaugguggaucacaaccacccaugacuccauucuaggaacccagugcccuguccuagucuccacagucaccgggcauacaagugggauacaugacacacaugcagcagaguacccauucauaucauuuuuuuuuuuaaagagagcaaugccaugaagauuccaauagacaagagaagaaaauucaagaagguagucaaggaugagagaacccacagaaaaacaaauggaaagagugaggaaaggggaggggcaggaaggggugagguuucacguagaaaagaugugacuggaggagauagccugaaauuucuuaggcauaacacacuguaguguacugagcaugcauugguccccaguuuguuucuggccgguucauggaaggucacagaauagaauagucccaguaagggaucugcugauggaccgggauugcccacauguacaagaaugcuugguugggucuccccaaagaacuuuggagcagcugcacccuacuuugcuagccuccuguuccugcagcucccacacguauaacaguaauaguccugaaaggaauagcucacauuguauguguguuguaccucugaaagaaggucaggccagaugaugauagaccauuuauagaccaggaagugcagugugagccuggggguuucagguuacacaccuuguaaauggauaaguuacaaguagaacugaggucuucuaguaccaguguucuucacauaagccaggcugcaauuuggaguuacaguauggauuuuggacuuagcuagcuauggguuuuuagcccaagcuaucacuggcacauuucagcagcucaggaaauagauaugccagguaaccucugagagauccuguacugugaacuaggaaaagcucugugacaacuaacuggggcuuugcuucugaauuugugagauaggaagaguauccauccuguccuuaagguuagaagguacuuguaaucaugaaguuacuccggcaccugucaguucuuuaagacuugcuguacuguguauacugugucuucauucaguuccaaguacuguuauccauaaacuuugcucaauacauguuccaaguagguucauugcuaucuuagaggccagagucaguguuaaagccagaguuggaguccaucugcugcuccccucagguugaguucuaggucaaggaauccagaugaugucccuguggugaaucaguguagcaggagggaguggcccuuagugaguuaaccugggagaggcugguaccucagucaccagugucagcccuuuaugacaauguguuuuucagaauggacccagaugauaaagaugaagucauagcacucuaccaagacagcagcuaacugaagggugacugcacuguagggcaggcuuugguucacagguuaaacguaacugcgcuucuccaguucugggguuuucuuugcuugcugcauguugaacuuugggcaugaccaucuucuguuaugagagcuugaaucuagccaguccuuuugcuauaucacaguuuaguuccaagaauucccugcugcccguguauuuccaggcagaaccagacauuagacagagccagauauguugauugaagcauacagagaagaguguccagugacuuugaaguuauguuuauguuucagugggcucggguugggggggugggggagacugaccagguacuuacagacacugacuuaguacuuacguauuuuuguccagagccugucacccaacauugauagucacucuuguguggcuacaguauauagcaagcucaugccagcaagccccaucuuuguucaucugggacaagaaaugagaggguggccaauucagguuagaaauacuaaagcucugguugguguucucucaaggaacuacagucgcauacucaagucugguccagagucaguaucauaaagacugugcuguuuaucaacgcaucuggguagaccuuucuugcuguuuucuguuucuguguacaacuguuacuaugcucggggcuuuggggugguacuagggauugaacccaggaccuggcaggugcugggcaagcacuuuacuacuuaguacauuccagccugacuagcccuucagugucggcagcuagaugcgcucccugcagauuagcagauuuaguaguaacccuggcauuaguaucuugaauccuagaaauuuaaauaauguauuuacacuuagggauuauuuuuuguuuuuguuuuccuugucugagccauuaaauguuuucaacagaacuaauauuuaauccuuaagauuucauaaccgagaaguuuaaagguuaacuguaacaggagaaaacaucuagugaaguuuuaaagguaaccagauaaggaaguacagaaagaguguagaaacauugacaagcucacaaagccaauuuuguccaguuuucugaaaacuccagucuguacggcucaagcacgugagucaugccuucccuuuuucuugucagucacucauucacccgcuuguauuacccaugauucauuguucccucugccaaguauugcucuagguacuagguaacaacaguaaauaagacagucagagcguacugugugccaguucugugccaggcacuugggaacuuggaacuagcugcuuucggcuccacaaucugacguaacgagggaagucaguuuuccccagaccucaccgacuagcuauguggcuugaggggggacagggucaguucccuccucucugaaaugcucuugcucacuguucacuuagaagccuugauguaaguaucagaugagauagucauuuugaaagagcuuuggaaagcauugggccuugcuuguauagagaccaccaguaaucuuguaacugaccagaguucgggucauuucauugccucugugaaaagcguaaagggcgugugcccauuguacauugaaauguauaacugccacuuccugcccaugggguggggauuucagaaugaguuaugaggaauaauagcugcagccaggaagacucacacaggaaacauaaugcaguucauacaugguauguguuagguauaaagugcucagaugcaggggcagagaaaagauaagacgggaguuggccucugaccucaagaaacauagacauguauaugaaaauucagagugcccaaauauaaacccugagcuuaauuauaguuucccagggauuacagcuauucauuugcccccuaaacguuucuaaaaguguucugauagccaucagggugccugcugggauguggugauaagauguugcuuccaguuucauauuuuauuaucucucauguccacuguacuaauauuuuagacugagguaagaaauguggucuguauagagagagauuucauucagaagguugauucccaggacccucaucaaagagccagcagacucacgcagaguuugguuuguaaguguuccucccuaacauuaaaucccaucauguagagacucgagaaucuccgucacagcugagagugaugucacagcauaauccuagcacucaggaguccaaagcaggaagaucaaagaaaaccucaaccugaccagcauggugguccauaccuuuaaccccagcaucagggaggcagaggcaggcagaucucuauaugaguuccaggacagcaaggacuacacagagagacccugacucaaaggagaaaaaugcaaaaaaaaaaaaauaauaauaauuuauuuuaauuaaaaaaaaaaacaaccacaaaccagcaauaauaaucacuuuuaaauaccaguucucuucagugcuuggagcaccacucaacuccuggauugaaugaguaaaagcaucaauagcuugaugagaguucugucugugcccugugccaaagguaucuagugcuugcuugccucucagacuaacacacaaauacagcuauugcugugauggaggccaaggucagagcuuugcagacccucccuggaguaagcccuaaaagcaacugaagagcuuguucccagaaagucugagacauagcccacagcaaccugucacaauagggggcuucuuuuuuucaccuacacauuuuuuuauuaaauauuuuuuauuauuuucuucauuuacauuucaccuaagcauuucuuuuuguuuauuuguuaucucuuuccuguucuugucaaaagauaaucccugaaagaguagauaccuuguggcgcuucuguaggguccgcuaugugagaacgcgguccggcacagagcagccugcucaagaagcugcugcagagccaguuaagauuuccagagggucgugugcaaacgagcacagggcaguagagaaaaauagggcagugugcuaguuacuuuccagagcucugucagggcguuauuucaccuuaagucuuuccucucagcuaguaagaggauacugccaguuaaaacugggguugccucuuccagugucuugcuugacacauguagaugggccauuucaucuucccaacugcccugagaucauggcauuuuuguuacuguguuuuguuuucauuguuacuguuuguagaaaugagaaaucucaggcccauaacagaguuggaauuagagugaggcacucccuucaggugcagaauuuaagggccaaaggcugugccaaaaguucaauaaucaaggcaaacaauauuguaugcaucgaagauuucaguucugacaagaucugacaguaucuggauuaaggugagggaaagugcauagucagagccugaaguuuauuacaaaugaugcuauucaucauagauacuugaguuuuagauuauugcauuaaaucauuacucacccugauuaguucagguuguguuacuuuguuuugcauacucuuugauuuuugcuucuaaggccagugcuucccucaggucacccuggugccacacugccuuggagacugaguggcccagucauauggccuaaaguagcaaagccugcauuugacuacagaucacauggccuucucaucauuucauuuagaaugccugauugucuugguuguuucaauucucuuaggcuuuucagccccauuauuuaaaaauauccuuaacuccuuugaccuuuauguauuuuuuguucugugaauuuauaucaugugcccucugcuuucacgucuuuugauuugugauuugugaguguuuccgccaagggcacauuacaagacauccgcuuugagcagaacaagauuuuguggccugacuuaggaaaucugauguggugugugccugugagaccagcacuugggagauugugagcccagccuaggcuacaucaaagccaaucacucaaaccaagcagaaaggagcccgcucuaaaugagcuguggaaggcgagggagguaugaucucuuaaucgcuaagacacuguagggcagaagggcagcugaauucagggguccguuuuauaaagucaggugggaacagugcgugcuuggaaucucaacucccugggagggaauagaggaucccaaggucaaaaaccaaaaccaacguaaaccuugaaacuauaagguagagauuucuacagaccauucuuuuaaugagguguuuguuuguuuguuuguuuguucuuggggaaggggcuccuugagagagggccucauucuguaggccacgcuguccuugaacuugauauccucuuguuuuagccuccugaauauugugauuugggauuacccaugugagcuuuuucuugaauaauaaaaguagccaaacccauuagcaucguuguuaucuguuuuaguuuuuuuugguuuucucgagacaagguuucucuguauagcucugguuauccuauagaccaggcuggccucgaacucagaaauccaccugccucugccucccaagugcugggauuaaaggcgugcgccaccacugcccggcugcaucguuguuauuuguauggaggaaauacaucugagugcgugaagaugcugaucuccuguuauagucuuguuauuuaaaguguguauugguuaguccugcaguacauuggaaaggauagacaacuuuccggaugaucauuuucuuuacauuugccugggaauuucaggucuaguauaucuguugggcaaauacuggaaguccaagauuagaaauagaagguaagggcuggagagauggcucagugguuaagagcacugacugcucuuccgaagguccugaguucaaaucccagcaaccacauggugacucauaaccauccauaacaagaucugacucccucuucuggagugucugaagacagcuacaguguaguuauguauaauaauaaauaaaucuuuaaaaaaaaguaacaagaaauagaagguaagaacgggaguaaauuguuuuccuuuacaauuaaaucuucguagagguaaaugaaauugaaggcaaaggaacaugauuuuggaaugcugcaguaucucuugugaaagaguuucagccucccugagaauagcacagaauaaaaacugacucacagcuacugguguugaacacucgguuugagcauccaacauagaaggaagaggagccucauucccacacaugcauuuucccauuuuacugcacugagaccacaggacuuuuauuuuuguagccuucuuagaggaacugggaggauggagccuagggguuuaggccacacugcugaggagcugagcacagggcuggagaaguuagugcuugucuuacgggucacacgaacuauagaagcucuucaucugaauggaugaaugguucugcaaaaguuuaaugcagagaagaaaccaaaggccagaaggccacuugguugcauguauacuuuuuuguauaccagcuaacauuugguuggugaguuuagaaaggaaaagaaugucauuuccucugcuguaagauaaaugacagagaaauuagcauaagcccccauuagucugcuaauagggaaguagaaguggacuucugugcuccaucaagaguggccuagaaaauggugaauccauuaacaaaaaauauaggaaacaguuuggaaacuaaagggaaagguagccuuuccaaguguguucucuuugaagcagugguguauacagagugaaaguacugcuuagcucauuggagaugcagaggaacagaaaggcuggauguacguacacaccgccauugacugggaagagagacaagauccuaaaguagucugugguggagaaggaaggugccagagccuagugcuggaggcaugagaggaagcagugucagcaggcccagccugcagacccagugugccugaagcucacagcuuaggagcaaucccaggagugggcuugaacucaggaaauaacagcacagguccauacaggaggaagcuaaaauaaaaaaagguucuuucccuugugugauaaagguuguuuguuuguuuuucuggacacuuaguggacauuuaaugaucucauguuuugucaacuugauuaagguggugguguaugccuaugagaccagcacugacuuucuuuuugauuggcagagauugaaauacauuuuaauguauuucuaugccuuacaauucucucuuuuuuucuuuuucgcgcauaacuguaucauugucacugcucacaguagacucacuaguauccacuaggcuucaaggagcugagccauguguggcugauugauuuuauguguuuaguagcauccuagaacaaggaaguguaauauacuguaccuuuccuuuuucgcuucaucuguggcacaaacaacaugguaguguaaaaugacacccuucugccuucagaggugggcaccacggaggcagcuccaagugugaggaacuuagcucucugugcaugaguuccaugugacuuccugggccugucauggcuugggcgcagagauguuuuuuacagcaguguuucugacagaugggaacaugcagcgaccacagcucccugaaagaucaccaugucucuucugcuuucagcacuugcacccugacaagaguucuugaaauccgauagaauucagaagcuuauaaggugaacucuagugacuugggucuauaacaagagcagcucggcucacuugaaucucaauaacaagacauugaaagcagucauugucaucuauaagaaaacccaagagccgucuccaggcugagaguauaacaagaguaaguuaggguaacauguugccuuguccucugguaggguuuacucauucacucauucauucauucauucauucacucacucacuguuuacuguguacaggcauacuuuaugccagacugucacuguugcugccucacgauucccuaacuuauacauaucucacacagcaaaacucagcacaggguggugaacacauuggcuacaaaugaagggagcuguggagaggaaagggaugacuagagggccagauguguuuucaaacaauaaaggaggcauguaggagcugaggggauaaguccaacugugaagaacugagguccaucagcauaaaaaagcuggauguggugacucagugaccagacagccuuugccuagucugugagcuccaggccaguaaaaaaaaaaauccugucucaaaaaaacaagguauacaguacagcaucaaagaaccaauaucugggacugaccuauggcagcuucuucauacacacacacacacacacacacacacacacacacacacacaaacuugcacauauacucagaaaaaauaugaaguugagacagucaguauacaauauaggcagaagaauuaacaaaauccuuauagggcucacuaaggaaucugaauuuuauccugagccuuauucaugaaccuggagccagcaggcccugguuuucuggcuuagcccuccacagugcuacagcuacaguagacaccuggcuuuucuauagauuuugggauccaaacacucuuaaccacugagcuaucuccagcccaguugaauuguccugaauagaaacaagucauggucggcauugugucaugaucugggaaggaugaagaagagauuuaggggagagcuaaacuagaaucagaaaaagaaggaagcucuaaguggaaguguuuauuauccaucuggacauagagaagaagaauggaacuugaaagaaugacuugaacuugaaagcugcuuaggaauuagguaacaagugcaauggaaggguuaaggucaaggauaacuuagggccaaagguaaguuucuagccuaaauuccuaggcguuggggguaccuguggcuggugccagccuugggcucucuaaggugaagaauugcaacagaggaguaaucaaagguugauucagucauuaacaggaacccucacuguucaucucugagaccuuuggaacgguacugcauagguaugaaucagguuucacuagucaggcccuaaguccccaccucaggguucugcagcaugcgugcuugcauuuauuacaguuagauacccuuuugauauuggcuuucgaaccugcucuuuaauagcucuauaaucauauguauguuuuguguuucaucuugauaaaugauuacaucccuagaacuuuauaucuucaaagaucucgaaguaauugauccauauaacaucccugggaguuaguagguggggauucuugcccuuuuuuuuuuuuaaguugggaaaaacccagagauacucagucacuugcuccaggcaauauggccuuuacaucaacagucugcuuuuaaaucuguaguuuucuuuaucuaaucaaacucaaacuagagcuuuaucacccgucuuagcuuacuauaccacguuuuccauuugacuuccuuauaaaucucaguaguaaucuugucgugggugagcaagcuagcagaugacaaagcccugcagauggugggguguuauuagacgcguucucacgaccggccaggaagaacaccacagaccagaaucuucugcggcaaagcuuuauugcuuacaucuucaggagccagagugcaagaagcaagagagagcgagaagcaagagagcaagaagcaagagagagagaaaagcaagagagagagaaaacgaaaccccgucccucuuaaggagcauucuccuucgccccggacgugucacucccugauuggcugcagcccaucggccgaguugacgucacggggaaggcagagcacaaguagucauaagauacccuuggcacaugcgcagauuauuuguuuaccacuuagaacacagcugucggcgccaucuuguaacggcgaaugugggggcggcucccaacaucggggaagggacagagauucagccacaucuccauccuaguguagauauucaaggggagagugcucaucuuccagugaagaugugacaucauuucaacucacagaccagcuacucacuuaccgcagucgccuuugauauucugaggggacuuuagcacuucaugcagcaaccauaagcagucaugggaguugccauaaaugugugugcauguguauguuuuuguuuguauauauguaaaugcauauaagaagacugugcagaggaguagacagaaaaucggcuuucgaguaaacucuuggcugaaauuccucccaagaaggaaugagugacacugggcaggaacuucagcuuccagcagccugggaaggguuagaucuugauauaucacagcuacccugcguggaguuugacaagucccugcuucauagacaaagaguaaucaugcugaaauggccauugacuuuucuguugaauggcaggcccugguaaauucaacucuugaaguguuacagccuauuaaagaagcuagugagcauuucaguccugagccaugaagguacuggucccaccccuuacucauggacagauaugggaaggugauucaguaggucagcugucagugugugccuuccaaaacauuauagucauguuacaguaaacuuuuuauauuuguugcgucacaaagauuuauugaagugauaaaaguuauuauggaaaacagugugcaguaacuauggcaacaguuauuugaucucacaguaauuagcugagcauuugguugcccaauacuuuucacaaugccuuccugguuaguucauuaaacaaaauuagcuuuuguuugaacugucuuccuacagcguccuaaauuugauuuuaguucaaaagaauuagaaaguguauuuuaaaacuaccuuuccaacuuuuggguuguagccauuauuugaagucauaacuuuuuaauuuaauccucuauuuauguacuacagugugcuaugauucauugguucauccucugaguuucaguguagcagaguauccugagagaugaacagugugguugaaugauccugugguagcccaugccuggaugccagcuuguguccuuccuaugucuccacucaauucuugugauacuguguuacuguaccaugggugucccaugaucacaugaauuacuuuguuaacagucugugucucccccuggcaccuggagcugggcacugccuagcuuugcugagauucgcucaccuugcugcucuugccgugcuccuagggacacaggcugugcuccuuccucuuucugcaugcaggugagucaugcagauagugaugucauccuuggaggacuuccucuugagacgggggcccucagacuuucugccuuuccuguccucugucgcuccacuugcagaggugaagaggggcacacccaaagaaaaugucgugcauucaagauuucaaaucaaaacucaugaaauaugaaauggaaagaggaggauguucggauguuccagaaugaguuagugugacuuuuuuuucuaauucagcaacugggguuagaaagguugcuccccaguuuaagggcacuugcugucuuccagaggaccugaguuggguucccagcacacagguuggacaggccacagcugccagugacuccagcuccaagggaauccaacauccccggccucaugccuacacuucaaaagaguaaaaauaaaacuuuaaguucaguaaauguuccuuguauuucauuuuaauccuugucagcucaguuccgugauacacacacacacaacuagcuuuuaaaaacuuuccaaguuuuuuaugauuuuuuuuuccucauuuaacuuccaauugccugccaauuuucaguugaggaaaguuuuucuuacauaaaaacagagccuuuccaguucugagauuaagacuauugguuucuguuuaggaugacucuaucuuaggucuccauccauaaccauuggcagaacucuguuaagagcuuacuugucccuguucuugcuguugaagauuuuuaggacgauuuguccaaaaugaaagcaguauuaauucccguagguagccucggugccuggcucaucuuuucugcugucuuccccaucacugucuauauucuggaugcuuugagcaucauaacuggugucaaggacccacaugcauuucccucccacacgcucuuucucucccuagaguaacaucguuuggaaauuugaacauccuuugauacaaccuuuacuggauggaacuucugugaaauuucucuugcuuucccucguauuaucaccugcucccccgucaugccccggcuguccugugccugauucuuggccacgauuaucaccauauuacaguuaaagguuaaaacacuguugccugugggcugugaacuccaggaaagagauacuacucucugcuucucccgagucguccauaggcugugaccagguuauagccaagcagaucagugggcuagccucaccucacgaccuccugacccucugaauccuagucauuucuauuguucauuuuacuguccaagaucugccacgguagguguucacccuccuggcucuuccaguuuugcauuccuuuccugggccuccaaaauguucuguacauggaccuccagugcucucaggaaggagggaagacaggagcuguuauuuauugguucucugcugcucaucucggugauucagcccaaccuacacugcauacuuggcccauuuacuagagcagucaccagcacucugugcuccuuugaucaccucaccucccacugugccaucgguccagccagccccugucuuuuguccugcuccagugcuccaggacucuuaacugaaacacaagcucuuccagauugagccuucuacagacuggcugcucagacaaagaucaccuaaucugcccagcucccaacccugugagcugccauugccaggcauggcuucauuauagucuuccagggagcccuuaccagcggagcaaaacuaaacucguucagaucuucucuucugccauacuguugcugagcccguuuccuguucccuggcggccuuccaugagucccucugauggcaaguccccuucucgcuugcuucugcagagcaaaggacugguuguuuugaggcccuacuucuugcuuuacuuuuggucacacugcaucuucugcccacuccgcuguccuccuaucucuggcuacagaauaucacuuagauaagagcacacaacgauguuucauguauuuucccugaugauguacacagugccugguacagugucugccaugguggaaagcccacgaacauuugaacagagaagaagccaaaagacaaaggagaguagauuggacccugcugcuguucuaugugcauguacgcauuuccuuuuuaagguuucauuguguauauucaucagcgucuauuuucuucucaucccuagaagcccagugaaguuagugcugucaucccugauacguaugugcagagaaaacucauagaagucacucugcuuguagggggaagaacuuccugucuuucacaagccugcucgaugccgucacuucugaaaagccuuaguaugccccuagccuuccauggcacuguucacucaugggcgucucuacagaaaugacauugugcguggcuccugugccaggugcauuacgcccuccuccuugccacugcuuacaugagggcuucugguauguggggucuuugacaguuuucacuuucugucucacacuccauaugccagucuuagcucuauaaccucagacaaguuaugaguuccucagguggguggaaguguuucuucuuuuaugugacccuuguuggacauacauaagggauuguugcguagugaccauuucccgucugcugaguuggaggcucugggacaugagucugguaacgucuucaucacuaggcuguucuucagaucucacuugcaucuuucuguuguucccugcagagggccuccccuucuccaguagccugucugccucuuccagucaagcacugguaguccuuagauaugacgaauauggugacuaacugagaagccucuuuguaaagaccucaaaagcaaucacagguuuaaauguguguuugcagauaaauacauacauauguuugcauauaaacaaagauuuugucaucuucuuuaagugcuuaacucgcaugugcuuacuaagacaucucugcagacuguaaauuaaaagaauagccagccaccgagaguuccaagaccaagaguuccaagacaaaaaauccgcaaaaauucuuugaaaaauuuuuggcuagaaaauuauuuuaauugacuuuuuaguacaacuuuugauguuaaauauaaugucaguggcagagaaucuaaaauaauaagcauacuugggaucuuuaaaaauccauugucaguguccaccaugugcagauuuuaguugauuauagugaaaugacuggcggggagaaagaaagguguucuaguaaguacucauaaggaauuccagaagcuucugggagcuaggaccacugguucuggaggcacugcaccaucuuuggguucuccaguggcauggagggcugcuucugagcaggccuggcccuccucucagguuugcuucucagcuuucccugguuccuuuggaggagaggaagugugugugugugugugggggggggggggggucuggagaagccugagggcagaacccauggguugcugaagugagcgagcccugugguugccaugccaaggccuggcuggugcuggcucaagcuccguguuugcuuugugggagcaugccggaacugaccuuucacuugcccuucacgcucugggugacucaaacgcugagccauuguuuuaggaacugauuaugcuuugacaguauggcagagguauuuccucagugcugggccgaggcugggagguggguagauuuugguaugauuuugcuucaauugggaggaccgcuuuucucuuucuuuggguauuguuuugcuuuuuccaucuguaauacacaugccagucccagaugcugaaauucaccugaaccuguccaaaaauugccaagagaucuuguagcuuucacuggcagcuuguagccuuaguguggcauuucuguuaaaggcucacucuauccuugccaucauauggaggccaagagucaaaacagacaaauguggaaauguaagccauauaaagcucugugcuuguaaaucuucauaguagagcaacuauaacagugugaagggaggcuuuuauuacguagauucauggaaucugcccucucugaaaguuuggaguugccgguuaaauacguauguauuuuucaaaggaaaucaucaaaaaggacauuccgcucuuauuacaaaguuauuuuagggguaaauauuuugauagaugugguucggugcaccugggagcugagccguagcuugaggcgguuagaacagauggagcucugagauaguucaaggcuuggguuuuccccugugcaagcacauggcuggugggccgcaggaaccuuaacuuucuccaugcugauguuagaaaaguagcuuucuuauggaaaggucucauuacugaagcguucggggaccaucguaggucuucucugaaauaaauguauagugaggucuguuguguacacacauuuuauuaagagagagaaugcagucucuggccaggaguaagucaugucaggacugccuacauuugcaucaaaugcaaaggucugggauuugggcgcugacugacugacaggaacagcagaagcuuagcaagacagaaagacugcugugagcuuccuucuuuuuugaaguugaguugaaucacuagucagauugaaauccuagcauauaauuuuuaaaaauagucuagugugucauccaaccuugucaggaaaucaguguacacgagcacagcucuggcugcuucccgugcucaccugccauuucaguagagagcuugcuuggcuagggacauucuacaauucuaacacuucucccucuuugacuaaagugaucuuuugucagccaugaaaguauuuguccuugugaaagucaccucguaggagccgggugguuugguaaccugaguccagucauggggccccguucauaaguuagugaucuuggaacagggaccauguuuguuggugugauuugucucuguuuugguuugguuuuguugagaaagucucacuguguagcccaggcuggccuggaaaucaagccaauccuggcucgguccccuaagugaugaguuuuacagguaugagcuaccacacccagucguuugucacuucuuauuuccuaucucagaauaaguuccccaagggcagaaaccaccuuucuguucucaucgaguaguuguugaugauuuguugacggacacauagcugagaacuguuuguguaacccccccccccccgcccccagcucugaguuaacacauggugauggugauuuuucagcacuuccuuauuaguagcacaggcaggaacauggauauugcaagcucgccaagcgcuaacccuucccacccuugguaagaguuccugauaaaccuuuggcuucugaggagagagaacuaagccccaguaccuccucagcaaccgccuuucuagaugcgggaaguggaucuggacugucagagcuguucuagugucauggagguguccuguguuugcagcagcugcuagcccuauugugcucuuucacugaacgcucuauuagccuuugugccaucugcuuauuugagacaauacagcuggguugacugcagccauuccaacaaucaggauuuucuuuuuaacaaugugaacauugcauacugccucucauuguacacaguauuaagacaaaaaauaccauuuagaaaugguugugcuaagcucauuuuaaaauaaaaagguucuauuuaaaguucagcugguuauaguauaaaccgguucugaugacucauucuagcgauacuuuuaccccccaccugugcuuuuaguaguuguuuggggcccagacaggaaaaacccuuacauuauguagauuacuuauuucaggcacuugauuuaguagcaacuuguugacuaauugaggaaacacuuuuaguuagaaauaauuagaaacacuagaacauccaauuuggugaagggcauugcauuauagguguaguucauuugugacuguauguauaaauuuaauaauuuuucaagugcgugcuugccuccagccccugccugacacaguuauaaucuuccucacaguagcucagcugcaggcaggagaccaucgucauuucccaggaagaagcuugcugguaucuccagaauaggucagcgaaugcagucucagcuguucucccugccuacaaucuuugugacaaucauaaacaaauuaaauggccuuaaaggacucagaacuuuugaccagcaaccugcuuucuuccuuaaagucuguggguaugaucuaguuagcgaguuucccucacggugcagagagggcagcauagcauagcaggaugggucauccacccuagagccaugaacaggacuugcaguggaguuguucacauucagggauaagucuucccuucuaaguugaaccuuucuggaaaugcccucauagauacacucaaaggcguguuuccauggugauucuaaaucaagugaaguuuacagugaagauuaaccaucacagucacuaaaaaugagugaauaccacucacugcacgacccagcgagacuggcagaguagugaggggagaacaggagucuccauggacucuggcgcacuuccaggucauccucugaggggcucagcacacucugcacuacagaguccaggacacagaguacacgagcagucugcugccuuuguaggcacugugcugaagaacagaugcccugccugcccuggcuacugcucucaaugauaguuuuucuagagaaaaugaaaauugguauuuugcuuuuuaaauauucacuacugauuacauuuuucaaagcacugaacaaagccuauuuacaaauuacagguuauauaugauugguaggucuuauaugguaugcuaauugcuccgauuuaagaguugauauuuagcuuuucaaauuguugauuuuguguuuuaauuuuaagagagguauaacccaaagaaagucaauacucucugcugaugaagacuugaucguuuccagagacaguuucaguacaccagcugugugacacccagcgcuuaggcaguaagaguacuaaccagcucaugucuucaaaguaucugccacugugcagaagcaggacgccacagcaucacagaccuguacugcaaccuugaguguagcaguguggagccucuuggguagcccuggcuucuugcaaguaauuuugccugagucauggauggaaacggcgagauuuggaugagcgcagcugugcuugucggaggucagucuagcagagcuguugaaagagcaagcagaaagccugugccggcguaaaccuuggcaugcuuugugacagcagugguaucaccaccauauuccuuggccucucuguggucuugcuuucugcuucucugaguaacagucauacagguuaaguaguccuuauccaaaggccucagacacacaguguuggaggagucuucagauaucaccauuuuugcauguauauaauaugauaaauuagggacaggacccaaguuucaacuuaaaauguauuaacauuguuuucaauaauuagccuauacauguggguuaaagauaauuuuaugcaauauucuaauaauuuguguaugaaacaguuucgugguaugugauauuccacccuugguaauaauaucugcauccuagcguuucagugauuacaucaaauauucaggaccucacgcguggcaaaugcauugcaguuauuaacuacugccccugcuacuguuuguaauuacaaaaggccugaggccaaccacggcugugccuguuaguaauugugcccucuagauucugcuuggugaucucuguaaagaucaauaugggcaagaaaacccaaagguaaaauguaauuacaugugaaugcacauaaagguuucacaaaugcaaaguauuguuuggugugaaaccuuguuucaaaagugaagacaugggguagaaccuuuccauguuugcccagcacugcucagaccccaugagaagucauucguguguguucaggaauuucagcugucucugucgcuucugacauucgagacauguuaugcaauuugcuuucagugucuuuagaccuccugaaagaaacauuauagggcaugaaagaauuugcauagugucugcacagucccccaucaguguuggugggauuucagucucuggaaagggccuuguugaauuauuccauuccaugauaauauuagaacaauagccaagacugugauauauagucccaggagcaguugauuuuuauuugggggugggugggggauacaaccaaaugaaaauagauuggucaaaacacugaaaaccccauuucccuaacauccuuauuuuuauagcuaaugugccaauugacucauagauaacaccugugucguuuauuuuuaaaaaccuuacugaaaucuacaucuuagugaaacucuaggaaaaaaaucacaacagcuguccaggcaucuguuugaaugaugcagugugaaaagaguucuaaauauaauuagaacguaagacaaauaaacuugcagagcaguacucaaguaucaauugaacuagaucagaaagaacaugccauucaaauaaccuaaaucuagaguauuuaugguuugcucuggaaagcaacagauguuugccuugaguggucuuuauuagcagacucaaaacacaacuaguccauugccacuuucugggugcagagagcuaguauaccaggauggggggcggggguaggaaugaauggugucaggcugacaguguagcucacuugguagagugcucccauacauguguaauguccccagcacggcauagaacagacaugguagugcaccaccuauacucccaggacuugggagguggaagcagaagacucaagguucuccucugcugcagaaggacucugaggccaaccugggcugcaggagaccuugucuccacaaaacugaaguguuaaugacccggcacagcgggcuuuugcaggacgucuucaucacaccaguauucccaggaugcccuguuucgauuugacauuccaggcaccccaguuagcaccucucaccaucuaucuuagucuguuuuguguuucuguagcagaacucugugacuggguaauugauaaagcaauuuauuucucaccauuguggcuacuggggaaccuagugucacggugcuagaaacuggcaagggacauuacaucgugccaucuaaaggugggauucagaagagcuuugcuguuguguugcggcugcuacuguuggcugguuggauuguuuuuguuuguuuguuugguugguuuuuguuguucuugguuuuuuguuuuuguuuuuuugggguggugcuacuggauaucaaauccauguucuuaaugaaugucaggcaagcuuucuaccacuacacuauacccucagccugcugaacucacagucuacucucaagagugccgauccacucauggggaaagggcccuccugguuuagaaaauuguugaacgucccaucuguugacacuguuaccguuacauugcauuguguuucuaacacaugagcuuuggggacugaggcaacaucuguccuuccuuccuguccuucucaguagcuccuaaguguccauacuuggcugagacugguuucauauucugagaauucaaagaagaggguagacagugucuccuuucuuuuaaaggcuaaguaacaugaugcacauuuuauuucagguacuauucggccuuuaaagcuuuuagcauugucuggcauacaguggguaucaauuaaugaccccaguguaugacaacauacacguuucaauaacuguaguuuauggagcgcuuguaauauucuagaaaaucuuuguacauauaugcaugcaaauuuguguuuaaucauuguuauccuaugaguauagguuauugucccagcuagucccaauucauagaugagcugccugaaguuggauggugaucuggaguuguccaagguuacacguaugccaggugugucuuaaguacaacuuuaguccuuuaccauuggaauguuccucagagucucuucccacaguccccauuucccauuguccaacaacuuccuccaaggacagugcuugcuugcagcauguguuuccugcuguucagugccugggaaaacuaauuucacugacuccacugugaauaugcaacuuuguagcuuuuucucagggcuacaaaacuuugagaaaacaagaggaaguuaccagucacgcugaaaguugucaugcuaauagguuaaugaucauacuaaugauuaguaauaguaggagggaagugagggaggagguaggguaugagucuauaauaucugcccaguuuguuucaggguguucagauucuuucacaucucugaacggcccacgccucacuaagucucccuccauuugguaggugaagcaacugagaccuagagcaguuggcagaagacauugcucaaagccaagaaucuauuuccagcaaagcugagauucagaugcagucuaguuccuuuuuauccuaagaaaaaccugccugucuggugguuaucuaucccagaaccucaggggucgagugaccuuccucuaaucccaccacacaugcccuucaucuguaggauuuuaccagucaugucagaaaccuuggaauuaauaccauacagaguuugcaucucugguuuugcugugaaucccauggcacacacugccauguaccuguugccucugacuuccacagagagugagaggucuuggcacguaugucuuuguacagcucucccagcaagaggccgucguucaguagaugcccuaacuaggaaagccugcuuccccaggaccuuuccucacagucccucucacugagucaucagcucgcuuccuucacucucagccuacacguucacucaagucucuccuuccaaaaggaagggcaacagaggcuuucuguauguggcugaggcugcuucucuuccuccugcucaaaggagaggccucacucuugaguaaacacaguauccugagugccuccaccauguagugaaaucucucugagaaugugcuccauggcugcaguccgcccaaguuuccguucugucuuaacuaagccuccaucucuuaaauauuuccagucacuguuugugaguuuguugguguguugcccagacugacgucuaacuccugggcucaauauauauuucuucuucacccuucugaguuuucaagagcaaagguaugcccacugcagugguucaucuaaugacuuaguguucucacucccccuuuguaaucucugcuuggguuccuucuuaacgccuacagcugcccugcagguacaguuggucaggauugucuuccugacauuuacccuucuguacugucucugacuggucauuucuggaguugcuauggcugcagccgccaucccacccacaugcugucaaaugaggucucuccucugaucuuaaccuuacugcuccuuucugucuccuuugggauaucuuaggagcauuccagugucacuguggcccccuuccguccugcagucccuccaucaguuaggucaucauccacuccacagagcaccaccaucaauaugaguccagccuuuguccuccacugccuggaagcacugcucaguucuguggcuccuuagguuugucucagauguccucucacacagugagagcucuuucucuggcaguuauccuuugugucugcaauacuucccuguuuucuguuguuagagugaguucuuuguccaucagaacuucaggcauuaccacugguguuucuuuacgauaaauacucuucucuuaauucaaucuucauacuuccucugucuacagaaguaccuaaagcuuaccauguccccauuaaauauuuguugaacaggaugagacuuucuaaaauaaucaagagugugugaaauguauuggaaauuaggcagggggugcgguccuugggaagucugcaaguucuuauucagucuaccuuuuuuuguacaguaggauauugacagguaucaguuccaucuuggaucucuucucuaccuucauucucacucuugucuguuccugcuuacucucuuacacucagcucucugucccaccagaaggaggauuuagaugccccuggcauggcaccuaucagucauguacuccauuguucaucgugccuagccuagcucuaccuucuagcuuuuaaugaauaacgaggggguauacaucgaaaucgccagauguuuguggguguacuacuguugaacucucuguagagcagaugucuucccacccaccucaccccugaauauacacuuuaagucucuugaguucaaccugagagccauucuuguauuugaguugcguucaaauucuaccugcuucaguuaaccagaacagcugcccagucacugucccagucaaagcauagauuaucaaagcuucuuguuuaugagucacauaugccauugauguuuagaagacgagguaacuucuacccugaaugcaaacuagucacaaaagcugguauacacaugugauaguauuuugugucugugugugaaguuuaaaggguguuggguuuugauguucuuccuuugaaugaaaugaggcuguauuauaaaaagucacuaaguuuuaggcaaguaccuuagaaguguaaucagaagcccugaauaugaaaacugacauaagcaguguuuucaugacaucgagaaaaguugcacugucugcuaauagaccgauguuauaaaaauauggaaauagggacuggagagauggcucagcgguuaggagcacugacugcucuuccagagguccugaguucaauucugagcaaccacgcggagauccgacgcacucuuuuagugugugucugaagacagcugcagugcacucauaaaaauuaaaaaauuaaaaaaucuuuuuaaaaauguggaaaggggauuuaauauucaaaacaauuagaccaaucuccaaguuauuauuaaaguaaaaagauacuaacacaggguagcuauagcaaaauaauggaauuacaaauuuaaacauuggggaaaaugguguuugucaugagagaaaggccuaaagcaagcguuagaaauggaugucaucacucuuccuagaauaccuacauuuuccucaugaauugccucuuuauuccucucuaaacuagccucucuggccaucuggcaaaagauggcuuccuuuuaccacugaagguuuuguguccucuuucaguucagcuaaagaauccauccugaauuagagucucaguuccaauuucagccucucagaagagaaguugguucauguggcauaagucaggaauccacugcggucccagcaacuguagccaaggagacagggccaugugauggaaauaugauaccauagcauccacccagauucaccggagaugggugguuaugugcuggacugaccgaccacccuuucaccaccagacuccgaggaaguauaacaugaaaaguacucuguaguaacauucgucgggaaaaugguuuauagccugauggccagggucugccaccuagugacucaccuugaugccagguucuagcucaggggcucacucuucauucuggagaacagagagaacacagagaagugcccgacuacagacgcucucggugcuacuauucaauuagcagaagaaaauauuugcugccuuccugguaauacauauaggcaauaaaugucugaauaaauccaaagcagaauuguaguuuacaaaggaaguuaagauggggagggaaggagagacggacaugagaacaaaaccuuucuacaggcauuaaaaccaaggggauggcagugguaaucauacgauucuguuuacauuuuaucuauucauaauuucagcauacacauaaacucugugguaugcauuuaaacauuuacugguucauugaaaauauuagcuacuaaaagguuuuuauaaaaauagauaaaauacaugccacuaauauugguuggcaacuuuaguauugacugaaauuuuuaguuuuuacuuuccaauuuuaaauugauaugcucccagcccagaguuugauauaauuauaaauaaauucugguaguaacaagcaguuaaguguaugguuggaguuacuaauucagucaacucuauaaggagauuuggacuaaaauuuuauaaguaacacagacugaaagacauuuucucuaugggacaauuaggcaguugcuaaagcuaugcuagaauguguuuugccagucugauggauugucuacaguccaccuggugaugguaaaggaccaggcugaaagaauguaggauaugugagguuugggagcugugccaauauagugguugccaauaccagcugagaaaucuacucugcaagcaaaccagaucuaauaguaguuaacagccuuuuaccuagcuuuauuaauuagagcaacuccuguuagugguuauuugaagcgucuguauaaacagcuccugagcucagggcuuauuacuauagguuuaguguaguucaguguagaugaggacaugucaguuccaugagguuaucuggaguccugggcaccuuccauguaugacuccaucauccugaauccccuccauccaagcuggugcaagggacaagagugagcuuggaccaggucuguaccagaaagcauccauuacaucaucacgauguauuucaggggugagucacacaggugugguaacacuggucucuaaggagcuuggagaaauaaauagucaggacccuggaggaaaacauucguauuuucaguguuugccauacuauuaggauggagauuugagaggcuauggaagcauuaggaaaggaaaauauuguuuaaaaaaaaauaggccaaggguccuuuuugucuucaaaagaauuuuauugaaaauaauucaaauuguuucaaaguuauuuggcaaaaaaaaaaaaaaaugauaguugaaauucagugggucaccuuaccucucuaguacuacagguagugguaauagcuuccacaggucaccugugacucccugguucuguccacugagaaauccagacgagggugagaguuuauagaggcugaaaagugcucagcccgggucagaagacugauaggcauuccgucucugcacagccccgcugcgcugagucuucugcaggugggucacagcagagcuaguuuacaagauugacaggugaacacuuguugaauauccccauaguauggcacuguggggugcaugcaagggugcauacguuugggggggggugggggucgguggggggggggguauguguuucuguuucuguaacgagaaccugagacagucauuauaggaggaaaguauguaucucugcgcuguggaggucccagucccuggugacuguugagcccuguugcuuagggacuguugcaaggcagcacguaugguaagaguguguggcagagcaaacuccagccugcggcuagggagugagagagacagaaaagacccaaguccugcagucaguccucuguggguguguccucagugacccaaaggcuucccauagaaggccauucuacuucuacacuagcuuauagcacagagcacuuagcugccuccuaugugccaugcaaaguuuguuugcgcucauaucaaccccuguguauugcucuuauuuuacaaauaaagagccaucaaacaacuugccagaguuugaacagcgauuuaauggcacaguuagacucugucccauggagcuuuugucugccugggacagaauccaacuaugaacuuaaaucugugaccuccuaagcaucaagcuacaaugcaggaauuaagacaccagagagacaaacaucacaaggguugggggguaaggguucuaaccuuaaauaauaggaaaauagagugcuauuucaccuuaaauucucugggaucuaguccauuaauccacaucagaaaacccccagccaggaaguuuauauggagagauucagacugggaaguuuaagagcaggaacccuauugcaaacaaaacugcuuggguuuucaaggccucgaguugggucugaguagcuccuccccacccccauauagcacagcgugacugucaagucagucaguuuuacaguuuaguugaguuugagcuggacauuuaacaguucacuaaaagaugccugggcaucugcccugugcaaagcgucacacaaaugcuuuuaaaugccauagugaggaaagugcacucauccagcucacagaggugagugauagaaacagggucuucaugucuucaacaugacaggccaccaugauaaggagcccaucccuuaggucugcagcuagugagccggacaggagacaaugaugcugggacccuacaucacauagucaucuuuucucuuaucugacguccugugagucuuucgcuuuagcuuugauagaaccacauacaacucaccuguucagagugaauuuuacaagucuucaaagcugugcgaccaucuugacaacaaucacaagaaacccucuguuaguauucacuucccguuuucuuccaggccccccagcgcuagccgcugcaaguggacuuuguaucucuguagacgugccauuuggauaucgcauacaaauguguugguguggucuggugugucuggcuucccugacuaggcaugaugcuuuccagugucauccauguggaagcauguguccacacauuccucuucaugccuuuaacccauuguauggacacgccacauuguugacucacgagcuggcggucauucugcuuguuuuucucuuuugccugugaugaauaacgcugcuugaacauuuguguaccaguggaugugcguuuucauuuucacuucuugugguguuuaucucagagcacaacuacugggucauaugguaacucuauguuuauccuuuuuaggaacucccaggcuguuucccacagcgagggcgccauuuuacauuuccaccagcagugucugaggguuccaauugcuucccguccuugccagcacuugucacugccugucuucuuacuguagccauuguagugggugugaaguggugucucguuguuuuaccuugcauuucucugauggauuaauauugugguguuuauauuacuaaccuaggcagaaguuuaaaucucauacuuucauauagaaaccacugcauauuacuuggauuaaccaguaauucugaagcaaaaccauaguucuguaccagauaaaugucguucaugaaauuauacuugaaaaaaaaacuacaaaguaaaaugacuugggaugaagauaacacacucaccugggacauuaguuuugcaguaugaauucaucugcaguguucuuuaucugcacuacuaaaaugcuguugugugacauuuacuggauaauccagacagcacuugacuaaauccacaguauggugucacuggguaaacacuugaaaauggaaauguguaucccuucugguuuuaucaguugagauuaaaggugguuuauagcacaggaaaccuuuucuccaccacccuguaucucagugugggccaauaaucugucaccugaaaccacuuaaaauagguugggcuuucuugacuguccuguugcugugaugacaucaggaucugacugcagaggggagaaaagaacacuucucugacuuguuugccuccauguccuuuguccccaguuaaaagcacugcccuucuuuagcccuuacuucugucugguucucagauguuuucuacaccgucugucucuguggagcuccuagucugcucacaguuguuucugucaaggaaagcuccgugugagcuuggaagugugagauucaccagcccuagauauguacaaagugaggaggggcugguggaggaaaaaaguaucucaaaccaaacuccaaagaugcuuucccuagaaagagucucaggacagcuuugaaagcuccccaggacaaauaacuucacaggagaccagugguccucacuggcacagagagagccucaccagugcuaagcuuccugugugcugugcauuccugacugcauucggcacuguuugcugagggccugcaggggaccaaggagaaaagagaaaggaagaguggcuauggcuaguuccgcccuucuuaguuucuaccucugccuuaucugcuccucaucuuacugugggccuguggcucggcuggggagugguuccaaagaauaacuagguugauuggcaggaauugaauucugccaccccagaguaacgggaggcaacaaccucagacccuuaagcugguuuaagccuucgugaguucucuuuugacacuuuuugaaacacugcucugggugaagcaagcacauuguggcuacuaaagauccuggacgacuggcuaacccuggcccaugugccuucaggacuguuacagaggaacuagauaggaaucauugguagguuaguagcaauugugguuugguucugauuuuuaaagugacuagcccucaaguaacagaaaaauaaaggauggcaagugcuuguugacuggaccguuugcuaagaucgugcgaauagcugugcauaggcuccgggcucauuuuuuccauagcccucugacaugacaaggucaaccuucaagugagcuguaaugaaacuucgugcaucccagccguauccagugugcccuuagcuuaacacucaucugucugugaccugacauagugaauguaguggcucccugcucccacaaguccuaugaggaaugguggggaggagguauaggaguggagagggcuguacagcaagaacuugcccacguuaggaagccagcugacagguuuggcuguggccgagcuuauuuuccauuggauucugaguuuccuugcagcaguuuuuacagaaagcuuuaagcuccuugccuucauagucccacacaggaggggaugauggccgaggaaaagcggauucauuuguuccuguaacaaaagaaucaaauguacuucuguggaacaaaaaugcauuggaaauuuugcuuguuguuuucuauuacaaaauugaaauaaaaaaggaauguuaccuguacugauuuucuuauuucauauggaaaauaagaauauguugccgggcagugguggcacaugccuuuaaucucagcacuugggaggcagaggcaaguggauuucuaaguucgaggccagccuggucuacagagugaguuccaggacagccagggcuacacagagaaacccugucucgaaaaaacaaacaaacaaaaacaacaacaacaacaaaaaaaaacuuuaaaaaaaaauguguguguguguguguguguguauguguguguguguguuuagagccugcguaucuuauuuccuuucugcaagcauuguuaucuacagucacuggcucaaugaacuuaucauuuuccuggaccacuguucuauaaggguucuaaaaucaaucaauaucucucucucucucucucucucucucacacacacacacacacuauuaacagcugcuugcuccauucugacuugugugcuuuccagcuaaggugagugugugcagugccgugacuaacgcugcacuccucucacagaugcugucuagaggggagcucucaagucagcaaagccccgaccuucccucacccauuccuccccaccaccagacucucguaggagcaauccuuucaucugccccuaagugaccuccuuggguagaccaugcccugagucuggcagcuuagucuauuuccuaguagaaacucuuuuucucaguuuagggaaauuuuauauucgcugugucuuguucauaaaaguauuccuuccagagugacacacggugaaaaugagggugggaugccuuaauuaggagacuucguugauugcuuccaauaaguaaagcaauuaugccauguaucggaauaugaaugcaaaugcuuuguaauauuaacccuugauguggaagaaguagccuggccuuugaagucagguaauugcaaaacuaaugcugacuggaugccaggcacuguugcaagcuccuuuauaaguugguucacucacgcuuaccucagcccucugagaguguucuauuaauaugcccauuucacagauaggaggaaaccuggggugggauuaagaaagcuguugugagugugggaaccagcaguugaaaucaaguguucugucugaguccgagcuuccgaugcuacacuucagucuccagguagcucuaggagcuacccuguccucacgguacuuugcucacccauaaaacugggcaaggcucuuugaagaguuaaaaggagagcaaacauugcucuugcagaggcucuggguuugguucccguugucagacaucucacucuguugucgccuguaacuccugcuuaggggauccccgccugcauacccacacagggcugugcacagaauuuaagauaaauacauuguuucuuucaaaugaauuaaauggcuuacuaucaagcaugaccggggauucuuaauggugacucuacaccuaacucauuuguggguuucuuuuguuucuuguuuugguuuagaccccacccagagaacucgugauucauuucuauaccccaugguauguggucucuuaugaccaauguaagaucccugucagaauuacuucagaguaagcagaguggcuuuuuaaaugacucuuguugaugacuguauaccucauuucaguguuagucagccaggacuaagacaggacaaugggaaagggccagccucauaaccuguaacaguuguuccugagauacguaagcugccgcccucgcccccucgcugcugaaagauagcguauuuuauaaauaaccgaugcaacugaaaaggaacaaauugguucucccucuguuugauagcuccucuguugacacccagugaccuaucucaaaaguaaaccuuuaaaagacauagaguguugcccacaaacauuuuacauuuuuagguccaugaacaguggagcucaaaagggcuuaaauauucugacugauacaggcuucucaucaccaggucccuuacucagagagggggaggcacuugucagcacacugcuuuccaaacgagaaaugagcuccccaaaagaacaguugccccugcaguguuuuauauaaugagaguuugagauaauugcuguguugauacugaagcacuuuugauuuauaaagcaagcauucauuuaagaaaaugucacauaacuugaaaauuguuaucugaacauaugauuuuaguuuucuuuugcaggaacugacuuacuucaaggccaugccauuuagaucucaggcuaagccaaaucaaaggugacaaggcacauuaaugaccugagaggcugggcuaucucacaggguggcacuaucccauucgacagucauuuauugagugcuuacaagacacugugauucacauguucaaaggacacugucccaacacuuaaguacaugacagagggaggcagugacauucagcugcuguuaacgguggaggaaaauaugaguaugcaggaggggcccuggaccgagccaggaguagaacaggggaggggauagggcugagcuacaaagcuuccuguaggacggacagcuagagugauuccuagaggacagguuacuguagguggaagaaccuuccagcuggucacuuguggacaguguaaacauccugccuaaccaacaucaccuuggcuacagggaaggccugauggucaucugauggcuucagucuuagaugaucuacuggcuucagucuuagaugaccuacuggcuuaagucuuagaugaccuacugacuucagucuuagauggccuacuggcaucaggucguaacauuauuugaacauuuuuaaaagucauuuuugucucacaaugauuagcuaggcucagaagcgcaaaggaauaagauauuugggacuugccuuuuugccucugguuugugucaccuacucuccuccauuuaccacuugacaggguuacauaggaacaagcaacacccucagcaguuaggccacugggaaagagaagcccgugccaccagccacaguaaaccuuauccccagugucacuggaauugaugccacucugaccaguggauccuggugaccaugucagugcccuuuagcagacuaaccucucuauacuuggcucucuucucaagauaaggaauaauaauagcuccuuacuauaccacacuacccuguggacauggggguugaggcugacacugaaugaacucacuccuggggcagcaagaacaauuuguuagcuguuaagggacagagucccaguuccuuucaugugagacuaagacacauacaaggacuucugcaauccagagcuccauuuucugcagauacuacuuugucauucaagccaguguguuccuuucauagccacugcuagugugcuaugugccagacacuguucucagcaccugggauagauaaacucaggaaucaguccacacagagucugagcuguggugugggaguuaaucugacacauuucauaacuggagagagggagaaggaaggaaggaaggaaggaaggaaggaaggaaggaaggaaggaaggaagagggagggagagagggagugagggagagaggagagagggagagagagagaaagagagagagagagagaacagagcuuacaaggcccagaugcuacaagcccuaccaagccauuguaguaaaaacugagcagaaugaacaacuacuagugacuauugagcuugcaggauauaguaggcacuggguucuguguuuuauuugaaauaagcagaugaagccuuuauguaaagcagaugacacuggcuccaagggaggcaauggaggaguuugcaaagacagggcucucugauucugaaaugcaccuugguagaaggguguguguguguguguguguguguguguaucacaagauugggaauaacaagauuaauuuugggcugcacuuggccuccauguaacccccuuccuuguucaggaacuggggagcaauuuugguaucugugcuuccagaaggacuagaccaaagaauccagccucauaaugcucacuccuuggguguuuuuccuggagcacuaagcagguucacgguccaagguacagcuucccugcccauuuuuaaagaccccagcauuucugagugcuuguuacagacagaggaaaaaaacuaaacuacagaaaacucaguuuccuguucuugguuaugaccagaaaaugagguggcuuucagagcagcaucagugacccgugaaccugcacuuuagaugugacucacaguaguagccuguggaaacuggcagacuccuuguucuacaagauguuauucugagccaaguaaacacccccaaagucaagaugcuuguuuaagaccaaaccucaagguagaaugugaaggacgggcagaaggcuuauugaaauacgucagcuuauuuugcaggacaaaaugaaaaccugccagacacucuuaauucauacauuacugauuugaaauucaugaaaccauugaaggggcuguguaauaauaauaauaauaauaauagugaaggggcuguguaauaauaauaauaacaacaacaacaauaauaagugagagucuuacuauuuagcugccuauuguuuauuugcaaagcacagugcuggccaucaacggugcaauauaagugaccacuggcuucuacccuucugacuguguagguaauuucuaaguauguagaguguaguauaacuacccuaagcuguguccugauuccaguugcucuacacagaaucaauuuguacuuacccagcaacaaaagaaaagagaauaaaacaaagaauaauguggauggugaguguaauuccaucugcauuuccagagagagcagccugcuguuccuuucaguugaccucagcuuccuauugcuuucuccugucucccaauguaagauuccauuguaucuaguguuugaagauaacauuuucauagaacauagcccuaggaugcuauaucugcuugcugugagcaaagaaguagcauucuuuccauugcuaaaacuaaugccagcugugcuuggccucaccaaggggucaguuuuucuuugacuucuaugauauuuucaucauguucuuuggcuagaggguuuauguucuaaaagagauacaguucguuguagugauagauguacagggcaaagucaaaccuuuuauaaauucaagaaucugccaaauugggcuggugagauggcucaguggguaagagcacccgacugcucuuccgaaggucuggaguucaaaucccagcaaccacaugguggcucacaaccacccguaaugagaucugacucccucuucuggagugucugaagacagcuauaguguacuuauauauaauaaauaaauaaaucuuuuuaaaaaauuaaaaaaaaaaaaaagaaucugccaaauugggaccauagccaaauuauugggcuucugucuguagcuagucauugcccacauuuuuuacaaaucuguaaaacaaagauaguuauauuuacgucauugauaucacaauguuuaaaugaauaauaaagauccugacaagcacguggaaguccauugcuauccaucccugcaauaaguaugaauguagucugccuaugaaaaccaaggacagggugucggcagaggggugacauaaucuaugugauuuuagaaaagaugaccguggugacuggagaguucaguacuuggugugcugacauggggaccuguguucagaugguuugcacccauguaaaaaagucaggcaugguggcgugugucugugaccccaaggcucagaaggcacagacaggaagaucccugggacuuucuggccagcaaaucuagcccaguugguaaguuccagacuugaugaaaauuugacaucuuagggaaaaaaggauaauaugguggagaaggaugucggaagauacccagugccaaccuccacaagugcacacagaaaguagagauuacugugguguccgggcuaaaccauagcaaaccuagaauaaggagauacuggcauauuggcaaagaugagggccugagcaaaagaaaaugguaauaguaugcauggaguucagaggucaaccugcaggaaucgaacucaggucaccaaauuugagggcaagcaccuuuaccugcugaaccauuucgcuggcccaaggcuuggcaguuuuaaaaguacaguggacaggacauaggaaccacuuagcuaagggaacauaggaagaguucuaaagccaaggauggcuuugaguucuucaggucuguggguggaaugauagaaagguugggcuagcuggggcagagaguaauaaaagguacugcuguaauacaggcagaaauuauaugccugguguugagcuaaagaacuuaauguagugcuugguuuagucaucaugacaagucugcagugguaagcaguggcuuugccauuuuaccacuguggaaauagaagcucaggggaacccagagccuugggagaaaacaugaggacaggcaugugugacagcaaaggcuacuuuuaaaccacuuuaaguaaacucacucagcucaggguggcuuggaacuuauuacauagcccagucuggcugcaaacucaugacaguacucccacaucagccucccaggugcugggauugcaggugugagccaccacacugagcagaguggggauucuggaucagaaaaagcugcacuggaauugcuaacauugggugaggucucuugaaggcagcuggaaaagcagaccugaagcucaagagaggguuagggucgaggugggggugaugggaagaugggagcuugugcugugggacaugcaugaggccgcugagcagggccagagaguaacugacuaaagagaagcauggccuaaggacgugaggcgagugcucgccuagccuugggcuuuaagaaugcauguacuguugagcuguguacgguuuuuuaagaaugcauguacuguugacuguguacgguuuuuucuggccagguuuaaacauugugcuuugguguguaagcuuuucaucagcaccguauuaaacuguccauuguacaguuauuguuggagcuuaguuucagagcaaauagauucuucaguacaaaagccauuagacaacccugacaaggcauuaucaguuagagcucaccccaaaguuuugucauggggcauucuuagagaguccuacauaagcuuaaucccaaagccaggcucaagggcuaaagccaaggaacuagacucuuuccauuuuaaagaaacacuaagaagccguuauuuuccaccuccugucccacccccuugcccuuuugggaccccauagccccauggaaacucugucccucuuccauacauauuagaucaaauguguacucugagaugucuuguaucuuuccccugggugcaucauuuucagauacaagacaucucagaguacacauaggaccuggguaaaacugggaagcagcacaucauuuccccacgcgucagagcagcacgccucgggccucugguuuauaguaaguagucugaucuuccguuauaaccuuuaccuugguaggccucuucauuuuaagaggcuuccucugugcuaaacauuguuaacacagagaccuagggugcuagaaagauggcucagcaguuaagagagcucacuguucuugugaagaaugcugguucaguucccagcacccacacaaagguugccagccaccuguaacucggcuuucaggagaacagaaguccucucuggcugccagaggcuccugcauguacaugguacacauaaacucacauagagaaacauguacauaaaauggaucuuuaaaaaauucaauaaagaaagccaggugcuguugucacacaccuuuuaacaccguacaagggaggcaaaucucugugaguuugagaccaaccugaucuagagugaguccaagacagccaaggccauacagggaaauccuucucagaaaaacagacaaacaaagaaaaaauuagaaagaaaggaaaauucauagacgaacagaggcgcugggguuugaauucuugcugugcuagucacuguagggugcuggacagcacacuuagccucagugcgucagcccucuacaagugagguguuaauagugccuacaguccacagggccuggugaggacaaacaccauucuuggcguacacaagacagggcucuuaacaaagcagcaucuguuggugagggcucauuucccagcccagcacagaucccuccaagccagcucucaccuaacaugaagagaagaguguaacaucuagcuccacuuugugagcaccuaauccauuacuuccaugccagagaaaagaagcucucuccuuuuuaaaaugaaggccccugcuuggugacacacaccuguaaucacagggcucaaguggcaggaccaggauggugaauucuaggccaaccugagcuauauagcaauaccuucauauucucucucucucucucucucucucucucucucucucucucucucucucucacacacacacacacacacacucucucacacacacacacacacacucucucucucucucucacacacacacacacacacacucucucucucucucucucacacucacacacacacacacgcuugugcauuagagacacacagcaccuucuugucccacaccacacaguauggucgauuucaaagccugccacucuuggggacugaagcgauagcucagcaguuaaaagcacucuugcugcucuugcaaagcugaguucaguuuccagcacugauaucagauggucuguaacugcaacucuggggcaucugacacccuuuucuggccucuacaggcaucugaauacauucagacagauacauacgcauaaaugaaaaugacuuuaaaaaagaaaaagaagucugacagccaggagauagggcuuuggaagcacgacguagaaaaaugucugguuuaucauaggcacagugggcaagcaagcauccagacuuggaugcuaaagugucugaucauagggggaugcagucuucucuuuguagccgaaugaaauuuuccaggagaccuuuugagcugccaguugacagcccuauaugacaugucuguugggcuccuuuggcacucauggcaacaagaaacaaacccugcaguuuuaaauaagcaguuagagagcucagagcagguggucauaacucaguaugaagccaccaaacaccucaucuuccugacugacaccuuucuaaauucucccaaagaccucagaauaccucccucucucaacagcgacaggcuuggcauuguuagugaaggaggcccauggccuucuuggaccucucugcaggucccacaggcuggacuuacaaagagucuuuugaccaggcagcgguguaagugacuuuauggaagacaagccagcgcuuguuuccucucugugcuguaaggguuaagagucaucacuguggucaccaaggucagacaccagcucucagugugcugguuccagccacagauguguuuggguuggccaggggaguuguauacacauguaucuucgguugcaacauacaccaguuagaaggguucccaucagaaucagcauuuccagcuucuuuuaguacugucucugacagcacaggcugccguguagaggcugucugccucagugacauggaggucccucauugacccuucuaccuugacguagcuucagccuggccuacuuccuggaugcagguuuaacaguguuccuacagaguccugugccauuuucucuacaauaaaagugaaaaguacaaauucuccucaucacacuccugaccuaauuuuaacaaguugccaaauacugagucucaggccuacagugugcuuuaagauauaauuccuaagggcagcauucuuugaucaauccucuuguaaagucacacaguugaagacgaucccuaccugcugguguuucugugucacagcucuucucccucugccccaugguucccagcaguguacaugcuaaacauauccuuaguuguccccuuuuggcugcucauagguuugaagcuaggcugucuguggggaagggaguguggagcugcagaggggaaacgagauaccuguuuggcuuccacuggcuugaaaacugagucaugaguccauaguacagagguaaugugaacaagucuuugcaaaucacugcaucaguaagccguuugcccccaccccuuacacacccuuuucucacccguuguauggccagccccucucuugguuccauuuagacuaccuaaccuccguuggcaaaaucugcccuuuuccuaccaccucauuauucucuggccaccugccaaccacgugagggcgauuugaacacugcugaaagcaggccagcacauggaguccuuagagacgcugucauguagucaugaccgugaggaagcaugucuccuggaacugugggucacgucacuccaccguugucauauuucacuuuaccaucgcagggguuuugugcauuucuuccaauucccaugacucugguuucacaugaggucguggacuucucaaucaaaaaguugcucauagcuuugguaggucugaaauuucagaguauugagcaaggcccgcauugugcuagaacaugaucuaauaagauuggacugucaaaacaagaagcagcagucuggcuaaaagguuuuuaagcaggaaaucuguccugugagaaccuccaaaagaugauaaacauguaggcugggggccgauuucauuuucaucucuaccaugaacuuaagcagacugaaguagaggcagaaaccguagaugcuaucuuuugguugggaaacuaauugguuguguaauuagcugugugaaacaucaggaaaauaugugaaccauuuuguuaggacccuacagaguacuugggacagagccccaaaaugucaaguagagacgaugcgucacucagagugcagucggagagcagggaguuccuuuccagcccaccaaccgugagaggcggcaaguuauguaaccuuuuccgcuccuuggucuuuucaucccugacaugagaauugggacauuauaagauguucacgggggauaaaaggaauaaucuggagcagugccuggagcuggaggaguggccaguaagcgagagcagugacugguagguacaucgcaaguaugcuugugcauucugaucucagcacaguuuccaaaagaagaucggcugguaucuuaguuuucugcucuuuguggcuccucacuaguggaacccugugaagggaaacaucuugucauucucugcaccauucucuugucaagagcacaucucagugaaggcucaggucaggauggcccuggcgaugagucacuguaguucacuuuggccuccuccugaagcccacuuuuauaauuuuccaguucaauuauuaagacacugaauaucugcaucauacuacugcuggauugcaauguaaccacuaaccaagcauguuuaugcaaugccuuauguguaaucacuuauaauaaaaguaaaagccgggugugguggugcacgcauuuaaucccagcacuugggaggcagaggcagguggauuucugaguucgaagccagccuggucuacaaagugaguuccagaccagccagggcuauacagagaaacccugucucgaaaaaccauuaaaaaauaaaaaauaaaaauaaauaaauaaaaguaaagaguauggcuuagugauggcuucauauuggcuaaaggggaaagcccgcgccgucucucagcauguuagauuaaucccugcaguggaaacuagauugauucugacagaguagcuggaagucuagucagcugccugcuugcuuccuccuugcugccguuguguaaugggcaaaggugugcucuggggaccacugaggcauuugguuuugccccuggcagaggacuuggaucugauucccagcagcagcagccgcagcagcagcagcaaaagcggcaaucccuuuccucugccgagucauugccagcuaaggaaacaacuguccucaagugcugcgugggaucagacaccagagagaaagaaaucccguuagcucauuuaauuaauuguuuuacuuaaaacccaagcugggaagaaggaaaagaaaucucagucugugaaguccuucauugcaaaugcggggaccaguaucggguccccagcucccauguagucagacaugguggcacaagcuuagggucccagugcugaagggguagaaaugugaucuuucaagcucaguugucaggcugcccuaugccaagaacaucacaccgaagucuaucuccuggccucugcaaacauggacacuccgcccucacacaggcauauaccagcacacgcaaaugugcacguauacacaauacauauaaguaaaaaauaaggcccaggggcaguugggaccagaucacaccuuuaaucccagcaauggagagacagaggccgguauucucugcgauuuugaggcuagccuugucuacauaggguauuccaagacagaguuacauggugagacccuguguuuaaaagaaaagaaaggaaggaaaagaaagaagaaauuaaaaggaagccccaaaucaguauaaaauccgagaauuuauguuucaguuuccuuaucuagcucuccaaagaaaagggucccacugucgucguccccccccccucagucuuuggaaaauacacagauaauaaaaacaucaacuugggaccagacaaauagcucaucaguuaaaggcacacacuacuggaaaaggaccugacuguucccugcaccuguguccggcagcucacagcaaugcucacucuggcucccagugaucugaaacccacuugugcacuccccggcaucagcacucagccauguacaugcgcacacauacacacaucauucaaaauaaccuuuaaaacaaaacuuguuccacauaguuuaugaugucaccagggauucuugaugagguugucagccuguguguaccguucuguuacuaagcccugcuuuuuucggggguguugugcaauaugucaacacuucccguuucuuuccuguaaacugcagcuuuucuggugauuaguauucaucgucuuuuccugguuaugggauugucagcugcagucuugagggaguucccugccugcuuuggaaacaaucugaagagcugaauguguuacuuggaaauuaagaaauuuggaagcauucaugggaacccaaacgguaaaacaaucaagagaugguuaugaucuugaaaaucagauaaugauaggauaacagaaggaauaaucucagccuuucuaaaagcuuccugaaacguuuaauggacacgugugucccugccccaugcuuuucaaaggauggauguucuuguucuaucucaggagcugggcaaguugugaugcuucaguuccaucccucagagaacccugacuaaugcacauggccacugcagaugcuucagauguggcuuuguaacuuagugccuugaauuacccaggguuaacgaacucuaucuucuaaaucccuucuacagccauggugccgacacacaucagugacaccuugucgugguagaagaugggcuaggcaaaggcaaaaguacuguuuucagggcaaggaguaugcaguaagcagcuuucugcccggggccagauggguugggacagucgggagacugcugauauaaugaagaacaaggggccuguuaaaggguggaagaaaaguuucucagggagugacuucaaacugaaccagaagagagcaagacaaauagaacgcagagaguccagcaagugcagaggacggaaugaagcacauguaaagacccgggggcauguggugucugagcagcaguacgaaggcagauggagcugggauauagagagagguagaacuaagcccugauuguaaggaaaccaagcucugcuaaaaagucaauuacagggaggaaacagugaagaauuggcuuuauuuauaauuuuucagaauuaaccuaguucucuauuauuucuccuuuaauuuuggguacuggggauagaaccccaggccagacugugguaggcucuuucagcccugguugccuuuccuuuauagaguguaauagaauuucauugcauagcucaggcugcuccuucaaauacaugauccuccugucucagccuccugagugcugggaauacaguccuaaauguguaaaaccuugaacgaaagcuugugugcccaaucugagccuucaaugcccuugucacauccccagcaccacacaaugcagagacaucucuucacccccacucucagcuccuugugccuuagacuauccccaagaacuucccugggccccacguuccucuguggacaaaggagacauccuggugaaaaaggagaauguauaaugaaagcucuugaucggugaguagaaguuggcuuugcagaauaaauugaagagucagagaaagucagcuacuggaggugagaugcagucuaccguucaguagcagcagcgcuccugaugcacacccuuccucuccgcuuccaccccccagguccuccuggcccccagaguaagcagcuacagaucauacagggauugcaugguagcgaccugagauaaagggaaguaagaauagcuuguggucuucaaagaccgguaaucaaauaagguggaaacaugcagagaugggaauugcaugcaugaaggugauaauuuguucaaaauaauauagcaaccagaagcaaagucuuuaaugccuaagugaauauggaagcauuuggccaauuccugcccaccauuaaaagcuuaugcaaagcccauaaaucagaaauaugcucuuuagacuugcaguuuccuuucugggagcuuugcauuuuucgacuugugacuacucccugaaaacaaccaagggcaagugcugguggcaugccagucugguuccccccacccccccaccccagaagucggguuggugauucuggaagugagagucuuuugccaugguaaauacuaugucugggcccacagacaagcauuccauacauggauuucauuugcugugcaccauugccuagcaguucuguguacuguuggugaugcagcaggcaacuaagggucagggcauggcaaaggauaagaagccuguccuagaagugugagugaagcagagguguggaagaaacggcaggagaggagcuggguccagggaaggggggggggggaaggaaggccucugaaugagggguucaugggagaaguuaugcuaaggcacaggcagccacaggagcugacagcagaagaccucaucucuagcuuuucacaugugacuagaaucuaucuucacucucucauuuccuguuguggggggggggcggugcagagggaagggaugucacaugucugacucaaggcuaaggauggauggcacuguggaggauuagagaaugugagccuuugguggcagaccaauccuguguaagcuguagauucaggagcuacauggccucaggcauuuccucuuccuccauauccagugucuacugucaaggugagacagcauccucuuuaaugcuccaggaugacauggacgguguggaacauagucaggagcugaguugugagucacaggccgaggcugcuucaacuuuuccaccugagacucuuccucucgagaguuuaacuggaaaccagguacuaucuggguauguaagguaggcauaggaacuauucacaggccgaaagcauacacauacagucuuaccauuuauuaaagaugaaauuaauuugcauacugaccagauggauuugcuuguuuccuuuuauauaaagaugggaucuuggcugaguguagaacaccuuuagcauuuuucagagcugaaucaaacauuccaacacaauguaauccaaagaaugcuaacuugauacucacugaggaaugacagugggaaaauagggaaaaccuuuguugucaguaaugaaaccuuuguguuuccuauaagagcagaagaacaaagcaguuacuaacagagccaugaggaaucugagucaggcugcugcaggcagcacucguuggcauugcacaguaugacaguaggguccaguacacaguuugaguguuacaucguuaguacccagguugcugugaagucacggggguaacacaagcaggcacugccagaaacucgaaaacucuuucacgucguguggaauuuugaagaaguggucauuggauguucagaagcuugucaccauugccaguuguuuuaguaggccccauaucagucaugugaccccauguggugucuggacuagaccuguuuucacaucaccuugcuuccauguguuagcuaagucauuuuguagucaggagccuccguauucccaucuauacaauggcagaauaagugucuauggucauuccagaacucagcuaauucuugagaggugcuugguggcacaguguugggccauguggucaguaacaaauguuauuagcucccuaccuccuuucucaauugcagagcuggucugaacguuccauaggcuaaggagauguugagguauacaauuucagggcccuugguaguuuagucauuguccuuugcuaagcugcauuuucccuggaggcugugcccuucaggcucagcugccuacacucacuucccuucauccuagcuuuguucacaugcugggcugaugaugacaaaugccccaucacguccagacaagcaggucaauggcacacuccccucagacucuggucuccucacuugagguuucugccuucaauagcacacacuuaggcucaguauaacguacugcuguggaaagcauacaacaaaugccucuucucgcugccuucucgggaaaacaguacuaauaaaaagcagccgggcagcgacaugaagaagugcgcgacugagcagaaagucugcucccgacacauuugcagcacugaaggugugugcugcucagccagagacaggacaccuaaguguucaggacgcccaggcucagggacuaauuagguauuaguuaggacagccaucaggucuuaguaacugucauuucuucacacacugccuccaccauccuaccaaacuuuaaauaccugaggaaaaaauucugauggucuuguuuauuaaaccuaagucagcugcccaucagagauaucgauccauguauuggccugaaugcagccuagcagcgcugaugauaguaaaagaacaagcaggaagacuguuuuauuguaauuuggggaauaagccccuguugauucauauacacaugugcaucuaagcuguggaaagcccagaagccauauagaaauagauggauauugugaugauuuuaagguuauucauuacaaaagccaacacccugaagaaagucagaucagcuaucagcuggagagaggcgggggauugugauucaacugcagaauguccguuuccugcacaaaccuuagaagucaguucagauaggacaaaccaacuuauacaaagucaaaggacauaaaugggcuguuccagaaaaggcauccccaaucaucaguaagcauauagauguuaaaacacuuguaaguaaaaugcgccuguccuuuaaaacuacaauagcaaguuaaauauuucaacuaggcaugcuaguauaugccuaucuucccaaaacuuggaagcagguacaagaugaucaggaguucaaggccaaccccagcuauguagugaguucaagucuuauccaggcuguaucaaaaguaaaugagcaaaacaacaagugauugagugaacagaugcauacauacucaugggaccaugggucuauguccagugauguugacuucagcaucugauauaucagccaacuagaagcuggaggcuucgguucaggaugaacugacaggaaccacaaguacaagcggaaaccauggaaggcaagcagggcaaaauucauaaaacccaagccaggauacgaugucaugaguccagugaaacccugcugcauuguccugagaguuuccagcuacugggaagacaggcgagcuaagcagccccgugcuguccuuguguggaaaucauuuggaaacaaagauagcuaaacuaguauucgagaacugcccaagacacaaaucuagaucuccagagggaucucguguccccaagccuucagugaaggaccaaggacacacacgugaggaaaccucccaaaguggagaacuuguccaagaggagagggcuauggaguucaaguguagggucacgugauuagugugugugaagacuaacgcuaaaggaaaaccaaaccagaaaacuggcaaagaacugcugagguagagcggugccugggacucauagugaugaugggacaagugugugugccccuuucagccagacgggggacaaauaacagauaaaagucauuagucggucucaauagagcuggucacucaggccgguaaucccagccacacagagugcugaaauagaaggauccuaaguacaagggccugagcaacuuagcaagacccugucucaaaauacaaacuagguuaggcuagugcugcagaugcaggucgguggugacaugcuugcugcgccagcuaggcagauagaucccugugcugcuauggagagauggauaaagaguccgcagaaaaaucaagagcuaaccagccuggcauauacagccaggaacaaaagagaaacccugucccaagcaagguggaaggugaagccugcccaaccaccaaggacugccuucugaccuuugcaugugccucaaaacaagccuauguacucauagauacauacauauguacucacacacacagaagcacauauguacaugaagacaacacacacaaggcauuccuccuauuuucaaccagagaagagauugccuauauuacauaggaaaaaacaggagacugaaaaacagauaggcagccaacccaaauuaaacuaggaauaaaaccuauaugacaacaguaauaaaguauaacuuaauuauauaauuuaaaauaaaucagagacuugagaggcucuuuggugguuaaaaagcacauacugcucuuccagaggaccugaguuugguucccagcacccauguccaucuguaacuucagguccaggguauaaacacacacacauacauacacaaauaaaguaaaauagggcaaaccacuggguaaaauuagugacaacuuagacauuuuaggguuuuguuuuuuuuuuuuuuuaugaaaaauaauguguguagccaggcagugguggugcacacuuuagucccagaacucaggaggcggaagcagguggaucuuugugaguucgaggccagccuggucugcuuugugaguugcagaacagccagcucuacgcauaugauauuaaaaauggguaauauaaacugcacaacucaauucuacaacaaaauauucuugcuaauaacccuauagagaaaacaaauggaaucaagaagaaauauuuaaacguugcuuuaagaguggagaguaaagaaugggaacaaggucgggcauaauggcacaugucuaaaaguauucuaguucucaggagagccucagggggcagaucagguuuggggccagccugauuuacagcuucaggccaaccaagauuaaagugaaaaauugucucaaaagaaagaagaaugguauucuugaccccagccauauuauagcaggccuaacaguuaaaagacaguugucauccuagauaacaaagcaagacugcuauauacuauauauagagucuaguuuuucgagacaggguuucucuguguagcccuggcuguccuggaauuacuuuguagaccaggcuggccuuguacucagaaauccaccugccucugccucccaagugcugggauugaaggugugcaccaccacgcccggcucacagagucucuauuaaauauaaaacacaagguuaaaagaacauaagagcacuguguacacaguuacagagauuucaacaguuggucgcuacaguggaauuacauuugaaguuaacagaaaacuauucggaaauuuccccauacuugggaaauagucagcuccccucgucaccugaggguuuauucuccacaguuuuaaaguaauaaauacaaauagaggcagggcaagcggaucucugugaguucaaagccauccuuagcuacaaagcaaguuccaggacacccaggacuacacaaagaaagaccugaagggguaaacauaaccaacaggaaacgaaguuagauucuuaccugacuuugagacuuacaaagcaguaauagccacaacaguguaguauaagaagcaacauuuuagaaggccugugaaacauuuucaaauccaaaauagacauucagaggcagccaguuaauucuccacaaauguauaaggagaauucaaggauuuuucacaaguaugagacacagcucacugagaaaggaauaauucucucaacaaaugauaguguaucaacuggauauacauacacagaaaguaaauuuugagaacuggcaagauagcucuguggguacaggcgccugcagcuaaccugaauucagucccugcaucccacaugggagaaugaaaagagugagagaaacaucagcuacaaguuauccugcaaccucccuaggucugcuggggcaagcguacacagugcauguacacacacgcacacacacagacuuguaguuuaaacggcguauauuucauacuauauauaaguuaauuugaaauggguuguaugucuuaaaaauauaaaauaucauauauauacacacacacauguauacauacauacauacuuacauacauacauacucaucuaaauucuguucuuuagcaggagugaaggaaccagugaugaacuagagaaugcuauuuuggggggcuggagacauggcucagugguaaagagcacugacugcucuuccagagguccugaguucaaaucccagcaaccacaugguggcucacaaccaucuguaacaagagaaugcuauuuuuuaugacgaaauauaacauuuuguaucaacaacauaaaaugaacucuagaaguucacuaagaaaauaaucuaaaaagguuuuuuucaagaaagauuuucaaaaggucuugaaauacacaaaaauauucaacagcuacuucaaaacuagauauacagcugacaagcccauaacucuuuggucaguacagaaauacagauuaaaaccacuuuacacauacgagggugcuuaaaguuuugaaaacaacauaagcuguugaucauaccaaguguuggcaaagcaguggagcuagggaggccgaccgccucuugccuggggugaaaauauuggcugaugugaaugcuuuaggaagcaauucaggagucucuuucaaagucaggcauaccauagacugcaugagcagguaauccuucuccaggguguuuaguuagagcauuggaugcgugugucauaggaagacuccugcacuaaugcccacagcagcuuugauuguaauuguucagaguuggaaaacccagacaccccacaacuuauggcugucuguauacaugcucaguggcaugccuauuagagagaaugcaguacugcccagagaacagaaacgaccagacuuugauacauacagcaaagaccaaaggagaacacaugcuauaugguuccacuuugauaaaauucuuuaccaugcaaauugaccuaagugacugaagucaguugcugccuuggaggccagugggagccagaggugcagaaguggguaauuacaaaggacacaaggaaacucuagggugagggcuuuggucccuauuuugauugugauguugcauggcuguauacaccugucagacguaccaagcucaguccuuuguagaccagccaugccucauuaaaggggaggaugguagcugcuuagcugcucauuguuagggauuaacucagugaauuccagaaggcuacagaacagaacauuaugcaacugaguuuuaaaaggaaguuaaucuguguguccaauauaaaaugaucccacaaauaaauuaauaauugugaaauacaaggugcaaaauaauguauguugagccaugcauguuagccaggguuuaaaaggcugaagcaagaggcucacaaguucaaagccauccuaugcuacauagccucucucaaaacaaagcauuauauauuaaccuuuaaguaaaaaugaguuuguauguauauguguaacacacacacacacacacacauauauauauauguguauauauauauauauauacacacacacacacauauauauauauauauauauauauauauuguauugcauauacauagcaguguguguaagggauacauuuauaucuaagaguaggauucugccccccuuagauuaggguguuccauucacuuuguugauuuuuuuuuuuccugauaugcuaagaaucaaguacaagggcuugccugccagacaggagcucugccacuaaccuauacccucaacaugagguuaguuguauauauuuguaaauuauacacacauguauaugccacauccauauauguguguguauguauguucuuuuguacaugcaaaaagaaaacugauuacaaagguacagaaagaggaaaaaagaagagaaagcaaaauggcaguuuuccauuuaauuguaacugucaauugaaaaaauauauaauugacguauaagccaggucugagagauggcuccaccauuaagagcacccauauuguaucccauggcugccuuuaacuccagguccacccacaaacacauggcauacauagacacauacaugugaaaaacuuuuuuuagacaaauagaauugauuuuguugagcaaacuuggaguuccagcauuggggaggcuaaagcaggagggucugaacuuugaggcuagccuaggcuagacacuagcuccacaauaaauaaauaaacaaacaaacaaauaacuguccaagaacacauugacauacacaagaaacuaucguaaguaugagugagguuuuucuacauuucuagaaacuccuggacugggaggguaacuggccuccaccagcuuaguaugugcaaggccuuuguucagucuccacaaccauaaaagagcaaagguguuugcuuuaauggaacuuaaccuuugagagaaucacacuggccauuuuccacauuacagucuaugggcacauuuaaguggagacacugugguggguagugauggcauaugccuuuagucuuggcaccugggagcagaggcagguagagugaguucaaggccagccuagccuaccgaggccacuccagggcagccaaagcuacacagagaaacccuagcucaaaaaaccaaguuuaaaaagggaagaaaauuaaaaacaaaaagagacauuauccugccacgugugacaacacacaccuuuaaucacagcacuugggaagcagaagcaagaggggcucugaguuugggggcagccuggucuacauaguaaguuccaggauagccuuguuaggagaaaggaguaacuauacagcucugugcauuuccuccuuccuucagacuucucaggagaaucagaacuguauccaaucaauggcagaauuguaacccugacuuaugaaaccucauguugcucccaucuuuggaagagauuacucaguccuccuucacaggaucuugucacggugaaagaugggugggguuaagugaaauagucuuuguuucaggauucguuuccaugucucaccagauuccagcaggagcagaauaaguguuagaauaagguggggcucucugaauuuacuguaaagacuggagcacccgagagucuggguugggguuuguggcaguguagcgaguaucuuaugcacacuacugagcuuggcugcucaguccugaugcuuugggaacucacuaugaugccagaggcagggggcaaggagcagcccuccugugagaccaugacccacauucuuccaaaaacggcccuggucacaggccagguuagggguugagucuccagcaugagugagugacgugguguucgcagcagcacucucagccugugcucuaauuuaggucagauggguuccacucucuagcucuuuuauuuuagugccaagggaauggcggucuuaaaauguuacagcuggaaauaguaccugaggucaucuggucccaacacacaggaggaagcgucuacagacugcuuccaugagccucuauucccacaucguggugacccuccugcucaucugcaggcuguaaaacuggguaugucuguguccagaaucaccuagggguauuuauuacuucuaagacaaaggcagccacucuugaaucacaucgaggcauuaccaaggugaggccuuaguaaagcccuggucugagcccccauuuacaucagcaaguacccuuuccuuacagguugugaaaaguguguccugggaagaguugaaagccuuguaccccugaagcugucuagccugguauagcagaagccucagcacucagacaaauucaccucucugugccccaguccccuuaucuauaaugggaauaauaugguagccugccucagagaauuauguaacaccuuaucaacugagguauguauacagcauuaauucagcucuggauggaugcuggacaugauggcacacaucuguagucccaucacuuucaaggcagaagcaagagccugucuuguucuacaccugaguuccaugccugccuaggcaauacauaacaaaaguaggugggugugggagugucauagcauugagcagcucaguagacucgugugggcuguuuccucaccuagagugcuuauugaucaucaagcccucacucgcacgguacugggaagaguaaguacuagaguaauuguuacucuugccaaagaacccuccugaaaagccaccagucaccuagaaccccauaaccaucagaccacugagguggggaguuuaaaccaaagccaggugaauuaccauguauguagggcuccuaagcaucaaaccgcugaggugggaguuuggaccaacgacaguugagccaaaggagaggaugugauggccuaggagugagugggaagggguggcuuuaaggggaagagaaagaaagacagcucuggcuaggugaaaacaggacucacuuugggaugcaccaugaagaagugaagauucacuccacugcccucaggaaggaagcuagccuuggagacccauagcucuaugucauagcaucagaaccacagaccauaaacccaccucagaaagaucaacauauccuagacauccaaugggaagcauuccuuaagcuuugaauguucaucgggugcuaaauaaaggagaauuuagaacauggcaucaaggagggggaaaccauguggaacgggguccccaaguagggacagguagacuagagaucuugcgucuccauugacucagcuguagaccagggcuagcacuaggugaccgcagcuuuuucaguuugaauauaaugccaaguccacuaaaaagcaaaaaaguccaccuguucccuuuacacauuaggcuccuguguuugugccaugcacuguggaaguacagccaugcauucgggaagaaaacauagcauugagcaguuugguagacuccuguggccauuucccuaccugccaagugauuaucuguccccagguccuuacucguggcauaugggaaagaguagauaauacaaagauuguaaaacacugucaaugucaaguacugugccauagacagagcagccacacaaggcaggaaagcaucgugagaaagaaaauaggcauucuuccccgcugugauuuuauuguucccaccccccaacccccaccccaccccgagacaggguuucucuguguagcccuggcuguccuggaacucacuuuguagaccaggcuggccuccugccucugccuaggauuaaaggcgugcgccaccaugcccggcuugugauuuuaaaacuauguucuagauuuuuaacaacuaaccaucuugaucuguauuuuccuguuaauuggaacugcccaacacacuuuggggcaguaccuccaacaucagagugugauacuagaagucauuucauuguuuuccagcccaaaucuuuuugcaaagaacuugagacaagcuuguuucaucuccaguuccaaucacuagccgugugauugcauguauaggguggaagagccaagguuagagcggcacacaggaaauccagacucggcugcuucuaagcuccagucagcugcagcucugggacaaaucagaguugcagacuuuauugagaagaccaaagcugcuguguggacuuaaucugcuuaauuuccccaacaauagauauaaaacuaacugcaaggucacacagaggaggaaguuaucuagagucugcaguuuagugucuuguccagugugucuacauucuccuaaguaaagcaacuugauaugucuggaaaggguauguuucugucuccacuuuauauaugcuuagaaaauuggcagauuugauauaagccuucauauucacagauauccuagaaauaucuaccauaagucuauccgcuauuaaggucacaguaauaggauuguaugguuuguagaauuaaauaugcuuagcuuuggccugcucugagguuuccaguuuucaaaaaaacaugagagaaagcacuagcaucagcguugucuccauuaaauuagauaauuugcagacuaugcauagcagagugcuggcuuucagugcaucauagcucgcauuacagaacagguucuuagucugauuagacuuucacugaauaguuaagcucuugauaagagaauccagaugaacagguaguguuucgcuguugguuaguuggcugguuuugcauuuacucuuuaucgugggaggcuugugcaugcuguguuacauacaggaguuuagaagacagcauguaggguuccguugucuccuccaaacuuggaguccuaugguucaaacauaguucaccaagcuuggugcagguaucuuuaucugcugaacaucucaccgguccuguuuuugucucagaucgggucuugcuauguaaucuuggcugaccggguacuuucuguguagcccacccuggccucaaacccacagcaguccucuugcccccucacucugccacaugcagccaccgugcccauuuuagaagaauccccaugugcuggagagcaggccucugccuggccugugccuucuguguuccugguugguaaguaauggguguucaggaaggagcugcuugcugcacuugagcuuggguuucugucaaaaggagauugccucuucagugaacccuugagucuuacgaaccaguccuugauuucaaaauuucuuuugaguucucaugaauguggugagcuaccaugcaguguacuuggaaacaguccaguuugguucuaaagagagaagggaagaggaagggcggaagaccaugucaucuaauugguuugggaccuuggaagagacaggauugucugaggggagcaccagguggagaauccaguauccuacacacugcugccagcagcacuugcuccugagagggaaccauacaggaaacacaucauccugugcccaugccaggccaucagagucaaagcccuaggaguaggggaccgaggcgucuuuguaguuuaguuugccagguuuagggagcauugccacagccguuuuccaggcccaggaagagaaagcaauucccugagucacucccagggcuagucagugaccaaggccagccuuagguucagaagacacucggccaguacagggucuucccagguuaucccagccccugguucucuacuggcugaagagcagaggcaaacgcuucucucucugugcuaucgagagcugccugaccuuaaagggccacuguggggucaagcuaguuaaaagauguucuguucuguucaccguguccuuuacucacagucuguucugcagacaacugaaaggcugcuaaauuaagccauuuuucagagaggucugagucaucuaguggcagcugucggugccucgcuggaggugcuuugaucauuguugucuaaaugcacacauuaguccugggcagcaguguguugugcugugcuagggacuuacugagauaaugggcucagcccuugaggacaucaaggaaagccaaaggcucaugaguuucucucagggcaagaaaaggcauggaagccacauauuuuagcaccaacaaucuagucucucggcuaggaaaagcuugaauguauccugccugcccaguuaauauagagaagggaaguaccucacucagaucacaugggaauucaggagcagauggcaggacacagcagaacagaauugguuuccucaagggaguuuccucuauucaaucaggaaggcuuucauuaagaguugucauuucaaggacaucuggaaaugaggucugagaagccaguccaaagcacagugaccaugggcauauguuugagaagagugguguacaaaagaagaaaaaaaaugcauuaaccuguuauaaagcaguguguauaacugauuuagagcacgggggugggggguggauggguggggaggagucagaguaggaaucugaagaggccagaagucaccaaacaguugccaacgacagcauucucaugggucuuacugacaugacuagguggucgaaagugguucagggggguuaaagucacugccaccauuccugaacagccauuucaugccaugucuagcauauugcauaaaaugucuuuuuccuuagaacagcuuuucagacagguguuuuccuccaagccaguguuccugugccagugaaugcccacucagacuuggguggcuuucuuaaaagcacagggcguucgggagacagaguucauacuuguugguuccuuccuugaggccucucucaggguauugagggggaauguuagggagagccauaggagaucaccgaaagcuucuaucuaggccugcaaacaaaaggggauaaaaugguagcuguggguggggucauacauuucugauuagaaagagcaagaaaauaaugcaaguuuuugccauugccucaccgaugcuuaaggaagaacaaauugaccggaaguuacuuacuuggcagugauugaccuggugacaugacccaucgaguuagaaaaaaggaaggcuccucaagaagaaagaugucacauaauaagcuuuacuggugaguuggaguguuuaacguugcaaugcccaacaaaagaugaaagguaaaagcagauuaauauguugauguguccucucaauagaugauagcacagcauccugugaccuagggucucacaaaaucugccacaggccugugugcaucgggcacuggaauaagaugguagaucacggaugugagaggauacagcuaggaauggaaagaucgaaaacuccgggaagcugugugcuaucaugccagccuugcacuggagggagagcaggggaauuaagucuggcagggcccaggguccuguaagaauggaucauuaauuuuuuuuaaagaugagaaaggaggcuuuuaggcaggaagcacaguaaacacaucucguauccuagaauccaaggaagagggggagaagaaggacuuagcugugcugacuacauuggucagucauucauuaaguuauaaauuaguuuaaaucuuuucaguagaccugccaauuaagcaucccacuuacacaugaagaaaaggggcacggagugcagagaugggcagggaacagguaggauuuucccaggccugacucugaaccauggcuuccaugccccuacugccucggcuagacuggagagcaguaaggaagacuugacagggacagagccagaagcugugaacagaccagggccagcgucugagaaccagggagccugaggucuugauggugcagaggugacauggccaaagcuggccacaaggauuggccucacgucccuuugccguguguggcauugugcugcccaguguguggacgagugaauauucgucaccugggaaugaugggaaugagucuccucuccccaaacuaguacuuuguagccauugugucuggaaaugucccaugugacaaccccauauccugucuguuuacccuuuccuuuccagugacaugggauacccacuguugauaaacugugacuuagugugaaucacuaaucauguaauugguagaaaacaauuaccuuugacaaaacuagguuaccugugugagaucuuuguacucuugaggugagaagagucagauggguagagguuuggcucuaggaguaggcuaaagggcuucaccucgcugggagcauagguccuagccccuggauuaagucgugcucuuacugcugacuuacaacccugcucccccuccuguaggggacaugucuaaacauaauuccucucuguuguccacuggcuccuguaacacaguuuccagaauguuaggaauagccacauugcaccuacaugcuguacuuggguaacuacuucuguugcucaaccuacuuaauauuggucacagugaaacauguuuucaucacuugagauccaaauuuuauuugccagguuacuaauggccauuuacuucuguaacauaaauuaggauguugugcaagauuagcuugccagcagguugacucuugaaaucccaggcuucccaugggcucaguguaaggagcuguuugaguggacuuagccaaauacccacaaaaaauuuugucugcuuuuuuuuuuuuuuuuaagauggucugauggugaguauaaaggauuuaagacuggaguggguuuggagagucuggaguccgcccuccugccggucucaugauuuacuuuucacauuggagaagaaacagagugaagagcagagcgcaguggacauaccuucccaggucacaaagccauugaggucagggcuuucagguccuuguacuugucccucuagcuugcugccaguaaaggcugucuaacccaaaggcuaucuguuguugcuguuggaccaagacagggaagcaaaaccugcuuguaagguaaaggcucuggagaauaguuucuauacacuagggucaacagaagccacguuuccuacugcaggagcucccaaagcccccucagcuugaauuuucuccucacuuagcuuuugaaaagccagguucccuuuucacuuagaaugaaagccuugcuuguucugacaacagcauguaaaucucuauugcauugaaacucccaagugcagucaaagcccagcgaugaucacuucugacuucauuagcaauggcagugagcauuuuaccagagccaugaaggugauauggaaaagaaagggcaaguuagcaauugcauaguuauauaguuaacacgguaugagaucaaagccugccuuauaauauccugagugcugcagacuuccugcgccugccuucagacugucuauccuuucuaaauacagugccugucgucaguaaugggguuuuagauuaauuuuacuccagcaguaauaaguaguaugugcugagaagugagggccacggaaauguuugugauagggcaucauguggcuucagacgccuugggaucugaauucagaaaaaggguuuuacaaagaucccacaaaaagguggcaucuacagcucuagacugagauucacaauugacuugauggucaaggaugagcggacaggcugggagaacacagaguaccuagucccaagauuggacugacccuggggaaaucuugucagaauguuguguguaacucccaagcagagguacauuuuagauggcaccugguacccggcugcuguggagucuccagcagugucugguuuccuucugguuugccugccguccuauccaugccaugacuugucucccccagccucagaugucucccaaugcuuucccuugagccccuacgaugcuuaguggccuuuccucccaggagucuugcuagaguucacaggacacaugccacacguugucacggcaccgucugucccaacacaaggcagcgaacucuugucuuacuuaguguuugcagggccucucaagagugucaggaacuuaucucagcagggaugugaggaaggaaaccagcauguuucugugugcugacauucuaagggcauuugaagaaucaguggugagaaaaaucucucagaugcuuugguugcugauguaaugaacaccagggcuuuguacacaucaugggagugacuguccuuguacccaucgugaaaaauguuaggguggcagcgccugccccacagguuucccugcacucacucagcucagcuccuuuucccuuggguaacucccagcaugcauuacugucccuucugucaucacuaucugaggccucccagaaugcuccccacuuccugugugcuccccauacugugcuguaccacaagaugccuucccugccuggcucagcccugccuucugcgccuacacaguugccacaugaaaauugcaugaaucauaucuuggguuccuaaaugaggaaaagaaaaaucaguuuucuuuagguuuuucuugaccaucuuucugguuuagucuugguuaucgguucacagagagacuacuccaagaugccaugauaaaauuagacuaaaugcugagccaggcacgaugccacaugcccaucauuucaguaguggggagacugaggcaggaguucaaggucagccccaaauaugugguaaauucacaaccagccuugacaagacccugucugaagaaagaaaaaaagaaagacagagaaaacugauaacucugcaacgccucucagcaugguugacuggguugaauuccaucucaguauuaauucucgaaaauaaaacuguauuuuaagauucuucaucugcggcucugccauccaugagaccguguuugacuguucuauucuuucugcuuugaucuccuuagcagcugaaucagacuuuuggaaugagacagucauggacuucuucaucauuaguucuuuuuuuuuuuuccuuuuacuauuuaauuuagaauuagagcaagaugauaaaauuagauacaagaggccucugugugucaucaaguaaccuagccuacuuuggauaacagaaauaaauucgccuuaaauacuugccagcuuguuugggccaacguuguuaagaugaauggccuuucagucggugcugugugagaagccaucucucccuaagaguucuuccugacaauuaaaauuucccucuucuuaauuucauuccagcgcuccuaauuaugacccuguaauuagcgugcugauuacaucccugugcaauuucucugccuccuugauguucacccuucauuuauuuuuagugugcuucuucucuuggcuucugaagccccugccuaccugucccccacggggcuucuagcucagggcucagggaagcaagggaagcuugccccaucaccuccaguugccccuccagauuuacuuguuuuugucaugaacaccaugcguuauagcugacaaagagaauugcacucuggggaacuggagagcuaugguauagccuugucccucuaccauguggggggugucuacucauugcugcaucagaaugauccagaucucccccaacacuccauuaggaauuacucgccugugcucggcaccauuacauccucauaguggcaguuaccuggaaucuucauggaguuccugaagcaaauucuugggagcuuucucuucacacuuucucuuuccuuccuuccauuuucucauacccacuuaccagcaggcuguccacucaacagcaauacugucuucugugguguaggaccacaggcacccagauuuaagaguuagacacccacagguuugaagacagaaagacacaccagccagucagccucuuuuuugagaaaccguccccagaguccucgugcuuuguuuuguuuuguuuuguuuuguuuuguuuuguuuuguuuuucuggcuuugcugcuacuucauccauuuacugggucccacacuccuccuuguuagaggguaagguguuuuacuucgucuucagagucgccuaaugagauggagaagaaagcacacacaggaaacacccauucaaaguugguggcagaggcagccagugguucuggggccuggacucagcacccucacucccaaccccucacgccccaaguguaugccuacaggaaaugugacucuucucugcacaagaccuauagaaugagcagagcaucuggaagccaccaaggacccuguaaggguacaguccacauccugccacagagcuccugucuggguaccaucccagggaauuuaaagaugaguaaaagcuggcccugcccucgagaagcuuacaggguuagugguaaaacaguggcauaaagacugaaggauguguuuaccugccuccaguagaagaugguggucuccagaggacuccugagugcguucuccagagaaggcagagcccucugcucucuggaccccucuugcuuccuucugugcagcauaggcaaggccuguagacauuacagccucuguugaugcugcugcuauguucccgugcuugccuccacuaucaucaccugucuggaauauguaggcuuucaguggucagguuugcucucccugacguuucucgaaaugaguugggaaaagaucaaauguuccgugcuaagcauauugggaagccccgugaaaguaaagaaguuuuagugugacuucuucauguuuacaaaaugaacaaaugacucacaucuguuguauacauucaccagagccauguccuuagcugauccuuacuaugaaguccugugucguacugugcaugugaggaaggguuuaaaaggcuggggaguggggguggggucgaggaaagucuuagggacaagggcugaguuuaggaagcuucaucacugggugcuuucgggaguucuucagucgaucacccucgugugcuucuuccucccucugcuuucucucucugacuuugauuuuaucucauccauucugucagcugaagucucccuucaggaaggauguugguuguuagacuaacuucagacagagccaugcaaacgaaaggcauggucugggugguacguuagcguaggagguccugcccugauggccuggccacuuggucaucagaagccaacccaucuguggguagcuuugcugacaugacggugacgguguuguuaagccucaguggauuuguacccucaagcuuugacauuuuaaaauuucuuccuaggcuaaccaaugccagcacucucaacggcagaggcaggcagaacuuggcuaaaaauauaaaaauaaaaacuuucuuccguaauaaauaugcuuugggaguucaucuccuggcuuuaaaaagaaaaaaaauguaagcacauugcuauacaauaaagaaguuggggguuugguugguuguuuuugguuugcuuauuuuguuuauauuuuaugagggguuguuuugagacaacuuuacuguguagcccaggcuaaccucaaacucuuuuuuuuuuaauauguguguuuuaaguuuaugcauacaauguauauguacgccugguucugugggagcucauaaaggggcacuggcuccuccuagaacuggaguucggaaccaccauagguucugggucuaaccuggcuuguuugcaaaagcaacaacuguucacaucuugcucuuccugccucggccuauugagugcugggauuacaagcauguuuguugaaauagugucucauauguagcccaggcuggccucagaccuguagcaauccuccuguuucagcuaucaaagugcugggauuauaggugugagccacuacacaugacucaaaaaucagccuuguuuuguuuuguuucaagacaagguuucucuguguagcccuagcuauccuggaagucacucuguagaccaggcuggccuugaauucagaaaucugccugccucugccucccaagugcugggauuaaaggugugcgcuacacugccuggcuucaaaaaucagucuuaacacucuuuagcaaaaagguauaaaaaucuugcuggcauaugcaauagugucugcguuugguggcugauuaugggauggacccccagguuugcugaaaggacccagauauagcugucucaugugaggcugugccagugccuggcaaauacagaaguggaugcucacagucaucuauaggauggaacacagggcccccaauggaggagcuagagaaaguacccaaggagccgaaggggucugcaacccuauagguggaacaacaauaugaacuaaccaguacccccagagcgugugucucuagcugcauauguagcagaagauggccuaaucagccaucacugggaagagaggccccuugguauugcaaacuuuauaugcccugguacaggggaacgccagggccaagaaguggaagugaguggguaggggagcagggcggggggaggguauaggggacuuuugggauagcauuugaaauguaaauaaagaaaauaucuaauaaauuuuuuuuuagguauuaaagggaaacaugaaauaaauggggcugaagagacaguucagugacugagagcacucaucacuuuuuuuauuagauauuuucuucauuuacauuucaaaugcuauccccuuuccuaguuuccucuccaaaaaucuccuauacccuccccaugcccugcuccucaacccacccacuccagcuuccuggcccuggcauucccuauacuggggcauagaaucuuagcaagaccaaggaccucuccucccauugaugcugacuaggucauccucugcuacauaugcagcuagagacacgagcucuggggguacugguuaguucauauuguuguuccuccuauaggguugcagaccccuucagcuccuucaguacuuucucuagcuccuccauuggggaccccguguuccauccaauagaugacugugagcauccacuucuguauuugccaggcacugacauagccucacaggagacaacuauaucaggguccugucagcaaaaucuuguuggcauaugcaauaguaucuggguuuggugggguuuuuuuaugggauggauccccaggugaggcagucucuggaugguccuuccuucagucucagcuccaaacuuugucucuguaacuccuuccauagguauuuuguucccccuucuaagaaggaacaaaguauccacccuuuggccuuccuucuucuugaguuucauguguuuugcaaauuguaucuuggguauucuaaguuucugggcuaguagccacuuaucagugagugcauaucaugugaguucuuuugugauuggguuaccucacucaggaugauacccuccagauccauccauuugccuaagaguuucauaaauucauuguuuuuaauagcuaaguaguacuccauuguguaaauguaccacauuuucuguauccauucuucuguugagggacaucuggguucuuuccagcuucuggcuauuauaaauaaggcugcuaugaacauaguggagcauguguucuuauaacaaguuguaacaucuucuggguauaugcccaggagugguauugcuggaucuucugguaguacuauguccaauuuucugaggaaccaccaaacugauuuccagagugguuguacaagcuugcaaucccaccagcaauggaggaguguucccuuuucuccacauccuagccagcaucugcugucaccugaauuuuugaucuuagccauucugacugaugugagguggaaucucaggguuauuuugauuugaauuucccugaugauuaaggauguugaacauuuuuuucaggugcuucucagccauuccggauuccucaguugagaauucuuuguuuagcucuguagcccauuuuuuuaaucggguuauuuguuuuucuggaguacagcuucuugaguucuuuauauauauuugauauuaguccccuaucggauuuagaauugauaacuaucuuuucccaaucuguugguugccuuuuugucuucuugacaguguccuuugccuuacagaagcuuugcaauuuuguaagguucaauuuaucaauucuugaucuuacagcacaagccauugcuguucuguucaggauuuuuuccccugugcccauaucuucaaggcuuuuccccacuuucuccucuauaaauuucaguguuucugguuuuauguggaguuccuugauucacuuagacuugagcuuuguacaaggagauaagaauggaucaauuugcauucuucuacaugauaaccaccaguuguguaagcaccauucguugaaaaugcugucuuuuuuccacuggaugguuuuagcuccuuugucaaagaucaagugaccauagguauauggguucauuuccgggccuucaauuuuauuccauugaucuaucugucugucgcuguaccaguaccaugcaguuuuuaucacacuugcucuguaguacagggugaggucagggauggugauuccaccagagguucuuuguuugguugguuuuuuuuuuguuuuuuuuuuuuuuuuuuugguuuuucgagacaggguuucucuguguagcccuggcuuuccuggaacucacucuguagaucaggcuggccucgaacucagaaauccaccugccucugccuccugagugcugggauuaaaggcaugcgcuaccaccgccuggccagagguucuuuuauuguugaaaauaguuuuugcuauccuagguuuuuuguuauuccagaugaauuugcaaauugcccuuucuaacucagugaagaauugaauuggaauuuugguggggauuauauugaaucuguaaauugcuuuuggcaagauagccauuuuuacuguauuaguccugccaauccaugagcaugggagaucuuuccaucugcugagaucuucuucgauuucuuucugcagagacuugaaguucuuauacagaucuuucacuuccuuaguuagagucacgccaagguauuuuauauuauuugugacuauugugacucaucacuuuuacagaggaccuggguucaaucccagcacccacauggcagcuaacaacuaccaauaaucccaguugcagggcuccggcacccuccaaccucugugggcacaggcaugcgugcgagggcaaaauaacggcaaucauaauaguguuguaaaggaggcauaaucauauauaguuacuacuaaggaucugugguauucccaagcaucacacuggguauuucugaugacacucaguaaaucugggaucuucaaggaagugugugccugucuugcuagccucggaacuacacugaacauugacgggugugacuggcucugccacaaguguacuucuuuuuuuuuuuuuuuuuauuuauuuauuauauguaaguacacuguagcugucuucagacacuacagaagagggcgucagaucuuguuacagaugguugugagccaccaugugguugcugggauuugaacuccggaccuucggaagagcagucgggugcucuuacccacugagccaucucaccagcccacaaguguacuucuuaacucucuugcugccuguuuccuaaaauacccaccuucagauuacgauuuaucuuucacucugagaagcuguauaaaacaaaccauaguauuaagguuagcuuuauucccuuccucaauucuggucuguauugccauuugauugguguuuugcauguucccuccucaugaugcugcugcugguggugguggugguggugguagcugccuaaaccccugauaaggaagccccugauuaaaucccuuuucuuugugucucuucacagcaacaggacagugacuaagacacaugggugaauugauuccuucaaauaauuaaucaauucaaugauaugaauaaaauuucagcaugcuaucuuauaggauagaaaauauuaggggcucagauauguuauaauccuaguccuccugaaaauuaaaacacagcauucauaaaguugagaauuuauaagucuugguuucuuuucuaaacaguuuggucuuuggacgucauuucauccuguuuuaguuugaccaguggaaugaaugugaccacugcuaccauccauccuaccagccucguaacuauugcuuggucuuaugaagagucuggaaaaucugagaaauuauugcugauucccaugcugauggucaaauuuauaguaaucaugucuccugcucaugauggaccacacauuucauauuuucuuuauguguuuccucucugcuauuuaauuucuuuuuacauuuuuaauauuuuaauauguauuuuugagugcuuccgauugggagggucauaugcauacaucuuaaugccagaggacagcuuguggggccagcacuccucuuccaccaaguggguuucugggaauuagcucagauguucaggcuggagcccaggagauuugccucauaagggaaaaacguuauaaguuacuaugcuguggcuuaguuaaccucagucugccacuggggugggauucaggauuagagcauuugcuuggugcuacaaagaguaaaaauccugagccuggaagcugaagagauggcuuagugguuacuaauacaaacuucucuugcgggggcccagguucauuucccagugccuguguugggcagcucggaaucccucugacuucaguucuaggagggcugcugaugcccucuucuuggccugcacugccaugcacaaacccacauauacacaugcacgugauuuaaaacaauacucuuuaaaucuucuaucaauuacccaucuuuuggugcucuuacacuagcuccuggcauuaaguaucuucaguuguacuuuucucugaccuugguagauggaacaagguuaaagcagucaacauauuuauaagacugauuauuguauguuucucuggauauggauacucuggggcaaaagaagagauuuuuguaaauacaguaugggauuuguguaaguacauacacugguguuuacuuuaaaaauaugacauccaacuuuugggcauuugauguuaacagaguggcaugucaucaagaauauguagucauaucgccuggguggugucauauggcucucugacaauaagaccaagaagccauccucuaaaguaauugccucccaaacaucuuuuuuuuuuuuuuuuuuuaguuauacuugggagcuuacaccuguaauccuaguggucaggagccacacauucaaggcuaacuugggugacauagcaagucccaggcaagccaggaguacaguaugaguaccugccucaaaacaagcaacaaaucuagucuucuugggucuguggguauguagcuaaguggugagcaccugucuugcagguuuaggcccuggguuugaucucugcagggguucaggagaaucaguuuaaucagcuguacugaaagcagcuccugcuucagcagccaggccuucacgaaccuccaugaagcuccugccuuuuucucuugauauggugauacaaugaagaugaaggaagcagaguccccacccuagaggaaucugcaggcugguagggaagugacaacauggaugcugaaggaggauauacuucugcuauaggaccacaccgaaggaagauuugaauugagucuugaagaauuucggggauugguguggaagaugguggagggaaagaacauggcagaucuggauaaaaucuaagcaguuuguauggaugcuaggcuuagguuugaggaaggaagccaugggagaucaggguuuucuaggugccaaggaaguaccuuguccugucauagacaauaauuuuaguacagucuagcuggggucuaaagaguagaugggaauaaugggugauaaagagcauaaugcagggaaacagaaccugcagagagcaggacugagugagaaggaagagccagaaccgacgguuuuaaaagaguggaugacaucaguagggugacucaacuguccucauaccuggcaccugguacuuagcagccucuaauauaacauaagaacagauagaaagaugaagcuggauaugguaguacauaccuguagucgcagcacucaggaggcugaagaucacuguaggcucaaggcugcauauacauaguaaguagauagccagucuucacuacacaacaagacugucuccaugacacagacaagaugagcugaaggggauuucuuccagucuuuccuuucaguagacuuuucuguaaaccuucauaauugaggguuguaaacauaccuucacggugauagcuaauccacauuuucuuguuagguggaguguguauauguuuguuuauugcucagaacagggaguuugaaugugugcuuuggauuuccuacucuugguuggugacccgggaaugaccaccauuccucucuuuuugaaguacaaauacagacacuguguguggugauguuuuucaagucuuucugccaugagacaacauagccaaaucucaccuggauggcuucaccccaccaguuaaaugcacuggguuuugauaguuuuuuaaaagcucuauuuugacaguauuuaaaagaugaaagcaaaauaauaugugaugucagcuaaagacaaaaggcauguguaacccauuaguagauacaauaguaaguggaaauaaguauuauuauuaagcuguuggcucauuucuagaaaugaucugaaacuccuuacucuuuuccuucaagauaaucaaccauaugucgaaagagccagggaaagcaggcagcagauugaagcuguugacggugcugugucagcaaauugcacaugccaggcuaauuuaagccucccuguugccuagggcauggaaggguuugucccauguacaaccccaucuugcagguucuuuggaaugauuuaacugaccuugcauauguuauagguacacacugaacgcucacuucaugcgaauuugggugauaauguuaauaagcacuauagcacucacuugcuuuuugccaggcaccauucugagaaccuuuccuagucaggcaugaugucccacaccuguaaucucagcauuuaggagauggaggcaggaggaucagguucaagguagagucagugagguauccuguaaccuacacaugcacuguacauauguguaugcacauguacagguacacgcaaacacacacacacacgauaaaccuaaaaacaaauguaagaguucuaaguuagccccagcccagucuaccugacaccaucccaucucaaaagccacacaccaacaacaccaaagccuuuuuccaggcucacucauuuaguucucauauaguuucauguaauaaacaucacuauuagcccaucuuacugcugagggauugaggcaaagaaaguugagauaaccugccaaggagcacuagcuaauugaacaaggcagguccaagcaggcucuuuccagaucucacguucuuaacuacuguaauucuuguugccuggcauccuucccgcuuaucgcaccuuccugaggagcguggcuuagucaccaucuucaugaggcgcuucaccuccacugcuccccucuccucaccucuagggaugcuucgguacaggacugacaggaguauuuguaccagguuccaucuugugacugcaccacagcagucuauccacaaggaaccuucagggucugugcugagacguugcaguccuauaaaaaccacacacaggaggacgguaaagcuaaaaggguauggcguggaaggcaaagauaggccauuggcugccgaggauugggugagguggaguaggaugcaguggguggguggagauggcuucuccaaguacagagagcagagauggcuguagauuauggcugugugaagagcaagcaagcauccuucagagagcauccuugagcugaggugguaguaaaggaaaugcucccguuuauggaggcagcagaguuguguuaaaucuggguguggggcugaacaucuauaauccuagcauuugagaaguggagucagugggauuguaaauuggagaacugaauuuguguggaaguucugcuucaaaaccagagcauauauucuuguugaaaggucuuuaucauugaagcuuauaggggaaccgcucucugagaggcucucucuccugcucucucuugggaucugcuuuccagagcucugcagcuuucacaauaccacaaaguuuugugugugcgugugugucccuguguaacuguacuccucccaugacaggaucccccugccugguuuaggauuuuuauauuuuccaauauaaggacaaugccugguacagaguggugguaagaacagugaugaugauuggccaagugggagaacugugaucccagcacuuaggaggcuggggcaggauggagaguuugagaguagccugggcuguucagcaagacccugccugucucagcagucaucaucaucauaaucauaauagcaguaaggauuuaaagcugcaguguuagaauucuguaauauuuauagaauuacacacacacaccugauaaauaguuguuagagccaucuuacauuauaguuguucuaauuucauuguauuacccucuguucgcugaauauuuuaguugaaauauagguuuggugacuuuuuuaaaaauuauuuuuagucuucacauacauacugaccaauuuucccucccuccacuccccccagccucccucccacaccuccccucucccccagauccacuccuccauugcccuuuaaaaaaaaaaaagccgggcgugguggcgcacgccuuuagucccagcacucaggaggcagaggcaggcagauuucugaguucgaagccagccuggucuacaaagugaguuucaggacagccagggcuauacagagaaacccugucucgaaaaaacaaacaaacaaaaaauuaaaaaaaaaaaaaaaagcaagcaucccggggauaucaauagaaccuagcauuaaaaaaaaaaaaaaucacaguauagacuaggaacaaacccuuguaucaaggcuggacaaggcaacccuacucccacuguuagaagucccacaagaacaccaagcuaaacaaccauucauuggggagauuugccauccuguguaaguuauaucauguacaaaauccucuguuccaugggcccuaucuaaacaugaugcacauuuuaauucugaaauacuguucgcauacaguuggcacuguguugacacagaaaguauugguagccaagacugaguucccugccaaagggaaaugucagcuuagcccagcuaagaagcugauauucagaacagaccaccagucccaagaagaaauuaagguauagaauuaggugcccaaaagucauagaagggcucucauccuccccagcuacacacacacacacacacacacacacacacacacacacacacacacacacacacacagacacacacacacacacacacacacacagacacacacacacacacacugucacaucacuuucucauuaggaccugaggcucaguguccagguaggccccugcagucccaggcauagcuaguacaaagaugauucauuggaacugcagaguuucagacuuagaaucagugaguuuugggaggccccuacaccuucugugcaccagcucacccuguguaaauaugcugucccggaauagcacaagugagaaccccagcaggcagcaaauauugguauagcauuuccuccauacacuacuauuuuugagagaaaagugcuuuuagaaaauguucgggccuaauugaaaaaguacauagcaaucaacauuuauuccccacuagcauaaaacugucuaacuaguagccaaauuugggaugccugaagacagacaagugacuaaugcuagggcuguguguggccagaaccaaauguauuugugaccacaagaccaugucuggauucuccuuuguaauuaccacacagccuacuguaauuguaaaacuuauauuuacuuccugccuuugacaugcaguccaggguccagggcugcacccagaccuaccaugaaggucucucuuauuugacaacguguacaauuauugagugagaggguguaaggguguguguguguguguucacaucuguuaaauaugcaaguauaaucuugugggaaaauaaucuccugccuuauugggugaagcgcauuaccagucugauguuuauugaacaacuccuaucugccaaggacuguuuuagacuuuaggaaccauaauaagaccacaaaagcuuugucuuccuggagaaggugaggguucugggaaggaggaagaaagacacucucgaaugccgugcgugugggggugugucccucagagcaccauuacagugcuaggcaucaaugacuucuucagcuugguacaucagaaaaggccucugcaagaugacauuuaaaaugacauuuuaaaugacaagaaagaguggaacaagccaaggcaagaacauccccccagcagauuauuggagggacccagagacaagaaggaauuugccuugcucacagagaccaggugaugggugacuggugucggugagguugaagggugcuguggggcacggcccuccccuccugccaggaggaacuguggcuguccaggcagaagguggucagggcuugaacugggguucacuagagauccaggcagaguauucagagugaaucacguggguucagcuuugagcaauuagaugguaggaaagugugagacagaccaaaggccucagcuuugacaguggaaacugacaucuuggucuaugcagugcccacccugucauguccucaauugugugugucacaaguauuuaacuuugaaaauccuccuucaaacacuugcaucauuccugcuuccucuggugcucauucuguggcaucaaggaaggagggagauguguaugcaucccccacccccaagcgcugggaagguggcucauugguucaaagcuuuucuugguuuuccagacgaccugagcuuggcagacuuacaacuaccuauaacuccaguuccaacuaauguccucuucucgccucuuagaacacacauacacauguggcaugcacucacacauuaauaauaauaauaauaauaauaauaauauaugagaaaauucaagguuuagggaucuagcuugccuaccuugcagaaagcccaguaccacauacacuaggcauguuucauucauaacuguaauccuuucacucagaagguagaggcaauaagucaaaaaguucggggucauccuuagcuacauaguaaauuugagaucauccuccaggacauaagauccugucuuagagaugaggguggggggacaucaauuaagcaaccaaauuugauuaccugacuccuacccuguacaucccuccacuguaaucuuaguuuuuggcaggcuuucuuccuccacacacacagugcuugcuuccugaacccaggcaucuagaugcaggguugggguucugaggccugcccauugguuagacguuaacagcuaacauaugcuucuaacgacauccagccauccuucaguaucugugagggguuaucucugggaugccugagauaucaaauuucacaaauguucaaguaccauagacacaauggcaaguguuugcauagaacacacucccucuuagagucuuuaagucaucucuggguuuacucaccauacccaauuugguguaaaugcuauacucagaggcacugcacuacuuagggaucaguaacaagaagaaaaguucugugcauguucaggacaggcacaguugcuucucuaaacauucuucaucucuaugccugauuuaauucauauaugcagaacccaggagugugggaaacaugacaucucauuugcuugcuuauauaugcaaaaucaggacuauuuugugauucuuuaauaaagauuacauuggcuuaauccagcugcuccuuuauuaaaggucuaguuucuacaguugccuuugaaauaucaugggacuuaaagacuuauucuugucuauauacuagacauaacaauauaguccaucguggguauuaugugaguauuaaaugaaauaauaucaagucacuggagcagucuucaguaagugagcuauuauuaguauuaaugagacaccuggcaauggaacacucuagaagcagcacacuguucacagugcucagaggaugcaucgggagaacguagaaugacaugcacccuggacaguuuuaagcacaagcuaugcuuugucuggcucuugauguucugggauaaguaagacuuugguuggcagcuaaccccacucuccaaaugucugugguucuggcagaucugugccuuucucucccgccugccuuuuaccacacguaccaugcaguucuguccuggagaccagguaaaccaccagaagugauauuuauugccagaugcgaccuuuugugagcaccuuguagaaucccagcauuaaugucacuuucuauaaauacaggugaagggugaggaaaugcucucuuuagagaagugucgcuauugcaaucuuuccucuuuuagacucucucggucugugggcuauuacucacggcuggcauucacccuucucucucguuaccucccuguucgugaucucugccaucucuuaguucccugcucggccucccuagcgguuggcauugcaucugaguuaugcuuucuugcuuccuccaccuuuugaaauuuaaaaauagaaaaagaccaacaaacccacagucuuucacgugggcugaacucuguuaauacgucuaacagauuuuccggugaauuccacacuguaauauuuauagucagaaaucugccauugguucagaauaaacucuguaagaaauucacaaggagcuacuuuauuuugacuaucagacacgaaaucaggcagaggagucaccagcccacaggaggaggcuuugcaaagagggucccauaggcagcgugggucccagaggcagcggggcucccugccgccccuguaccuuucuacauuaccugcccacuuuccugagucaguacuugauaaaggagucucucauacagugaacaccaagcccagggcucagaaaacaugcagaccuucguaggugugagcagugugagcagaaggcccaccccaguaucauacuaaacaaacauguaccaaacauguacagacuguuacaugcuaaacaccauuuuauugcugacagguguuuugaacuuucugcaauuuugcuuugaaaauagaauggcugaaaauaacugauuugucacuggcuguuagugucuaagcaguaaucuuugcauaauuuauuacauuaaauaauagauccagccuguguaucgauuccaaaugaaauauuguuaauuacuaaauaaacgguuacuaaggauaagcaaauaauauuauuugcaggccuuugacaugaguugauuuuuaaguugacagcugacuugcuuagaauaaaggauuacccgcugcuggucuguagugccuuagaccagaagaagcaccacugguuugggauuugggagcacguggacagacaaguacagccgggcaucccuacuccaucugaaaucagaaacuuugaagucauuguguugacgcucagaaagaguuccaguucugagacagagaugcacaucuguugaugguguccagcaucucugaugcuucucuacacccuuggaaagggcuaagaucacagacacuacccugcuguguaugcuuuccagaguucugcuugggaguccagcaucuuuauccucccuucauggagugagugucggcuuagggacuugaaauuaccauacaaguaaagggguccaauaaagaaagggggccccucuaaaagagcaguuggggaagaaucucuggccuccaaccaaauggccgugaacaaaaauuccaugcccuuguccugccuuaguaggacagauagacagacauucagacaaacagacagacacuccaccugcccuaaagggaggcccaaaguaguuguguaacacacaaguuuacaaaccccucugacccugcuggaguuucugacugucaagggcuuguuucccacaccuugacaagaaagcaguuuuaggucuauauuauucuaccagcaugaaagaaggaagaggaaaaagaaaaaagacagagaaaaggaggaaagaauaagccauugacagacaguugacaaguauagacuaaagaugacuuaccugagauacuugggaccacaguguuugugguuugggauuuuuaaacauuugcauauacauagugagauaaccugaggcuaggauacaagccaagcagaaaguuuaacuauaucccauacaguuucuacacaaagccugaagacaacaacuuuauacaguauuuuaaauagaugaauguccucaccagaaaauaaccaccuaagcuaaaacagacucugaugucauauaguauuuuaauccaugaagcaaagucucacagugucauuguccgugucuggugucaugucgguaugcaaaauguuguaagguuugguguauuacagauuucagacuugcagcuuagggagacucggccuguagccugucuucagaaaggagcucaccuguccccuguuuuccucacuaaaggacagguguaacacagugaggggaagcagauggcucuguguucacaaccucacacucacugugcaucauucucagugcaggcuaggagcugaggugccccccccccgccccccugggucagcucucuucagagcagcaaugugauggcaugcuuuuucacguccuugagauuccccaacaugguauuucacgggguuagaugccagaaagauacugaaaucuagcugucucuagaagcugccuucuaugaaaccaaacauuuaagauauuuacaaauccaaaaacaugaugccauucucugguuuguccugggaaauauaauuacuuuuaaauuuuaaauuuuuuauuuauaugaacuggguaugguggcucacaccuuuaauuuuagcacuuaggagcagagguagagggaucuuugugaguucagugcuagccuggucuacaaagugaguuccaggacagccaaggcuguuacacagagaaauccugucuuuauuaaaaaaaaaaaaaaaaaaaaaaaaaauuguagcgggaggugacucagugguuaagagcacuggcugcucuuucagaggaccuggguuaaacucccagcaaccacauggcagcucacaacuaucuguaacuccuguuccagggcuuuugacacccucacacuaacguacauacagacaaaaugccaguguacauuaaaauaaauaaauaaauguuauuuauauugacaugcaaugggaguguugcuauuaucuuuaaauacagcaauaaguauguuuuuuuuuaauucuucagucuuaauaucuacugugguaaauacugauacauacaacccaucucuuuaaacagcuccuggaguccucaguaauaccuaagaccucauugaaguucaaaucaugcaccccaaaguguuucugaagggucuacaggaagguccugucuacaguuuguuucuugaggcaggagccauguugcuuuguuuguuuguuuguuugcuuguuugcuuguuuucuccauuugucuugguaucaaagcucugaagcaaggcaccuugcuagcccaaagccugugacugaacacaggagaguccagguccucuaaccaggucaucuguuaccaagcuguauccccuuacagauucauuaucugaacuuuguaaagucuuauuuuacugaccugguccuugugggcagaacuggggaccccuugggacucuguuaaaaacagaagaguugaccuccagccauccaagugccuagugcagggacugaggucaaauagguccugaggaacuuccugcccuuccuuccucgcccugccugccacgcugcugagccaaggaagcucacuagcccccuuucucccugcagaugguauucaugcagacagagagaaugaucugacagaaggaguugacgaagauaugauugugacccagagccaaaccaauuucaucugccccauaacacagguauggcuucaucuuuccccucaaagaaaauggaguuagguugguuucacgggagcagaaggguuccuguuugcuuucugaugucccaugggagggaggaagcaaaagugaugagaucaaacuugggagguuuguggcuagcacuuucauuuaaccauauacuuuaggaccuggggaaaaguuagagcccagagaccaaguaaaguuacagccccuauagcccugaauuucaugauugcaagcugauacuagaagccaugaagaugagaauuuagccucuggggguacuaggaaguggguggucauuauuccugaacaccuaaugucuccuuaaucauagcuggaaaugaagaagccagugaaaaauaaaauguguggccauacauacgaagaggaagccauuguucgcaugauugaauccaagcauaagaggaagaagaaggccugguaagugggugcuggugggggagcagggcacccuggugguccucaguacaugccagaaaaagcugcccauacucccccuaguuauggcucugcccagacugucaacaggaaacuugcuauccgggaaggacggugugcagaagacacuaaaggcgcuccagcuacaccauccgcacagaaggaagagcgggugggacuggaguauuggauuacagaacucuagagaacucuaggugaugcuuacaaguuagcuagcugggugcuagcucaguuuguagagcgcuuaccuggugcacaggaagucuugcuuucaguucaaacaaucacacaaaucaggccuggacacaugcgccuggcacccgaucagugaggcagacaggaggaugugagagaggaggccguccucagccacacugagaguuugaggacagccugguuauaugagacacucucucucucucucucucucuuucucucucucucucucucucucucucucucucucucucucucucucucucuuucucucucuguugcacacucaacgcacauacacacgcacacacacacacgacacaccaacaaaccagaguagcugaggaucaacaaaacuauaaucugagauacuccccuuuuucagugucuacuuaacccagaggaaauuuaccuuauucuuugcuuucugcaauagugcuuugguuuuaaaauaaacauucaagacaagaauucauauccaguggucuuggugaggaagacugcauuaccaaagaaaugcuuucauuugaucauguaaauaacuccccgaacaguuucaauuaauccauggcuaacucaccaaugagaauuuuuuuaacuccgaaucuuccgucccuucucucccuaccucccaaccccaggaccauggcucugugccugugacgagaguccucagugggccacacugaagcugacuggguuuggcaucuccugagcucuuaucgcaggaauggaauggcaggugugaccguucucaggcucugauagcagccccugugaugugugcuuugcuucuucugcaucacccagaccgagagcuggaauuccccuccucuccccauguggguguggacugagagcuagcaacugaggacuagagagagauagcuccuuggccauucagucaaguaauuuucaguauuuacucuagaagacaaauggguuugcagccauuaggcuacaaauauaaaaaccauuaguucauuucuauguuuugcauuucugccuuagaauccaaauccuguauuucccuaaugaccuugacauuuuaccaacaagcaucguuuuguuucuggacuuccaagccuuccuucucuacuaauuuuuaaccuguguuccuucucugacaaaccagaaagggucaacauaauuccuaagagugcuugcuaguuugcuguccuuggcagcuccucuuucugacagugugugauacucuccugaaguuggggcuggaaagggcagggacuaauacaaagcauguuucaguuuccuaccagcagccccgggucggugcaggguguucccacacuuagauggcuuuucucacguacagcucugacuuccuaaugcccauuguccauuuggaacuacacacaauacuuacaagcauuuaagugguacuugacaucuaaggaaacguucucuucucucccugucauguuuccauaaccuggggggcagauaccugaaaauguucauagacuaauaauaaccauuaagucugagaggaggaaagcuuuacaaagaugacauuguuaccaggccuuaagaaauaaaggaacauaccggggaauggugaaggggcuuuaggagccaggccucuugaaguuuuccauuguaaucucuuuuuacuaggucaaaucccccuuuucuucuuucuauguguaugugauguguuugcauguguguauauguguguucauauguaugggugcacaugugaaggugguaugguaugcauacacauuguguguucauacauguagagacccaguguugacgucaggaucucccuugauuagaaguaaggucuugcaaagcccaagcuugcagguacgcagauaugcuggucuuacuaggcagaguguccccccuccccccagacauccuggccucuaccuucugagucuggcauuagagcuggggcgccgagggcuccaggaaucugacuccaggccucauuugcaguaagaugcuuuauccacugugcccucccccagcucccucaccuaagacauuuuauauacagccccaagcauauagcuauauaaaauagauauauaaauuaagcauuuacuaauacuaaauuauaaacaaauuuauucaaagacaguucuucaauguuuauauuuuacuauuuauuaaagaugaaagcaaauuuacauacuaaugaguggauaugcuuaauuuuuuaaaaaaauguugcuuguuauuguaaauaaguacacuguagcugacuuuagacacaccagaagacggcguuagaucucauuacgggugguugugagccaccacgugguugcugggauaugaacucaagaccuuuggccgagcgguccaaaggaugcucuuuggaaggcucuuacccacugagccaucucaccaaccugauaugcuuaauuuuauauaaagaauuaaauaucagcugaauauuugauacugcagauagauaaaguaccuuccgaguugauugaagcuuuugauuuucuaauugucaaugccaagaacaccauaaaugcauaguaccaaaagggcagaacgaucuuuacagccauguuagaaacuguugggaauuuuauccuaaccccaagcuaaaauucauuuuacaauuuuuucuuaugaaaccuaaagucaguaacucacugacuuuucuaaaaucaaacauucuauuauauuacaagacaaagauacaaugauuugcuacaaccuaugggaugauaggaggaaaauacugucuuuucucccaucauguuuccacgagagcaggaaacacgugcacaggcauuuguaacgcccaguugucucaggucugaguggaggcguuucccuggcacugugcggugugacagcagucccagggcaggcacacacaguguguguggagagggaaggcugcagugaagucuggggugcaccgugggcgcgugugggcaguagagagacuuugcugcucuccagaggacccaaggucaguucucagcacccaucuuaaaugccaguccuaggggauccagcacccucuucuggcugccaucccaccguguagauaacacaacaggcauaagugcaggcaagaaaaaacucagacaaauaaaaaaaauaacaaaauaguuuuuaacuggguauuuuaguuaauuuguuuuugagacagucucccugugugacccuggcuaucuagaacucacuguguaguccaggcuggccuuaaauucacagagauucaccugccccugcuuggaguaaaggcgugccccuccacacucaucagaaacugacuccuagagccucccucccacuccucuaucccccaccccacccccaucagaccagcuuucccguagagggcaguaggucugguguuggcuaguuacuguuuguggcaggaaaguaaaaugacaccguagaugguagaacaguaaauaggcagagacccaccacagaggcagugaauguccguuucaucacuuuccugcucuguaaacugauggugauaguuuucucacugguacaucugaaacuugaauaagauauguucuaaaggagcaggcacacaugcaguaagacucaguaaccaugaguccugcauccuugucaagcuuucgacagcaucgucaccagcaucuaccagcucugcccauaggcacagaagaccuuguagagaaaggggauuaggaggagccaaucuggagcugaggaaguuacuaccgaagcagugcagggggcaggugcuaaaggcuguggcagugccaggguggugcgcccacagugcauucugucacagagagugagcaggcacguggaagugagguguguaugcgcccgacagaaugugguagcugauugaaaaugggggaggagcuagaggggaauaugacugcuaauucuuuugagugucuagaagcaguugcuagcugcuuggucagggagagguggaagagaggagaguggccagcagggguucugagagucugagaucauagccauagagccccuugaaaacagccaaggugcaggcugugcccuuagaaggugacugagccagccaugagaauuguguggcuaugaggauagagcugggcagcugucgcugaggcacaguucugcagaggccagcaggacagagccuuggccuggcauaagcucucuucacucaccauaaagccucggcaccugacucagagccccuugcugucagcuccaagcagcuucuuguucagcaguuacugcacucaaguacaagaccugugggaagcagccuaaaccacacccaagacgagaggcgcugcagucacagagccagugucaaacgcaaggccaaccuggaaaccgauuagaacucacucgguucugcucacagcuuacucuguagguuucugauucagcaugaaguggugucauuucccaugaagcacuguuuaaaaaaugugugugacacauccuguuagagaacggugucucucuccuguuccaauuauguuagguuacuggagucccaggcacacuguguuacuuacuggguaccaucugaacuucccagcaugcuucagacccuggcggccuguccacuggacccaaguggagugggcuuguggggcuuuucacccuaguauacuguuagagucauuuccuaaaaccgagggaggucguaagcuauuaucucucaaauaaagcugccugcucguuuucauguuaaugaacuguggcugacugugacccccaccaauuguuuugguuuucugaaucuuuagggaauucuaagcucaucagaugaagugaagagaaaugugugaugucaaagcagaaucacuuaccaacaaauaacugagccucucagccggguucuuuaucucuaaaguaaaaaugacaucaacucaaaauuccagugacccuagagccuacaggggauuccuuccagaucuguacugucccauuucuuggcugugaagaagaccgggagauagcucagcucagugaggguucagcucauccccagaauucacaucaaagugccaagugugauagcucacuuguaucccggcacugggagagggagggagaugaaaggcaggcaggccccugaggucagugaggccagccagacuaguggcuguuuagcaagaauuaggccagugaaagagucugucagaaauaaauaacuaguacaguggacccugaggagaacgacagggaugaccucugacucccacagcauauacacaugugcacagcugcacacaggcgggcagaagcacaggccugacaggaaguuugcugguguacagugugaacucacagcuguggggcccuuauggcaaacagucaucauguguaccucacuguuuugugacacaucacccuggacuuggaggcgaugggacacaguuacucucugaguguaacuaugucaggaaucuacccagcucuaaugccagagguaucugucuauacagcugcuuccuagagcuuaugggccaaaccuugauauucuuaggacccaaaucugcaucucuccauacucagcauugugugauccugagcugaggcugaggccccgaauccccgaugccccugggacccucugcacccugagaccucuccuuagcauagacucgcaauaaggaaugcucugcccuguggcugacccaggcacaggaccagccucuccuuccaggucugugagucugagcccuuccuggggaugaguugaugauguugaagguguugccacaccugacuugcucaccaggauguccuggggauuauggccuaacgcuuggguaguguuguuucucggagcaggaaugcccugauucaagcccguggcaucauggccuuuucuuacccuuuuuaguuuaaaaacuuguucguuucuguggggugggguggggugggaaacaaggcugugcccugguuccuguccugccucuccuccaggaagucucucaaagguucucgcaugcucuucaguguuguucucaccaugucucugguugagccgccuugugugaggagacaggacugguuaacuguggucuagaacagcaagugcugcgugaugagaccuggagcacaauccuuugcccguggcauucaguggccuugauuuucacugugccaggaugccugcagacagacaagaacuccacguucaucuguuugcaggaaaagccuugugccgucaccuggacagugucagcacuaggggagccgacugcuaggccuuugccgcucuuuuggagaugucucacuauauagccuagccuagccuagaacuuucuguguagcucagucuugccucagccucgggugcugggauuguaggcauauacacuugucuuggcucuuccauuuuccaguuuguaucuuuguugucgggucaccucgcuccccucggauacuugauuuauaucccuguucccagagccugucucugcaugacacagacaucaccaggcuccaucccaucccaucaacaugagugugggcgccuccucugcagcucaguggugugguuaauuccgucagccauucucagaaugcccucauuuacugacuaaagccacugaugucaucaggaaguccuccccccucacucuccacuucccucuccacugcuuauucacugucuggcagaaggagguagacgcuguucucaggaguccacugcacccaaggucuggucgucagggacggggcucggggcucgccucucagggagguucacuccagaagcccccuguugugcacguccaugucugggaagccuaggggaugacagucuccguuucuaaagucuggaauguguggaugucuccaucaccaucucauacuuaggaauuccaaaguacaucggucgagcuggggugagcagguggggggcuacgcagccagauuccaggcaaaaggaaggaaggaaaggaggaagggagggaggagagaagaaagagcgcuccuaugccugacuguacaggacacauuuagcauuucaaaaugaauuccuguucucaagcuuacugucccugcaaaugggcugcacacuguccagggacagcccauguccugccaacacuccuugaccccaggaucaaggccaggaaacaccuccucuuuccugccucaucccugcauuguaacucccaggucagguucccuucccuuggccuuuuaccuuuuacucugcguuuccugugccucuagaagagcugucucaguucauggggcugagcccuguguggaucagagccguguuuauacuuaaggcuaugugauuagaaccuagcccagagcugaucacacagaagcaccgggaaugcaugaguggugugugugugcacaguucuguggaaggacaggcagacagaccagauaacuuaaaacuucccaggaggugaguggccagccuaggagaugggaaaguggaaggacaccauggagcacugugaggcccguuacccuguggaguggggacccugccccagaaagguuaucuugaccaccaaucgcguguuugagggaauucaggaccugcgugagcuugacuccaaacacugggcacuuagcccugcccaaaccuuguucacuguaaaaagaaaucaggugauucaguccaaacacucccucaacugagauggcuaacugagcaaggccuugaguuccgcccuuuucuggugagucacauucuuaauucccucaccucgggcuucuggccagagcccagugucccucucacucucuccauugagagguuucauggcauucagagggauggaguucaggcaggacuccugcccccaugccuggccuguguucccuucccaucgaaguuguccacugcuuggcucugcccucuccuuuguuuacuugccuuccauccgagggucugcagguccuauggccugguguguguuggagccugucucugccacacacucaaccaaacugccucgcccuuccuguacugaugugggacccccacuauuuccuccaccuugcccuuugcccucuagccuuuuguccucucuaaguagcuagagcaaguuuuuuaaauggaacuaaauuuuaucccacaccgaucuaaaaucuugggggaggguguguuuucauauuuaaaaugauaccccaggcugaggaaguaacuuaguugauagcuuuagccuaucauguaugaggcccaggguuugacacacacacacccgccccagcacagcauaaaaucagguguugguggugcgugccuguaaucgcagaauuggggaaaugagaucaacaggaaguucaucuccagcuacauagugaguucaaagucaaccugggccacacgagaccaugacucaaaaucaccuagagguccccuugccccuccuuucaccucauucgcucucacugcagagcaccuggccaagccuucugggcagccuagaccacaugcaagccuggcuccccuccccucccugcucccccaccccauguucccucuguccugcauugcuucacugcuauuguggcaugguauuugguacuuggugacugccugccucccguguuagaaagcacggcccuaguguaggugccgcuccuacauugcuugcuuccccagccccaaaccaagcugcccucgguggaaaaaaaacguguaugugugcaugacucuggguuugaggguuuggguuuuguucuuggguuuuuuuguuuuuuguuguuauugugguuguuuuuguuguuacuguuuuggguuguuuuuguaacguguugugauuccagugcccggcugugagagagagagguuaaugccuaaggcaugacgguggcaugggcucauggguauuuuuccuuccucacaguugccccaaaauuggcuguagccacacagacaugagaaugucagaucucauuccggaugaagcccugagaagggcaaucgagagccacaacaagaagaaaaaacgccacuccgaauaggagcaagccaccugcccacagggaugucagcagccuaccuccccgccagccaccagagagugagggaugccagcgauaggccuggccaagcagcgcuguuugcgguaacccuugaaggcuaauuguaauugaaagcauuuuuuaaguuacacaguaaaaacacaaguacauuauauucuuuauuuucaagugcucugaaauuuuaaauaaaacuuugauaauccucagc

SEQ ID NO: 7770 - RNA, 884 nt, Mus musculus
ugggaaaguagaaugagagagcagggugugagaaccuagccuggcaaacucacaaaaauagaagaagaagcagugggggagccaagaaaguguaaagaauguaaaucguguugugagcuggagacuagaaccuaacaugagagaggccaaugaggcugugacaaucaggagugacuagacuccugaugcaggaguguccaggugaauuuauuaggccaaagucccuaccacugcuggaaaguggggguccugcaaaugcccuucuuuacaaagcauggcuuugacuagaaccuuuacaagguaaacugaggacuuccagucugugugcacugcuacucccugaccuuacaguagaagcagacucaaggcacugaugaauugcucugcaauccuguaggcagaguguguguguguguguguguguguguguguguguguguguguguguggugcucuaaagccagaagcuuuugcaagucacacagacacuaaagaagagauucccccacguuuuauauaaugugcgcucaugaaguggcuaagagcuuauauguccaacucuuggcaaugucaggccacccucaggaggucacugcugacugacuauauuugggacacagugcacacagagagaagaggucuuuacgccacacucaguuguuuuuguuuuuccaagauaugaugaaaaccccacacuuuuucuuaaucuuaacauucuugcauguggacaucaggugagcaaguguuucuaguuuaggugaaaggguggaaucugacuagaacaaaauggcuuacuaucaauugugugagaggacuuaagaacagcaggaagaacagagccuguagcgucccugaaucuucagaaggguuauguauagcuaccu

SEQ ID NO: 7771 - RNA, 2633 nt, Mus musculus
uaaugaugaaaaggauuuauucuuggguuugaccugguuuuagaaaauuaauuauucagcauaauugcaagaaaggauuuugauaauaggcaucuaugcuaagugaggauccagagacuccaaacugaccugguuugcgaaagaagugggggggggggggaccaaacaaaacccagcaacacaaaaugugacugcaagcuguuuccagggagcaaggucagccaguuucaagagcacacaacucaaacuauaugaaaguauacaugcgaccuuguccgcgugcagaugguaucccuggcagugaauagaaugacccguaccccaguauccaauacuccuggccgcacuggcgcccuagacccucgggcgcgcauugcaggcgggaggggacaggaaucuggcgccagccacgugggccccuuccgccaguuccccacauccuuuguuucccaccggccggagcucaggaagcucuuucggcgagucaccgcgaaggggcggcccaggagcuuggagaggcuauuuccgugcaauccgggcgggcggcaggcgcgggaggggcguggagguggaggcagagcagaaggcccaguguuugcuuuuauuucauccaacagaagguucuauuuguggaagcgaacagacgcuggggauuagaguugggagggggcaggaaaagaggggaagaaaaaaaaagccacauucacuaccacgcacaggucuuccccggaacuaccgcgugggggugaaugacugauaauggaauucaucaccuuuccucucgccccuuccuccggcugcagccgcgacucgacggcgcccacagcuccaccgggagcuccccaaagugcagaacggcggggagggggggacccacuaggauaaaggcgugaccacugggucucagccagcugccggugcgcagccaggaggugcgcgcgcggccgccgggagcucggugcuccauuguguugugugaaugaugcgcgcgcaccaaucagcggucguuucgccccugcugccccgccccucccgcccacuuccccgggaaccugacgucacgggagcuuugccuccgcccccucccugggcuacgggcccgcgggccugcgguggggcgcgcgcagccugcugcccagcccaacccggggggcgugugcgcgcgcccaaggcgucccaggacguucccaccugcgccucggcgcgcgcggucaggagcauccccaggccuccagccaccccuuacaguuccagccuccaacuccaccuccccuccccccuagucuccucccuccgcuccggugacugcaagccgggcgacggggccggagucgucgcagccaccucauugcacaacccggcuucccaacuguuuacacagcccgggcugugaguguguguguguauacagcgugagucaccgggaggcggaggagguggaggaaaaggagaaggagugcacuggccgggaucagugcggcacacacacucauagucggucacucucucucucucuccuggagcgcgucucgcucgcucacacgccuggagcccaggagcgcgcaggauuccgagcggcgcggaaaaguuguaccggcuuuuacgccagacuaauugcuuugggaagugcguuugcucggagaagccgaggagccuguggaauccuguccucgaggcucaacacccgggaacucgggccgucuccacgucccggacuauccacagccucggcaacaauagcggcggccaccgccaacgaggcgcccagaccuggugccugugggggucuggagaccuuagccggccucccacccuuggacgcguggccaacgugguucugguggacaacgccagcguccuggaacggcuccucuuggggaccgauccaagcucuaucugcaaacuccaucccgccgacuggaagaagucacagcgcagauccagggauuuacaaagccggggccgcuccggccagggccgcgaugcgggucggucccgugcguuuugcccugagcggcgccucgcagccccgcgguccgggucuacuguuuccggcugcccggggaaccccggccaaacgccugcuggacacggacgacgcgggggcaguggcggccaaguguccgcgccucucugagugcucgaguccccccgacuaccucagucccccuggcucgcccugcagcccucagccuccgcccuccacgcaggggaccggcggcagcugugugagcucacccgggcccagccgaaucgccgacuaccugcugcuaccccuagcugagcgcgagcaugugucccgggcacugugcauccacaccggccgcgagcugcgcugcaagguaagcauccuggggcggagguugcgggucuggaucguccacagaagugccuagguuccggcccaccgggaucacagucccgccagcgcuuggguuuggcagagcagauaagggcguuuaguuggauaaggaggguauuuuggucagcuucguguuuuuggagguugagugcuuuccuguggaguguuuuuuggugaggguuaggcggucuagaggaagugcaggguucaguucuuuuaucucuguucuuuucuuuggcgcucuguauugcuagcgcguggcguuccauuu

SEQ ID NO: 7772 - RNA, 8827 nt, Mus musculus
acgggcccgcgggccugcgguggggcgcgcgcagccugcugcccagcccaacccggggggcgugugcgcgcgcccaaggcgucccaggacguucccaccugcgccucggcgcgcgcggucaggagcauccccaggccuccagccaccccuuacaguuccagccuccaacuccaccuccccuccccccuagucuccucccuccgcuccggugacugcaagccgggcgacggggccggagucgucgcagccaccucauugcacaacccggcuucccaacuguuuacacagcccgggcugugaguguguguguguauacagcgugagucaccgggaggcggaggagguggaggaaaaggagaaggagugcacuggccgggaucagugcggcacacacacucauagucggucacucucucucucucuccuggagcgcgucucgcucgcucacacgccuggagcccaggagcgcgcaggauuccgagcggcgcggaaaaguuguaccggcuuuuacgccagacuaauugcuuugggaagugcguuugcucggagaagccgaggagccuguggaauccuguccucgaggcucaacacccgggaacucgggccgucuccacgucccggacuauccacagccucggcaacaauagcggcggccaccgccaacgaggcgcccagaccuggugccugugggggucuggagaccuuagccggccucccacccuuggacgcguggccaacgugguucugguggacaacgccagcguccuggaacggcuccucuuggggaccgauccaagcucuaucugcaaacuccaucccgccgacuggaagaagucacagcgcagauccagggauuuacaaagccggggccgcuccggccagggccgcgaugcgggucggucccgugcguuuugcccugagcggcgccucgcagccccgcgguccgggucuacuguuuccggcugcccggggaaccccggccaaacgccugcuggacacggacgacgcgggggcaguggcggccaaguguccgcgccucucugagugcucgaguccccccgacuaccucagucccccuggcucgcccugcagcccucagccuccgcccuccacgcaggggaccggcggcagcugugugagcucacccgggcccagccgaaucgccgacuaccugcugcuaccccuagcugagcgcgagcaugugucccgggcacugugcauccacaccggccgcgagcugcgcugcaagguaagcauccuggggcggagguugcgggucuggaucguccacagaagugccuagguuccggcccaccgggaucacagucccgccagcgcuuggguuuggcagagcagauaagggcguuuaguuggauaaggaggguauuuuggucagcuucguguuuuuggagguugagugcuuuccuguggaguguuuuuuggugaggguuaggcggucuagaggaagugcaggguucaguucuuuuaucucuguucuuuucuuuggcgcucuguauugcuagcgcguggcguuccauuuaaguuuggaauugcaauggguuccagggccaugccauugcccugcucucaucccccuccucccccuguccuggaaggacgcccugcagugugugccuccucgggacuuggagcaacuggcaagcucuuugcgcgaggcucgcggcauggguucuguauagaccaagucgggcuucuuuuuaccuagggguuucugggcuugaacuccuguugggaccagcauacagcccaccccaggaaguguugggaugggguggucuuaagcgugggaaggcuucuggccagcaucggaguauuggaaaacuuccagaggcucgcuuccacuugcuuuaguuugagccggcgauuuucauugcaacauuaacaggaguacaacuagauacaggauggccggucugggagagcgcguagcccaggacugcuucgcagugugcucuucgugagccggacaccccaucucugggccauugagagccccacugacuccuuucauucuccugcaguuaaaaguggcaucuggguuuccaacaacucaccugaaagccccccuccgcccccccccccccccaacgugagcgccccaccucuccguuugcugcugccaccuacuguccacucucgugaaaucucugaugcguggucaagcacagagagaaacucuuucuucuugguggaugagaacaguuuugggagagaaacggauggggcgggaggagaaggcagcagauauauauuuuuuucccaaguugguacuagagcagccaccucagaggugggguuggucugggucauugugcaaccccuuccaguuccucugagcagauaauagccgaauccagauggugacagcccgugugucaccauuuccaguugcgucuaggauaugaguaaccgggcugaacaaaaggcccuuaaagagaccagccagcuucuuagaggauuugcuacccguucuggggaggggggccaaccaggguggaugggggucgaggaaacaaacaggaaaaaagagaagaccuauagaggugccuauccucuccuguaagaagguaacuacaggcugcuuccaccugagucucagccauaggcaggcugcauaaggccgcuuugucagucucuccuuccaagucaucaguuccuucugacuaaugacagcucugcguguuugcugccucagcuucccguggaggcugcaaagucaccacauucuuugacugugcucugcugagccuccuggguucgcaggagaugcaugcauguuuagcuguugauuuuucacucuuagggaugccggggguaccuuccccuagcuacuuacugucugcuaggaagagcuacagcagggagcugggcuugcuuggcucccaggagcugauggcccccuaaaagacaaaagcauuugcagaagggaguucuucuagucacccuacaguagggggugggcucugggagugugcuagcccagaucccaaaguguagcugguuuguuguaaggguauccuaacagcuggagcucugaggggcuacccagaaaagaauauaugaauggggcuuauugccauugaaagcccaaagauggagaacuccagcccagcuucagauaggaccuuggaggcgggcccucugucuuucucauuccuuaaacaggucacuuuucuccccacaggaauuccccauuaaacacuaccaggacaaaaucaggccuuacauccagcugccgucccauagcaacaucacuggcauuguggaggugcuccuuggugagagcaaggccuacgucuucuucgagaaggacuuuggagacaugcacuccuaugugcggagccgaaaacggcuucgggaagaggaggccgcucggcucuucaagcagauuguuuccgccgucgcccacugccaccagucggccaucgugcugggggaccugaagcucaggaaguucgucuucuccaccgaggagagguaggcagcugacacagcacuucugguggccuuuuggaacaacagcagcaacaauccccacccccccaaacaaugaaacaaacaaacaaaaugaaacaaaacccccaaaggcacaggucaugccuuuaggugcaagauaaacccaagggcucaggucuucucugcuguuaguacuaaguccugcaucugggaagugauggccaaccccaguuuauucucugcucuauuggacgcagcauagggaagccuagagguguguuggugcuuuucuugaugcuaccuguugacaggaugcccuuccugccccugucucaggcucagguuuaucuccucuugucagaaaggccagucuuuuggggaaaagguguccacuugucaaggacaaguggacuccaagaggugcucaaauucuuacuuccgugcccugccucugcuguaccuagaagacuuuacagagcuaguuguguuguuguguuggcagaauaacaaccaucccuaucacaccaaacucccguucuguuugagccugggcgcaccccaccccucccaguaguugguucccauucucuggugaguuuuuaaagacaucucaucagcuccaucuucagaaaauaaccacauugaauaauaaauggaaguuggcuagcgugcacugcuaaauauaguuccuggcuuaccucacaaaggacaagaugugcuugauaagggaauaaauaaggagacaguaagaucugaaguggaggcugcaccaagagaacccaggaagcagcuugagcuauaccacacuucauucugcagccagacuccguccguggugggaagauagagauugccugucuguagaauuguccugugggagugaguuacuuucucgaauacaguuacacaggacuuacccuaccugugcacuuuuaccuguaacaccagggccccccuaaaacaguuacagagguuccccaaaguguguguuuguaucugaccuugcacugaccaucgaaacacacaggauuagcaaagagaaacuguuugccgugaagaaguguccgguuccuggccggugugugcuucuuugauaauggcgaugccuauuuuugaaacaugcacuacacaccuccucaccggcuuuugaaaucugcauugcacaggccagugucaugggcauaggguuugguaacccgaggguuaagcaauggcaggcugacguuauuccuguagccagcacaggugcaggguuuuaguacuacaggagccaaucaggggcagacacccgaggguugagucauauuuuccguuuacagaaccgauggguauuuuacauaacagggaggucaugcugaggacauaccgaaguuagcacauguauacuacacuccagggaacaggaaggcuggaaaggaaaaaaaaaaagaaaagaaagaaacuaccagaccuuugauaggaaaaggaauugaccaacuguuugcauguaacuucacaacaagugacuuacuaaaauucagagaagcaggccccggauauuagagguaccccacgugguccuuggggugggggggcggugaggggggguaucuagaagauguggguggcuggcucugcgucaggaggcaccugcagcuuuauaagaguuccuucgaccaaaggucuuguggagugugguuucuuuaguagacuugguuucuggacuuucuuucacauucuacaaugacuucuuuaacaacgaugaucuauaaaacagagacagacucucaugugggauagagacucauguaccuugaucugcaguccuagggguagguguucaggggccccuguagucuucacaucuaucagccacgcacguuuguucaccuaacuucucugucaggacuaagucgucuuugccgugaaacaaacagcccaauaaaugcaauuaaacguuucuugucaccgucccccucugguuauugcagcugggacuugggugaaugagauuuuguuggugugugggcaguagugucgccagcccugggcagucagugucacaguaagagacugguggccuguacgauggauacacagcccccaccugaggaaggaggaugcauacccucacucucccaugacaacuuuguagaacaugccagucuuccccugaaaccagcuccccauucugcaaugugaacuuugucaguugugcaacccuauuaggauaucauaagcucuagcaucaugaauauuauuugagacuuugcaucauccccuccgcccccggcacucucucgcuacuuugcaaacauuuauugcaguuuguauugguuugugaaaucgcucguccuggcuguuugcagggcagcgcucacuagaugaagggguaaaugacauuccaacggccuuggcuguuagugccugugggcacuguuauugggaagagcuuguuccacggcagcuggucugaaaauaauagcuucauuucucucucccacagaacccagcuuagacuggaaagccuggaagauacucacaucauuaagggugaagaugaugcgcugucagauaaacauggcugcccagccuacgugagccccgagauccucaacacuacugggaccuacucuggaaaggcggcggacgucuggagccucggggugaugcucuauacgcuuuuggucggacgauaccccuuucaugacucagauccgagugcccuuuuuuccaaaauccgccguggacaguucugcauuccugagcacgucucccccaaagccaggugccucauccgaagccuccuaagacgagaaccuucugagagacucacagcuccucagaucuuacuccaucccugguucgaguaugucuuggaaccgggcuauguugacucagaaauaggaacuucagaccagauuguuccugaguaccaggaggacagugacauaaguuccuucuucugcuagucccccccaaaaaaccucagaaaccucauaauucucacacauggcauuucuaaugacaggcaggcccucuuccauggugccggccagauuuggggacggagcaccauugucccuguggggcucaauguggugucgccucucugggcugagugacuugauuugaccagcaugcacucagauuagcugcucgacagagguguccccuuuucaaugaaccaucaugacugucccagugucggaugcaagggugccacgggcucugaagcuaacgggcaucccacgcggucagguguaguagugaacuugaacauuugaaugggaaggaagcacuucgcacaauggcauuugaacaagguggcaaucgguuggaguaacaaacucccccuugcugcugcaguuucuccuaccagaaguuuuucuuuucuuuuuuuaacccuuacucucccugcagacucaaccaugacuguucugcguuggaacagauggagugagaaacccuacagccugcccgaacccagacucucccccaaagccaagaccuccuaugcaauaaugccccccuccaaccccacccaccccaccuugggaccuauccccugcagcuaugaaagcagucaccagcuaauuguggaaaaguaucaggagauucaaauucuuggcuguuucagaacucuugagcucagucaggcagggauguuuuuaaagaaaugaauuugaucauguggaaucuguuagcucuuaaggcucuccucgaauauggcagcauuuggccgccacucccuacgcccaccauuaggaccaucucuggguggaacauuuugugugugcagacaagggugaggagacucgccagccugcucucucaggagcacgugugaaccgucuucgugcuucagcgaaagcgaguuugaggcagucuugcaagauucucagacuaauuuccaaaaggaaaccggaugccaacuucccacggguuuacugugccucuggcauccagggucuucaguuucccgugcuuggcucuuugggguucaugugucauguugcuuaugacccuaucugugaagccggcucuggagugacagagagaaccucaaaaauguagcuggaaaggacuuuaaaacucauccaaugcagagucucgcuccuagcugccuacccgagaucccuugcuucaaccuccccaggugggggaccuggccucugccuaaaugcuucuggagacggaaacauauucccuacagggaaugaagcuucucagagaaacugccgaaaguugcauuaaaaaaaauaaaaaguacagaagaaauaguugccacugucuaggacagugcugaagcuaggugguuaaacggguaacagaaauacuguauugugagaaaugacacaacaaaagccggcaggcaucuuuaagggcuaugccuagggagacuacuaacauggagagaaugccguguauaccucacguacugugugcuuuauauuuguauauacauuuuaccuuuuauacagauguccgauuguugucauuuggcucugcagcuuguuuugucgucugugucugucugaggaaccuguguguccagagccacaugaaaugugaaugauuguuggcaauauaaucuugagaggcuggugggacuuggggaaggagcagggacagacaucuguugguauugcccagcuccuguaucugugauacauucccuggcugaggacucggggcuggccugggcauuugccuggacugcuggaaacacuaggucuccugugcguguguggaaagguaauaguggcacaauguugcuaacuuuagacaacuuuuaauaaauaugguuucguaaagaaauacagugaguuuccuuugugugcacgcugccuuccugugacugucccuggcuacagugagauacccuuugacuuucuggcugcauuggcucaaggacacaauagagucagacaggugguuggcuacuuuauuuuuuuucguuuuauauaguccugcuuagcauuaaaucgcuauguagaccaggccggucuugaacucacagaggucuuugugccucuggaauuaaaggcaugagugauuaugccugccuggaaucugcccuuuuuugugugugucugaacauguguucuuuaaugggcaaggcucauaugcagaaugaggugggugggugggugcuguggucuggguuggaagcauuggagggcaguguaacauggauuuuugaguuuaagaguugaagaauuggcugccuuuugacaggcuuggaugguucaccccugccuuggcuuucugauacuguggaagcugagacagguacaucaagaguucaagaccagcuugggcuauauagcaagucuguuucaaaaacaauaaaaugaauucucuggcu

SEQ ID NO: 7773 - RNA, 1269 nt, Mus musculus
ggaaccgagagugucuguaggaccugucggagcguuaggauuugagcucgggccuuuugaacccaggaucucgaaaugcaucgugauuccugucccuuggauuguaagguuuauguagguaaucguggaaauaauggaaacaagacugaauuagaacgggcuuuuggcuauuauggaccacucagaaauguguggguugcucgaaacccuccuggcuuugcuuucgucgaauuugaggauccccgagacgaugcugaugcuguccgggaacuagauggaagagcacuguguggcugcuguguaagaguggaacugucgaaugaugaaaagagaagucggaaucgugggccgccucccccuuggggucguagucuucgagaugaugaccgcaggaggaguccuccaccucggcgcagauccccaagaaggaaaagcuuuucccgaagccggagcaggucacuuucuagagauaggagaagagaaaggucuuugccucgugagagaaaucacaagccgucucgauccucucuaggucucguagccaucuaggucaaaugaaaggaaauagaagaccaguuugcaaaagugguguacaggaaauaacuucaucugacagaagcauguacaggaaauuaaaguuuuguuucagacuucauaagcuuggugcauuuuaagaugguuuagcuguucaaauuuguuuugucuauuggaacagugacacacaaaaccauguaauucucuaugguuucagauggaucauaagaugaaugugauaucaagaauuguuacuuuacaauguucccuuaagcaagauuucauuuucuuggaauuuuaguuuuucauagacugaaauaaaccuagauccugcccaguuuuaagugugauguacuaaugauauaaagaaacuggcggaaaucgaaagaaacuguaguccucuaguagccgagacacuguggcacuguggguggaaugauaaagugguguuuaagagcugcugugaacacgagccaacagauaaaggguaggaaccacacucugaagguuugcaaagagguuccucccugcuuucuauacagggaugcagagcuauuguaacgucuuuauuuggaaauguaaaacucagauaccaguguccuuucauuuuaaggguacauuguagagcucaacuuuucaguuacugugcaagauuguuuuucuuuuuacgugcugucauuuguaguauguuugugagaaucuuugggauuaaaguuuugguuacaaauuguuguc

SEQ ID NO: 7774 - RNA, 1955 nt, Mus musculus
agcccguagagcuaauguggagcgacgguaagccucauagcagggcugcagagcaggguaguccagaaaggcauaggugguagucagaagcuagcaagauggggaaccccaaaaaagaaaucuccaaaccugaacaaauuauacagucagucucaguuucccaagcuucaaauaggacaauuaauacaauaaacuugagaccugcaaagaauuggaucaccucaagcaagucaggcacagaccuuaguggaaaacacuucuuguggauccuagcaagaguaauguggacuugcugccuacacgggguuugccaaggcuaggagguugauacacgguauuaaguauggugguacugccuggccuuuagaagcagaagagagagagggagaaggggauggggggcggagggagagagagagagagagagagagagagagagagagagagagagagagagagagagagagagagagaucgucuuagacaaaagacuuagucaaagcacaggcugaaucacucguggguaucuugccaugcuuucagacugaguacaaugugucugauccuccgcagaaagacuaccagcaccaguguugacugcagagccaucgacgaaucagagcuuugagccggguucgacggugcaguuucgauguaccgcacccaaggcuggccuacgcuuugagucuggccugcgcuuuggccugcauaccgaagacuuguaugagcgcagccugauccagauacugaagucuucuggucaugaaacuguauuccagcugcaaaaccucucagccgcagauucugccagcuacagcugcaucuauacugaacugaaaccacccuucucuggaucugcucccagcaaccuugugccucugaugguggacggugagcugagcaaagccacguggcuagcagcccaguggggugcuagauaagggggcagagguucugugcugugauccugugauggaccauucuuuuuggguugugccuuaaugagauauuggacuuagugguucuugaagaauccuccuccaggcaaggcaugggacucugguauguuucccagagucaaaacuggccuuggucaaacaaugugcaggaguguuaggauucaagauuuuaguguucagguacacucaucuaugaugcauguguauuagcaccacuuauaucaguggcugccuagucugggcugagacugucuccacaggcuggagcuaauuuguaacuuuauagagcccuugaguuccuggggucuauuuguuccuccgaucucuucaucaaggucucccugagucagaggucauccaagcagagaccaugcagggccuccagccaggcuuaauucugaccucagaccuuugaacugugcuucugccagaaacaguuuccuaaaaggucucuuugccucucugaggagccagggaaucccuggaacaggucaaagccugggagauucauagcccuugugaugcuggggaguugcacaccuagaggagacacagacauuauuagauggaugcccaaggagcaaggcaagagagagagccgccugauuccuaguguguagugcaaaaggaguaagcucaccauagggccuuauaggaaaugucccaaacugaguacuaucccucacacugcacuagguccaccaccaccaccaaagcuccaagcucuaugaaggguaaagugccugcugguuaugauguugcucuacgcugucagagugauguaccugggguuaucauggacugcugugugauggcaaauuugugccccacaggauccuacgaguacugaacuccuauaguaaacuggagcugcauuuugugggucccgaacauacaggaaacuauaccugccguuauaccuccuggcagccugagcccguccacucagagcccagcaacuccguggagcuccuaguggaagguauggcagugguu

SEQ ID NO: 7775 - RNA, 829 nt, Mus musculus
ccuuccccuuuccucugucaucuugacaagucgcucuaccccgacucagaucuaccccagccuaccccaacuacucuugagaaaagugucaaaagcacaggaauggaagaaagacuguccuaaccggccgcuacauucaagacgcagaaagaacacagggaaagaccaccagaucugugcuuaccgggguuuccaacgcccaaaggaaauccagccuucaaacagcucgaggagcucuuuucaggagagcugaucgcgggcagaggcagagaacacuguccccaaauagacaaaaauucccuccccggagccuggggaguccuguccuggcucgcagauuguaaguuccagugagaagugucugcccgcugcaaugggcaaaguuucccagcggcggcgaggguugcggccgcugauguugggucagucgcaggguuggggagagugggcggcaggcucggaggcaaagccccucucacuccagagcugccuucuuaggucgccccggagcgcggcucugcacacacggcucuuccaaccguccgcucacucccucugucucucgcuggaauuacuacagcgagucagaaaaaaacgcccgaaaagcuucuuuuauacugcgacucaggaucccuccccucccuucuuuuucccgccaagcgucggcgaagcccugcccuucaggaggcaggaggggagcugagugaggcgagucggacccggcagcugagagcagcgcagcccagggguccucggccgcgcagacccccggaauauaaagggcgggugggcggggauuagccagagaaucucucuuucucccuucccc

SEQ ID NO: 7776 - RNA, 5056 nt, Mus musculus
uguauuuuuuccaauuauuuuauuuuuuucuaaaaacaauagaaaaaaaucaacuuuaaaaaugaaaaugucuuuaaauaaaaaaaauuaugguacaugucuuaaaaucuuuuguaacuguuauaaacguuuuauuaaaguuauuuacauuucaaggcccuauuuacaugggaaaauuggauagauuuuaagauuuuuuuaaaaaaacaauuaaauacaaaucuguuaaaaggaaaaagaaaaaagaugggaagcauaaaaaaaaguucuuuuauacuauuuaaguuugaggcaguuaaaauuauggcugaagcuuacagucccaaagccccagccaagguugugagguuaggcuuugagcaugcauuuuaauuccagcgcaucaguucugucagaaggaaccguucuccuuacucucacgagagauuccagcuccuccucgaguuaggucaguuuaugcaccagaguuucgaagcuguucgaguuuguguuucaacuguucucgucguuuccucaauaaguccuuuucagaggugagcuugugcucgucugcuugaauggacaggauguaggcgguggcuuuuuugaggaucacuaccuugggggccuuuucguuguuuuccaauucagggaucuggucacgcagggcaaaaaagcugcgcuucagcucguuccuccucugacguuccaagacguuguguguccgccucuugucguuuuccuccgugucugaggaccuggggcuggagcacuugcgguuguugcugaucugcuucaggacccugccacuguccaacuuggcccucuuggcagcuggauaguccuuccuuguggaggggggugcggcguaguugugcuggugaguggagacguggcaccucuugaggaccagugggcugugcggagguuugcuguggccucgggauggagaugagcccgacuccgaccucuuggcagggguuugccucuucuccacagacaccacaucaauuucuuccucaucuucuugcucuucuucuguaagggaggaaguggaagaucacaguuagccacgccuccugaaucccggacgcuauacauaggauuugaccgaugcuauccaaauaccaaguuggaaagggaagaaaguaagaaucagauccagacaccaucuucccuucucccagaaaggcagaacaggguuagggcacaggugagaaaauuaccauguaccaggauaugguauccuugccaauucuuaccuaagauuuaaugaggcuucagacacacccaaagcaaagcacauuucccaagcaccuccuauuuuuaagggacuuuaccgagaaccuuucaggucccgugagggauagcugcaaaucucuugcuaugacuuuagcaacucccuauuuuacuggaagcacaauuaaaaaaaaaaaaaaaaaaaaaaagucuugcagcuuugccaaacguccugguguugggggaguguugggacggggggagaaguccaaauugaacagaauuugcuuugaaguguucaaaagaggacgaaaaaacaaagcaaaacaaaacacccaaaagagcccagcucuucaauucuuuaggaacuuucacuagugccuggcucuaaggcuauaaaggcugucccagcuucugucauugcuucucuugggucuuagacaaacguauccauuaaauucaaauauucuucuggcagucaagaaaagaagcagguaauucaccccccuccagaucaguuccuuuauccucauucacacccuucccaggguaauuaaaaugcuuaggagggguaaagggaguggauggagcugaaagauaagccagaagauuuaaaaacccaaaugaaauuccugaggggugggaaggguggggggugggggugacaaccagggcggucugggggggggggggggaggggagggagggauagcugaagcacgggaauccagggaugaagagcucuuagacagaagggaaagaaagggggagccccggaggccaauugaauuaaugccaaugagugguggagaaggagguccauccaaccucucgcuuccuacccugcugugaaugggguagcuuaccagagucgcugcugguggugggcggugucuccucaugcagcacuaggggcucagggcuggcccguggggaggacucggaggacagcagcgaguccgaggaaggagagaaggccguggaaucggacgagguacaggauuugggcgagcugcugucguugagcggguagggaaagaccacugaggggucaaugcacucggacgcggcggcggugagguccugcagguacaggcuggagguggagcagacgcugugcccgcgggcggggcucaggcuggugcugucuuugcgcgcagccugguaggaggccagcuucuccgagaccagcuuggcagcggcugagaaaccgcuccacauacaguccuggaugaugauguucuugaugaaggucucgucgucaggaucgcagaugaagcucugguucaccaugucuccuccaaguaacucggucaucaucuccagcugaucggcgguggagaaguugccaccgccgccgucaucgucuucccuuggggagaaggacguagcgaccgcaacauaggauggagagcagagcccggagcggcggcucggggacaggggcggggugggaagcagcucgaauuucuuccagauauccucacugggcgcgggcggcugcagcucgcucugcuguugcuggugauagaaauucucuuccucgucgcagaugaaauagggcuguacggagucguagucgaggucauaguuccuguuggugaaguucacguugaggggcaucgucguggcugucugcuggagggggcacagcaagggaagcaagucuagaguuauccagcucugguuggugcggaaaccuggcgcagcgcguaccccaauccugaaccacuccccuuucagcgugcuguacuuccaagugugugugugugugugugugugugugugugugugugugugugugugguugggggggaggcaugcacucuuuuacucccuacuaucagugacgcucgucggacuagcagcugcuccgaguccccgccuccuucgagcagggacuuagcccugcagacgcccaggaaucgccaucggccuuggcuucagaggcugagggaggcgacuguagggaauacagucugcuaagagccgaggcgcaaaguuuugcgccaccugaaggagaaaggcgagaggcgccgcgucgcucggcccccucccgugugccggcucucugcgccgccgaccggguccgagucccuauucgcgccgucgccgcgcuccuacccagccggcgccgccgccccucuccgcccuccucuuucuccacccccagcgcgcccccuuccuuccuuugccggcuuuucuuuccgauugcugacuuggaggagagagcucagucuccggcuaucacaagccucucgaaauaaaaggggagggggugucaaauaauaagagacaccucccuucuacacucuaaaccgcgacgccacugcaccagagacccugcagcgauucagcacugggugcagggcgucuucccucuccccgccgaggguagcagcuguuacggaaccgcucagaucacgacucaccgcagucuuccuagcaauucaggggcgcgagggauacccgcggaucccaaguaggaaugugaggauucccucugguuucccccaagucaacgaaucggucacaucccugucccaauuuugcuucuccucacugcgcuagcccaacaucaaguccuagugccgcgggggucaggcuuaaauuuuacuacgaucacuauuuuuaaagccaaaauagcaacuucuuaaaaggcucagggacggguugcgaucgccgccggggauuggcgggcgggacgcaccuccgugucggucccaggcugucagaaaugcaccaagcugaaauuuaaaugcccucucagagacugguaagucagaagcuacggagccuucucgcucccaaacgcaaaagguaaucccuucuccaaagaccucaggauuccaagggcuuucuuuggccaccacgaagcgaccucccgguuugaccccucaaaggacacauaucaauuaauguagcaaagcaagaauguccaaccggccgggucagcgucagcccauaguaaccucgggaaccccgcuucaaaaugcaucccgguuuuucccuuccccuuuccucugucaucuugacaagucgcucuaccccgacucagaucuaccccagccuaccccaacuacucuugagaaaagugucaaaagcacaggaauggaagaaagacuguccuaaccggccgcuacauucaagacgcagaaagaacacagggaaagaccaccagaucugugcuuaccgggguuuccaacgcccaaaggaaauccagccuucaaacagcucgaggagcucuuuucaggagagcugaucgcgggcagaggcagagaacacuguccccaaauagacaaaaauucccuccccggagccuggggaguccuguccuggcucgcagauuguaaguuccagugagaagugucugcccgcugcaaugggcaaaguuucccagcggcggcgaggguugcggccgcugauguugggucagucgcaggguuggggagagugggcggcaggcucggaggcaaagccccucucacuccagagcugccuucuuaggucgccccggagcgcggcucugcacacacggcucuuccaaccguccgcucacucccucugucucucgcuggaauuacuacagcgagucagaaaaaaacgcccgaaaagcuucuuuuauacugcgacucaggaucccuccccucccuucuuuuucccgccaagcgucggcgaagcccugcccuucaggaggcaggaggggagcugagugaggcgagucggacccggcagcugagagcagcgcagcccagggguccucggccgcgcagacccccggaauauaaagggcgggugggcggggauuagccagagaaucucucuuucucccuucccc

SEQ ID NO: 7777 - RNA, 345469 nt, Mus musculus
caugagugggaagagaaccgaacuuggaggauuguugcagaauccagaaggaagagagguaagucuucuagagccguuauugugagcaugaggaaggacaaggguuaaaauaagggacccaggcaccagagagauacugggaagaaggcugugucuccugaggccuuagagaucaaauagaagauaggaaacuaaaccccauaguuuugcugaguguuuucuauuuauuucauuuuauuguuuugagacaaggucuuauuauguagcucuguguguccuaggauucacuauguagaucaggcuggccuuaaacucacagagacucgucugccucugcuuccaaaguguuagaauuaaagaugugcacugguuacugucuucugaauauaagcgaccugugcuuauuuugguccacagacuauuuaauccuuagaauuuggucaucucauuuaaaacauucuuuucaccuggcugucgcucaccacuacccacgauguugaccacuacugaaugaaucucuugcuugaaaugauguugcauggcuguagucccagcauucuggaggcugaagagggcacauggagaguucaauagcagcuuguggucauacagcucugaacauaccaaccuugucugauguuggaagcuuagcaggauaguuagugucucauuuguacuuggacaggggagugccaggcuagucugugcuagauaaugagacucaaaaaacaccagaaagguccuauuuuccacugagacuccuuccaugcagugggaacacguaggcuugcaaccugcagauaugcuaucaacuauuaauagcucucaaucaaggacucucauuguuaccucguagggguaaguuuuucuuuuguuuagcaucuacaugaccuguucuaccaaccccuaguugcugagaugcagaccauggcuaucaccccugcuccuauguacaacaaucccucauccuuguuuaucugguagguuuguucuccugaaccaucuccaucuccagucccucucuguauucccaaggugacuuuuccaauccagccauuugcugcaacugaccuccuaagugaacucuuugcuucugauuaaucuaugcugaaauccguucucugcaugacaagcagggggauauuucuaguggacaggacaccucgagccucagcccugcucaccgauagucaagacagaggugacagccucagcauggaacacacaaggccucuuggaaccugguuuaaccuuccauagugacucuguacuuucguuucugauucucugcagaccguucucuguguucaaaugccucuguggcaaacucaacuuuauuuuccacguuccagcacaggcuccuccucucuuuucaacuuuugccaagcacaggccucguugagugcuuccacaucugggaucugagcccucucuuccuguucucacaggagccuuucacucccuugugcagccacucauguuuguggagcugguacuggagacaggguggucggcucaaaacacaugcuucauagccuaacagaaaacugucugcaacuguuggccaguuucaggaucucaaagucaauggaccuugacuaacagacugaccaccauguucucaugcacccccaggccuauauauauauauauauauauauauauauauacauauauauauauauacacauacacauauguauguauauguauauguauauguauauguauauguauauguauauguauauguauauguauauguauauguauauguauauguauauguauauguauauauauauguauguugcucuucucucuuccuugaagaaugucuugccucaacucauucugguuccaucccucucugucauuugagcuggauuugcugucucauaauucaggaggagcccagucucgccggaugauggaauggauuaguccagagcaaagaugucuuuaguuacagccauccuguaauugcacuguaaauaaauccaauacuucuagccauacaaguuacaguaugggauggcuggcggcagccugaaaacagcaccagaauccacaagcagcagaggacagaggggaaaugagccaaugccguggggaagaagacugucuggucugucaaucaaaccggauaacacacaccaccaggguucagucucccuuucugcaucuucacuuuucugcgacccuggaggguuaucaugucauaaagagauauuuaaaauguagucauuguuuuggcuccauguuagucuauuucccuagcugaaaaauagaauaaaguaaagaagggauggaacccuugucuagccugcaggaagucuuguguuuagaugcagcaaacagaaggaagggaagaaaggaagaaaaguaggaaggaagcaacauagaaagggggaaaaagaaaggaaggaaaaggaaggaaggaaggaagggggaggaaggaagaaagaaucacugaagugguucaguagguuaaggggcucgucaccaaguguuaugacuggaguucaauuguagggaccaacaggcuggaaggagagauccaacucuaaucucuucuuccccuucuucucuccucuucuuccucuucuucuggcuccucuccccucuucucuuccucuuccucucucuucucuuccucucucuucucuuccucuuccuccauuucuuccuccuuucccucucucuuccucuucuuccccucucuuccuccucucuccuccucuucuuccuccaacucuuccuccucuuccucucuucuccuucucuucuuccuucaucucuuccuccucucccucucccucuccccuccuccuccuucuggcuuucucuguacaaacuagucuggcuuugaacccagacaucuaccuaccucugcuucccaaguucugggauuaaaggcaugaagcuuuacaaccuccauuuuguaacauaauaaaaauaaguuuucuuuaagaaaaaagaacaaagaaacaaagcuggucuuuaaucccagcacuugggaggcagagacaggcagauaucugaguuccaggucagccuggucuacaaagugaguuccaggacagcuagagcuacacagagaaaccugucucgaaaaacaaaaaacaaaaaacaaaaaacaaaaaacaaaaaacaaaaaaaaaaaaacaaaaggaaaagauaaaauuagaaacauauauuauaauguuuguuuuagauaguagugcuauuaaaaauacuuucuucugugaaauuuugcuggaauauuuucuuucuuucuuucuuuuucuuuuuuuuucuuucuuucuuuucuuuuuucuuuuuuucuuuuuuuuuuuuuuuugacaggguuucucuguauagcccuggcuguccuggaacucauuuuguagaccaggcuggccuggaccucagaaauccaccugucucugucucccaagugcugggauuaaaggugugggccaccaugcccggcacuggaaaaauuuuuaaacaucccauaaaaggaagccccacuccccaaaguaacaaccuggacagaaagccuucgaagagaaugcuuuaaaaaaugugguaagaaugcugaaguguagcucuccacaacuuauggcuucuggagggggucggguagguggggaaggaaucaguuuucuuuaaggagcuggcuggucccuaggaguguggccauacuccaguggcucuaugacuuuccaguggugguggugguggugguggugguagggauguucacaaagguggggaggacugacaugggaggaucgggauaagagugcuauuagaguguauuaugugaaauucccaaaugauauuuuuauauuauaucgggggaaaauauuagccuaaaauuagcgcagcaaaauuuagucccagggaagggcaaacugggucgagacuaaagcugaaugaaccugggugaaggucuucagccguugggaggucuaguguacaggacuaacuggaaggagcagguggcaucuucagggauuuguuacugaaguugucuuuaaaacugggccucugagagccugugguugcuucuccccaaggucgcagcaggugguuugggaaaugucugacacaucgaaagcacauacagacauagaauucagaacccucuucacucucuagcacaagaaggagauaaucugaaggagauaaucggaagaucuguucggucacucucaggguggaaaccaaccacacacagcgcgauuauccgugcauaucgcacuggcacacacgaguaugguaaauuuucucuucaacagagacaucuucauguggcuaagaaguaaugaaagugaagacauugaagggggaacguagagggagggaggagauaaagacucucugagagauugaaauaaagugagguauagugugcugagagaagaguggacccgcguuacuuuccgcgauccugguaucaccuaguuaugcaacccgcuuuccacaggacuccgguuucccucuaggaucugagucuaccucaucuuucauuccccuuucugguuguagcacguugccgcgcuugacuaaaugguacuagagacgugcaccuguucggugcuggauugaauacagcgaaaagaauaucgugguauacgcgugccuuucacaccagccuucguucuuugcagaggcuuuugcacauuugagagguuaguguaauacccuguacggaccaagaauggaggaugcugcagacaggugguccucucucagcuagaguuugcuuaguacguccuucucuccagaaccacagaugauggaugguacccaggacugcucucagaugagaguucugaaauagaacagauucgggggggucuucuguaggaacuacugaccuauuuucugagcaguuugguccuuuuaauucacuggagucuccuucccuauccgaaaagugggaagacugcuaagcuucaaggugaagggggaugggaugucuaccuuaaaaaggaauagugugggggaggggaggguggggaggggaggugggaaagcuaguugaccucgccugggcauagccccaggcugugugggaccuauguaggaccuagguuugagugcagcuagaaccucccagcccaggacugacagagugugcucucuacuagggccaucugggcauuaagcagccucaguggcacgccaccuccaugcgguucuccucucaggcuugaugccccuucauugccuagggcagcaggcagaggggcgagcuggaucccucaggucagaaaccuccagacaccaggagaucggggacacacgcggccugcccgguggcgcgcgcuucucccccucccccgcggccgggagcgagccgccgugacgucacgggccacccgccagccccgcgcucuaccaggcagagcgcguguggccgccgagcacauggacccacuggucaagcgggcucggcaaggccaggaugaagagaagcuacgaacuuagcauucccagagccccccgaguggauauccgcguggaaaggauguuggcagccccggugaccucggagucacggcuggauccacccucuuguaaguuccaaguuuauccccuggaaacucuggagcccagggaugcagagucuggauagaggaaaguggcuuuugcauucccacgagcgcguguuaaccuugcacuuuuccucaucacuagacucgagauugccagagaguuugggugugggugagaagugugggugcgagggagauuucccaggauggccucuacauagagguaauucuggauuuaugcacuugaucaagagcccauuuccucaggucuaaaagagagagacgcccccugcaaucagcgcagauuuggggccgcugaugugguuuggaggccucauuuacgaaacuggaagucugagucuagucuagugaugcucccuccauccuuggccagcccuccuccgagacacccccucggggcagaaagaaggugaucuccuaaaacucccugugucaggaaacuuucugugcuuuuguauugcguuccuguguucguggaaggcccccacgccuucauccuugcuaauucuuuuuggauagcuuguugcuuuaacuagauuggcccuuucuuggcuaguauuuucugcuguaccuaugaguggugugggagaacugugcagacuuccaggaagcgcagccaugaagcuacaugugccuauguguagacacaucauggauuuucuuacuaguuuacuagugggugauaaucuguccuuuugagcucuccagaacguucuagaagcuuaaggagagaaaucacuuaagagaguauagggagaagugagguuuuuguuuccuuucugcucuuguguuuuuaagggguuguugucauuugaccuagagaaagccaaaugugugugugugugugugugugugugugugugugugugugugugccugccugcuugccugucugucugucuguuugucugucugugugucuguguguuggggagggcuaaggaugcaggucucuguugaagugcaugugguaggauguugcaggccuguuuugcauaugggcagugacaaguuugggcuuguucacuugcacaguccuauggucauagcuaguccuucuuaaagcucuagccagugggaaagcguuuguguuucuauccuuggagcuccaagugggacuucuuaaaagauuuagaaggagcaaagcugucaggaaaucagaaacgucacauggacuccaugacugggaaaaaccucgugguggccugcucucagugcuuggaugugugcuaguuacaucucggaggugaggaugugccuuacgguuauuugaacucaacuagguucaugauggaucuggugagacauuaaggcugguuuaagacauugugggcuauugugcugggacccccaccccacucuguuagggagugacuguaugggacugccuuguuguuuugccugguuaaggguggcuguuucuugcugcuuuaccuauugagugcaggauuuugcauaaaccagcuucccuugaaaaguagaagaaauugauuuuuuuuuuuugauugauucuccucugacucauccuguuuugcuucugugacagcaguuuacagaacuggaaaggugucucuuuucuguuguuucugguaauuuguauuauuugcuccuugaaagucugucugcugaguucuuaccaucuccacggauccgauucuugucuucuuugaccguggaaggcuggcaggcagccugccugguugcugaggccucugucuuccauguccgggaccuucugucugccugcccaaucuagcugcuauccuuaggcaccucagcuguugacucucuuggaucauagguuaccuuugauuccauuuugugcaagaugcccugaauuuguucauauuaagggcagaccagcauuuuccuggggacucugaggaccuuggauauuuguugaacucuacuacacacacacacacacacacacacacacacauuugaaaauaccaugaguauggucuaugcaucauuuucaccuccucucuucccugcaacuccugaugugaccccaagcccucucaaaucucuaacuucuuuuuaaaucacacauaaacauaauauauaaauauauaguuugcuuaguucauuuaacguugcuuguguguuuaaagcugaccacuugaaauuggauaaccuaucagggacucacccauggagaaaacgauucuuccucauuuggcagccauuagcuagcucuuccucgagggguaaggcuuugugaaguucgucacauucacguugacauguaaacuuguguugugguggucccuguucuuuagagugguagcugaaagccauuagauggcuauacuuuagauguauauuuuagaugccacauggccuuugcgugcacuggcuuguuauugugucuuucuuccucuaguugguugcagacauagcguucugcauguugcuaacacucccccccccucccuuuuucucccuaauaucaguuuaugaaaucacuaagagaccagaacguauuuuccacagugcauuucaugcauauugauuuaaaaagaugggcagaacauaaucuagaauaagaauagcuaggcuguuguggugcuuccguaguuacaagucugaugacuuacugaaaccuacuguggcacaagagaaccaaguccccaacauugucuuuugaccucuccaggcaugauuuggcauauuuucuagcuuacacacacacacacacacacacacacacacacacacacacacaacuuuggagcuagguguggugguucaugccuauaauccaaggauaugggaaguugaagcaggaggauaagcgugaguucaaggccagccuuagcuguaggccaguugaacuacagcuugucucaaaauuuaaauaucagaaaaaaagaaaacaaacgaacaaacagaaaaaucagauuagccucaguagacuccugcugacaauuauguuuuuaaaauguaucaguucuguuucauaauaggcuggcugcaaggugaauccuuuguucugucaccagaauucuagccaugccugaccuuguuuaacuuuggagaucagagcagauaagggauuugaggcaauauggcuguagaucacgagccucgaugaccugauuugcuuuucuggcaccaagcccuguaaggaacaauacgguagucauaguaucuaauaggaacaaaggcaauaguaugacagugacuuucggcuucuuuagcaugcuaaguuuauucuuuauauuuguguuguccauaacucugcagaaauacguaugaaaaacguccagcuuucauggaguucuuuuuaugggcaaggcuguguguguuuguuauaggcuaagcugaccuccagcuaguauucucucagccucguccucucaaguauugaaauaauagguguaucccacuaaauucacacuuuuuaaaaaguguuuuagauauauuauuuuacuuuaaucucccagcaaucucauaaaauaggauuauuauaauuauuguugucaucaucgucgucgucgucgucgucgucgucgucaucaucaucaucaucaucaguuuuuagaccagaaacacagcugagggucaaauggaucaccccaggccagguaacuaggcaccagcaaagaugacgggauuuagauccgagcuauuugucgaccuucagaaaagucagaagauagugaagaacaaaguagaagauggcccuuggccuugggcaggaauccugaguguacccugccugcacacccagcucaggugcaagggaaagcuagucgcuuaugaagagauaccuuuguucagcugcccgucuuuggugccacaccuacccgacugacacaagacaaaguuucagugcuggaagaguuccgggcuguagucuuggaaggggugugugugcuggggcaugggcaggggccuuggguggggagaggugggaagguuccggcugagccuaagaucaauuugcaaagggcaccgacugggcauguauccugcuuggccuugugggaaaaucauucuacuggcacaguagaauugaguuacuguugacauuagaacagauggaagggagggaucccuugacaucaguaacacccuugcuuuuccuggugcuuucugagcgccagcuuaucugcuagggguauucagguccugauguagggaccgucaucaacacaaagauggugauggcuuuccuuguacuccaucauuaagaaaacaaaaugcuggcuaguugguauuaucuuggaguccauguguaccuuccuucuauccugcccucccuucuuuccuucucugucuuucagaguccaucucagggugacaggcauguuagccagguccucuucccuaccccagcuacuacccucuuagcccauggcuaaauuaagugucuuuguguagcccuggcuguccugagucucuauguagacuggacuggcuucagacuaacugaggucuaccugccucugccucccaacugcuggauuaaagacaugcaccacuacucccuggcucucuuuugcuuuuugagacaaagucuccuauauuuucagguugccuuuaaauucccaacuccuugugccucuaucuccagagugcugugagaaccaguuugucaucaucaaccuauucucuccucaucucgaauucuguuacuuuggcuuguuuguuuauaaguuguuuuuuuuuuuaagagauuuauuuauuuuuauuuuuaccuauaugacuguuuugccgcauguguauauguucaccacuuguaccaggugccugcugaguuauaguugccaguugccauagguuugcuggcaaucaaacccagguccucuggaagagcagccagugcucaucaccaaguugucucuucagcacuaguuaagugucuucaaagauaaagcuuugugcgugccagcuaagugagcugcagccccaguuaucgauugccuucuguuuugguugguggugcgugaggcauggggugcuguucuauuuauccaccucucuuccuucauugaccuuaaacuucuugcaaguaagauaucuggugucuacacagcccuaggccuugugggaaucagguuacagguaagaacugcuccccugaccugccgccuccccccauccccuuccaaggaaaggggaaucugcuguuucuaagguuacugucuaucaguugugaaacaguugacagggcagaaagcgaggccuugccuccaaggaaaguacacuugaaaaaggaggcagccagagagcugcaagauacaacuggggccauauaaaggccuguauagaucccagguacuuuugagcaaauaugucaccucaguuucugugucuguaaaauuggguaacugagcugcugugaggaugggaggaucaucagagagagacauuaacggguagagggccugggcucagcaacagaaccauucuggguccaaacacaggucaugagaccguaguggcuucaccagcuguucaucagcaucagaaaguagcccuggcuggaauaagaugugaggagaaagucagucagcugcagagcagugccccggaagucgugccuccucagaggucagacugccuuguacaccgcccugggaagcucacugggccagccuaucuucagcuacgucuugugggaggacagugguucugcccgcugagggauggugcccaggucucagugcagcagcccuugagugaaagccuuugccauuguuuauuauucuguaggccuguugccuggugaaucagccuugccauucgcucucugcucuuucgagcacggauccagaucgaaugagucauucauuuacugagcacaugcugggugccaagcacuaggcuagcaagagcaagaggacaaaaauaucuaccauccuauggcuuccauuuucaucaagguacccaagagaacaggguggaaggagggcaugcucgcaugugugcgugcguguguguguguguguguguguguguguguguguguguguguguguaugugcauaggagcacgugugaugaugucaaugccacgugggccuaguguccggcucagcuugugucugggcaggccuggcauacagugggcaccacguaaguaguucuugccguguuuaucauugcuauccugcuucuucgguggcugucuuuccuuuacagcauuuuauuuuccuuuguaacgugugccuguuuuguuuuauuuuugguagacugcauaugugugucugucuuuugccaguaaaugguuaaacccugugaacacuuguuccuucugcccuuuacucucaugcucaugggauauauuuacugcaggccaagucuauuccaauagguuuccaaaguagugggacuuauaauauagcaagaugagacacgugaggaauucugcacauaguaaugacauguaugguaucagugaggguugaaagugcuuggagccuagcagagagacauuagcaucuggagggcuggaguggaguuggcugcagagggaggcucucuggguaaagcaauuccgggguaaugcagugguccuaugggcucaggaacuugugugcuaguguagggcuguguauuuuuggcccuggggagaggucagacaggcaccaaggucagaguggggaucugcaagaagaaugggaaggguccaaggagagucagucaggugacagcaauagaaacagaaaccagagucacaugcuacauacagggccuuucagaaagugcaaaagcucuuauuuguguacguggaaguguauuugagcgcaugugugugcgugguacauguggaagccagaggacauuccugaggugcaagccaccuuuggaucucucauugaccuggaguucacuggcuaggcugcaagcaggccuuuuauuucugcugaugcagaggguugaauuuaagguaugauugcaaggcccgcacguuacugacugacccauucccuaguccucucccaccuuuccugagaccaggucucauuauguauguauauagcucaggcugggacuuggacuauguagccacaccuucccaaggguugggauuauucauuuguaaccuucugguugagagcuguuuaucuuuuacccacugguucacugggagguuuuagguggugggugauacgauucuauucaauuuagguuuugagaucagaaaaaagaaaaugggacuggaggaaggggcagcuggaaguggagugugaggagccacuaagcacacaccauaagcacuucuuuaggcugugagcucuugauggggcuacaggaguaagcugcaggcuuuuccuuggagauuccagcauggaaaacuccaccauccaguccaguagccuucugugcccagaguguuuuuaaaaugaacuuggaaugugcuuucuguuaaauacauagauuuuuuuuuuuugaaagcacacccaaaaggggauguaaaaucugagugauccaguuugguccaguugaucauaucuugaaaggguaauauuuuagauugccuuggguuaggcggaauaauaugcuuuuaaaguuaauuucaucuguuucuuagcuuuacuuauuguggcuacugggaaaucuuccuaacuucuuuuuucaagacaggguuucucuauagcccuggcuguccugaaacucacuuuguagaccaggcuggccuugaaaucagaaauccgccugccucugccucccgagugcugggauuaaaggcaugcaccaccacgccuggcauuacugggaaaucuaaaacuguacuugguaauguuuccaugagacagucugaggucugggaggcauuuagugaacagugugaguggcaggcaggggauucugcaaagagaagaagccauaccccuuuuucaagaugcuuccaggaggauugauuuagcucaguuuuagguuguuuuuuugggcaugccuaaaaccuggccuugaucucuaucuaacacggagggaagcagggaagaguucaaggucuugcccauuuacaaauugaauuuguagcuagucugggauacagaagacucuauccaaaaauaacacaaaacaaaacaacauuaaaaaaucaaaacgacauuaaaaaaaauccuucuacggcagagaaaaaggagggugaacauaacugcuggcccguuugaggggagagaauaggcaggugggugggaccguagccauggaucugcugcagcagagaagucuggccccaggacagggagagaugcagcuggauucuuccugguaggacugaccauugagcagccuggucccugggucaugggguguugaauggagacaggaagugagaugucuguggggaaguaagagaguagagugcuaucuagaucaacaauggucagacugauugguaugugccauuagcuugggacaauuuuugcuuuguuuuuucuuuuucuuuuuuuuuuuuuuuuuuuuuuuuuucuuuccauuuuuuauuagguauuuagcucauuuacauuuccaaugcuauaccaaaagucccccccauacccacccacccccacuccccuacccgcccacucccccuuuuuggcccuggcguuccccuguucuggggcauauaaaguuuguguguccaaugggccucucguuuuuucuuuuucuuuuucuuuuucuuuuucuuuuucuuuuucuuuuuguuuguuuuuuuugagacaggguuucucuguguagccuuggcuguccuggaacucacuuuguagaccaagcuggccuugaacucagaaauccaccugccucugccucccaagugcugggauuaaaggguugcacccucacuaccuggcuaaaauaggaccuuuuaagcgucucagcaaguauuuagacagaugcuggggagcacggggaaggugggcuucgggagcaagcaucuggugggaauucugggacagagguaugacuagggaaaugaaaagucucguccucaaugaaggaugagcuuauucgucagaaugggaaggaggacugggggacagacagaucaguguuagaaugcucucccagcauucucaagacccugaguucaagccucuguaaacaccacccccaucagggaggggaaggagggagaaaggaaaagcugaugugggagggggaaugguuucugaaguuagggacuuggcaguauguguaugucgugcauaaggcccuguauggauuugauggccagcacuucccuccaguaaucuacucccaccaaaaacaguuauaaaauugaaaaaauuucuucagucaaguaugauuaauauuaucuuggguuuugucuuucugucguugcuuuuuuucuuagauaguuauaauaauuaccguguauaugcugagcugcuggcuucuugcuuuguugcugcccggucguaggucauacacauuccugaauaagccuauguauugcucaccugacuuuauugguugaguaguaucuguggucuguuucauuguuuacucuuuccuucgauaugauuuauuuuauuuaguuacugagcuuuauaaacacuuagauagauugauuuuuuuuuuuuuuuuuuuuuuuuuuuuuguuccugacaaaucauacggccaggguuucuguauucuagcaucuaaagauuuuuagaauuuuaggugaauuuacuguuuuuuggagacaugcaauguugcucuuuccaugaucuucuaacuugucuuaaauguuuagugaguuacuugcuacaaacauguuuaucucuaucauauguacccucuuaucugucucucucucucccugucucucucuuucucucuucuguguguguggggggggggggcggggagguugggggggguugagagaggguuucucuguguagcccuggcuguccuggaacucacucuguagacagggcuggccucaaauucagaaauucaccugccucugccuuccaagugcugggauuaaaggccugcaccaucauugccuggcccuuugucuuuuucaaauaacauuuucuaauguaccccaggcuagccucaagcuccuuaugaacucuaggcuagccaaacauuuaugaucuccccaauuguacaccucccaggccugcaccgcugcaugccuagcuccuggauuuuucuuccccccucacuucaucagcugauguuuagagauaccugcugugugcagaaugcuuggguagguuuugcuuauucaggagugcucaaaggcacagugguauugauacuuaagggacuuauugcaaggacuuauugcaagcgaggaagcauaugcauguaggccacauuauuguauaauguaaagaacaugugauggaaguggggagggcugauggccagggaagacauugauacugaggggcugugugaguaacugagguagaggucagacgcugagguucaaaguuaacuagagagacggaacacagaagacgagcucgauaaaaaaaagagauauuaaagagaaauagcacaccuaggauugcaggugguaaaggcuugggagguggccaauccucacaaccuggcuuuugucccuggcuccaagacauguaaaguggaaggugagaacugaugauuuuaauuugucuucugaccucuacaugaaugccaugguccaagcccuccugcuaaugauaccuaagugaaaguaaaauauaacuaagacuuggaagauacuuagagugucuguaauauauuacuuacacacacacacacacacacacacacacacacacagcauuucccaaagccaauaacaaaagauaaacagacuccacagcagagugaguaauagauuuaaaaaacauucucaaaagcagugagcaagaaggaugacuaauaugaauagauuuugaauuucacccauaaaaucagguuucucuaaagagaggcuuuuaagaggagaauucauucuuuguguuuguguuuuugguuguuguuuguuuguuuuuaauacuccgauguguuucgguaaauguagauagcucgguagcacugccaaguccuaugucacaaucaagaccuaggaugcauccaucauccuuaaaacucuccccuuucuuuguugugaaucuccuuugcuccagcucugacaaguacauagaccugcccgaguuacccuuuucagaauguuaugcuaauggaacugccaaggcuguggucuccucauuuuggcuccugucaccuggugccauaccugugaggaucuucuguucguccccucccugagugguuugucaguuccugcacuggaggaggggaacauugugcuucacggaugucccacauugugugaggccccucccccagcugauggauguuugggcuacucguaagaaguaugucuuucacagcuuaacauuugccggaaauaggaagucugacucaagcguuggugggcuugugugacacaggauucugcggcccaccagcuagugaaugugugaggucacaucacagaccagcuugccugugugucaugaaauuggaaacacaugugcagccccacgcagagguaaauuugaggauucccaguuuggacugcaguacuaacuucaggauucguggagaaggaugcgaugcgaaagugggcugggcuggagcaagguuacagggcagccuggauaaugggugagagggcggggcugguauugaguggcaaagccuccuuuccgcucucuuuucauguguucuuuuccuucccuucuuucuccccccuccuuuccuuguuuccuugcuuucuuuugggaaagauuuuuacauuuuucuuuuaauuuucugagauuauaauuauaucauuuugcccguuccuuuccuuccuugaaacccucuucuauaucacuccuugcucucuuccaaauuaaaggucucuuaauuguuguuacauacacauggaugugaaugucuauaugcauguggauguacgcauacguguguguguguguguguguguguguguguguguguuccuaaauauagaaaaacaauuugccuugccugugcauguuacuuguaugugugugauuucaaggcugaccauuugguauuggauaagcaguugucguguucuucccuagagaagaccauuucuccugucucagcuuuucuuaguagucuuuuacauaggguuggggccuugugggcuuuauucuaccaguguuguuagcauguuguuuuuguccuuguucauguucagcucauguuuagacagucauguuggagagcggguguagcuucugacguuucuagaagacauguucuuacagaaaacucacugcuucuuugacucuacaaucuuccuauuauccuuucuuccacagugagccccuaagccuuagggagcuauacuguagauguacacuuugggaugaggcucuauagcuuuguauuuugauuggcuaugcuuuuuuuuuuuuuuuuuuaauugucuuugucuuuugcaaaaagaaguuuucuuuaaaggagguguugaggacuacacuuaccugcggguguaaggacaaagguuuugaccauaguuggggauuaugcugguuuaguagaguagcaguuacagcuccucuuacaagauuuccuaacccuggguaguugacuagguuuccaguacaagacauggguuucccuuugcugagcaggucuucucuucaauuaaagagcugugguuacaguuaugacaugcaugccacuauugcaccuuuaggcuuacggagcuaugcugguugucauuguggauugguggugucauagcuggauagggcuguugguucuucccuccuuugaaaggcuguguucagggaagaggauuucaggucagguccaaccccaauuccaucuagacccugaguaugaaguagaugguaucuuccccugaagcauaaucuugcucuauggcucuggcugucccaaaauuuacucuguaggccuugaacgaucagcaauuccccugccucagccuugcaagugcugaaauuacuggugugcauugccacauuccagauugucaccuugacacaaacuaugucuccugggaaauguaacuuuaauugagcaauugucuucaccauugacuuauaaaaauaucucugggguauuuuccuaauuaauuaauuaacuaacuaacuaauuaauuaaugagagcccagaacaccauuggcaggaucaucccuagguccuugucuguuuaaaauccauagcugaucaagacauagguaauaaaucaguaaucaguggcccucccuggucucugcuucaguuccugccucccuguaccugucucuaugggauucuaguuuuccuccugagugggucccagcuuccuccaaggucccuuggcuucccuugaagauaggcuggaaccugucagccaaauaaacccucucuuucuaaguagguuucagccaguauuuuacugcaauaacagaaaacaaacuagaacaacgcauguuuuuagacaauuuguuuuguuuuguuuuguuuuuguuuuuguuuuuuuuguuguuguuguuguuguuugguuuuuugagacagggugucucuguauagcccuggcugucuuggaacucacucuguagaccaggcuggccucgaacucagaaauucgccugucucugccucccaagugcugggauuaaaggagugcaccaccacacucagcaacaauuguauuuuuuaauugacauaaaaauugucuuuauuuauggagcaacauaugguauuaagguguguauagacauguuugaaucugaguaaguguaucuccuuuagagucugaucauuucugugggaaaacauacaaaccuuuucuuuuagcuuuucugaaauauaccuuacauuuuuauuaccaguguguuccagcauacuaaacacauuucuuccaucugauuguggcucugugcccagaggcuuagccucauugucccuugugcuccccagcuucuuucugaugaccaccauucuacucucaaacucaaggacauuggcuuaggugacuuaguugugagaucauucgguaucuuccuugccugccuuauuuuacuuaacaccgugcuaccuuuaaugcuguuuaguggacaaacauaaacuggauguuuguguguccacucagauucuuagcacuugggaggcggagauaggagcuuuagcaauucaaggucagcuucagccccuuaagaauucaaggccagguccaacuccaauuccaucuagacccugaguaugaaguagaugguaucuucccuugaagcaugaucuuccucuauggcucuggcugucccaaaauuuacucuguaggccuugaacgaucagcaauuccccugccucagccuugcaagugcugaaauuacuggugugcauugccacauuccagauugucaccuugacacaaacuaugucuccuuggguccacagcugggucccacugaagucaugacucgggaauugggcaguauuguuaggauccuagcaguuagacuugagcuuuuaaagagaccacucuuggcuauauaaacucugcuugcauugggcuagauaaaacuucuaucucauuuuuauauaaauauauauuuauaagauuuuauauuuauaagaauauagacaucuauaccuaccauguauacauuuugaaaauauguguguguguguguguguguguguguguguguguggguggguaaauggaagcagauauaacuagcugacuucuucauacucuucauacuuuaagaguaugguuuggggggccggggugcaagaaaaaaaagagagaguaugguucucuuuugucuguuaggcaaagagaacagcacauuugaaggcccgaaagcaggagaaaccuggggguuauucagaaugccaagagaauugugcaguuaggguaaauaugucugugggggcagggccaggucuagguggggacaguucccuguauagggacccuucaacguuccucugugucuucugcuccuuucucauugcuagguugagaauggauuggccaguuaacaauagaagccagaaaguuuggagagaacucuucgcuagugggagaagggacgaauacaaauucagcauucauuuuggaaauagaaaggacuucugucugaaugguaauguuugagucuagaugggcccggacuguagucaggggucuuuugauaucaccugaggugcucuaaucuugcccggagggaaugugacugauuuugaacuagggcagaagugagaucagaaugcuaugccagaugugucugcauauucuaguuuaugugaccgagagagaguauggguuguucuccaguugaguauuggacuuuuuuuuuuaccaguaucaaaaggaaauaggaaaaggaaaaggccugugcauggaaaguccccuggaguuuauggaauugcaguagcagagagcauaagccuuugucuccaucaagcuuggguccacagcugggucccacugaagucaugacucaggaauugggcaguauuguuaggauccuagcagucagacuugagcuuuuaaagagaccacucuugucuauauaaacucugcuugcauugaguucagagaagccccugaggcugaggccagacugcccuagcuggccagacugguuuauagcuggaauacacagccugaggggccuccaguuuccuucagcuguucuauauucccaccccccccccagcccgccuugcccugucacugugggugacagcucuccagaagugugcacugggaggggaucuggagagugguugggggcuggcugcaggccuugggugcuguucuguggucucgggcucuggugaugcuuagcuggcuuaauuggcccuggcuucuguccuuccgauaggggccgaaggcuguauuucuucucuaucaugacucugaacauuccguacgugcuuuuucugucagaaagacauucccugcgugcuuauuccuuuuaaaaggaagagcagauuuaaaaaauaaaauuaaagucugugagugcaaaagggagagauguauuuuaguaauugugccauauggguguaugcuaucauguaaguuuuuuuuguucuuuuuuguuuuguuuuguuuuuuguuuguuugcuuguuuuuuuguuuuguuuuguuuuguuuuguuuuuuguuuuuugguuuuuugagacaggguuucucuguauagcucuggcuauccuggaacucacuuuguagaccaggcuggccuccaacucagaaauucaccugccucugccucccaggugcugggauuaaaggcgugcgccaccacgccuggcuugcuugcuuguuuugagacagggcuucuuuguaacccuggcuguccccguaacucacuuuguagaccagcuuggcuuugaacucagagauccacuugccucugccuccugagugggauuaaaggugugaguuaccacacucggcuaacaaggaggggguuuaagagugcaucuggaagcaagcggacacucucagcuuguuagugaagcuacgguccauggaagcucugaggagcugauacuaaauccugcuacucugcuucucagcuucgcuuccuuuauuucaggaaggagcaucuuaacaucccuguccucuucuuauccuuucucuaggagaagcacauucuggcuggcugcaaacuggacuuaaaaucauguacuuaaaaagcuuuuaaugguuugucauuguuauugggcgucugcucucuauaggcgcacggugaguguuuauugaauuacugagugaaugguguauauaggcuuuccacacccuccccugcugaacuucagagucugcguccuuuugcccugaggaugcccccggcuuggguagcagcagaaacagucagccaguguaggucuaaaucauugggaugauuggauucuuccagaagcuuuaucucugucgaugauuuugaauuucaugccucacaauugcaugacccuuagccagucugguccugggauaagaauugaugcuuucccacuuccucauugagggaacugcaguguuggcuuuaagaugcaguguaaaggucaccuccuccaggaagcgagcaaucuuuaacucuagcagcuucugagugcugaccuuaguaugagcugcagaagcaucauaccccugcagggcuccaaguccucucaggaauaugagcaaauuagaugcaaauaucccaggugcaccuggaacuuacaguacaauaggagacauugauaguugcagucuuccuuaggaggagcaacuguccuuugacaguaccgucuuccuacucuugcuaacaaagaugcggaagcagagcuuucugucuuucaaagagaaggcugggcugggggacagagucagaguacagcacuugcugggagcacaugaugaccuggguuuacucuucaacauccccacuacaccaagggggaaagaauacgacgagggagcuuuuaaaauauaaaaaaaaaacgcuugauuucugcugggugugguagcaucagggaggcagaggcagggagaucguaaguuugagguuagcuaggacuguacggugugagacuguauuaguuacuuucuuucauugccucagucaaaaaccugauggaguuacauuaagggggaaagggugcuuugggggauacauuugagaggauucagucacuuacugugggaacgucacuguaacaggaacaugaggcagcuguucacacugcaauuguagucaggacgcggagagaugagcgcugcuuucagcccccuuucuccuugucaguaaguccuagaauucagccgguugaaaauguguugcccacauucaggguagaucuuuccaucucagcuaacccagucuagaaacuccuucguaggcuuugucagagguggcucaccuagaugcuccuagauccugucaagcugacaaugaauguuaaccauugcaccccccacucugccccccacaaagugagauagaacaaacccucuccugauuucaaguauguucaauucagauuuuaagggaagucccaggccaaaggaacaacuguuucgggccaguagauugcagccuucaggcuauagggcuuccccccuuagguugacguagcuccuucuguugggccaugacucuguauccccauaucccuucagacaacagcacucauggcaggcaugcucuacuugcauggcaguggacuugaaugcuauuuuggccaccugacaucuccugacccagaguuaacugaucuuuccuuagaguuaucugccuagaauugagccacucccuucagucuccccucaacuuccaggccauacagagcuggaaaagccaccacuuccugcauucuacauaggccugcucauuucucuucccucuccgcuuucucaacacaugccgguucuuuguuccuguugcgugggcuaucaugaguuucccaacugcucugugaccuuucccuugcuggcugcuuagccacugagugaggauuucacuggaagaucagaaugacugucacauuucucuccacagacaggaagagauuguagcaggguugcuugaggaagaaaaaccaacuucccauccugaggagaauagccacaugucauuuuaugcaggguuuuuuuuuuuuuuuuuuuuuaaaucauuuuccauuuuauugagcuuuuuaccaucuuccugcgaguuguaagaggaaauuggauagggacacaaagggaguggagcuugacguggacccggagguauucgagauuguccagagggacaguaaagaggaaucuucuuccuggaaggucccagccuuugucucugagaaagguggagugagagaaagggcaaagaggaggaaacugugucauuaacacagucacaagcugggggcugcggaggaagcucaccggucaagaauguuugguguucuuagcgaagaccaaaguccugucggaaacacccacaucuggcaucucaaaauugccagugccuccggcuuugggagcguccaacacccucuucuggccucugugcaucuaauguacauucacacggaugugcacaggacacauaaaugaaaagugagaauaaaccuuaagggagauaagcgcauccugccauuacuuuguauuggucacaacucuaauacagugucauucagauguuaaccccguucccuaguauucuuccacgcucacaaaugguggaggccacagucccugugguacaagccugaaagcuaagcuauuugggaaauaaggcaggaagagguugagaccagcuuuggcuaccgagugagcucagggccagcuuggguaucauagcaagagucuauuucccguuacccuagccucuucacccacccuaucuuuucuuuugcucauuuuuuuuuuuuuuucuguagaauacaguucaaugacuuggaguacauucauugcacagccuucccuauuaacuauuucuagaacuuucuucauuaucucagacugaaagucuaucuguuaagcacuuucacuucccugccagcuguggaacuugcuguucaacuuggagucuaggacucuggcugcucucuuacaccaucucugugaaagugacuggcccaggcuggucucugacauugccauccuccugcaccaucugccuggucucacucugcuuugaauugcauuucucuaaugacuacugacgagugucuuuuuauguacccauuggauacccgaauauuuucagagaaucuuuuguuacuauuguaguuauuguguuauaaaaguuccaugaugucaguucccucucagauacauaguucuugauauuuccuuucuauuuucugggcuguccuuccaucucucuugagagugucuugucccauaauauaaaaucauuuaguaaaauaauugcuuuuucucuaggaugucacacaucauuagauagccucagucuuacuguguaaucaaaggcaaccauuaaguucugauccauccucucccuccuaagugcugagauuagagcuaugugccauuauuucuggguuuauauggcccuggggaucaaacccaggaccuugggaauguucgacaggcacugaagcuauguacacccucagcccuuuguuucccauuucgauaaucuuggcuaccuuuuuguuaacuuuggugugagaaacccaguuaaagccaucucccuuggugucagggcccaggacuucgccacggcuguguuguccucuaagacuuuagccuucuggccuuugggucagguauuugcaccaugccuaguacuaguucagcugugcaguccaggcaggccauaaacucaagacucuccugacuugagccucuuaaauacugguguguguuacuaagcuugugcaucucauucaucuuccuagcaucccuuuccagggugcuguuggcccauuuugcauauuuuaagaguccagccucucacuugcuuguggcagagauccccugagagcagcucacuuaccccuggauuagauacccuguguaugaaaucaucugcugaaagccuuuccaagguuguucuagauuucuugcaauuacagacucucuaaguugcaaggggacuucucuggcuauguuguuuguccucauagguaaucuacaggaauauccuuguguguguguguauguguauguguauguguguguguguggggggggggguuggaggcgggggagggaugguuuagagcacaacgcuaugguugagaggcacagucaacugcauuuaccucauucucucauuacuucacuggccaaugaaauuaauugucugggcuagugucuaucauuaaagacaaaaggagagccuuuuaguuuuagauuacauaaguacauguuugugugugucuuuugucaaccauacuggccuugaacucagagauccaccugccuguuuccuccugaugguugggauuaaaggaguguaccaucaugcucagcuagcuucagauuuaaaagaagucaagucuacaaaguaauuugcccagagagucguugagcauucccugcugaugucugaagaucacuuuccauguaaagaccugagguucagaguaacagaaguggcucccaggggcucccaggaggcucagcccuggcagcucuacaguuuauuuucuccaugagggaucgagauggcgggcagauucacaguucacccaggcucugcucucugcugguccugggguggcacuuuccccuccugaguuuccagcuucauucaggggcuggagagcugugaggugucuccuuccagcaugcuuaguuugcgcagcuaccuguagcugaaugggaagaagcccggcccuucuucaugucuccugggcaugaaauaccuguucaguucuuauacugccacaugccugacauuccacacccaggacccaaauugcuaccucccugccuuccagagagggacccaguuuauccccagacccuacucauuuggcuauucguucaggccuggagccuggacuuuucacaccugagcuccuggcuggagaccugcagcuuucugauggugagugacaaccaaaaguccuucauuguccccguguguuagaaggcaaaagagcagagcaucaugggugagauacuggucuucaguuaacccagggguugcucggagugugccuucuaccccuucaaacucaggucuagucacucaaacuucuccaggcucacucuccccaccuguaaaacuagaaaguucaaccuugagcagugaguugaaugggauucuaagcacuuaacaugcguaugcugccacccagaagguaagcauucaaguacugacaguuggcauccuucuugucuuugagucccgggauaugcuugcuggcgucugugcugaugguaaagagaauuuacuuuaucuuugcugaauaaggaagugcacucagaacugaaugcccugucaauccuacuccaucaucuucccuuuccuccuuccugguccuuaaauccagauccaggaaguugagucuugaauguagaaugaaaccaaccacuuauuaccuuccuuccccuuugaccuccauauccucacugucaucaacucagggcagugugcacaguagcagcuguagguuagguugauguugucucucccauucuaaggguggggaaauggaagcaggggcuaagauaacgucccaaggcaaaucaucagcugagccagagccagagccagagccagaggcagagccggagccagagcgggagccagagccagcauuuguagucaggugccucuucacuggucuccucuucugccuuaaggccaucucuggagcucuaggacucagauuaguggcgccagcacagaggaccucugggcaucaggcuuuuucuuuaucauggugcuuggggcaggugugcugugcaaucaaggaggcccuuugagguaagcuuaaacaucaggacuggauugaaagugugcagauccuaucaagcuguccucuggcaaccgccagugcacauucuucauuuuugugaaaagacacuaaaugcuaguguaaucggcagggcugguuugagauuugggacuuguugccuuuuguagagauagccgcguuuuuuuuuuuuuuuuuuuuuuuguggcucuggauucugcucucuuccaauucagauccugguacauucgaguuuagaaggaccccuggguaaaccaccauagccaacuuuguccugaucuuugaugacaaagagaugacuuugugcugccugggacuuuaggcagagugaguaggcucaugccaguaacuccuauaggcuacaggccacaggaaauuguacauaccgucuauuccacauuucauauaggaaaauuacaugcuuuuuucuucaugcauacaguauagauucuauggaggaaaggcuguuuaugauagcaagaccuugaacaaggucccuuaaaggaauguucauaaucuugaucuagaaaucccagauugcucuuaggacacuauagcuguaugcucuuagacaccacacccuaugaccugagccuuugacugagacuaaacuuugaucaaggagggcugcuuaggauugcauggacuuuauuucuauggcacagaugcacacuaacuucccaaaauugcauacuggugaguuuucaguacuccagcaacuguccaguuuccugcccugcuguagugcuugaaaaacugauguguuuauaaaacauaaagagagagagagagaggggauauguucuauggaggugugggggaacggggugccucugcggacccaugcugagacaucccuucccccugagggacuagccaugugaagguauaguauagaacagaguuuauucaggacauggggaggggagucaagaggguaguagaggcuggccaugagcacauggagagagaggggggaaggguauggggagagggggaggaagagaaggcaagagaggaacaagaaagcgaggagggggcaagcagccccucuuauaauaagucaggcauaccuggcuguugccagguaacugugggguggaacugagacagacugcuaacauugauaacucuuucuguucugguuugaaggauggauuaauucacuuaccaccccuucauuucuacaguagugggcgggauuauuucccuacaguucucaccguuggagucauaaaucaugcuuuuuaagaacaagcaggcucuccagcugugacgaguagaggcuuccagaugcucuacugcugggucgcagcgaaggaugcgugauggggucuccuuagaagccgauauacaaagugggccauuaaguuucaguggcuugccuaucuuucccaggggaacuagcccuuggaucucuccacaggcaaggagguaacauuucaaagagaggcuucuuagagaacuugaagggcuggagagauggcucagagguuaggagcacugacugcucuuccaaagauccugaguucaaaucccagcaaccacauaguggcucacaaccauuuguaaugagaucugaugucuucuucugagaugucugaagacagcuacaguguacuuacauauaauaaauaaauaaaucuuaaaaaaaaaaguauagagaacugggguauuuugaaggggcugaucaaauguuaagucuguuagcuucaaccacucaugcagguugacuugaaccugacaguggaagaaaauggagagagacaucaaggucagcacgagauacuggaaguccagggagguugggacagcauggugucuacagucuuauguggcuguggaggaucuaagauguauugaacaaugcuauauauguaauauaauaauauuauauaauaauauaugauauauuauuauauauauuauacacuauauuuuauagacuuagaaaaaauacagcugcuuucccccccauauugauuacauguugaaaugagauuucuguguucuggaaaaagugaaauauauugacaaaaugaaguuuaccucucucucucucucucucucucuauauauauauauauauauauauauauauauauauauauauauacacacacacauacauauauauguuaauguagcugguaaaaaauugaauuacauauguggcaugcauuauauaucuauuggauacuggccagugaaacugauaccagaauagaacaucaguuuugcaguauaugcauugcaugaccuuacauagcagaucuggcagguccccaucagguugccuggguuugagaugugacucugacagcauucaagugugguauugguucugagguuuacauuucauucauuaguauggcaauacuuccagcuccauagacuuguaaagguuacaugguaucauucaugaaaaguacuuagagucgggccagccugucaagucagugaguuuuaccugucuuaguaguuauuuugguggcuacugauuucaaaccugaagguucauggauuggaagaucuaauauauggggaucagacaaggaagaaaagcaaggaaccaaugcaguggcuggcaagguagcucacauugauugcccuagcucuugggaggugucagguagaagaauaggaguucaaagcuuagcuacauaguaaguucaaggcucuguguuacaacaauaggcauggccuaaaacaaaacaaaacaaaacaaaacaaaacaaaacaaaacaaaacaaagcaaaccccaaccaacagagcugugaauagugcuucuucagagcaaaugauauuuagagauagugaugcugagucgauugggccaaguagggaguuuggacugcauaguucagguggguggugccuggcccauucuccuaucacaaugccucugugccaggaaccuuugguuuacuuaauaauggcccugcaguagaaccauaauguugcaauuuggaugugccacagauaggcgggaagugcuuauuuuuggugcaaaggugaaaagaaaauugcacauugagguuucugagaucucguauaguuauuacuaaucucccauuaugucugaugaauguauguauacauuaaccuuuaucaugagguaugaauguaaacauuguacacauacugcucugcacuaucugagacuucauguaugcacugggugguggagauggaucccugagggacuucuucaccuguuuauuccauuaaggugucuuccucucugucuagguuugcuuuacuccugcuccccccucaccccgcuucccucccugcucccccucacuuuucuucuuccuacuuccccuauccuccccagcucccucuguuucuccugcuccccgugcucccccugcuccucgugcucccccugcuccucccuguuuccgcuccucccugcucccccucccucugcuccuccuguuccccugcuccaucugcuccgugcucccuuugcucccuucucccucccgcuccucccugauuucccugugcucugcaggccaaccgcaguguagacagucucuaggguuuguuucccuguucauuccacuuuaggcuggagugccuucuuacuagcuucuccaucccucuaaugcaucauuuggauuuuguuuuguugcaucauaaucugaaaacgagacaaaacaaguaaauccuucaguugaugucauauuuuacauaugcuuacuuuaucuagguuugggucuuugggcauauuuuauuuguuuuguuuuucuagauaaugcuuauauuuaugauaucgaucuuguuuuugguagaaacaugggaaauguuaaaagccuaaggaagaaaagaaugaacauagauaauuuugucacauuuugugguuuugagcauguuucuugugaauuugagaaauagaaaacaguuauuuuggauuuuucuuuguguaggcagagcuucuggcaucuuuuaaaugcaaugucauguugcacaaugcugaggcugccccaucugggcucagucuccugcuguccuccugcuucaacuuucuuagggcuacgaugacaagcaugagcuacguguuuaaggcucuccaugcaaagggccuugccauuuucuuauucugucacaccaagucuagaauggcagaccuucuuccuccacggagcugccuuucuguaaaguugaggcucaguauggggucuggcugagaugaagaugaugacuuuuuaagggguuggccauggcuuuccuaagauuggggguuuuuagagucauuccauaggacuguagauguuucuuucuuuucuguuuuauguguaugaacacacuguagcugucuuuagacaucccagaaaagggcaucagaucuuauuacagaugguugugagccaccaugugguugaugggaauugaacuggggaccauuggaagagcagucagugcucuuaacugcugagccaucucuccagccccagacguuuccaucuuaaguuuggggugcugaguggaaagaaucuugggauggaccugauauguuuccaaaagaauuuuggaaagccacuuagcaucuguuagccuuguuugcucacaggcaaaaggagaugacauuuacuccaggauggcuagggaaagugaaguaugccuaugcacgucuggcugcuaaguugggcucccccauaaaauucaauuucagauguguuaguagacaacagaagagcaggccauagauguucaaccaaagaaaagcuuagguucucugacaauuucccuaagugggugucugugucaguugauuuuuccagaaacagucaacuugaaaaggagaaaauguggggggcuggagagauggcucagccauuaagagcauggacugcucuucuggagguccugaauucaaaucccagccaccauaugauggcucacaaccauccauaaugagaucugaugcccucugcuggugugucugaagacagcuacaguguacuuauauauaaucaaucaaucaaccaaucuaucuuugggccagagugaacagggcuggagcgagaagaaaaaaaaaauaaaaaaagaaaacguuuaaaaccuuguuacaguaguggccccuguacaguacugcucuagagauugagguaggaggauuguguguuugaagcuaucaugggcuggguaauaagacauugguuuuagaggaagcaagguugggaggggugagagggguaggggugggggaagggagagggagggggagaggcuaucucucugaucccuucaagggcuugcuccauaugaccuaaaaccucugauuagacccuguccuuuagcuaaagguuccacaccuccuaguagugcccuucuggguagcauuaagcugagggcccagucuuuaauauacagcacuuuggaggccagucugggugcaaagugaccagcauuucuuguauguagcuucccaaccuugcugggaugacaacucaugccaaugguuuucaauucuuccccugcuaugugucuggcaccaaaaaugaugagcacaagagaugcacccaggguccucauaggccacuccuucuaguuaagugaucuugggccaauugcuucucugagaccuuaguuuugcuuucucugaaacacaaacuacaacugcuccugacuccuuuuaugggaguguguauugaucaaggugguuccugaggcuugcggggguggggguggggggaugggguggggcacagugcccaauccuagaaacucuagguugaauguaguuaccuccccuggacucauugagcccacccaggcuguauuuaaacuuauuaagcugucucgugccuggcuuuuggcuggauuuguucauaguuaggaaucuuccaaaaucagaagggacccauccaugcuugucauuagacggaugacaaaguaaggauccagauggugagggacuauucuggaagcucuuaacuguucccacuuaugcaugaaggaggaaaacacauacauacacacacacacacacacacacacacacacauaugcaugcacauauacacaugcacauaaauuuauaugcaaacauucauaugugcuugcaugcaaauauguacauagcaauguggaaguauguauagaggugaugaugauaguggccauuuguaguacgagccuuuggggacagcaaggaugcuuccacuguacuguguggcuuuguguggcuuucuccuguuggaaaauauccccauuuucauauuuuuuuuuaguuuuucagugaggagagcaaacccuuuuagggauguggggacagggucucucccacagcucauuacgaucuauauagccagggaccacgcugaccuucugguucuucuuccuccacuuccuuaguguuggaauaaaagguguguguuacaccccugguguuugugcacuucucggggaucaaauccagggucuacugcaugccagacaagcacuguacugagcucugucuccagacaccagacacacgguuuuacaaauccaccaggaaauaaagaccuuaggauaacuucuuacuuccuaauucaggcucuuauaucccuaagagaauuuaagaauauauaucauuucuacugcugucucuuggaacccaggucuccuggcuucuugacuuucaugcuuggcaauacucacacaaccuuugaccacuggcuaguggcucaucucuccaaagcugccaaccuaaacugugcuccuuugguggcucuggguaacccgaguaccgacuucucuccuagcccauucccuugaauggcaccagugcagaaggaagccacgcacgacuccuucuccuccguggcuccucugccagccgaauggggcucagcugcuuccugaggcugcuugugguauuggaaggcuccuuggaaaccuucccuacuuucuuucugacacaucgcguaaacuccuuuaccucucuuacagcgacccucagggcucauuugagcucaauucuugguggccccugcagggacgggaacagaaacccugaacccccuacucucuuccuuccuccugagggccuuugaucuucaucuugcugcaaagcuacaucccucccccacaccccuagucccauuguuguaucugguagaccaggcuguuagggaccuguuacugcacuguggaagccauugaguucaauagugagcaauauuucaaugcccaguggccaauucaggaagcauaaauggauuuaugggccccccuuuccauuucuccauuuaacguagaaagaccauauugaucuucagugggggauggggucagauggcagguccuaccuucucuguccugagacccucucuguuauacagaaaaccauuuugaagccuguguucucuuuuuuagguucaaaguaguccucagaccugggucuucuuaauauuaauaaggaaaacugagacacggggcggaugugacauuucugaggagcgucuucacacaguucugagucccuaagccgcccuuuaaaacagcaacagcaaugagagcgagcauagugagaauuccgagagcaaucacaagaacugcagcuguaaaugggccuucugccaccucgggcuggggagccuggacgauuugcuuuccuggucaugccacaagcccugcccugguggugguuguguuucugccuggccaaaagcguauuuuaaaauuaaacaagaaagcaaacaagccuggcuuuuauagacgugucagaaaacuuaaccucuacgugguaguuuaggagccaaaucuuccuucagacauagggagaucgggacaggcgcucaugaaugcacagaucauggcuacaucuggguaaagcuggcaaucgaguugaaggggucaguggguucuuguggccaguuugucaccauccuuugagaugaaaacaaaacaaaacaaagcaaagcaaaacaaacccaaaacucgagaagacaggcuguuuauuccuguuaaaaauaauggcccuccagaugccguuccaggaccugcaccucaaucagcuaaggcuuuuggagcuucugcccagaaugccgcuuagcaaguggagcuuguuagcauccgagccaaguauaauaauaaugagucagguccggacuacaaagggcucugugaugagcagaaaguaauuauugcacauugcagauaauaaaaccuuuaauagauacuuagaaauauauacauauauauuuuaauggguggucccuccaacaaaaaaaaaaauacacauuaccacugcagaaucuauccuccaucgcccggaggugguucugaaaggauugguagccaguuggaggaacucccugguaaacgguacuucccagaugccuuuccugacaggcuccaggcuuccagauguugccucucaagacuccuuacuuugcaucuguccugcuaaaagagcggcuucucgacuagcauaguccuggcuuucuggagcuagugaggucugcaucucagcucagcucaccacuuaccagcugcauguuagaaagggccagcucaucuucugccugcacaucuguaaugugagaucaaggaugcugccuuggcuaggcuucuaagagguacuguggcaucuuagggcugccaccucugauggccuaccuagacuaugagccuagaaagcagaggccacucugcucccaggauaggaauaggaugcacuccacccuggucaucuucuuccuguacucagugcagacaucacuaguugaucaugaccuccuuuugcuuugaguguggacccagccccaggauugacuuaacugcguuuuagguagcccacccaccagcugguugaaauaaaugguaccaccagcuggccuucuggcuguggugcccaguagguuccugggucaggaucggggcucagcaagggauuucuaucuagaacgaccaagucgauguaccuucucaaaaaacacugagugagugagugcuuugucacugcagucaaucgagcugaggauggcuucauacuugagugaggugaauacaguucacacauuuagaguaagucuaaggugguuugguauuuacgaaguuauuuaauggacaguguuuggggggacaaaaauauagccccccugugcagagccuguaucaggagaugcagagcaagagugacauugcuuucuucuuuccuuugucugcuaugggcccagcucuccuucacucuucugggucaucuuggauaauggcugucccuaaagcggggaauaacugggaguggucaaagccccuaggggucugcaagagcagaccugaccagcaggcugcuaaguggccuuugugcacgaaauccugucgucacacuucaucccuugggcccugcugugcccaaaggcauggaugagacagcccggguaagggcugauuuggugagacugugcacuucaguuuugcucaccaagcaaagcauuucaucaucuucccuaccuuccucaguccugcccuggggacuuucuggagcugccuggcuacggggaccagccagcugcuccuaucaccucuggccacuccagcccucugacggagucacagccgcucuccccuucuuccuccuucuuuaacgcuucuugcuggguuucaaauucagagccuuguguaugccgcaugaguccuucccaucuuuacugggcaggucccagugcuggaaguggaauucuucucuaggagccaucuuguagcucucuccguuuugacugggccugucccugucagucucuucggaagguaccuggauaucaguuaugcugacagucaacuuauccagugguucucaaaugaagaggacaucaauguguccuggagggcuuguuaaaaacuuggaggcuugcuuacccuuugggugggaggauuuaucuccaauaagcuuauggguuaccauggaauuaaggaccucuugguucacugugaguauagucuagaauguucucccuccaaauagcccuccuuucugccuccacuuuacuugucucucacugcaaagucacaaccuaaaacaagccuacccagacuacuucuacaauggcucccucacagccugcuacacacacacagccaguagucaccguccagucuccuccagcugucccuuuccuagguauaugguucagugaucaagcccuugcuaguauaugcaaggcccuggguuccagcucaaguacugggaaaagaacugcacagggcaugaguuuuuuuuuuuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuagggcaugaguuuuauccuuagugccaagaagaaauugugacgccauagaugccaagcccucuccagacuucauuugcaacccugucugcuugcaucccugagcugacuggccuucugggucuccaaccucaucuuauuguuccuuagaacuuugguuagcucacuugcccuuuucuaugcguuacagggccuuugcuuuuacugucccaauacuuuccccuagcucugcagagggcuaauuucucuuccuccucuucccccugucauccugucuuuccccccuuuccucccuuuacuucccuucuccuuuuccugguacuggaaagggaaguguugaacccaaggcuugcaccuuuuuuuuuuuuuaaaucuaguuucaacucacuuccucuuaucacucccaucuaauaggcccauucgcuaaccuccaacauucugucuccagaugcuguucauuucaaauccauaacacuaacaguaugguuuguggcuccaaccagaggggguggggaaguguagccaacuuucuuugccucuguuuuuucagugugauuccuccccaccaggcuggaagcugugacucucucucauucucuaaggugcugugguuuuacaggauaguuuguaaacagaugaaggaguggagccagguuagugagcauaacuucuauuagcuagaagggcuucggaggguggguagcuugccugguaaaugcuagggcuuuuuggaaucuugcaccauuuuacaaccagcacgaaaccuggcuucccucuggccaucauuaucaccugaugccugcacccggaaagccugggucucuggguggggccagcaagugagccaaaggaggcuuuaggcugucuuucugcccagcuuuguauuccacaauccuugauuccucuccccucccuuguuuguuucuuugcucuuuauuccuuuccuuccuucucucucucucucucucucucucucucucucucucuccuucccuucccuucccuucccuucccuucccuucccuucccuucccuucccuucccuucccuucccuucccuucccuucgcuuucccuuccuuccucccuuccuuccuuccuuccuuccuuccuuccuuccuuccuuccuuccuuccuuccuucuuuccuuccuucuuuccuuccuucauuucucuuuuccauuuuuuuuucuuuccaauacagaguucagacugaccucaaacacacagcaaucuugccuuagcauucuaccaggaggaaucacaaggguaggcuauaaugccagccccugaauggauuuuaaucuguaaagggagaagacaguauuaaagguagaccucagcugcugcugucugacacuugaucauuuaagcucauauucuggaaaacuggacuugguuuuucuucuguuguugagaacugagccaaccuucucacguauguuaauuggguguucuagcucuggaaaaugcuguugucgauuuuugguguuuuucgaaggcuguggauaacuaguuuuaguguucacuauaauguccugggaucccuacaucuauuauuauuguucuuguuauauuauuucuuuaaacauuuguuuuaucuaaggugaaaaaggaaaauccaggcaugguggaacauaccuauaauccaauauuugaaagguagaggagaaaagaggauugucaugaguucgaggccaucuugggugugagaccuugucucaaaagaccagaaagaaaagauagggggagaggggaacagagggcagaggagggggauaagggaaaagagagagggagcagagagagaagaggguaugaauauaagucuucauggagcucuugaauaccaggagauucuucuuccccuuccuccuccuccuucucuuuucuucuucuucucccuucuccuucuccuccuccuccucuuccuccuccuccucagguuagccucacauugccaaaacuggcuuugauuuuucugauucacuugcuuccaccagaaagcugggacuccaaaccuucccuuggcuuucuuccguuugcuagccaccacuggacugauccuaagaugggacucugagucuggcuggagaaggcucuuguucaaggucauugcugggauucuccuuguauuccaacuuuaguugagagccuucuagguuuuguuucaugcaggguugggaauaugggaugugguucugaagggcugugacuguuuauauaugggcccauaacacacgcaaugaguuccucuugaauugugugcaaacuauggucuccuuucccaaagcacacgucuggggagccuagaaggcuaauaacacugugauucuucucaagagugauggguacaaguccuuuaaaggcuugucacugaggaguguugagaggcccagguaaugccacaugcaacauagccaugguuguuaccccagugacagugauagcgucuacuuucugguuguccuggauuacgugcuagguucuauuuucugccagcuaagucuuuuuauccaucuagcuaugcuagauucuaaguauuaucauuccauucuacagaugaaaaaaaaaccaaaaaaaaaaaaccacagccuggagagguugaguaacuuggcccaagguuggcccaguuaauaaaaggcagagaugggauucaaacccagauagugagacuggcagagagcccauggaagcacccacaucagucacauggcucuggguuagucacggugcccagcgaucaguuaaggaagguuuagugauagaugaggguuuagagguggagacaagacaguagguaguuuagcuagaacuggagaggaaggacugcuuugggggguggacgugaggaugaaccagucucugucacauggaaggaggcccccacccccccaauuccccgaucucucuguccucuaaauuccugcugguacccuccaacacuccagagcccagauguagcuucuaccugcaugccuccuggccuccaagacaauguauagcauuuggagaggauggccuauucuggugguucucaauguuaggaaaaaugauguagcccucugauuguuauauuauggugaucaccaaccauaaaauuguuuaaguuguuuguguugcuacuucauaacuguaaucuugcuacugauaugaaucauaauguaaauaucuguuuuaccauucccaugagagggucauuugacccccccccuccaaggaguugcaacccacagguggagaaucacugaccuagagugggaggagguuccuaggcuguaguggaguaagcaggaugguggaaagggccaggagccagauagaagaggaccauuccacaugugaccuugggcugaagguggaagggaaccuacuugaaugucaugggucauucuggaggaugaauggcccuggguguggaccgagacuguguuguccucuucccugcuuugcgaugggaccuugagcccaccugagagauccccuuuucuggagaaaagcucuacuuuaggucaacugccuagaggagccucugcccggccuccauguguagccugccagccuguaacugacaggaaagagaaaggagcugugagucucaagagaggauauucuggaaggcuugauaaucagaacccauuguaaaacuguguuuucagcucuaccauuaaaauuuuuguuccaguggaaaacauuuguagucuguccccugugagcagugaauccuguguggaguucuaacaaccuuaaaauaguguggaaugcuugcuaggcgacgaggcagggauguggcuggugacgauggcuguauguaggcaggaccagcccaaggcggggaugcugcugcucuuagagcuuuaagacaguucaaaagaggauuccaaguuauccuuaaauuuaagaugauucuaccuaccagcagggcagugguggugcccacuuucaaucccagcacucuggagucagagacaggcaaaucucuugaguucuaggccagccuggucuacagagcaaguaauaggacagccaaggcugccuagagaaacccuguuucaaaaaacaaaaauggggguggggagcucuacucagagaaauguaaauugaaaugaaugauuuucccuauugaaacuacauuaugcacaaaucaguaauggacucuuuucaacccauggauaguaggcccucuaugcagagcaguaguagugguaggcagaggggaugcgagcuggcuguaaaagauggugcuuuguuuuuguuuuuuuuuuuuuccuguacacaauacaaauacacacagccucuggcuuucuaauuucccauugguacccugaacuauuuccccagcagauguaccuguagauaucuguacaaaaugaaccgugcccagggugauucauaguuacauuuuuauagcagcaaaagauugggagcaauuuugugaauggaagaucgauucaguaaaugaugacacauggcucagcuggcuggauguggaaaggaaagagggaucacacugugugcaugcacaggcagauucaaggauauauuguugaaaucaaagcaaacugcaaaagcauaccaucauuugccuaaguagaguggggaaggggaaaauagauaucuguccaaacugcuaagacaucuagguaagugaccauguaugacuuaugggcuaucaguggccucaagaguggauaggguuuggggaaggaugauuacagaacauaugcagcccaugcuugucacagcacgccaagagacugaguaaauaaauucagggaggaguucaccuacaaaaugguuggcauaggccaacaagauggcucuguggguaaaggcauggugugaucugaguuccaucucugacucugcauaaagacagagggagagaauuaacuccacaaaguugucauccgaccucuacuuacaugccguggcacacucgcacccacccacacaccuccacacacaaacacucauaggaaaauaaauaaagaugcugggccagcacucuucacaacuggcccaaugacagcccgaccuaggacuaucauuaaaggaacgggaacagcugcccaguggugcagcucuguggaaagggcuuuugggcacugaaagagaggcaaugucaggcucagggacguauaaccuugucauccaaggugugggugccagugugggcuauaggacaaaucccaggugccccccggugaguagaaagaagcuacugggaagaggauggcagagagucuuauucccuguugguggcagcugaagcuagaacugaguagauuuauuuaaugagggagcuaaaaccaggaacaggaugcuuugaagagcaguuguuagugaccuuugggucugccaauuuuuggcaaugcuacacaaagcguaugaucuuaggcauugccauguagaggcaaaccaugcauccaugauuuuuauuucaaaccucugaagaccuuuccccuauucaggaucucuagagugggccgagggcauuugugaacuauacaggaagaacugcccccuuucccccagucuuccagcccuagagauaguggaacuugcagccagcugccuucagaacaagguguucccaggagguugaaagacugguuuguaaucagauaaaggcugaaucuuucagaaacuucuagguucccggcagcugccauuacacuccaggcucugccacaaaggugaaaggggcuggaagaagaaacagggacugaggaagaaggaaaagaagacugggcauauguaggauccagucccugugagugggaaccugaguaggggacugcggcuuggaaacaggcucagacagacagagcuagaguccaucugacuuuuccacuugccugagcuugggucaggcuuauaaacacagguagugcuguuggcauggcaaagaaacccuugcugucuuuauggcuuuccugauacaauaucagaaaccugagcucuaggccgauuugucuuuguacuacuuuugguuaugauucuacucacccugguucauagaagacaugucccuguccuagaaaugauggcuaaugaugaaaacaaccgagcacuuaccugguggcucauaaccagguguaacucuaguuucaggggaaacugaccucuucugaacuccauaggcacaugcaaaacacccauaguaaguaaguaaguaaguaaguaaguaaguaaguaaguaaguaaguaauuaaguacauagauaaacaaacaaacaaauaaacaaauaaauaacuaaacugauauucauguaaguuacagagcuccguguguucacacugcggugaaaccaugugaugcuccaugggugagcccugccagaaacuucucggauucuucuuccugcuuuugauuugaacuaaguguuggcucuugugcauucaaaacccuuuuacuuuuuuguuuguuuguuuguuuuuucaagacaggguuucucuguauagcccaggcuguccuggaacucacuuuguggaccaggcuggccucgaacucagaaauccgccugccucugccuccugagugcugggauuaaaggagugugccaccacgcccagcucaaaacccuuuuacuuuugacaaacauuuuugaaccacccuccccucaucuacacacacacacacacacacacacacacacacgcacgcacgcacgcacgcacacaugcacacacacauacacuuaguucuacaauucaccaaaaugagaaacuggaggcugaaggcuggucaguguuucccuuuccugauuuggaagguguggggcuaauaggaagugagguguagagcuugguacucggaugugagucacuuagguucgaaugucacugugaauguaauuaacuguucugggucucuguucaaucccucuauaaaauagcaagccacagugacgucugucucauaggauugagauuuuuccuugaguuuauuaauauagccuggucuacaaagugagucccaggacagccagggcuauacagagaaacccugucucggaaaacaaaaacaaaaacaaaaaaaaacaaaacaaaaaaaaaaaauauauauauauauauauauauauauauauauauauauauauauauaaaacaauugaaugguauacuuugcagcaucucagcaagacgaggagguaaagccagagaaccaaaacaaggcugaguaaaaugagcugaggccauuggccauuccuuauuaucaggaagacauaggugacuaccuaccuuucucaacuucuggucccuuccucccucccucccucccucccucccucccucccucccucccucccucccucccucccucucucccucuuuuuucuuccuuccuuccuuccuuccuuccuuccuuccuuccuuccuuccuuccuuccuuccuuccuuucuuucucucucucuuucucucuuucucucuauuuuugagacagggucucuaaguaguccuggcuguccuugagcuugcuaugaaggccaggcuagucucuaacucaaagauuguccugccucugccucucaaacacuggggccaaggguauguggccaccaugcccagccuuaagugaaugaccuggaugcucuuugauagugaucccuccaggggcuuggcccgccuuugcucuaauauagagcaugcucuucagcuuguagggcaaugcucuugugacuuugccaaccuagagguugcugagaaagaaagcaaguuucucacuucuccuggaagucuguauggaagagcugcagcaggagcugcacaggucccauaaagaaggaauagaauagagggacucugcgggaggggaggggcaugcugauguagaggucuccacaguauaucuugacucaagcugguugugacagaagcuuucuguagggguguauuugcugggcugaguaaccaaaguugaguucuaauaaauaaagaugaaugaagaaggagggaaaugugggagguuggggaugggggugguacaagauacucucugagucugugugccauucagaguaauuuacacugggggucccauugugcccuugggcccaggcucuauuuugccccuuuguucccuguucuauccuagcagggaugcuugcugacuuccuggccauccccaccccuucuuggguccuggauccugcuuccuuucucccccgcuucacaaugaucucaucccagccgggaaaugggacuuuuguugccccugccuauuuggccuggcccagugucaggcccaucacgugccccugcugggauaccgaguguaugaaucucaggcagugggcaaggcuggcaggggagggcauuccucuggacugagcugugcugguagcuuggcacaccccccccccccccuucuagaagugacucaaaagcuuuucugcaugcucuucuaguggacugcugagucauucucugagucacaagugguacagcuguguacucaacagugagcccuugugugggacccagaugggcuguccugacucuuggggcauuuaaaggcaguucacacuggcauuugacccucucuguccuccucaaggacucuuuuacccugauuccuuucuaggccuauguguguaggcuagggagugauacacaccucgggcugccagcuaggauucagaauccaaaaguucaauucaagucagcagcuggcugacaggcagggagccagggcggugauuaagcaagcuggggcaagagugaaguagggcagauuccugggcccuaggugcgucucaggaagaucagccaacuuucuuguaucgugcguguuuugggagcauccugaagcuaccuugagaauucaaucuuuuuuuuuuuuuuuuuuuuuuuuuuuuuuuuuuuuuuagugaacaaguggaagaauucuuguguauuaaaucucacuguccuuauacccauuugguguuugaaggaauggggucuaguagaugauaccaguucagaggcagagugagaagcauaagucagaauaucagaguaucuagaauuugaugcucagaccugccugacucaguuuagcaccccucccccaaacccccacccaaucugguugccucgagucuuccucuuaaggcagcuguccuguagugcaggaagccaacucccaagguaaaaugucuuuagacaaauaaaaaugucuuuagaaggccuaggcucucuauggggugagacugaaugcugaggcccgaucuggccucugauagaggagggcuuucaacuguugggggcagggaacagcuaggagcuuggcagggaggacucuguauauacuguaucuguccgguagcacuggagauagagcccuagcugacccugaguggaaagaugguugguugcauaguugugcuagcacaggacauacugcaaggguuugggcucuagaacuuuuccucugcucauguggcuuugguggagucaccucugccggcuagugcuaguucuaaagccuaacccauccuuugggaaggagucuguuuuauggcuuccuagguaaggcugaugacccauguguuagugcugaugugagccacuuguggaagugguccaguguucagccaccacuuauccacuggggccagaugggcuagaccucaaagaucuguagggcaagauggaaaacagucauccuuugaauucaccaggaaccucaugacuagagagaugauuaggaggccauuguuaccuucuauggaaggugaugagugagcuggaaagagcuuuggguauggacacgcuucgaaggcgggcauuuugaauaguagcauaaaggcagauggugauggggaaauuucuaauagaguguugcuguagaacaagguuguucccaaccuucugauccccccuucccugucuuccuagugcaguuauaggcuaugccaccagauuucugguuuugauagaagcuuucagaacucucuuguguccaggaaugauucauuuucuaaggacaucauccagcauuggggccuuucaaaaaggauggccaugugaguaguuuuucacaaacugauguacaacaguugccucugugaucuggaccuaccuuuuugauccuuuccuuuuuucuaccucgggauucauuuuuagugacacuauaaaaauauauccuauuauguuuauuuuauuuaugugugcacguaugaauucguguguggcaaggcaguguuggcucacgccuuuaaucccagcacuugggaggcagaggcaggcagaucucugaguucgaggccagccugaucuacagagugaguuccaggacagccagggcuacacagagaaacccugucuccaaacaaacaaacaaacaaacaaacaauccguguguggugagugcuugcaugcauuuauuuaugccacagugcacguguauaggucugaggacaacuuucaggaguugguucucuccuucuaccauguggauucuagggacuaaacucaaguuauuugcugaccuugucaguuggaaaacaauucucugggccacacaaaggaauauauuagugaugugaaaguaacucugcaaaauaauuucuuuuugucgaauggacauacccgagcucagauugggccacugaacaugcacggcccaauuggucuuuguauuuuguuccuaacacaggugguaauuauugcucaucuuguugguggaaacucaguuugaucugauuggcuaaucagccugauggggauagaggagguuuagggaauauggaccucugcugauaaaagaacaguucgcacagcaucaagccaucaugccugcccuuuaaugacacguuucaaugagagagagaugauuucccucuauuuuuuucugugguagauugggucagguuagacucuuucagauugaucacacaacuccucaauuuuaacauuguguccuucgaagaugcaaaacagcaaugugugggucucuucccucauugaacaggagaagaaagaccaggaacaguuuuggaguuuuccgggcaaaagccugcacuuuuauguaugccuguauucagaggcacauacacuauguuuggccauuggcccccaaucccauuuaaauagauaagcaauggugcaaaaauagagagaggauauacauucguaagaauggccacacuagaacuaagaacaaauagagaguucuagugacccgcccccccccccccccccaagacugucuccuggaacacugacaugagcuucagguuugaauggggaaaguuuuggagcaaggauuaagaaggccauaccaugauuaagcaaucuugucaaagggugguaugcuugauuaucgucucacuacaguucuguccucauuugcugucauugcuggacaugcucaaucugugucauaggaaaggcuauuacuucugcucuggauguagccauggcaucauggauaauugccuucaucugguuuuccugcucuugggaaccaagacaacugcagguuucagacaaugaccuaaagucuauguuguuagccuugaaggaggaugagaaagguuagacacacuccuuaagcugcagagauuucuaaguguagcaguaagugggugacucacaguauaggugauggacagaugacaugugcaacaaggaugcuaggcuguuauccaguuuggggacccaugugagcugucaaugaaugcuuuuuaguaaaagcugcuucuacgcaucuguuucagcuccagcucuggauuagggaagggcaugaaggugaaaucgcuuucucauggucacaagguaacagaggugaaaucugaacucugacaggcauuugaacuugcuugucuccuugcuaguuugcaccacuaccccuggaucaucaggaaccuaacaggcaguuguaucuaaaaaguuguacuguucucacaaagauauguacccugcucuccugcaugcucuacauagguuuguaucccacgaggaugcucacugguucaucugaggaugcucacugguucaucuagugucuaaaugccacuccuccccccccacccccaccccccgagcuggaacaaggcaaugcuaaauagaagaagcaguacaaaagugagaucugcacguauugucuucugggaggugaauuuuggguuugcuauucaguuaaccuguuauaacaucaauuuccuugucugucaaacgagggugauaucaucuaggucaaagagaggagagugcgguucucaugcuugaaaugccugguacccaaaggcccuugcaaauccuugcuucuuugucccuacaaguaggugagcugagucacaaguccuggaggagauugcuuucucucccuucuuuaccugugccaucuuguccuccuugagcuuauauauuaucuggguguggugagccucgggauuaaugcuguucugccaagagaugguugacaucaaacccugugaacgccaacuuugacccuugagucuuaguacuggcuaacagcugccaguggugacaggaacugaggaugcuccaggggauacagggaaggcagugugugaaucugggcagggccauuuccuggaaccaucagggaacuggcuucugggugagccuguguaggagaggaacagguuuagucgcggauauggggcugccagaagcaaggcuuuucuuggcagaacuugggugccaguugugggcgcugggguacugcauuggaaccaaggcgggcugcuccacuggcugcccaaagccagcuugauuggacauaaauggaauuccaguccaguacuugggagauuugaggcaugaagaucaugaguuugaggucagcuugggcuaccaucuccacaaagaaaugaucuuccacaaaccaaaugauggacuaaaaguuucugauuggugcauuuaaggaaaagguuccugagacccuugaagcugagcaagugccucaagagacuaggcagguaggcuaggcuuucuuguucaggaagaagucaauggccaagaguucucugcuacuguccacuuggccauauagacagaugacauuucucccuugcugguugagcaucuaagggccagggaacuucucacagugucuauuacaucugcucugcugcuuagaugggauuucauuauggauucaccaccccaccuugcuucuacuagauuuccaaccuaucuggguguuuggggaggcgaugauucuuccugauaauuuuccuucuaaaucuuguuucuucugugcuuguacacauuauaccuguacauuuguauuccauguucuuuuuauucucccaacaauccuacuaaaguuugcuccacccagucaucucuccaucucuggccaccuuuuuccacccacucagucuuguauauagcuaugcuugcauguaagagcucuucuaauuaacccagcccuagggacagaaacaagagaugcuuuuccucgccuguuuuaaggaucauagcugacaugcucauaauagaaggugcauuagcaagaacaaaccauaacuuucuuauuuaguagauugaacucaggccuucacaucugcuaggcgagcauuccaccacugagcuacacacccaaucaaaacaaauguguuuaauuacacuuuuauaugauauugggagccuuuagaaacaaccagccaaggacccaaagauucagagaaaacuacuuuuauccuuugguuagaaaugguauggacagcauuguagaaaugugauuggacagaaguaucugaucuaaugaccacagaccaacaugagaccuaguagccugucaccucauauuccguugaccuuucugcaugucuuaguuaggguuucauugccaugaagggacaccaugaccacggcgauucuuauaaaugagaacauuuaauuggaucugguucagugguuuaguccaucaucaucaugacaggaagcuccgggguacgcaggcaaacauagugcuggagaguuagcuaagaguucuauguauggauugacaggcagcaggaagagcaagccccugggcuugccuggcuugagguucugaaacuuuaaagacuacagugacacaguucccuuaacaaggccacaggucuggauccucucaaguaaugccaguuguucugaaccuguugaggucauuuuucauucaagccacuaaaugcauauacauugcuuccuuuucccuaugggcuggacagcccugaaaugggggucucaagagggugagucagagaguucaaggucauucaugagacagaaggcaaacaaaggggccugcuggauucuauggcuggcucuuaggaaaaagggguucuaggucuuaucaguugccuugaggaacaggaaucucacuuuuaugggccaagcuguaggagaaugaaugagucaguguggcaggaaaaggucuguaauaucuugcuuuggaggcuuuucuagauccuauaguugagaguagucugccugucaaaacacuauauuuugaaauauauucucuagccccccccccccccaacauccuucuaucuaacuaccuuucuaccucgccacuguuccaucaagccacucuuccacaaagcuuccuauucauccaaauauccuuagccaagaccccuuccagcagccauugacaguuaguguccggcccuacacacuuggcacuggauaagaggccaugacucucuacucaggggugggagaugaaaauuuaccaccgagucaucuaauuacuguugcauuacaaagguauauaaaugugagcauucagcuugggggaccuagaauaaucccuuagacaacugcuuaaauucagucuuacaaaaugaguugguucugugagacuguugggggcaagggccaggaggcauaauucaguauguaauugaugggccaggcugcaggccuuucaaaagacccuuguuaaaucgucagcuuguccaccgagugguccauguucuuucuaauacuuaguuuacugcuguccuuucccaaaguguccuuuccuacagguuggaccugugccucuguccccagaucuuaugccaaugugguaggaaacagcugccaugccaacuaugugcccaaugguauauacagcguacauacucuugcauaccauauagaguguguguguguucuuuuuuuuuuuuuuuuuuuuuuuuuuuuuuuaagggccacugucaccucacaauugaggauuuuguaagagguagccaugcuucuuuugggcagucuuguagaaacagaaaaugaaugauguuuccaaagcugcuauggggaugagcaggugggaguccuccuggcuccuuacaugggaccaguuacauagcagguauuggguucaugcugcuguugcuugcucuggcagcaccagccacauuaaugcuucuguuggguaggcagacuuccuuccaccuuauauuggauaacacacacacacacacacacacacacaccuuuuacuauacacagcuuucucucucugucuuucuuucugucucugucucugucucugucucucucugucucucuguguguguguguguagagaugcuauuccccaaauagcuauauguuuaagaggccuuccuuuggagaagcuucugccauaagccgcuccuuguuauauguguggugguggguggguaggggaugacuuucuaagcaaggaagagaccccugcaggaagagcuuaauuugacaggcagauucacuaagcagcauacuaacaaccugagguaggggccaaagaaaagagagcccucuucccucacuguaaagugccugcuggggcugcagcuuuuccuguuuaucaccuaugcauguuuuguaaauccucauuuccaucggugggugguguuaaugcccagcuccccuaucccaggguauaagccaccucuggucaucuuuugcuguuuuuugggaaccagggaguccuccuugucgauuuuguuguuguuguuguuaggccuguuguuccaggacccagugccuccauuucuaugggggaagugucuuuagaauucugugucugacuaggaccaaagacugugcuuugcaagugaauaugaggaccuacucagccaucaacaccuucucccuccccccuccccccuccccccauccuucugccuauccacccuggagcugucaauuuuaaauauucuucagguaaauggccuuucuccuucacugucuucagacacaaaauccugcuuuuuuuuuuuuuuuuaaacgacuuucugggagcuacaccuccaagcucuaccuuagcuucuggggugugcaagcaccgcuugcauuuucucucuugaguguguagguguuugcaccacuguccagccccuucuauucuagaagcuucuuucaguuugcuuccucuguuaagaccagcugcucgcccagagccgguuugggagcugccacucagacugggaaaugacuugccugcagccaugcagcuugaagggagccagcuagucgcacagguccacaggugucugggcgcaucuuucaccuccagcucuccaguuugcaccugggcucaggacuuuucccuggugccucggguaaauggcguaaagguuacccagcagcaggguccugcuucuguggucuauaaucauugaccggucuugcuuaaugaggguguagggagaacuucuuacgggaaggcuuccaggugagaaccuagcgacagcuggcuucagcggccccuugaauaccuuguggcugcuaggcuugccuaaugagaacucugccugcauggcuccaggcccuguccuguugagacagaaaagaguguucgggaaagaaaggcaccaggcugggguuggggggagggggaggaggcagacugguaggugacaucagggaggguccgaaugcuugguucuacaugggaggggcaaagcggggagaggaggcuaguggaagcuugguucagggaagagagcuuauugucagcccccugcuguaagaguuugggcauacuacccaucucauggagagccuugaccuccuucuugcuuucagacggaucugcugagauugagauccguucucagguucaugaccaagacucagugauggaugagucucuugagcccuugccuguauccuggauguugacugccuuuccugcuucucuccagaagagacucaugcugugaauggguuucacccuccuuucccccauucuuccuugucugucuccuugucuucuugucucccuucuucauugauguaugggcauuguauaucguaguuaaguuucccaaggacauuuucaguauuagggacugauccuagagucucauguauguuagacaaguacucuaccauugaauuuaccccaacauugcuucuuccauuuuauuuggaacaguggcuugcugaguugguugacuaggcuggccuuuguacuugugacuuugugccuuccuccaggcaucuggagauuacaguccggcgcuaagaagauuuuuuuuuauacaaguguauaauuguggcacaauauuuccaaaauuggaaaauucucaguggagauagugugauuugaaaaugcagguccucuuaucccuccgaguacuagguauaggugguagagaaucuguguguugggagggacuauauuaagaagauuaaugcauaaacagacuagacaguucuccugugguucagauaggaccacggagcuuacaguacauugagaucucuggugucuggcuucaucuucaaguuagccucaggucaccacacuccagcauaaguuaggccccugugaauaaauaaagaggugauugaaaccauccaaacauuugauggaauuaaggugggccuuguuuuuaaacugagaguuggagaugcuagucuggauuuugauacugaacaguauuccugggccugaaauaacugugauuaacagaauuuuguuuuuccaaaauguuuauuuccaagucuguggaacauuacaugguaaggagggggcggggagugguuuaguacaugguugcauugauagguaaccuugaacagcagguuauuuugaguuauucaguggucucgguauaaugacagaaguuagcaagggugagguucacaaagugucucagcaauuaggagcacucaacugcucuugggauuggguucccagcauccaaguauggcaugucacaacuccagcuucagggaaucugaugcucucuuauggcuuugcagauaccugcacauauguggacauaccuucacacaggcacauaaauaaaggacaucuuaaagaacaguaaacaguugaauaaaggacaucuuaaagaacaauaaauaguugagaaguuuaagggugcaucucggcugggaguggcugucuagcauucaaaagccucuagguucggucaccaguguucaguuucggaccucaggacaagagacugaggugcauauuuuacaaaccaaaacagaccgggccuucuuguucuuccagcaucccucagucccuaucuggcauacccuguccccaacccugaacuuucccuagaggcuccucccuauauaguccagacauuuuggucucuuuugguuccuuucucuucucucuucuuuuucugcacaagugcccacuuuuucucugcccaccccucuuuccacaaggcaacuucccuagccucaguccauggggccagugagcucgcccuccugagaacagcuucccaauaagcccgccuuuaauauaauccauucugacuugaauuggcucauuucaccuguggcagagaaauaaccuaucaacaaguacuaccuagaccaggcguggcagugcaugccucuaaucccagcauuugggauacggagacuggaggaugaggaacucagcucaaggucaucuuuggcucaguguauuccaggccaaucaggauuuacagagacuguccuuaaagaaauaauucaaguagacaaaagaggcagaaaugggucugaguagugugaugugaccaguuuuuguaagggucuaugguuugcugaagagugacacccaggacucuaagacuauacaugcaaagaguguuuuauucuguagagguccagcauguagucuaccauuauaaagauggacccugaagugagcuugcaggcucaauuuagagcauauuaggggaauauacugggguaggugaccuuugucuuguuugaucucuagggacauuuuagaaccauugcucggaccuggggggggggggagggggcuagaaucuguugucgcagaagucugaaaacuguccuugacucagaccagguggcagggcagcuucugcguccugaacuugccuggguuuguccaguucuugggaaccgauuuaggucucaacuccugaauuguccauuugaaaccugucauagagucagucuagccuuuuccccuuuuuuucuuuaguuuugggccaucucgaaucuuugagauguuucuagaggcugguauugugguuugagaguaaauccguuccuuaacaaaccuaaguaaaacauugaugauguagggaaguacaaguuaacaucaaccaaugggauccgucuuguagucuguuucugacuaaggccacagacguuuugaccacccuugaauggucaacauagaaacaacauuuuucaccuaaagcuauauagaguccucccuguuggaggaacaagucuaggccucuuuuguucugcacgacuacuucugccauggaggauaaggaauccuguagggcugugauggacuuuucuaucuccaucuauagggccuuauaagugguaucuuggaauacuaagacugagaccccuagacuagcagcucuggacagcccaguguugaggagagaaccuauuaacacagugggaauggccacccuuuuuacuccauucuuuggagcuauuaguugauagaauaucuccuccccagaguaauaagucacccuggguauaaacuguacuagaacauacaacucuucagucauauuuauaaucaggccacaaauguauggaguaagcccugagguauaagcccagcaagcauucucuuggggcaacauguauaccuguaacaguagggguuacaguguaguuuagaggcgggcauaggcugaggggaccuuauuucugauguagagucccugccugguauccaacaguucugcggccuucuugucaaccacugugaucucggugacaaaguuguugcaucgcccccuugaggguacucagauaguaagguagagagugguucauggagucagucuacccuucucaguuugcuggcuuagaagaugagggauguugaauaaccuacacugcagccuccggaacagcagucacuauguggcucuuaauggauggcuggggacauuuaucuuggacuuuucuguuuccaaaacugugcugaaaggcuuguguagauauaauauucaaagcaucuggcggucacauuugcuuuagccuacaaggaaugggugaugaagcaguaacugaaaggguccuuagggugugccaaugccaggugguccuuuguuugagugugaccauugaggccuaugagaucagugugcuagcguagcaggauggcuaaguaaccuggaguugaggauagguaagagaaaaggcccuguguugugugcacauuaccucuucugugauagucugcccagcccuuaccugagcaucuggcuugggugacaucaccuaguguugcugcagacguaagucccuuccugucaugccucgcuguuaggauccuugggcugugugcuugauaguccuuugagcaucuuggaagugcuuuagcuccgaugggugagcaccucuggcucaugguccaaaacguuccuuuuccuuccugaaaguguguccaaacuguugcuucgucuuccuuuguggagacuguggcugccucaucacuacacuuccuugacugacuucaagagugugauaucagggcaggguggggguggggcagccccaacagagaucuuugugcuuucugaauugauuuuagugcuucccgccuaucaagugcccagucuuuacugucuugcuauauauauugcacagccgguccugcugugucuuaucuuuaucugugucccagucaaacugcccucucuuuccguguccggugggagccugauugcuuagagaugaguauaagguugaaaggaggagaaaacuccaugucauagagacaauagugggcugaaagaggaacauuaauuugaugugcccaagggagagggagccgcaugugcuauugccuuucugggugcgcucuggugcacccagauguggauacaaacagagcaucuugccugccucuggcuuauugaagcugcucacugggguggcuucacucaccuuuaugagaggccuuaggcuucauuagaaaaagccuuuauggcaauuuccauaauacuguguaugugugaggauuggauuccccuccugggaugauacuaaauaccuuuguaaaaccaagcucaccuguuaucgacacacaggggccaggauugcucaccucauggaaaggcucagcagccucacuugcccuucucaagccucucagccugcucugcagaaugcaaggaauggccagaugcugccuaggcuuguauuuggccucugccaaggucagguugucggggaggaagaaggggaggggcacccuugcuuaguaaguaaggaggggaggaagaggcccagacagagcagccacgaaagaucuuuuaugugcaagccuggcucaucugcaacucugcuuggagcccacccccaccccucauuuccuccuacaccaggaaggggugcugggcaauugggagggggcauugcuuccgaucuggugugaagcucacauuccucugcaguauccugggguugccugccugcagacaccugguuggaauaacaaugagugggaagcucgguugcagccucugcucagcucugaggaugcucugcuaggagaggcuaguucugcugagcuagcacuuccucccugccuuuccuuccaggccaggcccucuuugacuccagcguggcugcuggugaaaaguauauacugaaaacaguacuugaggugguugaaucucauuucuuaugcacauauguuauuggaaugggagaugauuaauaggggcacagggugagaccaggggaaauggccugaaaagcccugccuugagcuaacaucacuguaaacgucacuuuuuauucaacaucugucugucugucugucuaucuaucuaucuaucuaucuaucuaucuaucuaucuaccuaccuaccuaucauucugugagugucccagauguuuagguuaacugcuuuuaccaccuccauaacauaguuagacuuggcuagguuuggguagaccauucuaaaccgucacaaagcgucauuaaaggcuccuuacguugauguuuuugaucccuucugucuuugguuaucuuuauuuuuuuuuuccugacuuuuacauuuucugauuauaacauacauaauuauucugucuagcauaggauaggagagcauuucuucgaacuaggcugccaucccagccuuuugcaaauaucagcucauuuaauuccgagcaccccaguaugaugguguuagguuagacauuauucagggguuggauaaguucagcauagaggguggaaaguucagcauagagggcuggaaaguucagcauagaggguggggcuugccagccaugcuccguaacagguagggacugagggaugcugggagaaccggaggucagauccacuuuggaauguuaaauaggcacuucagcugcuugcucagggucugaaucucaacacuuagaaauaagcacugugugaagacacacaggugccacaggagaauuuuauuuuuaaugguuccagaucuucuuccuuccucugaacacaggcaucuuuuuaauucuaugcccuuuauuuauuuauucuuuuugguuuguuucuuccuuuucacuuaaaaguguauucucggggguggguggguaugggggacuuuugguauagcauuggaaauguaaaugagcuaaauaccuaauaaaaaauggaaaaaaaagguguauucucucauauguuaaguccugaccaccguuucccaucccccuacuacuacccgccccugcccccccuccacaucuccucuuccauuucccuuuagaaaagagcaggccucccagggauaucaaacaaauccagaauaacaagacuaggcacaaauccucaggcuggacuagguaacccaguaggaggaaaaggguccuuuuugcuuuugagcagaucgguauacucugucauggggcuaaugcacaccuugauuuggaggcacugcaccugcuaggugagguuaguaauauacagcuuaagacuccgcugauggcagaucugguauguaagcagagggcguggucuagggcuagaauuaggcucccaugaauugcaaguuguguauugaguauuacagguuuguguuuugcauauuacacacugcgaugaaguguuuaagcagucauuaguaagucacgaagcugccauucuuacucuuuguuauuaaauaguaaugauacuagugucaucagguuuuaauuaauucucauuaccuaauuuuaagcguugcuguauaucagauacucuaguaagcucuucuacucuucuuucaccccaagaacuuaaggaccugguuguuaccauugcccauagccccacagcuuccacuuggaggauguuugucacccgcaaaucuuauuuauuuauuuauuuauuuauuuguuuauuuuaaggguauauuuauuuuuauuuuguguguuuugccugcaugugcgaguacgucagaccuccugaaaccggaguuacaaacacuugugagaugugaauugggugcuaggaaccgaacuggggucuucuggaagagcagcucuuuacugcugagccaucucuccagccccuguuuuauuuuuuuuaagugagaaacugauccaguguaccuuggaauggucagcuucucucccuugcuucccagccccccuuccuucucucuuucuucccuuaacuguacuuugggcuuucagcuaacugcuauccuccugccucacucagccucuucagugcugggacuaaagcaaguacuaucacauccagucauucaucuuuuccuuaugagaaaagaaccugguuagccacaagucuucuggguugacagggccccucccaccuuggucccguucuagccucagaauaugccauuauuuggacuggggauuucugugacauaauuacuucaggucaggugagcucaucuuaucaacggugagaaauguagaagacaggaacacagcucuacacagccacccccacuagccuaggaggcccccuguuuuuuucuuguguuuagaggucucgacucaggucaaacuuagguuuauagcuucaauauugaaauacguuucaggaucaguuuagugaaccaguaucccugauguuaucaagaguauucuaauauaggcuaauaugagggcuacgagaaaaggcgcugggcauggugggguacaccuuucauucuagcaugugcagguggaucucccgaguuugaggccagccuggucuacagagugaguuccaggauagcuagagcuauacagagauacuuugucuugaaaaaaaaaaacaauuaaaaaagggggagggagggaugggggaggaaggaggaggagagauugagagguguugagaagguaugucauauccaagugggaguguaugcucaucagaggaaaguaagaaauaccuuuacccuccucucucucucucucucucucucucccucucucucucucucucuguuuuucaagacaggguuucucuguauagcccuggcuguccuggaacucacuuuguagacaagacuggucucgaacucagaaauccgccugccucuaccuccugagugcugggauuaaaggcgugcgucaccacgccccacuccucucucuuuugaugagagagaugcaugaagcagcccaagagacaccuugggugcaaucauagucuaauaaggaaaaaccaggagucaccaagguuauccaaggagcuuugugcaugucccuucccucugaacggaggaguuccuagugugauuccuagaaaacugccgguugcuggcuagaaagugcugaaguucucuuucucaacuggauuccagacuggggggggcuucuuugcagauuaucacaccccaagauuuucuuugccuuucuagccuaacucagaauuggcuucugguaaacuccgcagccagggauugguguuggaccaagauuggagggggagggaggcagucuuagggauacagggaaaaguccaggugauaagggaagguagagaugggagagauggcgccacuagccagacagugacagggccugagggcucuauuagaaagccugcuccuuagagcccccaggagagaacagcccagaacuuuccugggaaguagacuucucagacuugaaggagucuguuucuucuggggcaagguuaaggugcccacuguagagugauuuguuaggaaacucuugacaguaccucgcucagaaugggguucucccaguguguggggaaguacagaaaauacucuccccgacuuuacauguguucuuuacacaaauacuugcuaaugacugugaagcucacagugggaacgaucauuuuguuccauauucuuugcuguagcucugcgagcaauugaaaucgcuagacaaacuuccucgucuacuucaucucccacuuacucacugagggaccuugaguagauggugaaacacagggcucuagaccacgcagcuuugccagggaagugcaaagugguuugggucauacauagcauuggucaagugcuaugaagucuguauggucauggcaucuagcucagaauccaaguggcgcugggcagguuuguguuuguuuguuuugcuuuuuguuuguuugcuuuugucaacuugacagaagcugguggugucugggaagagggaagaagcuuaaagcuuauuuagagaauuuccucccccagaauggccuauaaguaagucugggguaggggauauuuuccccacuaaugauugaugugggaagacccauagcacuauggacaaugccaucccugggcagguggcccuagaagauagaagaaaacaaguugagcaaguuguggggugcaagccaggagucaacauucuccuacagcuucuacucacuuccugcuuccgcugugccugucuugaguuucuguccugacuccccucaauggcugcauugugauguggagucauaagaugagauaaaucuuuuuuuccacagguugguuuugguuaguguuuuaucucagcaauagaaaacaagcuaggaucuuaguucuuaguauuuaaaaaaaauuaauuuaucuauguguguauuuaugcuugucuguauauggaccgcauauaugcagguacccaaggggaucaguagaauauuaaacacagcucccuugcucugcaacaauagcuuugcuuuucagggaaggaaaccuggccucugagagauuauuuuaguucugguguuguuuccuaaauggacaaaaggcauguucuguuuuucaccccauucuuguugccucaucuguuugggguguauaagccugccagggguaucugacuguguggguaccuguuugcaagucuguuuuucuuuuguuucaggugugugugugugugugugugugugugugugugagagagagagagagagagagagagagagagagagagagagagagagagaagcuggguuccacuugggcuacccuggaagguaaucaaggacucccuugaccuggucugccugccucuaccucuccugcauggcgguuacugcugugcaacaccacaccugcuuuacucugugccgaggugguaccuaggucuuuguauaugcucaagccugacagacaaggcuugcuugggacuaaacugucggacuccugaugccuaggaucacaugcuuaugucagacagagucuguuaggagaccgugacugcuucucaccauauguaagggaucugaagaagcaaauugguauaaacauuuuagaaucuuacauuuuacaaguauuuauuucguguguguguguacacguauguauguacguacaucacagugcgcaucuagaagugagaguaccaauuaugggagucacuugucuccuucuagcauacgaguuccagacaugaaaaucaggucacuaggcucaauggcaagcaccucaaaacaccgagauaccuugcuguuccucuuuggugugacagccaggaauuguucuuacacacccaaaggagaauaccuguaccagguguuuauggacaaacaaaaccccuccuagaaucuacagcuccuuuucugcuugugucagaaguauaugcccuuuauacacagcuacaaacaccauagggauguggaaggaacaaucccuguccguuguuuguuagcccaaauuuggaaggagucacagaaccuugcauaggaauccugagaucuauguguucuuucaguaguggggucuguuuugccaccagaggagaugacagagucaccaggaagcauuuggugaagcugacucccuugugggcucaguggggcccagucucuguccugauuccgucuuaccugcugcuguagcagauugucgggaauacagaggcagaggagagagggaauggggaguggccggcuuuggcuguuacugacugcacguggugcuuugcugcuggcuccugcccucccccucccuccugcccgcuggaguugcccugcacagcuaucuugcuuggguuaggugaggacacaaagcagcagacauucagucucuggugcuugcuuguggccuccgaggaccuaggccuaccuccagcuucuggugcauucccuucagagcuccugagaaacccuggccagccucacagcccccaacaagcucuucuuuccaagacacucagcaauuccccggguuaccggcucaguuuaccuugagccuacuuaccuggucagcaggccuugcgugaguuccuugaaguccuugggggaaauagcauucucuucucuuuaaccuacuuagauuagagggugugcagccaggagagucugcaaacaucuuuuccugaagggccagcggggcugccgagaaaccaucgugacuaguguuaauuuugcugacgaaccccuugcagcuggugaugauaagaguuaaugggcucugugcuggcuugcuucuauugcuccuuccagcaaguccaucccuccucucccuuaucugcagacccucgggaugccggaaagcugcagcugcucccacguccucuagauacugcuuuuccucuacagaugcaucuuggauuugcauauaacuuuacauacaaacuuauaaauacagacaaauuuguaagggaacuguagcaagacauugacaacaauaacuuguaauagaguaaccguaaugacaagaaauauucuuuaaguugauagguuugcauauuucugaaaguuuucauguuauauuuucuuuggauuagaguuggccaugcgucauguagaccauggaaagugaagcuuucuaugacgaggaaugaacaggguagucgguaguuccugaggaagaggccggacuuagagacacugagcagccucaugggugugcccagucagcgacaugaauggcaguguccuugacagucuagagccugggcucuguggcagacaugcaugcacggagucuguucccaucucugcuggccacagucucucucucucuuuuuuuuucucuugagucagggucucucuguguaguccuggcuguccuggaacucacucuguagaccaggcuggccacauucucagugggaccuuccgguauaucaucacuauaaauaaucuccauugcucuggccaagcacauggugguaggucuacacagauguccaguucuuccaguaggcaucugugauaguuuucccccucauuguuggaacuagaucuagggccuugugcacgugagguaagcccucuaucauugaguuauaucucuugcauuggggaaaaaaaaaaaacaaaacaauuauagccggacuugguggcgcaugccuuuaauccuagcacuugggaggcagaggcagguggaucucugaguucgaggccagccuggucuacaaagugaguucuaggacagccaaggcuacacagagaaacccugucucgaaaaacaaaacaaaacagaaaaacaaaacaaacaaaaaaacccaauuaugguacauuuguuucuuuucccuguaugaaauguaugccaugugaauaccugguaccuugggaaguuaguagaagcuauccgacccccuggaacuggaaccauggauggcggagacaccauguggaugcugggagcccaaaccaggccccgagaaagcaacaauuccucacaacugcugaaaccaucccuccagccuucaauuuauuugugcuuaaaaacuguacucauuagcugggcauggugguacaggccuuuaaucccagcacucgggaggcagaggcggguagaucuuggugaguuugaagucagucucaucuacauagagucuagagcagccaggacugcucagagaaagcccgccucaaaaaauugcauuuuuauuuauauguaugaauauuuguagguaggcgcauaggucauagaucacacgugaaaaucagaggacaacuugcaggauucaauucucaccccaggaauugauugcggcuauuaugcuugacaggaagugccuuuacuuagcgagccccaucgucagguuuuauuuuauuuuuuuauaguucacuuacuaauauuauacaaauaguauuugcaauauuuacauugugucgaaauugcaauuuuuuuuuuuuuuuacauagcaugaucugagauauuauacugauaaguacauaaaagguuuguucacugacugcaacuuaggauuccgauuauaaguucauuuauuuccuaggaaugcugaaacagauugccagaaacuaaucccagcccccacauagggucucauggagcccuggcuagugguaaacucaacacagaacugagaaggagaguaaauguuugaucucucugccucugucuccaaaaugccaggaugucaaauauccagggcuguggauugaccucaagguauuucugucugcuagacaagcacucuaacaauggaacuacaguccucaccugagccccuuaacauaaaaaaaaaaaaaaaagaauucaagacagaauauucuuuaauugcccaggcuagccuuugaacucccuuucaaguugucaggcucaacuugaacuucuaacaccccgccucuguucuauagcaucugaacauacauggauuacaaaugugugccagccucucuggucucaugauggucccugaacacugagcagcugccaggcagcaucagauauuguggaucugaggcuguguuauaguccuaauugcucauagcuucuugauggagagaggucuggggaugugcaaagucucaaagucguguggagcugaggacgaggagaaaauacaucugugcuuuuuuuuuuuuuuuuuuuaaaaaaaaaaaagaauauccuacuucuacauacuuggguccauacuaagcgaguggaccagagaugaggucaggguugggguuuaaaauagaugaugucauggagggcacugauugauuagucuuggggucagaagucgcugagggaauggaugaaccagaagaagguugucgugugacacggacguccuguacggugguggcugccauggaauguguaagggcuuggauauggagccuucuucauucccguucauccuaucgcuccugugacucauucugccuuucugaccugugcuguagauauggggcugguuccugccugguaaagguguuaggagguuucauuguguuguggcuguuggugugcgaggccuccagucuccaugaugcucgguggacgugagcuuucggagguagcaucacugugaccugacgguuaagcagagagucugaugaaguaacucauccucuuugcucuauacuaacccuucccuuucuugacaugccuguggucuccuuccagccugcagggagcugacuacuuucuuccucaacuuccuguggcccagaggccucugagcccuucucauacucaagauucuuaguggccgggugagaacuaagcacugagguuuguccuaauuccuuucccagcuucucuaguggugguaggaucuguucuccuaggcuaagacguggagacccccugggaacugcaguggcuucuugcccacucugaucugagcaguccuguaaauaaggaaaccaaacccuuugugggagucaguuuuauuaucucuaugaacaaauacccaagggggaaaaaaauaaagagagaaggguuuuguauuaguuaggguucucuagaggaacagaacuuauagaaugaauauguauauauauagauacauauauucaaguugacaaccaagaguagccaucccagagauaguuuagcucacuguuucagagggcucaguccauuuuggcccuuugcugcaggacagucgugccaguagcagccaggaaaaagcagaugccugcuccaggcugccuuucccauuucuuccacacagauccaaguccuugggauggaaaugcccacgcucaaagcggaucucacucccuuaguuaauccuuucugugcacacccucaccaacacucuaaauguggucugaugaucuuccuggugcuccucgguggguuagguugaagaccaagguaaaucuucacacccuuugugaaacuccagugaguccauguaagcaucgcaugagccucauguacgggagucccagcuguccagggugaugguggcucugcgugcauuguuuuacauccuguccuuuuuguagaucucaacagaugaacccaggggacauuuguuguuuuuaacugaacaaagauaaaaguuuuaaaauuuauuuauguauaugaauguucaauguauaugccuaugugacagaagaaagcauuggauccuauuauugcugcuugugagccacuguauuguugcugggaauugaacucaggaccucuggaagaguaaccagugggcagugguggagcacgccuuuaaauuaaucccagcacuugggaggcagaggcaggcagauuucugaguucgaggccagccuggucuacagagugaguuccaggacagccagggcuacacagagaaacccugucucgaaaaacaagaacacaaaaugaguaacuaguccucuuaaccacugaaccaucucuucaggccaaagagauucuuuucucuuucugccuuucugucuucccucccucccucccucccucccucccucccucccucccucccucccucccucccucccucccucccuccuucccucccuuccuccuuccuuccuuccuuccuuccuaacuuuauuuuauucuauggauauggauguuuugucuauauguuuguauguguaccaugugugugccuagugugagugaaggucagaagaggguggcacaucccuuaaaacuagaauuccagaugcugugccaauaacuaaacccaguucugaauccaggaacagcaucucucagugccucaaagacauacuuucaaaggaugugcuagaggcccgaaggucuucacacucuggcuuauugggucccugacccaauucauauuccauucccugagugugagaaggagccagugcuagaaagcuugugcauccugaaacagcugaucucuguuaaggcagcagcuuggggaagaaaggaaaggaagggaaaaugaagucugucuacagaaggauaguuacaguguugucugagagcagacccugaaaugucuuucuaguguagacaagaccuagacuuuggcauacaaguaccuggucuccaugacugcugcuucugugcgucagggaggaaggaaaggagaugucuucauugucaaguuuaagaggcuguaauuuuccaauugaggggguauuugugggaggcagugaggcugggccagccuucccucccaggaccauuugcuagccccugcagucaguacugugguccgugggcugcguucguuauucaggcauucugauggacuucuacuucccggguuggagacugauauuguuggacaguucuagaaguuagagaaggggagugagacacucauauguguguguacuuauauguagugucauggaagaauggggacacacugggacacaaaauggguacuggggaagacuucugagcuucauuuucugcuaacuguagcaccuuguguuaccccugcagcuugcaaagcauccccuggacccguguucaagggaguucagacacaaagcccuuugcucuauugcugguggguaggacacugaagcagccugcgguucucaucaguaucugcuugcaggcgucagcugguacaaauaccuaggagggaggguggucaaaaaggaagugacacauuugggccugacagucugggagacagagaggaaagaggcacagccaagagaaaggaccccggggcugugcuuucucguggggcaauuuucugugucacaaagccagagcuugcuuccugaugaagccacccccuggaugucuuccaggcacggccagcugacagcagcagcuugugacaagaugguguggagaguccgggagccccuguagaugcccauucucaagucagagggccuguuucuaugucuugauggucccgugguauacuuucccaggaaagucuuaaaaaguguaagcccucuuucacacacacacacacacacacacacacacacacacacacgcacacuagcagcucaagcacauaagugggcacaugcacagucagauguggagccagcaagcaccuggauagacagaguauuaccccuuucagaaggucugcucccacaccaguuacucaguguaacuuaguuuugcuuucuucuuuugcuauuuuaauuaacuauugcucuucauuugugugugcaugcacacauccaaggagaacuuuguggaauuggcucuuuccuucuacccuguauguggguuccaaggauugaacucaugccaccaggcuuguugcaccacuugucuuggcuucuaagagcacagagagguuuauuuagguuuuuuuuuuuuuuuuuuugugugugugugugugugugugugugugucaugguaaauacacauuccuguggucuuucuuuguccgccgcucucugcagccucauugaucuuugcaguaagugcuauacaccgcugagacucaguuggugcucauugcuccuuggauucuccgugugguuuuaaagcuuaucuuauagcgucuguacccuucuagagagacagacauucaggguugaagacacuugaagcccugguguggcaagccccgccuugauguuuucugacagacaagaguacgaugaauuaucuuuucuccugagcauccucacuggcucuguucuuggucaggaaccaccccuugaugagaggaaugcucacccagucaugugagaauucuucuucagguccuagaacuuuaacggacuugauccagcaacguaaacuuuccuucagggcuugagauuugucuguuggccucuguaaauguuuaacuaugucuuugcccccuuauugcuaacugagguugugcugagaaccacagcugugucuuuccucugcaugucucuucccccucuuagagauuaaauggacuccaggucugagagucagcugcuggacuccccugguugcuacccugggccucaaauucugcaaccaaauaauaaccauuuauaauucauagcucgaucucucccucucccucucccucucucccucccucccuccuucccuguguguguguaugugucgaugaaaugagauuguauauguaggaaaugucuaaaauuuuaaucauagccaucuuggguagguacucuucuuaagguaaugcaggaugcuggaucgggccucugauugggaagacaggugacugccuaccuggcgucugcuguucucuuccuauagugcaucacacuuacugucugugcccuggugccccccccccccccaauauucuaggaacuucacugggaaaugcuucuagugggaugaaugacagaugcucugcgaagugccacuagcgcucuuaggugguuagggaaggucaggccccagccucugugguuucuaggauaaugugaaaacacuggauugaggagaccagcuuaguagcuggaccagucuagaagggcccaggaauagcugaauaaauaagaguaagagccccuaggcccuguccuggagaagcagcucaggcaguagggcagaacuuggagccaggccagccuuuugugguugcuuuuaaaaagaaacaaaacaaagccugacuuccgaccagcugaccccuaagccucuaagccuaguagcucccugcugggaccuuucagaccugcaggggagcuuggcugggugccaggccuggccuucugucagccaaagcaagccagagacugacgcucucucucccucauccauacuguugguucaggcaggcccuauucuccucccagccaacucugaggcucuccugccuggaggguuagcgacugggacccaguguccgucgaugaaggcuuuccccacaccauacccuuccuuuaccccuaggccuuccacucacccauauauauauauauauauauauuuuuuuuuuuuuaagcacauuccucuguggacaggucagggucagauauaaggaagaauuguugauugcuacuguagucugugauugugccaaagugguuuucuucucccuugucucaggucugauuuucuuaacucuacuacgguaagaagaugcccuccaucagcaggccgugucugcugggaccucucuggagacuuccugaacccuguggauuuacaguaagaugcaguuuccuggggaguaauucugguggauacaaauuccggaguauuacaccuggcuugccuggagauguuacaaguagcuggauggauucuucagccuggaugcccacugaaaacaaggaccgaaacuaagaggauuguaucucuacccuugacucaaugagaauguuuguugucaucucucgggcuaccuggagcucccucuaaaauguaagccccuaagacccaucuccuuucaaugcaguguuucugguauguuccugucuuuacaccaagcuguccuggaugcugguugagggcugucuguugauguggcugcuaggaagagaucugcugucuuccgugucugucuaugugucugguaugacgcugggcgccugugggagaaagacaaaaaauagaaguuguucgaguuaauguuucuuucuuuuucuuuuuuucuuaaagauuuauuuauuuauuuguuuaucuaucuauuuauuuauuauauggauguacacuguagcugucuucagacagcuccagaagagggcgucagaucucguuacagaugguugugagcuaccaugugguugcugggauuugaacucaggaccuucagaagaguagucggggugcucuuacccacugagccaucucaccagccccucuaaguuaaaauaauaauaaaaagaaaauccccucuggagcuacccuugccuauguugauggguacuuacugauugaagggucuuauuucugucuagacccuaaauaccucgaaggccaaggccugagggggaugacuaugucucugagacuuaguguauaccugguacuggccucucacccuacaaggaugauaaaugaagaugugaugguuaauucauuaagacacuggcaguuccauagggaagauagacacaauccuuucuuggcucuaugccaagagcggagaacaccacgggaccagauguuugguaccaugugugucagcagguggcuguucugaguuucaaucucuacuacccuaugugacucagggccagugacaauccaguucccuucccuucucucuuuggcaugacugaaguuaguauucucuucugucacaggguugguguugaggcucacaacaggcacuaugugcugaauaugugccugaugcuuugcacagggucaggaccaugccagagcagggcagcuucuggggagggugaguguugguuccuuuagaaacuucuguuucuaagccaagccggguaagcaguggcucggcuuggacaguagguuaagguucauagcuccugcagcccaugggcaggcugagcaucaagucugcaaugguuagccagagggagagaguaauggauuugacaaccgaggccuuuuugguucuacaucggacugacggggaaucuugacuccuuagggguuacaagguugguagaauccagggauguuaacuguagugccaggcugccccaaggagagugauagccccaguaggagcuagcacaauguucaggucacaaugcucaggucaccguucagcugccaaaguggaacuugacauagggucugcuugggaugggcuucuuggucuuguguucccaugaugaacuucuaggcaggccuaaaaguuccacgcauacagaguccuguguuuaugauaugcuguuauucacagacccuagauguacaccgacuuuaugcugcagcagaguucaucuggugggaggguggcccacggugguuuccuuguagccccaccgaacauagaugugagcaugguccuuuggaacaacugcguaauucaguccggcacuccuuuggaaggguugugugucuccacucuagaguugagagugaggcuuaugacuuccauagguauaugcuuaggagacggucaagcuggaagcuagggucagccgaaggaggaaguuuuucuccuggggcuggagguguaugugaugcgacuuucuccugucguuggcuucuuaugcccuuaaaaccuucaguccuccuuccuccaccugagaaaaacagacuuuagggauuuccacagggcuugagcauuacggcugagacuggggcuggaguugagucaggcugggcagacggcauauguucucaaccuauagaugggggcaccccccuccccccuggcugaauaucagcuaaccugcguaucagauauuuauauuaugauucauaacaguagcaaaauuacaguagcaaugaaauaauuuuaugauggugggggaauaguuuuacgaggaaguguauuaaagggucucaguacuggguugagaaccacugguuuggagagaauucuuuaugcuuucggugagugggggcuuacuggauaggguauuuggagcuaugcucacagaccugccugauuuggaguggugacuggagucauuucagggaggggcuacugcagcuuuuagccccacuaugucuuccuagcccccccucccccauucuuccucugugacagcuaucuuucacuuauugcauagcucacagcuccuuuucucugcuucgauuggucacucucuagaauaacccuucuguggugguucucuucaucuccugcccuuacaagagggugauggugggcucaggcuccgaaagaaauaacacagaaccauaacugagaaauaagacaguugcugaaugggcauggaacuagcagcuaucaccauuuauuaagccagugcaggcggcauggcaaacacugaaccacauaugugucaaaacaggaccacgggguagacauuguuaggauauggguuauaaagcaaaguagguuuccccaggaaacacaaugcugccagccuccacagccaugggccaugcugccuggaguugagagaugugacuccugcccccuucuuguccccuagagugccuauaauauagaacaggucaccuuucuucuuuuggucuguuuccucauuaguagguaacugagagauuuuucuucuaggcugaggugcuugggacugaaagagucuuuguggcacaaagcacaagccaggcagauaccuggauauggcuucuagggccugcagucucuagaaccgggcccaaagaacaagggucuccccagguggauaauugguacuguugguacucaugcuuuagaugcuagcuguucuccugcucuggugcuguuuguccuggcacuggugaugcugguggcauugguuguggugguguugguacugaugacuucuaaggcagcucugccauucccucuuguggcuacaagaguaggcaguauuucuguuuaugguucaugcccucaauuguuccucagcuaccugccauguguccugucgauugcuguuuuccauacugguucuccuuagugggcuucugugcuaauggaaggaagcacuugugcuaguggagggcugucccucaagauccuucaucccuagcgauagcugagcguccuggaccuguuccaaugcagaggugcugggaaccauagugggucugcacaguuuggcaugaaaagagucugggcuucuuucuuuucuaguguucuuggugcccugcaugggacugucuaugaacuggguuaaguccccuggaccaccucaucugcuggggugaggguggcccucugcuucacauuugaagauuccgagguucaaagagaucuacauagucauuaagagcaucuugguucuucacguaggucccagaaacuauauuuauuuggacuuggcaagccuguuuuagagaaaaaugauuguuuuguaugcagcuuuaacaaauuuguaaaggaauugcuacuggcuuaugagaccuuugaugucuuacauaucaucgcuaagaguacaaauaucuaacuuaauggaagauaauccccaguuccagaauacauggcggcucuuagccuugacggggccuccacuuggaguauagguccuuguuuacagauauuguacugugacuguagaaagcucaugauaucacaggagcaaaacuuuggagccugugacauggguuagccugugacauggguuagccugugacauggguuagcuugugacauggguuagcuauggcuccugcuuuacaucuggcaauacuguggcaacugugcuucccucugaaucuggaagauuccuuaugagauggcugcuuagcuugaucugcagcaacacacacacacacacacacacacacacacacacacauucuguaaccuauggagaacaucuuauuuauguaugcuuuuaugcuuauuaugcauaaaccacacuuguuuuaugugugugggguucuaccuccauguauaucuguguagcauguucauguaugucuacacagcauguacacgcaugucuguacagcacgugcaugcagugcuugcaguccuccguauacucuggaauugcaguuauaggcagugguuaucucucaugugaguguuggaauugaguuaggugagugcugggaauugaaucaggguccucugcaagaguaaccgguacccuuaaccacuaugccauucuuccagcuccugagaguaacuuauaaucaugugaggaaugcugccacugcaggcacuguguggguccuguccacucuguugugcauauugaauaccuagugugcuucagucaaccccuccauuacccuagguugacucauggcauaguaaauauucccacugugcauuugacugguggcuucauaucuuucucguucauuucuuuucaaugauuggaggcuguuaucucccccacaaugguacagugagaaugaaauaaaacacacauuugagcguuugagucagcggguuguuuggggacauauaacaucuauucagggaauauuaguuauuuuuaaguaaauuguugaaguagaauuggaagaucaaaacaugcagacacagagaaauaagaaaaugcugaagaugugucaugacucacggaaauuuaauguucaaucuagcuuuggguuuccuaguuaccacagcaugcugaguggguuauauuucugucuaaauuaagguuuggcaaacuucuccuccccagggcuagaaaguaaauauuuucagcuuugggagcccugcaguucucuacugcucaucugcccaaugagacugcugggaagcugccauuggugguauguaaaugaguggguguagcugugugccaauaaaacuuuauuuacaagaccuggccaagggcccauaagcugucguuuguucuugcuuuaaaugaggaaaccuguuuaucuuuggaagaaauuucuccuggaucauaaacacuggauaggguuugucaugagauauaauauuuguaugaagcuguggaaacagcagauggguagcgcauucauuggguuucacaggaaacauaaagaaggccuucacacggucaguucaugccuacugugucuuaagcugugauauugacagagaguacauguacuuuggcugggauaggggacuggcaagggagagaccguagugauaauucagcaagggcacguuagaguguuuguucuuaaguauaguguugaguccuggauugcauccagagcucaaugcuccuuuggagcaaaauuaacccuguuuggaagccuucaguuucauagcugguugcucucccucugcuuucuuaagcucuuugagcucugcuuuguccaucugcaaagcugaguugcaccagggccgggucagcuaguguuugcuuuuuaguuccuucccacacgagauccagggggagggugaacuucuccagcacuggccugcaggggugaggaucauaccguuguugugguugggucugucgcuauguauuguaauucuaaauucuguaucccuaugucuaguugccucuagacacauaugucagcuuuuguugugcaaaccuugcucccuaauuuaaagcuauugguuaauaaagaugccuacagccuggagcugggcagaagaaaggucggggagggggcuuugguucuagggcuuggggacugaggcagagaugauagagaugacagagagauaaagagagagagaggaugccaugggguagguggaucaugagcacaugacuaguugguguaggagcagcccaggcacaacagggcaagugauaucuugggguuacugacaggaaaguagaccaacuagcauagaggguugguaucuucccagcucuuaugcuuuaaggcuuauuaucaauacaaauauuuugugucuuuucuuuggaaaccaaaucaccuaaggcgggguagaaaccgccaaauaauauuuaccacaacacagucccccucuuccugugaauauuuagccugugggauuccagcgcugacaaaggcaagagauucuaagcagucaucuguguaaccucccagccuuuggccaagcccugacugaguuugggugacgguaaggcuuauagucacugcaccaaagaucuugccugauauggagugggacuaggcaguggccacuggaaaccugggucaaaaugggugaguaugggccucuucucccugguacuuggcucucuggagugagacaaggcucuggacaauuuagcaacacuugaugacuugaccaaauaaacagccagccacaaacucgcagacuccuuuucacccuuggucaccagaaacucuuuguuauauguuuaggauccaugaagagauguagaauaguaaaaauaauucuuuggauggaguauuagaaaaccuagaaccaucugauaaugguggggcacacuuuuaguccccgcacuugggaggcagagguggauaguucucugugaauucaaggccagucugaucuacaggaugaauuccaggacauccaagguagucagucacacagagaaaccucaucuugaaaacgaacagaaaccuggggccaacuaagcaaaagggcuuucuggcucugugaccuccaauauagauugguugaccucucugggccuuucuuuuucucccuccuggagcuggcuauuguaaaacuagaugcacugaagugggaaacccaaccagggguuaacucucuuccucaagccccaugcacagcaaaucccuaauccaauuccacaucgccaggcagaucgauuuugugaccauuggguucugaguucaagucagcucaggcauuucuuaggacuuuugguggcggagacucugacuugggguggcugcccaggugugauacuugggcagaugccaagaggacaaaugagcccuauuagugaaaguguuggagauccagagugagagagugauagcgggacagagugcuuagggaggagcccugagugguggagaagaagguggcuugggaaauucccuacaugccacacagcagcccuuguugacugcuauagaguuggaaacauacagugauuuccaggaccuuggagccuuccugucacuuuuuuuuuuuuuuuuccuguaacacugggaauucuccaagcuaucucggccccuucaucuucuagugacuuccagaaagucuauccucauuagggaaucugcuguggaauuuggaggcuguuucucuggguaaugugaguuaucuagacaguggaagucacaaagggccguggaacagagggcccguucccacccgcaggguuaaugcucacuggggaugcugcuuguuugucuuggaccaaugccuuuugaagaaauaaaugaaagagaaccuaaggcugugagaagcugugcugcucacguucaauagaagcucuacucuuggacuuggguccaggaggucaagcccugcccuucuauuucagaucucuguggaggccucucugggcacuauauuucagcaguucuuaggcagguggcacagugcagaugguuccugcaaaaccuguuacucagcauuagggcuucccugugguguucauuccaggcuauauuuuugggguggggaugggggaggggaucacuucuagaauccugcaacaaguaucuauauacacaguagaauguguccccaggagucuggcaugcagaggacacauuugcggucuuccuagguguggccacguggcuuuccacguagggucaucagcugaguuucuucucucugagaucagggaacuucuugggugggcaggaauggguggaacacaucuguguaccugugaccaucagcagggucugcuaccugauccuggucaggauaugacuacguggacuacacucuggaagaagacuagguaaauacccagagacacuccagagccagggcauggaaagagcaucgugucagagugagcgugcggaaggagcggagcacugaguccuucuguaagaacaggaggagacagcagauacagugaugagggagugcaguauagccauguguugaaagaccacuugaggugucaucuucucugaugucaucaauccaggcaugaagguccaaggcaccauugcagaucugaugagcaggggacacugggcuuguugagaagggcagagcagaucuguugaacagggugccucauugggcagaggggugagguuuccaucacuacaugaggagcugggaaugaggacuugaggaaauuccauagcuuggcucaggaccuuuggagaaaagaugacugagguccccccacccccucucaaccccccagcaggacaucugggguaggagcauccucacagaugcuuguggaaagucaggauuggaaauugcuggaaguucaacccuguggaaagucuaagagggacaagaggaaaggagagucagauguggaaagcuggagaggcuauuucuguguguguguaucugugugugugugugugugugugugugugugugugauuagaaauggaacauugaaaauugcuaauggaaaauagcuguauguugugagcugucuccucuuacugucuccccuacaaugaaaaauuaguacauacaccaguuggacuggaccaauuuugucuggcuugaugaccucaugcuguguugaggcacaggacuaguugguauauaggcauaucucccuuguucuauuuggcacauugauagauggcaucagcagggccaagcauggaaacauuugcugagcuugcucugaugggguuugauggcuguccagggugcagaccacuuguggcauguccuggcaccauaacucaggaagcacccauuaucuuauggucguuauguucaggcauuccuuguuccugaacacuggcaguugguuaauugugguuuugugagauguagcucagcuggccuugaaguuauguugauaguccugccucagccuuucaagggcuggaauuauagugugcuguguauguuguccccagauuggcaguucauauuugugccaucauuuugugaccaguuaacccaauuguuuagcagcucagccuuggcccccuuuugcacaacccaggagacaggcaguucuaucccagcuucgcuuuacuagggcauauccuggagcuugaggggccgagccuacuggaugcucuccuuagggugcucucugaaggaacaaggaggaaaggccauuccagggcugucagagccagauacuaugcauacucagggaggcugaaaacaugcagagaucaggugucauagacaggaccauccuagagcacuuaugcuguggaaaaacgcuucuccucaagagggagaacauucuagagauaagccagcauucucacucaggccucccaagaaagguauaaguugguccagccaguagucuagauucacuggauuauuacggaaccuguacucagugcaggacagugcgcugagaaaucacccuguccuccuguucaagucguucuuuagucuuuucuaauguuucacuggcuuuguuccauugauuugcucuaacaguccugugacgugguuucuguccucauuuccuaagucaggaaaccaauauccagccacucucccacucuggccuuccccagcaucacaguccugcauaucuucuuaucuugaauauccauucaccuagagcagugacacaaagaggugucaccuggguggccuugguugaguuauguauguagucacgaucucaggcaagucacucaucauggcuucuguuucuccacguauaaaaugggugguaacagggucucucucagggaagaguuuggggguuaaaccagauacaauuaggacaggccuaacacaaaccaagggacuuggacagagucucauuaucaucagguuaccaauuuacaagugaccucacagagagagggucaggagcuugcacaugagauggguuaguccuuuuuccaaugggagcuccuuccuugcccuguccuacguaccuagucauaacuauguagguuguuuuuguagcuucccagucuuccuugauuaaccacaagaugggggugagcuggggggaagaaauacccggcugaugcuuauggaguuaauuaagauuuuccuggguuucauuuguucuccugguuagcacgaagauaaauccuccaaauggcugggaggguuucggcugacagugcauugugaauucacauagcauuugcaucuuccuggggaugauaaauguuuagauaacgacaaacaacggggagggggaaagagaaaacugggggaauucagguggggcugaucagauuggccccccuccguggugugaugaaccagcgauaaacggcuuaacugacauaucugaugcccucugcuucccauguaagacugaggaaaguggcuuaguuuuguugucugaugaagccaaugccuuccugaugcuucugugggcugaugugaacccgguucucacauauauaucaaauggcauggugucuggguggacaccaacguccaggauuuuacauguucuacuuuauuggacauucccaaugugccaguguucgauuuaauuuuccuagcaguuccaaaggugaaaaagcuguauaaucgucauccugcaaguguugaaauggaagaugggagggguccaguccccagcuagcacgcacucuaagaugggaucccuucccuggggcuucuggacacaccuuucuccaucaucugcuugcuacccaacaaguguccacguuuaguccguagguggcagguugcugcuuccugcagauucagacaucaagggcccucagaagacacucugacuaccagcaagaggcuggauaccugaagccuguggaagugacagggccuuuucuguuuauagucacugcucucccgcagucucuggaagucauaaaccuaagccagccagugcucaggaggaugacuggaggcugugccuuuuugucugcuaggggacagugaaugcaggugugacaggcagggcugguggaagaggaagcuugcuccuugcucucuaguucagaccguuuuuccuggauuccuagcugauuacauggcgccuccaaugaucagauugaggagaggaagccagaaaguucuggcauuuuccuacuaaauccucaccaguuuaaaucagcacccugucuaguccccccccccccccaccaacccaucccacuugagacagggucucagguaccacaggcuagccucaaacuuaauggacagcagagaaugacucuaagcuucagccucuaucuccugguugcugugaucacaaguuugcaccacauagucugguuuuauuaggugcuaugcaucgaauccaguucuucuggauuuuguacugaguuacuucccagcccagaaggacuucuuuugaaugaucaccucagcgauucuacaugugggguagcccaagccgcagucuuacugaggguguaaacagaaggggagggguguguguguguggggggagagugauagcugaagaaaguacacauuccacacccagccccuuccugacucugguucccuggaacugcaaacaaggagcugauucacauggcuggcuccggggccccccucgcuggaguugagaaccugugccuuccacugacggggaggaaauuccauuucaguuauuccgugcuaugaguugcucggggcauucucuaucuugauuuuuagggcugcgucaucuuuuuggaauucgcaccccccucccaguuuucuuucuuugggugauauaucgaggugaaagcuuaguacaaaucuacagggcacagucauucucuggcaucuagggcuucauguuuuucggaggcuggucuguuaggggcauggaugcaauugccuucuccaucuucccacauccauuucuuaacccuucaugggacuuccgaugggacacucuauuuuggagggcugcaguguguuacaacucuuggaaagacuccuugagguguaguagaagaggccaccaccgucagugucccagugaagaaguaaggaacgcugucucagagguacaccagccucaucaccaaagcugccauccagcagacuguucggcuaguuuccugacucuuccagcugauccccgucuccaccugaucuugguuucacaccugccacagugucuguaaauccccuucuggcuuccuugacagacucagcugcucugccucucagcucacggccacuguguccuuuucuuugagguguccugucucucccaugagacugaacauuuccggggagaagugguagcuuuggauccacugccuauucagagccauuuaucuggggugaguucauguuugccaaagaacucuccagagcccuguuugacacuuuuaaguguauaugaguguguacuagacuacacaggccaucucuuccuuuucuucuuccucucugcggcuguuucugauccagaguaccacugagggaauaaguggcugcugccccuguauucauaggaucauucccaaaaguccuaccuccugcuccucaaauucaaugaaaaagcagccauguaguuaugaagguauuugcagagauguguggguguggggcaugggaugaaggcagagugaaccuaaccuggccauuuguagcuugugcucugguagcauaggagucuagauucuuuauucuccaagcuaauuuaggagauugguucaaggaccauggaggagaugcaggcacaaacaaguucaauaugugcagggaucucuguggggugagggacagcugaucacugaagcacucaguagaugcacacaggaugggaccuuucacuguaguucugagcauggaagacauguuuauaaucugccuuugagauugaagaucgaucuaacucgugcuccauaggaaauucaaggccagcuuggauaaauugacaucuaggcuuagggggaaaaaaacaauaggaaggaaggaaggaaggaaggaaggaaggaagggagggagggagggagggagggagggagggagggagggagggagggagggagggaggaaggaaggaaggaaggaaggaaggaagcugaagaggggcuuuaggggugccuuugugauuccucuuaagggugacacagacagagaccagacaucugaagggguaagauauuaugaaaauuuuugaucaaaaguuguagagagacacacaggaugccuuguguacuuguaggacggggguagccgaguucuuuaaaagcuaacagaacacagaggaacagccaggccucucugagcugugcugaagaggaccuggaggucagauguggggucagaaugcagagcagugugaaauccugaccugaagcauucuucagcaagcugaaaaaaaggcaaauuuccuuccugcguucuguuuauuagucccuuccuuguccccgugccucugcccucccacucaccacccugaggauggucacagggccugugugugacugcuagucuggugcugacccacugacccacacucucuguuccugaugcucuuuucuuuauuuaaaacaaaacgaaacuuaacuuuuuuuuuuguaacuauaguguuauuuugucccucuaguauuuauuucaauaagcagaacaucugguuaauaauuaagaaaaaaacaauccuuaacuaucagucauaucuccucuaacagaaauccaacaggucggaaacucaagaucugagugguggcccggcuguaucugacugugaccuguacccagcaauuccucccugcccuccugccugcuucuucacauccugccugccuucuugaccuccuuuugcaguugaauccuuuaccuauugauaccggccgcccucaccagcgagaucaguucacugagaugauugccugaugggguucauuagcuucgugagaaauaaucauagcugacauuuaucuagugauuauuaacuuggaggcaauugaaauuaaaccucuucuguuauauauaauuuaacuuguauaguaaccgugagagauacaggguuacaauuaauuagccccguuuuuacaaugagaaaacuauaagaacagagaggcuaaguauaguguuugaguuacacagcugaaaaugucugggauuguaacucuaaugccaggcuuuacuccuugggcuucuaacugugguaccaugagugccagaggagguguggcaaugucaacauugguugguugguugacauuuguguggugaaaacccgacaggagucaccggaagagagcuuccuagaauauucagcuaggcuugcuggcaggagauuggagaacagauggggauauggguuuugauuccccggcagcuugucugucccagagccagggucuggaaccuggagcugcugggccuugaaccccaagcuccucuuuguccaguucugaccauccuaauggggguggcgcaggacuuggaacuggcuaauggcuugcucuuccuccucccuaccccccacccccaauuucccuuugaaacuucggguuugugaccauacucuuuauuccuggacugugucagaugccugaaugccgaggcauccgaacugugaacugugcuggggaauucugcacauggaagcuccucaaagaugcagcagcuggugauggcacccacuuccugugcugucucgcuucugucuccucagagugccaucgaggaaaguugagacucccuguccuugcuaggggauggugccguuaguaacaccuagcucuguuggccucaaguuucccuuaucuuaggcuagagaaggacagaaagaauagcuuuaugcccaaucaacuguuucaacugaaccccaccgcagguuaugggugggacaugguuaguggcggauaaagacugggugaggcucauguguggggagguugguggaugaggcaggggcccaggagaacagucuuucagagacagucuuggcuuugaaugcccaaacgaggugagccuuagggccugucuacuucuucaaggggacauuaugcugcagcuugguuggagcccaucguucagugaacagugcagugaggaaguguuuguuuuguuucaagucauguaauaacagcuagguaaauuuccaagcacuucccagguaccugccaagugcuuuguaugugugaacucaugccugacaggaugggugcugucgccuucaccccucuguuacacaaaccgaggggcugaguaaugcacacaagguucacagcaacuagggccagauggcagagcaagauucuaccaguggccuucuaccaagggaacacagcaaugguuguggggguguguguguguggcgauggugguccaucaucuguggcaugcccagaauacuuggcagaaguacccuuaacucuagcuuaggaguuaaguuuuucuuuuguuuguuuguuuugguuuuuugagauaggguuucucuguguagcccuggcuguccuagaacucacucuguagaccagguuggccucgaacucgggaguuaaguuuauugcugguuauuguacaugguggcaugggcuugaucucuaaauaugagaugacuuguauugugucucuuuuguccugguuagauugagaugcgaaccaguucauggucccucacuggucaguguucuuguccaggugacccuagagugggaccugguuuggccugaguguuuuccugacacuuguuaacuaagaacuccacaagggcagugacaauuagccagcaccuucuucuguaccugucuaaccuacugcaccuggccaagguauagguccccaagcggugagucacauggggcaccaugugugaccacuguaagucucaggguggggaagaccccacugucuggguacaggcugcccaucaugggauggauguauucucagugcaaggggcuggaagcuccuaccaagauaaggaauccuccauagcuucuuucugggcagcgucuucuuugcuaagugcauuuccccuuccucugucaauggaggaaaugggaaacacugaacacuugaagucauauggguagggaaccccuagucucccaugcuuuaggaccuccaagggccuuuucucuucugacuugcuucucuuuacucugcuguggaggacccuuugugccucgguuucccccaaacguacacaggggagcaugagaacacucacuuggcuugcuuguugggauuaaauccguuguaucugacuaucccagcaggugcucaguaugcuggaugagcaggaugcuggcaugacugauggcuggcuggugugguccuucuuagcugcucccuggccaaaccaaguuuaaacacuuccgcgcacccugcagagagcagaucuaaauuccaaagccaaaaacuucugugaaaucuccaagucucuuggugaggugugugauccaguccaaagaacugacauuccucgcauucuugguggggaaguugugggccauugcuuguaaaaagagaaggccuccuucauuucaucccuuccucuggauuccaccagguucuuaaaagcacuuugcagaccuauagguaguaccuccucuguguacaagcugcugagccugaguaucucuuuaguucugacuggaauaggcuuuuauuuauccuaucaguccaaaguagcuucuauggcuucuuuacuaugcaacuauaagcuaagcagccuuguuuuggaguccuggauagcagagagggugagaccaaaagcccuaugauucuguagugaguguguuagacaaccuucaauuucaauccuacuugguuuuguaucuuuucacucuuuucugcucauguacauccaucgauccauucaucucucucuacccauccaucaaccucuccacuucucuagccuucaguugacccauccaucugaacacuuacuucauccauuuauccuucuguccaucccacuguuucgucacacuuccaucaauucauguacuauuaaccuuucuacuauucacauaccuacccacuaaguuaucuauuacuucauucaccuauuaguccacuuacccacucacauacucauucaucuauccauccauucaucuaucuaugcacacaucugucuauauacccauacaucccucucaccuacacaguuaccuauaauauauuaaccuaucuauucagucaccuaccuaguccugaauagacagacaggaaaauggacccaggucucaaaagcuuguaguuauaaguaggagguagacacuuggauaaaaggggaagcucaaauguugcaaguaccaugauuuuaaaagggauaggcuguucuaaugaugauaggggaggcuggcagcuucuugagaacacuuuuccaaggauaaagccugcucugccagggcccuaggauagguuugucuuccugucuucuaccucaagaggcccuuuugagccacuggaaucugugcugcaguguucccaguugcuggcuuugcugcagaaaaaagugagaaggaaagaaagagagaaacagaaaggcgggucagccuugcugugcauuuaguuugugguuccagaccuccguuuccuggaucugauuugugugggacgcacgcaauggcagcuagcuacuguguuugcugccacgcugacucuguguggugaugaggucuguccccaaacagaccuccuuucuaucccacuggucagcauuugguggccaagggcagaguggagcccauguuuccaacagcuagccaccucacacagugaagcacuucagugauucugaagguauguuggguuaggcuccucaccccucuccccuacaagagagagcacagacaaaacgggauaucuuuuauuuauuuauuuauuuauuuauuuauuuauuugguauuuucuucauuuacauuuccagugcuaucccaaaagucccccauacccacccacccccacucucccaaaaugggauuucuaaugagcagcucugcuuggcccguggaagcugggaguggaaagcuggaagacugucccagagugggcagucagagaucugacugauggacgcauuggcauuuguguucagcccucaugggcacugcugccuuuugccucugcucucaaagccauccaggauucacccaucuguguugaucggccugggacagcaagagccauugggagucaaccagagccaaugguagacagaagugugcggaugaacuuggaggcuguuuauggaguaggguggcaaagccaagucauggcuugcuuggugcugggguuuugguuggugugggagcauccggaagagccacagagaacggugaugccaguuucucuggcaacuugcugaguaagcagauacucgcucauccucucugauccgcuucguuacucaucagugggaauagcagacucagaaugccaucaguauuuauggccuuuacaauuugcuucaugugcugccggaaggucccuggguccccaagaauuaucuauugcuauuaauaauggaauaauggaguaugacacuagaggauaagacaugaguucuuuaccuggguuuccccuaggacacuugugcacagccagccugccauaccggguuggcagauggccugaugaagagagggcucuugggcuuugccauccguacugcccccgaagcuauuaugagaauggaucgcugugaagagcagugugaguucauuuucaaagugcacguguaacacaaacauugcgugaacucuaaacaccugauuuguucaucugaucccugcagcaguugccuguaacugcccucaugauuuagagcauccuaacuacuuaaggaccaccuaugucggcccgccugcuaccuucuuaauggugcuucuuggggaggugaguggcaaaauccauucgguccuuccugucuuuuuaaacaggcaucacugaaaacagaagauguguagcuuaggcuucuagaaccaaccagaucugauccaucugccuuuuggcaucaucuguuuuugcacuucagguagcacccagcuguugugagcugaauguguccccuugcugcaggcugaagagcugugaggcuccuguguucccuuuuggaauuguuucaagagacagauuugucuuccucucucaugccgccuccuccuccuccuccuccuccuccuccuccuccuccuccuccucuucuucuucuucuucuucuucuucuuuuuucccuuccuguuguauuugauacugaggauugaacccaguaccuuguacacaugcuaggcagauguccaguccuggaagaauagcuugucaucuccagcuccuggaugcuaggaucauagacauacacugcugugcugggccugguguauaugguucucuugaucaaacccaggccuugaacgugcuaagcaagcacucugcuauguaagccacauguaguucaacccacuuugguccuccauauacucucuuuauuugugagauagacccuggcuugguagcucuguccagucuucaaaguggggcccuccuguucccugagggcugggguaaggggcacagcauuguacuaaccugcuuguuuuuaacuugaccuucuugucuacaaauugguuuauggacaguuuucuccuggcuucaggagggagcguggggauagaugggccuuccuuucuuuggaucucuuguuuccuagucugccucaacuugagagccugcauauccuuugagcagaucaccuuugcaaagcaaacugaaugagggcucuggacucugauggucucuguagcugagacaacagaaagaacacuaggcuaggaucccaaggcuggguaccuggcucccaugaccccucagggagcugucuguccucauugcacagccccugucucauggccucucuuggaccaccauccaaaagcccuggccucauggggauuugaccuguucaggagugggagagaacaccucccccccccccccuuacucuucacccuuuggcccuccauuuucaucccaguuucucaucuuuacugcucucaccagcuuguggggauuuccaaauccugugccccuugcuaagugucuacauccaggcagggaucguguuucucccagugacuaaacacagggacauauuuacagauggaggauuaacccccccacccccacccccaauccuuuucucuacuccauacccacagcuuaugcucagguaaccgagacucuauguggguccuuuacauuugggauccugcaagcaugcauggcacagagucuugcgcagggacaccaaguuguugccacgugaaaacaaagcacucauaaacucauugcuaacauccagcccagccacauggaugccguaccgauugccagaccuuguaaacagcugucaguaagagcgugaagagcuagaacgcggaacugaccucuguuuggcucacuccgugcauucagugacacagcaaauccccuuuacaaagcaaaaugaggccaccgucccucuaaggagcugggcugaguagcugcuacacagaagcccaguuucccacauuaaaagauccauuuuguuacuuuaaagaauuacuagcaaguauuaauuauucauagucccccccccccccccccccaagacaggguuucucuguguagcccuggcuguccaggaacuuauucuguaggccaggcuggccucgaacucaaaaauucacccaccucugccucccaagugcugggaucaaaaggcgugugccaucacugcccagcuaauuauucauaguaacagguuucauuaggagguuuuuguacaucuauacuaucaauuuugaucauuucauuccuuuuucccucacccugcuggacccuuuuuagucuacgugaaccuugauuguucuacuguuauuacuguguggugugugugugugaugguaugaauuugcuuuugauugcuuauagacucacgggcaacgaguuaagcuguuaccuagacuuuucugucccaguauguucauuagcuucuuugugucuguuuguuucguuuauaaucccugacugcauuccugcuuucuagagaggugaaugaguuaaugcacaggaaggcuuagaacagugcuuccuggcggauguaugguaaacacucguuaaauguuaacuauugauacuggugugccuggaaugcuagccgccaccagcugauuugugugcuugccaaaaguuaguuguguugguaauuacauauuauauacacagagaaaccggaguuucuuaugagguggucccuggaaaacguaggccuuuggaaaaaguagauaacgcuaauuuguggggacauuguuaccaaauuacucagaagcaagacagcugugaaaaaugaaggcaugguaaagcuauggggagucugcauuccauacguuacagaugacuaagcuuugcuuuacugcaaggaaacggaaaucugguauugcagguauucacgugugaguuuguuuuuuccugggaaagauaauuuguaccuauagucagcggaccagaggaaauugcuucccuuccauugguugauuugcaagcagcucucagacaguguuaagugcugguucuuuucaguaugaucuacauuuguguguguguguguguguguguguguguguguguguguguguggugcagugcuauugagauaagcuuucuuucuguagcccuggcuggccugaaacuagcuccguagaccaggcuggccuggaacucccagagauccaccugccucugggauuaaaggugugugugcaccaucacuacccagcuccagaggugucuauguuuugaaugaaauggcaauggugagguuggguaaaagcuuguuuucuucaagguuggucaacugacagaaacugugugccuugaaugaaccacgacccaguuuuaugggcugggagcagggcuggcaggacguugacucaagcugggguacugguaguguuaugagggauguaaagaaggcaguaguacugucugggggaaccuugcuucugaauguggggaggcagagcacugcucaugagacgaaucacuaaaaugugcagugggcuauggagauaguguaguuauaguagauguuugccuugcaagcauaaggauuugcuucuauccccaggauucauguuuaaaaguugaaaauaaaaaaagaagcuggacacgguguugcaugcuuauaauuccagugaugguaaaaaaaaagaggcaggaagauccuugggacugucuggacagccuacauacuacauacaugucgaauuccagggcacugauagaucauuucuuaagggagugggugguauguugcaccugaaggaaugauugauacccaugguccucuggccuccacacugcacucaaacaaauaggcacaugcacauacugacacguacauacaugcaaauaugcaggcaugugcuuacuaucucuaguggguaguuugugucucaauggcuuagugaucaacgggggagggcccagauuauugugggucaugccaucucugggcugguaguccugggcucuauaagaagguaggcugagcaagcuaugcgauacaagccaguagcaccauuccuuggccucuguuucagcuccugucucuagguuccaguccugcuugaauuccuguccugacuuccuccagugauggacuaugaucuagaaguaagccaacucccccccccccccaauugcuuuugguguuucuuugaagcaauagaaacccugacuaagacacuauccguuuugggacccugaagagcaacugcagagcagccuaaagaacccuuggagggccccaguuagcagcagagcagaaaaggcaacagcuccuagcagaucuagaaggggacuuaacaagagaagaaauuaggaacaggcuugggagaauucugaagacaugagacuugucaugagggaggaagggagggaaggaaguuugcacgcugugaggaacuguguacugagaaaaaccccuacaggcaggaggauggggcagagcuuaauucaugacuuguacauauuuagaguaugucauagaaugcaccucuuucccuccuccccccaacacacgcgcacacacacacacacacacacacacacacacacacacuagggcaaaagacgugggucacuucaggucacagcuagaaacagcuguugauuaguuuuuuuaagagaugagguaucugccccuucccacacuaguccuacauacuauaaauaucugguccuuauuuucacuggugcuuuccuuaggauggcaagaucuuccaccuccaauuccuuuugcucuucuuuacugaggugcuagggguugaacccagagucacauauaauuaaccgguaucucuucuggugaacagcuauacccagccaugcccauccuuugguuucuaugguuuccucugccuagauuccucuuucccaucuugucugcaccucucucuguccuuucuaggcuuuuuccuuuuucucucauuugcuuucucucccuccagccuugucucucuuuccuucuuacuguuuuuuuguuuguuuguuuguucuaaauggagaugggaugggggggggggggcucacaaugugucucaggcuagccuugagcuccugucuuggcuaccugggugcuaggaugaacaaucguguuccagaacaucuggcuuguuucuuugugccaggcaggcuccuuggguagguugagaaguccuugaggaugaagacugugcuugucaccuguguccugcuaacucugcugcucacauuugugcagaaaucggugguggccaggauaggagagguucuauaggguuugcaucuuuauguagcucuggggacccuguuuaucuguauugcugguccuuccugguacaaauaggucugguggggaugccuaacacaacgggggugguuuuuagaugcugggaaagcuguuaccuaacacagcugguggaaugacugacuggucacugcauucuggccacuuugagaggucaccaggccccaaagggcaucauggggucauggaacuguuggaauccuccgcuaccagagcuuuccccuuaguuuugggcaggguuuugaaguuucugggcaagauuuuuuucucacccuaccucaguuguagcuuaguuuguuuuaaucuuaacagauuaagccaacaaaggggaccacugaauggaauugucuaaccuuacucccuggugggagcucuggccuaccuggguauucauugucacugaacccucgggauacuucagaccccaagcugcaguaguuuuugcauguaaacaagucugaauggcauucacauuaaacauuuacauggcccaauuagaauggcucccguaggcucauguauuuacauaguuggucucaguugguggaugccauugggaaggacuaggaagccuuguucgaugagguauuucacuggaaggaggcuuugauguuucaaaagauguguucccuucccaguguggucuuucugccuccugcuugugaaucaaaccuugaggucucagcugcugcugcaaccuccugucuuuauguuuuuacuccacaaucacagacucuagcccucuggaucuguagcccaaugaagcucuuuuauaaguugcuuugguaaugguguucugucacagcaacgaaaaauuaagacagaccauucagauguuucaugacaagggaaacugaggcuagacagguucaugucccagaugaaaaaaaaacacaaagguaggguguagggaaucugggaugacaacugggcagagacacaaagccuggugacucaagcuuggucucugaaacccauguaaagaugaaaagagagacccgagcccacaaagcuggccugacaucuuccugcagacagugcuaugugauaaacauugcacacacucacacacacagcuacacaccaugcaaagacacacaagaauauguuuuuaagaugguggguuauaggcugaccaguugcuucccaguaguucagugcccuuccugagcccuggcaccccugaugcucagaugaaguaggugaguuccaugugugugugugugugugugugugugugugugugugugugugugugugugccuggucugucugucugucugucugucugucugucauugccaugacuacgcucauuguacacauggcuugugagaacuagcuguuggcauagacgcaugagggacucaugucucacccuaccuaguuucaaaaacuguuccugguacaugcagauccaguagcuuuuggugacaaaggcugucuucucuucgcucauagaaacuggggagaauagaggaaauucaggcauccccagagcccuggggcacagugcaaggcaggaagcaacuucugcagaggccugggagaggagacaggccauccugguaacugucaggcacccuggugcaccaggcuccuccuguuguauaaucagaugucaccucagcgauucucagcaucaggcuucccaagaccagauugaacauuaaacaaacagugacugcuuuauaaauauuuaacucccacuguuuaggaauugcuuggggcaggagacaaaauaagaguuccugacugccgcaugacucucuguugugguguuggacagugagggagucagagcuggagcaggggaggcaaagaggcagaaacacagcucccuguguuggggguaugcuuggggacauguguguaugugcucaucaaauuguuuaaaucuaucuagaacuuccgucauauccagcugaaaccugccauugcuguaguccgauaacaguccuuauacccucucccucaccucaugcuuuguucuccuccuagccuucucccaugauggagauugaaccuaaggacuggaaaagcaagacagccccucuaccauauagccacaaccccuuucuucacuuuuacauauagcacuuuuauugagauuuaguucaaacacaccccauucauccauacaauagaaugcuuuuuaucuauucaugaaacuugaaguuguuaacacagucaauucuagaacauuuguaucaaucacagaagaaaccucaccagucuccucuacccacccccagcccccaguuucccagguccuaggaaaccacaagcuugauuccugauacagugcguguaucuguucugaaaaugucauauaaauggggucaugugacagucugccgugacugccuuauuucauuccugcgacucuuuaaagauuucccuguagcaucugucuggcaguucuuuacaacccccccccccccccuuuuuuuauggcuaaaugauguuccauacuugaacaucaccugcuuuuguugaccaugccuuuguaguggacauuuggggacagcaacacucuagcugaaagauuaaaacauggcugacccagcauuaugugacuaaggcaaagcugacuucacaaagaggauccuucaucguguuggucuaggucaugcuuaaggacacauucuuuucaauggguaaauucugagcuuuacucggcacuaacuguaugcugagagaaaccuaauccauucacaauguucuaugguccccugaaagguuacuaucaugcgcugcccugccugagacucacuugcaugggagacuaggagauguccauauccucugcugauggauuuagcucaggagagagguaugaggaggcacagcaucuucccuuccucacccacaggcuacuucucuucucccaugugugcuggugacccucuggaccccggucccccccagcacucacagagaggcaggcugagucuucaggguaggucaagaguuuaugcucccggucaccucagucacacagcugucauucagaguaagccgaagugagggcuugcacuguccugggcagcauacuaugcagagauaccagaagucccagcagucaucucgucuggagauaagccuuguuugggaaguugcauagcauagucauagucauaucugacucaggagcaagaaugcuggcccucuucucuaccuaucccaucccaucccaucccaucccaucccaucccaucccaucccaucccaucccaucccaucccaucccaucccuucccaucccaucccagaaccugucuccaugcucuccagcuucaaacacucugcagacagaccucccuucuuggucuccugaagacucugaagauucuugacugcccguuauuuucacuccugggccagagagagcuuccccagguugcuuuguggcguguuugguuuuguuggguuuugauuuccgucuuuucaggcuaaucagacaucaggaaaagucugcacugagucacagucguggcuauuccccuguuuccucugucccuccccgccuucccucugagcauccuuuccugggccagcaaugaccucaacagcaggaggccuagcugugggcaaaaacgccaccguccuguuauucaguccaggaacugcaugugauaauuucugccuuggacuucccauuaacuggcccacugaggccuccuucucagcacuguugggaagaggcuacaagugagacagucagugacgucaugcagugaucacuggccucugcguagaggcuaggaagauguccugaaggacuccuggauucccucacuggcuuugucagcuggcaacucauccuuuucuggccucacugcuucuguuugcccuggaccuucuuccuggcuuauucauccuuuuucucucugaccugacaaaaggcuucucaaaggcaaugugaaaaugccaccuccucuuugaagcccuccuggguaucugugagugauacugaagcuuuucagcagagcccugaaauggaagagccaugggcuugucuuuacuaugcugcugggcauggguggaggggguggaagaugcuguggagcagaaaaacauguucuagggucagguggggacugucuuaauuaggguuuccauugcugugaugagauacaaugaccaaggcaacucuuauaagaacagcaguuaauuguggcuggcuuauagguucagagguucagcccauuaucgucauggcaggaagcacggcaguaucuaggcaggcauggcacuagaggagaugagaguucuauaucuuguucuagaggcaaacagaagaagacuggcuuccaggcagcuaggagaaaggcccuaaagcccacccccuaaagugccugccucacuuccuccaacaagacuauaccuccuaauagugccacauccuaggccaagcauauucaaaccaccacagggacuuugcaaucaaccaccuucccuugcuugcugaaugaauucaaacaagugacaauuucccuagauguugugaacaaacccucgggcuacuucccauauauaccccagggccuuugcguaugcucaaccaguagcaguuuucuuacugcacgacauaggccaaucuaccagcagaguuuaagcagagagauggguguuaggugauagcugguggguaagggacauccccuucuguagacucuugggucaguuuagugaggauccuuucuccucccauaacugaacugacugguucuuugucuuuugcucuaacccuggugauaucugcuucccuagccugucuucaagaggaaucucauuugaucacuuagcccagcauaccugucaugagugauaguucuuccuggggauugucugcauccugaccccagccuuccccuugaucagaagaaggcauuggaucucauuacagauggcugugagccaccauguaguugcugggaauugaacucaggaccucugggcucuuaaucgcugagccaucccuccagcccugcacugucaaccucacuggauuaaaaaccauuguagaguuaauaaagcagggcuugaaagugucucugaggguguuucagagaggaauaauugggaggauaaaacccacacugaagauaggcaguaccauccuuuagccugugggccuagacuccauagaagccagccagcauauucucucugugugucucucuguccuuuucuuucuucauuggcaugagcugugugcuucauuacaaucuugccacaauggacugaccacaagcagaaaauagcauuuuucccuaauguuaucccagguacuauuucacggcaagaauuaauaaccccucuaaaucuccaaccgugaugaucucaaggaaguccugaucugcuuuccacaagcaacacuaaggcacucucugggucuagauagcugagcuccaaacaaggacagaggguugccaugccccugaacacgggguccucugcucaguuuugagauucaaccauggaaucaucaccaccaucccaccccuaccccucccuuccagugcauguggaugagagggagauaaccaaucauuuccuaccuccaguucaucccugucuaccuacuccacccgccuccugccucgcgccucugagucuggccacguggucugcauccuuugaaaggggacacacugcugcucaucgccugccuggcugugguggcuguggagcagggacugagaauaagcuuguguccgaggcagcccuccaaauacagcauggcuaggcugaccuuuaaauagaugggcuccgagccacucaguuccuggaaguuugaagaaagucagccuuuaaagugaugcgccuugcaaccucaggaaagaucuguguguuugcaaaggcaguaauuuacggcugcuuuugcaauucaugcuauguggcugugcagccgcugggagccaacaugccaguguuaggaggggaaaauccucaaguauuuuaauauaccccugcuugaagcaagauaaacauauguauuguacuuugcgacagaggcguggugaggcgaaggcagaggccuggcaaggcaugaaagguccuuugaagcuaaacugugaggguuuucuuuccuccuuuuuuauuuguaagcaaagcuggcaugggcggaugaugcugggcucuacuuggcuggagagcaacuaguggcucucaagaccagcagacugccccaucccucccuaagccauaaaccaccaaccuccaucuugccucgucccacuagaaaugaugaaacggagguuguuaucacccuugacauagaugaaggacuuucuuccaggaaacuuucuccgucucguaucucacuuugcaaucaugcaaagggaaaagggcuaauaaagguacauaguaugagcuugucauggggaaaugcuuuugacagcucacacggggagccaugcuucgauaaaaagggcugauauagcaagaucaugagagcuaaggcaggaugcuggaauagggccagaaggaaggaguccgcagagauguggggacgggcuccgaaacugaaauccagauagcugugagcuugagcgggaauugacagaugucaguuacacaucagugucugccuuagauuuuaccuugaaguagacuucucccaggguccuugaggugggaaacucauacacagcacacaggagugaugaggcaugaggucagguucucugcuaacaugacacagggaccaaauauuuuguccugcaccuccaacuuucuaaaacucucugaauuuuuuuucccuuugaugaaaccucaaacaaaccuggcuucaauucugauuuuuuuguuuguuuguuuuucuuuuccuuccuuccuuccuuccuuccuuccuuccuuccuuccuuccuuccuuccuucccuccuucccucccucccucccucccucccucccucccucccuaccucccucccucccucccucccucuuucuuucuuucuuucuuucuuucuuucuuucuuucuuucuuucuuucuuucuuucuuucuuucuuucuuucuuucuuucuuucugagacaggguuucuuuguguagcucugacuguccuggaacucccucuguagagcaggcuggccucaaacucaagagaugcaccugccccugccuccccagugcugggauuaaaggcgcacacaagcacugugcggcuucaaugcugauucuucaaaguccauggaggauugaguucagccagagaccuggcuucagcuuuugaaaagaagguguauguguuugcacauguaugugugggcgcugcaaagcuggucugcacgugcggccuuccagagaaucccuuucuuugcagcugauucucucuccucuucuguacuauaucaagggcugcauccacugaauugauuccguuggauuuguagaaucugcucaaugugguaaggggccacucugguucaugcagcaggauugcuguguuucugacuuccugucucucugugcuugcugcuuguggggcauuucgaagaugucucauuucugugagaaggugugcucauuucgaagaugucuugugaacuccagccauuuguuuuccucuccuacacugccagggaccccuggccagacuuuccugcagccuuaggacccugugucuuucugcuuuacuucucugucugugauaggguggcaccguguuuuuuccuuaggacccagauuggcauguauugaaggcauacuuugugcagauggagacugguagucuguccucagagcagcagccuaaccaguguguggcucagcaugaagacaugugagucaguuuccucccuagcauugagccagugagaauccacacccagaccucugccugccacccuaaugcagcucuuguuuacauaggccagaggugccccuucucaugggucugccaauccccaaauacggccacagccagaaagugagagggugccccuuauauaaggcucugugugcugguccccagacaaugccguuuccucgccuggccaugugugacugcauaacaccccuugacucauuuccucuggaaaacucggcagggccacuuugcccugcuuccugcuucugucacacagauuuccuaggaauaccaccucccugugcugcuucgggugucugagaucugaguggcagggaagcugccugagggugccccugagccgucacgaugggcauucuagagaaagagaggagagaugagcagccuugguucaguuaccuugagaauuucaauugaggaaaagacaaaugcaaauguuucucccaagcuuugagcuggaaauucuggacuauugucuuuacgagcucuguaagguuuaaaagucuuuagaugcuuccugaaauuauggggacucccuucuugggagggagaaucuauucuugagggauguggggaaaguuaaagugauuuucaauucauuuuauguuucagagacccuaucucgugucaccuaggcuggccucaaacucacuguguagucgagggauaacugugaaaugauccucccugcuucguauccugagagcugggauuugugggccugcaacauacagacugcuggcuucgugaugguggcuugccagcugcucccuggagaagcagugcugggguaggacugacugacagucacuucuggggcaggcagggcuggaguuuuguucuguuugugcugcuguugcuucugcauaugcugcauaugcugggauccaacugucccuauuuaaauuuucuuuucuucauuuaagucucccccacccccuccccaauaagaaggaaguaagcaggggugccuauuagcucguugauugcauggacagcagcacauucaccugucuucacuguucuucuacagguuaauuugaugccuauucagagaggccagcuagguguaucucugucugucugucucugugucugucugucugucugucuguguaugcauguguacacaugucagucuuuucuauucuagauauucuauucucuauucuaguuauucuauauuucaauuuuucuauucuagauauuucuagacaguaucuguugugugcugaaccccaagguaggcauuuucauucauuucucaguaugaauucagccugcgagugacagauccuguauuucuuguuguaaaggaguaaaugaaguuucaaagagacaaaaugccuugucuccagucaauauagccgggagcuaucagaaucauacacaaguccaucgucuggccuauguagaacauacaaggugaagcaaugauggccuagugacacagagccuccggccgugugaccugggagguacuguaucuugcuaagccucaguuucuuaccuggcaagugugaugaucacaauacuuacuuccuaggauuaaugagaacaaccaucacagccagguccuucacauggaggagggagugaccaaccagcaugugugcuuacaaugcccuaguuuggauaagcuugacccagagcucaacucaccagccaugagauguuucugaacaguguugcugggugccauggccacgaggacauauugugaaaugcgggcaaguggcucuucaggguggugggugcugagugaagagucaagacaagacaagaauuaggaagguugcuuuuuccagauagaaacacuucaggcuaggccucugcucuguucaguuggacacaccccaaugcuccuugcauugggucucacucgcccuggcuucuuuggcugcucugauccugacugguugcucucuggaccuggauuauuguuguaugaacauuacuuucaucccaugugcugggcuuggagacauugcuccuuccucagagacaguccauccucaaagaccagcagggacaguguggguuagcuguguugcugcauccuuuccggccuguugaauuccaucaugcaucugguguacaagcaacaggccacauugggaagggagcuuucccuggaaugggagcguuugcuuccaauucuugcacaggaccaugcuuauugcaucaucuggcuuggcuucaccuuugccgagcuagcgaccacccaaccaguaaucucuucucaggcaccuugcuggccacggauucucuuagugacagagccccugagaaaaggcaucucuguaugcacacugacuuggaccuuuggagaguuugacacagaaaguggcuuucagguagaggaagacauacauguccagcucccaguucccauuguaacuacagauccagccaccucucuacucaauucugucuucuguagccuccucauacaauuaccuuacaucacuugacucaguuccuuuuccuuaagauauuuauccugcuuccauggauacauugcaccugcuugccccaccaauagcagccucaccggcaauucauaagauugcugaccaugucaucuaauuaaaaaaauguauauuagggcauuaucaucuguaauguacagaggccaaacucaaagcucagaaaggaaagguacuuuugauucucacuaagacugagguacgauaugaaucccaguuucuuuauuacccugaaucaugacccuuuaugggcugugucuggcuugcagcugcuugaacaucuguaccugagcccauuaguuucuucuuacccacuucuuguucugguucuucuucuaaggcaccuucauccccucaagacugaagccagcuggacaucaccggcuuuguguccucuacuugugacuucucugaugggaugcucaaggaaugaaaccauauggagaauaaggguguccuuauauagggcagggguagggugaauccaaugaccuguguuggccccuuaugccauuucagaaauaguguaccucagcuuuuucaguucaaacugccagugauggcaguuguagucaccugugagcaaaauuaaaaacagugguuuccacagagggaguguggccuaguaggcuauaggucccagaggaugucccauuuugggguggagcgagccaaauuguauuauaugucuucuugacuacagaugauguuccaugguuucaaaaggcacaacccuaucccuauccacagccccugagcagagcuguuucaguugauaaagggagaugcuccugaguguggacagcuuagggguauaaaggaaagccuuaccuugcaguuauguccugugguuucacaaaugcauauauuugaaagccucuagcaagacagauggcaugaacucaaauugaagaucccguugggguucugacauuuguuuucuucaaguguuuagaggaaaaugacccuuuuaaaaaguggugucauuuguucuggaagcugcaagaccauaaugcgcagaacagaaagauuuaugcuuugcuggacaugaacuaaauuccaacuccauuuuuauugcuuuguccaaggguccuccugugacaggugcauuguuuuguuaggggugaugucaaggaugaagccgugguguugugggauacaggcaugccuuuuacuuuuacagucucuguuguuggaugaggggcuggaggcgauggcuuuccucucucuguaagccaaugguuacugaggcggaaagagcaccucuucagugguacuuucccccaucccacccuuccucauuuaacaaccauuaauaaaggauccucauguguagggaaauaaguuagggcucugugcccugaugagguauggauggagcagagaugcuccguggaagcaaucuguugagauaucagaaggagcagugugugguagauagaauauggucugaagugacuggacaaaggacacauuaaaagccaucucagccaggugcaggauacacuggaacuucaauuccuugagcauugugguccauaaaaucugcauuugguucucaguggcccacaugcccuuuacucuucuagccaauaguauuuucuagagccaucuccugcuccuagaugucaugcuccuaccaucacaaugaugugaugguccuugucuaguuagguggcccgugugaauaagagauggcaggaacaagcuuaagggaacaucugagggguuaugcauuccugcacaccuccgggguccucagagucuagaggggaguggucuccuuuagguaaagugcccuuccuacuggaccccacuccuuuuuuauagucauggucacuauuucaaguauucaaaagaguaauucuguagaugauccccaacuuagaauaguuugcuuucugagugagagauauuauucugccaccaugccuuaugaugguugcuaugaaaauucaguauucagcauuuagaaaaugugaguauucaguccauucaaacauggggaauacucagaauauuuaggucagagcucaugauauauccagcguucaacuucugaccaucccuguuggaacuggucaguaguauacccucagugacuguuugcuguccuuguucucaugaugggaacgauguccuuccgguuuucuggggucccgugucccugcuaaaggauuuaucucuguaacaccaaugcuuauuacuuugguccugugaauguuuauuugagcacucugaccaggcccagcaugccucugacuaauuguggucuccucaagugggugaaugaaucugccaucucuuccccauuaugcucagccugcggccucgugucccagcagcuccaugggcuagcugaaccggucuucccuuguugagcuuugcuuuaaguuauaugucuuguugcuguuauuaaaaaaaccucccaagaaacaaauguaaaggaagaaaagagucauuucuagcucacgguucaagaguacaauccaucaucacaggguagugaugaugaacuugacaggaacuugacagcuggucacgguccauccucaggcacagugagaugagugcuggcgcucacuuuuuguuuuuucgagacagaguuucucuguauagcccuggcuguccuggaacucacucuguagaccaggcuggccucgaacucagaaaucugccugccucugccuccccagugcugggauuaaaggcaugcaccaccacgcccggcucacuuuugcuucuccucuuuagcugucuaggaccccaguccaugugacaguauggccaauauuuaggguaaguuuucucaccucauuuaaccuaauauagauagucugacagaagccucccuccccagugguucuagaucagcuguacaaccagucuuaagcauuacaaaccccuagccuggcccugaacauggguacaaugagacuuuuccucuuggggaaguggguagucuucuuuuuccaaggaucauccuaccuggaggucuuccaucgggccuuugguggaugggcccacaauuggggacagcaucaugacuuuccugucaucucaagucuuagacuccuuccagauuggaggugaucuaagaguccugcauuucagaaaguaaugcuuacuguugcagccauuucucauccuagcguggggccugacucauaguaggccuucaggacucauaguaggccuucaggaauauugcaugaaaggacagauuucucaggcauccugaaucgaguucugguugacuggugaguguagcccuacguucccaguucaguccucaaccugucugugcaguuuuuacuggucuccccgcuaaccagcugugagauacuguuuuuuccuuugaguuucgaugggggagggcaguuguguaacuuaccuacauguuuuaacccgguucuguuugccggagacaaaggauagaaaucaguacaguuugguuccugugagcucacaacugccucuuauuaacauaucauccccauuuacaucuuuguaccuugaaacugaugcuucaccccuuugaccuauaaugguccugaggcuggggaggagccuacuacacagcugcugagcuagaccacugguaguaccgggcucuccugugaauguuaguuccgcagugacugugaaguccccaguaccacagagcugacucauccugccagcuguuuuguuugccguuucagguaucugaaccuccagcuucagcaucuuucaguagaaaacaaaauccauacuucuccauccauccugcuagguauccacuuuuaucuuuugaaauacuggcuguucuaaaacugucaagugugugggugugauuuuauaaguugucauuuuaaauguaauuauuauucuaccuuggcccuuccucccaagguucugaaagaauaaaaugugcuauaugggguuuggagucugaggccggggcauaucucauggaccauccugagaugcauugagaugauauaggccauuccaguccugcguuucagaaaguagugcuuacuuuuggaaccauucccuauccugacucauaguaagucuucaagaauauuucaugaaaggacagauuucucaagcauccugaaucauuucauaggaagaguuucaaccuagcacuugcuucucugugguugagcguuugugagacucugccugugcuagcuguaaaaauagguucuauggagucuaauauaaaucagaaagugauguacugauuuacugagugcuagaaagguuuuccuuguguggccugaggaugaugacgucauaaagacauguggggucugaacuagagugucucagccuccucugguugacauuuuggauaagauaguucuacaauuggcugcccugugcauuaugacaguuuccuucaccuucuuucuacuuaagacaaguggcuccaccaacccuaguuauaacaacucaaaaugauucuagacaucaaucaccaaauguucccuaacugggugcagagagugcagucuccuauucacuagagacagcggugguuuuguggaucucaugucuuucuuaaccuaguggaguugauguggggcccaucuaaagaaaaguuugcauguaacuuaguguauugcuucccuccuuccugugacucuaggagcccuuuauuuuggcucacuguuugagguaccaucuauuauggcagugagaagaacagcuguagcucuggugucuggagguugagguggaugguugcauggcaucuguagucaagaagcagagaggugaauucugguacucaucuggaucucccccccccccaucucucucucucucucucucucucucucucucucuaaaauucagcacuagacaccagucauggcauacugcugcuccuauucaugagggcugguuucaugccuuggguagucuucucugcaaacacccucacagaacaccuaggaaggugacacaaaguccagucaacaaugaagacuaaucaccacgcuugguuggggaauauguuguguuggaagugaaacucgugccuguucuaggaugaacacucuucucuucccagacugugugaccuugaacauuuauucagcuuucuggauggaaagccaucccauguccccagggcucaggguuucggguaaugaaaaauacagauguuaaauauuucaucuuccaccacacucuagaaaaugcuggcucucuguuuuugaguaacagcaucuucaggaaaaugacucgacucuuguaugagauucaguugacauuuucuguuuagccauagagaagagauucagguccugagaucuguaucugucauaaaaccaccuuggcucagagccugagcucagacgauauuuucuacaucuacuacuugcuagccagccugagaucuagucuggauuucacagucucaguguguguguucgucuauaaaaugaggcuaauaaauacacuagcaucacacuguuacuguguuaaggauucagagggagguauuggucucucugggggcguguccacugguccuccuugacucuaaucaauccccuggccaaagccuuuucauuuucacaggacuccagucccauucuggagauucagcguuuaaggaaaacagcuuguugcucuguccccaaugccauggcaguagaagugguggucucagggacagcuggaugccucauugguaaugucagccgggucccuuugaagugguuuuaagaccaauuugguaacuugauuuggaaagugguauugaugacuguuagggcccuggcugcccauuagcugcugccuggguuggcaaauugguuuaaaugggaugaguggggucccuugguccccagggcucuuggcuaagggccagguucuuuguuagggaaaaucuggguaaaaagacaagugaaaagguuuccuggagccugcuucuccccccacccccaaauaugugaauucuguuuuccucuggggggcaaggccaugagcugauaacaccagagaaagaguuagccuggaagagaugggggaggggcaaagaguuggccugaguggaugggggaggggcaagguaguucagaggggaugaauagcgaguauuuuccaaggacgacucaucuguccuccuguuuagagacacgguggugcuuacugaaccccuugcuuccuuuucauuucuucugccucuaucccagccagugcucgugggaugaacuuccugguguuccuuauagaagacaagugucuaagguucuuggggguuuaccuaaggaggacagaugugcugcugccuccgagucugcuaaacacucuccaucacccacauaguacugacgaacuuuucccagaacagucauuccaguuugcauuaguacucaacaugugcagaguguccguguccccccccccccccccacgugccaugcauugucacacaccucuauugggcucaucuugucaguuugauggguaaggugcacaucugguugguuugcuuacugccaguggcuggguguucuaucugugggcacuuacugucugggagaaaggagcccagaggcagccugucuacucagugccuuccugccccaccugcucaugagcacuuacuaugggccaguuauuccauugauuauguuggguaccugauguaucugacauaucccugaugccagagauauagagaacaguauacaaauguggcucugcccugugggggcguagaaucaaagggaaaaaguaguaaguauuuguaagaggaagaagucaaugccugaacaucuugcauucuccugaaugguuuuauguuuguuuguuuuuugguuucucgagacaggguuucucgagacaggguuucucuguauagcccuggcuguccuggaacucacucuguagacaaggcuggccucgaacucagaaauccgccugccucugccucccaagugcugggauuaaaggcgugcgccaccauugcccggcucuccugaauguuuuuaaguggccuugucacucaagguagaaaggaaaccauacuccucuuucuugccuugcucgcugucucuguaggagaagguacugacucacaaggagaggagagagauggggguggggcgggguggggaaugaacacagcacuuuuuagaaaugaagagaagagcucuuguuugguaagcacucaucauguguuaggcccugugggaagagcgcagcccagggccaauccauagugagccucagagguucagaaagcuggccucaguccccauguuucaguggccacuguggcggcugcucuguuuagguaugcaagagcuaggcagagccacacccucccaugcccgugagaagcuucugcagggacagcaggcuccuggccccaugugaacaucaccagcacagagggaaugccaaacaaagggaauuggcaugauugagugacgcacucuccauguuucuucaucccuuccagagagccgaguucugucaccacagacauuggcaguggcacuugcaugccccuggcaagcagucuauccugagguggaggaaguugcccuugaguucuggcugguaaccagcacaggugagguggaaugucugucucaagggaugggagaacccacucacggccaugugcgccugcugacuucucugaggagacauacagaccugucucccauuuggaauaugauucuggaugggccaaagucaagguuuucuuuagaagcaguggugugucaaucaggcgugggagcuucagaggaaggugauggccgcuauauguaauguagucaugccccuuaggauguuaguuggcauccucaccuucgaucucaaaaugugaccgcagucccaaauagggugucuaaaaagguuuuguucaucgaggccucagguaugggcccucagccuaugugacuggugcgagaagcggacacugggauaaagauuucaccaaagaagauagcugaggaacuugggggagguggccacagccaaggcagggagaggggccccagguaaaguggaccuggcugauuccugauuucauguggccuuguaacuugagaacuaggaggaaaugacuuucugucauuuaaagcacccagcccgugauaauuuguuacugcuuguccuaugcgacaaacacaacgacaagugagucccuugccgcuacagccgucuucugagucucagcugugagaggggaccuugcacuauucaugucaggcugugggauucagagugacugcacaggggcuuacuacaggcaaggcccuguucgaagccuuuuaagaagcugaacgcagggcguguuucugugggcccuugugggaggagauucuuccacucuccuuuauugcugagugaguggaugcccugaguuguugaccgacuugccuaauggugcucaucugggaagguguucagcagcaguauaaggaccaggaucguuauagucuuugaagcucucauaccugaccccuaaacuccuucagcuucccaguacuuagacuauaggacauccauugaaggcagaucucugagaugagaucuugagaucuuguacauucuguggugugcguguguauguguguguauguguguguuucauccccccacccccuuguacugucgcugcuccaucagaccccuuuacuucugucuucucucugcagaccucaucuucaauugacauuggcuuccaucccagaacucagccuggcguguagaccugcccuguaauccucacaccucacauagcuaaaucaacaggggauggcuuuugggaaaugacuuguaccuaugaaucuguccuuuccuccccggcucugucuaaucuuucuuuccaugcacaguucccagggcucuggcauucucugccuguuuucagaggcaucucucauuauugaccaaugucagacccuagggaacggagaauagcgcuagcccuggacuuucacagcacuacuuacgggaaaaugcaucacccagaguguuggccagccaaggcaccaacccaagccagcccugcccgggugguuaggugcacuggccgccuuagucacuggccaaagacacuauacuuacucuagccuuagccgaucccaccucucugauggcugaauuccuggaaaagcuuuacgccaugagacauggauuuuccuucuugcuauauaacuggaaccuucauuuacugagugcaugaucagugucagggacuguauugagccuuucugacauagcuugugaguguguguguguguuugcauauuggugcccauuuguguguugauguuagaggucuacauugagaaucuucugcaauccuuuuuuucccuuuuaaagauuuauuuuuaagacuaggcaugguggcucacaccuuuaauuccagcacuccagagagggaggcaggaggcaggaggcaggaggcaggaggcagguggaucuccuuguguucaaggccagcuggucuauauagugaguuauauccaugaaagccagggcuaucuagagagagagagagagagagagagagagagagagagagagagagagagagagagaaagacacguucaaacaaaaguuguuuuugauauuuuaaauuugauguguuuuuaugugcgcuggcauguguguacgaguacagguggccacagaagccaggggcacuggaucuccuggagcuagaguuacaggcaacuguaagcagcacagagauuauagaaaugcacuacuaugccuggcuuuuuaccugugggcugggcaucuaaacucucagguuaucaacgcuuauauggaaaacgcaacugagcugucucuucagcaauccuauguuccagccuuucaucugaugcuccuucuaaccugaucuggucuccuucugacugguugggaugcuaagcucucagcucggaagcaugagagcuaacaggagaaaguacucucaucaauaucaggugucaaauauguccugggguaaugagucaaccugaaauggcaugcuguucuuguuggcccuuuguacacaaggaaagauuaagaccugacucaugggugccauuagcagcaggcuuuauagccacaaagccguagugccuuauggggaagguaagcgugguuuccccaguugggccaaacuuggggccucagacucuuuguaacuguucuacacuaucacugauaaagccuggggcggcacucuccuuaaacaaguuccaggggaccaauagagucaucaugcauacagaaaauuugcuuaaggaacccucuagagaagagcuaauugcaggaggaagaggagauaggcaguuaguaacucaggaagagaggacuaaagauggaucagggcaagacagccaucaaucaacccauaggaucuuggccuggaagaccuucuuccaguuauguucucauaaguucuuaguauacaaauccaccaugaggacuugcccuggguucuagucccuccccaguauacauugucauaggggagcaagcauccucagggucaauggagccaagauggcuccugaccacacugaguaccacggagacaugaucucacuccauugagcaaugaucugggaaucugaacccuaguaggcugaauggggaacuaggacuuccugagagagagagaggaagugucacccauuaugcuucuucuauccucucaugcacuccgaaaucccauauggcucccugcacagaaauguucacaaggguguccuugccauacuaaaaccugguagucacuucagggguagauccgugaaucccggguaggagcccaggguaggucaaggcuuacauaggccuuaggauggugaaaaagacagggguaguucauggagcccuuguacagaacagauaguaagagauuccagcauggccuuggggugagggcugaaaaguuauucucaguaggauaagccaaaaggcauuucaaaauuaaugagcgggucuugcgguauauaauucaaugguauaacauuuaccuagcagacaugaggacccacguucaauaucuaacccugaaccaaacagaugaaauauagguguuuauuagaggaacucggggauaauagcacuggccuuucacaguuacuucccuuaacucugcaugacccccacuugccuccagaagaacacugguuugccuaucuguggucugggaagcccuuuggacugccagguggguccugggcugaucucccaggcucuccuuacucugcuccauuccuuagaaaaauaaaacaaaacaaaacaacaacaacaaugacaaaaaaaaaaacaacaacaaaaaacaaaacaggauucaguuaguguugcugcagcaaauuuauuuaaaaaccaaaccaaaccaaaccaaaccaaacaaguuucaaacaaaaagcauuuccaccugugaugccuggcuuucgagggaucaaagauaaagaaacagauuguaguguaugcuguguaagcagcucagacaagcugcccggccucaguagguccggggagaccacaagccugcaguuucccugucucagcagagaggcaggaaccuguuaaccugucuuagaagcuaauaaaaagaucgcaaugagaucaugucuguuaaagcccuuugaguuccuggagcucccgugcuauaccgcgcuguauuaacagcauccuuacugcuuauucagcaaaaugaucaccuagcuaagaacugaauucuucuuccccuccuuccggucccugguuuccuuaagcguugcaguugaugcuuucuuugcauuuugaaaagcugccuucgaaaaacauuaaguggauaauuauuuuaaaccuucugucuuagagccucauuuugugcugaguccuuugucucuguuaaagacugugaacuucugcuggcagaagucacugacgcucgggcggaggaacccgggaggucacggcugggagcagucaguuguauuugccuccgggucaugccuuuaaguaaucaugcuugcauuuucuagauuauucuuuucggugagcagggcaugucugcauuuucucaaugagcaaagggacggucugccuucgagggacggggcagccagccgauguucugaaaauuucuagugcuggaugacugguggggugucagcagcucagcccacauuucucccaaacucucuccucccucuuucuaaugagaaaauuaaagcuggaacacacaacugcagaccugggacugaaacccaaagcucauucccuuugucuauuaaaaaaaaaaaaaauucugggcauacaucuuaaauccuggcaugugggaggacgaugcagguggaucucuaugaguuugagaccaucuuggucuauauagagaguguagaccagagucuaggaaaagacccuuucucaaaaaauaaaaaauaaaaaaauaaauugcuugauuaaggacuaggaauucuguuguaaaucaauucuacaugcacuucuagauguucucugucuuuuguguauugaaugggauucauacucuggugacaggggucaaagcugcuggccaauacaaucuuagugaucagagaugaagagagaacagggcaaagcuggucaagcagguugccugaaggucuguggacaagauacaaagccugaaacaaugauggucuugaauguucuucggagcuggaagcaagaccaucaaugugugcuacacaaaagcaaaccggaagacuugcccguagggucguacuaaccagcuguuacugucagccuucuacacgggcuuuagaauagucucugagaaucauuccuagaagugagagaugccugggaauguccggauuugaguuacaccaagguuuugcugugaguagugcuggcccagucagacuucacuuauaacugaccugcugcugcuacuccucggccacuaccuuuuccuuuaauuuuuuuuuuaaauuucuuguuuguuuguuuauuuuuauuuguucguggagacagggucuuuuuuuugcaguccugacuguccagaguuugguauguaaaucaggcuggccucaaauguagagauccuccuaucucugcuuccugagugcuggggucaaaggcaugugcuacuguacccaacagcauccaccugcuuccauguuguauugguuuuuucacacucuuccaagugaucugucucacauggguuagcacauagggcuagggcauugaugcugguugugccucuuagguuagcacauagggcuagggcacugaugcucgucaugcccuucagguuagcacauggggauaggacacugauucuggucaugccucucagguuagcacauggggcuagggcacugaugcugguugugccccucagguuagcacauagggcuagggcacugaugcuggcuggucaagccucucuaucucucuucuucauauuguuuguugagcccaagucuugcuacuuagacaggcuggcauccauacuccugcuuccagugcaagagugccaggauuacaauuauacaccacaugccuggcugaggaauaaggauucagagcccuuccuagcacagcgauuuccccaugugacagugacugaguuucucuuuuugguugggacuucagaugucuuagcucaucccuuugcugacaucacccaugggcacaggucgucaguucuccuguuuuauacuuggaauggcuggaauaaauugugugggaauuuaugaugcuuuuagagcuuagcaagaugaggugacauggugcucuguguccuggcuggaacuugugaugucuuugaacaagucuggaucuggagauagcauuuguaaagaggucgugaaagugacaugaaaucauugggauggggccauccagucugaccagcauagggauguuugaacaagagaagacagcacggggguggggguggggguggggguggggggccagugggaggugucaugcacaagcaggccaaggagaaaaagccugcuacagcgcagccucugaugcuuuuucaugguccccccccccaccccccaggccaacaaagacauuuaggcagcaucagugguuaaagucaagauuucuauaggcaauguuuucauuuccauugcaagcgaauccacaaacagcaauaggcuguuagcaauuagguuccacguuacuaagcacauuggccuugggagccucugaaacucugguguggcaucucauagucuuuaucggcacuguuuccauucggcagauguaacaccucgugaagggcaccaaguaucuuggacuagggaucuagguauuucaugcaagaguuaaauuugaagcuggugcucagcuccaaggcugaauuuacucacugucuaucuucuuuuguuacagugggucugggugacugauuucauucauaacaacagcaugccacuaagaauggaaaaagacauccauccaugcccaaaggaagcccugucuuuagcccgcagcuucgggcugagccuuccaaccgcucuucucccaaccuuggaaggaggauccugagcuggacuugugaaggcuguagcuacagcugugacuguagccauggggaucuguucccugcccuuacucaaugccaucaaagcccauguauggaccaguucagugcuagcaucugggcuaccguaggcuuacccugcauaucuuauucugccucccacucagugaaguuggcacagugaggacuccauuaccuccuuguauuuucuguagugaaaggaagacgggccccugcaggucauuugcaaaaugaugaaaaacuggucuacccacacaauggaggcaacugucaguaaaaguuugguucuacuguugauuuuuuucuuuuuuaaagaaugacgugguggugguggcacaugccuuuaaucccagcacuugggaggcagaggcaggcggauuucugaguuccaggucagccuggucuacaaagagaguuccaggacagccagggcuauacagagaaacccugucucgaaaaaccaccaaaaaaaaaagaaagaaagaaaaaggaaugacuuucaugggccccagguguuacaguaaauacuguucuccuccuccuccuccuccuccuccuccuccuccuccuccuccuccuccuccuccuccuccuccuccuccuccuccuucuccuccuccucuuccuccuccucccuaucaccacaaccaccaucacuauucuucccuguagauaucagauaggaucaaggaacuuuuuaaaccacugccagacucuaccuuagaaguuaggacagucucuuagauucagagaugucaaaugacaguuauuugcaaagcuuggcagaaucuacauucuguuccuaagcacugggaagagcaaacagguaccgcuugugauaugaaccccuucucacacuuggguuucaggugugucuucuacaaaucggggcuacccugugucuaguuaccuacagguaacuagauugagaguugggccagugaugugucuaggaguccauagccuauuauucuccuuggugugcaagagugugcagugacuuugcugaggugcugccgugaccggaaguuugcacacacaggugcacucacgcgggcagccuccuacaggcuuucaggaaagugggguguggggcauaacucccaggugcucugcuguuucguguuccucaggcugaaacuucagagcagggcacagcuugugcaaccuuaaggacagaugcauucuuagaucuugacccugguguugaauuuccuggcaccaagauuucagcugacugaucaaagcagaaugucucaaauaggaguggggcacauagaaaccaggguggcuggggacuguauggguguauauggaugugacugaucugagggucaugggagcuguaauucauguuaauauaaucauuuagcacccuuugugcuaacucuagaaagcuuccugcuuucuguuugacuugauccagguuuugggggaggcagcuguuguaaaaacuauguuguacacuggcaagccugaagcuuauucgccugggaaaguaagacacagagccaggaugaacuuagaaccccaaaguacaaaguauacuuggauguuugggaugcugggcauuuguucuucauagcuaaguguuugcagucucccugguggaaauaguaaucugcuaguaggcauggguaccauggagccaagccgaacugggugaguaccaucuuuguaacucacugugaguuggauacuauggaaacagggcaucaucaaucaguugagggcaucagugaauaauccaaggcugucuucauggcaaagaucagaaucuagcauguggccagcguucucauguccuugucacauaugcuuuuaagacugaagguugguaggaguguggugaagugagugugccuagguguuggugucucucugaaggaggaggggaagggaggaggcacacauaaccacagugguuggugauucugcuaauugucuccccaaugcuucccucuaagcguguucaucauuaugaagacacuccugaagcccugcucuagacucugggcauauggcugugaagagaugugggauuugcucuaagagaaagccuugguacuacagaguccucagggaaggaggcagggaguuccacuuuguacucuuccacacacuuguccaguaaugguaggaaggcgaggaccuuugucagcccuuagguuaucuugucaagcuuggcagcacccugcucagcucccagagaagaccccuacugagcuuauucccaggcgaggaauggaucuuuugcugcagugggccucaugcuuaccuccucuuguucacuuuugauggcucccauccuccccaaccagcaugaagggucucuuguauccagcaguuucaccuuuugcagaacaacuuccuggaaaacuuucuccccagcuuuaccacccuacuauuucgcuacaaggaaccauuuuaagcagacauucugcaggccacccucauuuccaucccagcccuaauuacuggaguuuaugaaguugcaggagccauauucucuaaaagguggccuuauuugucucaaggcaucagcugaagaguuguagguagccaagacuccagccuuggaggccaggcuucuguggccuuucuggucuucugccuccuggagggcuguagauaggagacacccuuccuggaaagacaacaguuuagggacacuacagauaaggccaggcggggugugccuggucggcccagaauaaaaggcuuaccaggagaaguuucuuaggaauccaccuuccugagguggguccugacgauaaagaugccuuugaaguuccguuggugagagauaggaucuuugcgggcagagccugucaccagggagccuucuggauggauguccccagauagccagaucagcaggccagagauagagagaaagagcacuuaucuaggagggccucugcaggacuggcuuugagguacuuccuuccugucagcccacuucuggagucuuucuucacucugcagaugcagaaacugaggcagaggucaccuuuuuuuuuuuuuuuuuuaagucccaauaagcauuguccuuguuugcagccacuggagacuucagaaugugguguuacacaucguggacauugaacacauacuaaagccaagcacuguucugcauucagggauuacagaaaccaauuaucacacuuuuucccagagaacauucugggucuucugacuggagagagcuuagaugggcaagcaugccauuccagccaagguucugagugugauucggggaacaggucagcacacagaggagcuugcgguuggacuuaugcugagagagagagguagaagaaggaagguaggaaaaagugagcaaaaaccagacuuugagaggaccucuuaaauucuggcugagcguagagagugcaauggauuuuuaaguagaggaugaguauggcuuuuuacacaccugaggucucugcauuauggaaacaucacugaaaaggaagaaacuggcagugguggaggugaacucgaaggcauagcuuagugguagagcacauagcccugguuugauugccaucccugaagaaacacacaaaugcaggggguugguuggugaggaagggggccaucuagccugggacagacauuggugaauuggaaaccccugauacaagagaauuuucccagaguaucuucagacaucauuaccuuuauccuaggggcugggacacugccugauugagguggccauugagaauucaaguguaccucuuggucccugaugcagaaaugaaguccccagcaugcucaagaagagcuuccuuggaggaugagaggcaugggaaucuaagguaugcugugcuuguucuuggagacuugguagggcaugcaugcuggacugguugcaggcuagauguucuuacagaaggacuguucugcugcugcugacagauguacagacgaaugcagagacagugaagggcucucuacugaauaaaaagccagaccugggccuuuucacagaaggaaauccauccacaauccaggcuguggacuggaaacaaaaguuuagcugccaauggucuuguaaagggggcuggagaaguucagaucuuggaauuaggccuagaaacauuagaauccagaccacggagcuccccagauccugaccucagucccaauauggggcacaaagguguuagaucaacccagagguggaugugugcuucacugcguacauuccacagaaccacaaagugcgcuucuguugaaugaagcagcugccacgaggcucagaaacguucaugggcacccugggaggagcuuaugcuguaaucccaagcuuagauggagguccauccuggguuagggaugacauaguggcagucaucuccucugaagauggaaacaggggauuucaauccucuauaauugcuuucaaugccagcuucaucuaugaagaugggagaugaacugguaguucucaaaugccccaaagccugaaaccaccuuauugaaaaguagacuggaaaagucugccucuccagccaaaaauaaaaaugaaaugugauguguaccuugagguacuaauauucuaaaagggccaaaagcagguucuuaggugguuuuugauaugaccccucuugucaccucuuagccaccacagcacaguggucagcauacaaacaggccuccugauuuauaaauaaaguuuuauuagacuccaaccauacccauucuccucuauuuuuucugugcugauuugucgcuuuaggggcagaguccagucauggcagagagcuugugcccuacagagucagaaagguuucugucccuuaaaggaaaaaaacuggccagucccugcuguaagcugcucuuccgguaccggggcugagcucuucuuugcagaauguggagcauucugcgggccguuucucaguauuuccuugcuucucagagcaugccagugcgagcagggccagcagcaggugagcgagcagcuggcauucacagcggcucuccuugaccucauaggcuaagcuuauccugcauaccucugccaguaggcaacaacccaggcccacgcugcuaggagaggcuuuuccaaauccaucacuuggggauugcuggguaagaguuugcauuggugaucauagagagcaugggacauaucucuucccaucuucccauggaguaucccuagccccugccuggccugauauguaaguuaauuuuauuuuuauuacuauuauuauuacugugacaauauacccaacaaaagccaagggaggguuuauuuuuggcuuacaguuugguucuccguaguggggaaugcacggaggcaggagcaugaaguagcuaaucacauuguauuuguaauucagagagcgaugccuauacuggccuucuauuugcuuuaucaguuucauuuaguucaggauccugaccaauggcaugguucuguucauccuuagagugagucuuccuucuuaaccuuaaacuauuuaaguuacucaacuuaacccagucuagaaacucucucacacagaucuucuggaaauuugucucgaggagacgcuagauucuguuacaugagcaauugauguuagccauuaccccugggauuaaaucgggauuccaauaauacuuuaugacuggaaggaagacucuagaaaaggagauagccaugaccuuucaggguugaaugcuagagcccagcuucuagaacccauggcaggcugcugggugaccuuggacaaggagccugacucucauggcuuugauuuccucauuuggaaaguggggguuaagccuaguccugacaggaccaugagagauacaggcaugacaaugggucacaugcaggaagcauucuugacccauugccagggugcugagaagacaggcuguuacaggcucaggggcauuugccggggacuccugagagacaaagaguaaaaggagaagcaguccuuugauagucuugccaaaggaaauucccagcaggugagaguguugaagauggaauagcaagccuuuccucaccugguccgcucuugagaaagccagccucggcgugcuugucuuccuccacggaacagggagaggcagggugucuccuguggguugucaacagcaccucagcgcugcagaggccccaacaggaccuggaagcugcacacugaagcacgcagggggcaaauuccauucuugucacccccccagcguugguuaggugcucccuuugcccucuguggguaaguuaccuucacuggccugcuuucccauuucagagaaagucacuggacugaacagcaaguaaguagucagggaaccucuugccauuugccaguuacccacagagcccuggcucguuccaaaagcagcuauugaaccauggccuaaacaaauuaagaaggacuccugccuccuguacucuuggcccuggaguuuuggagagaaaucacuuuuauuuuuuaugaguuagaucuucucagcccaauuuaaucagcuuugaaauauaccuauacuaggauacagaccugauaaacagauaccauuaugcagggaagaacuagacgucgguugccccuggaagccacaaggugaaacucuugccuguauaugcccuugcuauacauuauauguacauggucuguaaaaucuuggggggggggguaaucagccugcucaggagaaaagauaccagaagguccccauuuauggguauaaaaacagugcagguuucugagauaaauugaauguggccagaggcacagaauugguugccuaggcauuaggacuagauuuagguuaagugcucaccucugguuugauugucucugccuguauuuuaugcagacagcagucugucgggauucuaugaugggcuggaaucccacuuggaccccaauuugcaggaaccuaaauuuauccaugcucuuaagcaccccacugcagaggcuggucucaguuaccuuucagaaaaaggcuuaauucagguugcugaguuuugaaaucgcaucuagaccucccugugagguguugcacgaacauuugugggaaucaguuagcauccguucauaugcagaucuggguuuuuuucuacucuuaucugaacacuguaggaaggagaggcccggaccucucagagcugaggcuaucagagacuguuggauccaccuguauacugcagggcucaauaagcugacauggcgcugacugcacccacauccacccacaucugcuuucucucccuagagaccauguuccuguaucuguauugaggcuagaggauaacuuaagaguauugucuucaggaaugccaucacuuucuuugaaacagcuucucgaaucggucuggagcucacuaauuauguuagauggguuggccagcgaaccccuaagacuugcuucccugccuuccugggauggagauucugaguguguaccuccaugcccagcaagguugcuuucuucaacuugcccuuugaugcuuucugaguuuguccguuucccauauccugagucguuuuuagggcuuuaggguuucauccaugcuuaauuaucauauauaggcauggagguagagaauuauuugucaucucuuuuucauccaaucauguuuauaucuuaaacuuucaucauuuauauuaaagcaccguacaaugcucauuucuaucagugugucaugguuagugaagcugauuauauuuaaaaccaguuggcauacaagggacuccaguuugcucuuacaccugggguuuuuuuuuuugugugugugugugugugggggggggggggugcggcugugcaccucucugcauguaaguuuucuuggaaaucauuuggacacauucucagcagaagguuuauugagucaaaggccacaguuuaauaacucuugacccauauugccaaauuacuuuaaauaggguuguuuacacugccucaguuaacaggaggacaugccagcuuuaccacccaccaaugucgauuaguauuuuaaaaaaacauguuauuuaauagguacaaaauaaucucuuuuuaauucacauauauuuauucuagggaggaucuauccccccacccccaucuguuuguuuaccaacucucuuugagaaugcugaccuucaccuacaccaacaccugcugcuucuagaagcuacuuuauucuuuuccaugugaaucccuucaagaugacccagggguaguguuggccuaacuucaagugugugaacuucaacauugagccuuugugugaaaaugauguuuuuuuguuuguuuguuuuuuguuuguuuguuuguuuguuuuuuuuguuuuuguuuuuuguuuuuuuguuuuuuuuuuuuuuuuuugacuugcuucagagcuugaaggccaggaccgaaacaacuuauucuuaaccuaugaagccaccaaauuggccccuggccccugggcuuugugacuuugaacuuaacacuuguuucucuuccucucuccugccccagcuuugcuugaugagcaaaacaggauuuuucugaagaaaaaucuuugagauacacccccucaacuauuuuuggguuucuuacuuugugggagggagagagagagagagagagagagagagugagagagagucagagagucauguguuccuguuaagguuuguuuuaaguaugagcaguuguuuaccuuucuagacagcuuucuuugauuuucuucucccugccuaacccacagcauccuguggccuugaggcuucuucagcaccuugucucugcucucugccccaaagcaugcuggagcuccuucaacucucuagcuggagccccuuuugcacaaggaaggccuacaguagcuggaagagcccagcagagaauuucuagaccuuugcugucccaaaggaagagaggaguuugccuggaugcguagccgugcccacagucaccuggguguacgugagcggaaccggaacuucagcugagauuugcaguuucucucuggggcuauugcucccagcccuuuggucccugaguccucucucugacuuccuuauagugcuccugcuucgauuccuccugggcuucagagcgaugcauucguuucgcauuguuugaugcaggguuucauguugaccaaguuggcauuagcuguacucaaggcuuccgauccuucugccccuaccucucuaccacuguguauacuucccaugugagauauauauuauauuccauguggauuccuucaagaugagccaauggcaguguaguauaagugaagaaacuugaacauugagcccgugugugaaaugcugcuuuuuuuuuuuuucuucuaauuaugauggaaaagauguaugaaaaucaagagggacugagggauugcuguauagauaugucugccuguaaacgcaugaccacaucuguuguugcacacucagaccugucuuacacaaacaucuucaaccucauuuuacucugccauuggcaauaaaauagcuuuuauuuaaaaaaauaaauuaaaaacccccaaaacagugaucacaugguaaaccccaaacuggaggcugggugacuccagcgagugacuucuuugggauugauaucuucuuugaugagauucaugguuggcuucuguccuguccugggcugacucauagguugauaguugacccggggucacuugagaucauuuucauauuuaagaacucauuuguauguuuguuucuuuuuuuccuuugucaguauuucccuccucaccccuguguguggauauguguacuggggugucaugaaacuacuuagaggagguucucuguggggcauaagcgaaaacucacaaggaucguuggaaagcaaaauaaaacgaaacaaacccugccaguaaguucuugucuguguugcucaaugccuccuucuccaccucaggacuuguuaaccucacaggaacucugggcuggauuccuccuucagcacagcacaguccugguaugggaguuuaggagauucuguucuuaaggaaguauuacgcgguauucccucucucucugcuauggauuagaccucccacuugacauccucuuugcucuguucagcuggcuuaaggaagaguuaaggacuucuuuuggcuuucgaaaucccgauugccuggagcgugagucuuuuucuggggcuuaggucuugcucuauguagguugaccuguggcuccagcuugcuccccuuuuuccuguugaguguuggcgacauccugguuuucuugagucauuaguaaaguggaggauacccauuucaugcuuucauaaagcccucaacccucugacauaaacuuaggccuuauccaugugacuaacuggcuaaaugaaagauguguugcuaacagugcgcuacgucucuguaguagccucaucacucuggaaucuccagaaaagacuuucugaggauguguggaacccuagggauuuguggcauacacuuggaaagcacaccaggagagaccuguaaccugggaucuugaggacccuagcauccacuuacugcauuauguugaaggcaauccacacagauuguucuauguuuaguuuucauugaaucauuuaaggugcuugagucugugccccauguuccugaaaggccacaaucucagaggcaaacuucacucuguauaccugaugcuacacaggaaggaaguagcgagaacucugccuaaauucugagcuauacugccucccugcgauaugcgucgucugcuaccugauacugacaucaaggucugcccuggacuuugguucuuugaacuguccccccugacugccaccucuggcccuggcauuuggcuagugaggugcucccagcucagggauaugcuauaauaauaagcuaaaggcagcaauggauucuggaacacccuucucguuuagcucuguguaucaccuguuuccuaauugccucaagcaaacaucacccucucucacuguccucaccgaccguugucugcacaagccccaagcucuucucauuucccuuucucgauagcccauguaucucaaguauuauccucagaaaggaggucaguuggacucuaggaucuuaacuaaaggagguccuccaaguguccguaccuuuucaauggggagacugaagcuagggucuggauuuuucccaaggcugguucugcuucuccuauggcuaucuucucagaaugaagaagcuccugguugccuccgaggcucuuucuacuucacgaccauggaagccaaggcacccaaagcaacuguggacugcucaagggguggcuaauuugggaaaucucacaucaguucugaagcucggguugccagcugucaucuccuugauuccaggagcuugagaguuucucaucacuauaggaaugaggauuuagaccauagugauguguugguggccuucugugaccucuccacagggaccgcaggaacaccaugguucacugaucuaguaaugaaggcuauggcuguggaauucuuccacacuuugcauuuuuggacugucgugugaagcauguguccuguucauuggauagcaaaguaaaggccugguuuauuaacccaguguccuuguacaucuuccucgcuccuucuuucaaaucauguaaaucacacaugccuccuccaggaaguuuuucaggaguucuuuaguuguuaucuuugccauuaaauccuacacauuauacaaccaaagguucaccaagcuuugcacacugagugucaaaucacugugguuggucguuuaugcuauagcagguucagcugacuuccuuguucaacaaauauaugauuacauuacauucuguccauccaaucaucaucuaaucacaugaggaacguuuugcuuaugcuauuucaugaauagugugcugggggaacaaagauagaccauguaugacucuaauggccuaggacuuaggcacacacugcaacaaacaugaagaucugaaccuuuuucauagcuccugcucauuagucauaguugugagccuugaaucccauacucuugucgaugcauuguuuccucaucuauagggauguuaccugccuuacuagagcuuuuaugugauaacacagagccuugagaauccaucauuaaaaacaaaacaaaacaaaaacccaaauaaacaaaguaaaaaaacaaacaaaacaaaacaaaaacaaauaaaaaacuacccucguuggccuguaacuuuccaucuaacccaggcuagccugaauuacuaaucgucauaucucaguugccugaaugcugggguuacaggccugggccaccacagaugggucaugagauccugcaucuuacaugcugaauuuuucucugaggcagguaucaguguguagguuaauaagcaggaugcuuacucuggaguacauugggaucaacaauugugaaacgcauggaaggaaucaggauuggaaggagccaucaagcugugaaggugucugagcauagcauagccucagagagagcucugcauagaccacacuagaaugcucuuugagaacuguccugaauugugguggcaugacgguugaucagugacaauguagcuuugccuggaaggauacuugagucugacccuguucagcuaaaguugucuccaaagaagcuggcagcugagugucaguugguuguaccaagcaacuguuuuuaaugauggaugcaugguaccuagcacaaaauaagcaaucaguauuuagggaauguuuucacccaagcacuauucauucagcaagugguuacuauuuggacaauguucuacuacugagcuccuuauacgagucgugcaccauggcuacaaauaggaaguuuauaauaugagguagguucaacacuggcuuccuggaagaguagaccuggagaugugacuuccuggaucaugggcccugggacucgguauuuccuugucuuucuagaagaucauuucuugagaugaggugcgaggugucucaggggugggacucuccaucacggcccaccugauggugcaccugugcaccacgggaaacucccugcuaaacuuacauuaacuguuugaauucccaguagcuuggaacuuccccaggggucccauuggcucugugacuuuccaucacuuaaguaauuggaggauggagccgaauggaaauaaucuauacgcuuucuucugugagucaccaaaaacuacagcccagaguguguguaacugcuugacuuacuuuuccuguaugcaaaugagcugucauuacaguucaguaaguagagacucuacagagugaacaugagaccauuauaguuucuauuugaaaaagacagagauagcuugguacaacugucugccuuggcaagagcccuugguagaaagugcuuuuggguugggaccuuacaacucuuugggaaguguuuguugguacacucuggccccauuuuccagcucuugccuugaccaagacauagcaggaaguagaugaucucuagugugggguagguuguuuuuaucuccacaagucacccaggugaucagagaagcuuuccggaaagcaauggcuuugauguucugggugacaagcugugagugugcggcaggaaaggaggguuuugagguuggagaaaugaaacuacuuuggguggugacuucaucacuugacaccccuaugguaggaagguucuuauaaaagaaaggugaaugcaaggguagguaugaaaaggaaaguuugagguggacaacagugagaugacgggcuucucaugguucagggaaaucuaccggcaccaucgaccuucuaggacccuucuuccucccacacuucaccgaauccucaguuucaccagugaccauguuuacaccuguuaucugcuccauucuucgcacaugauguuacccugaccccaugugugccuacugcucagggagcuuggcuuagaaaccagaguucuugggacaaauagccuuucuccauagaaucauaguggcccucacugaccugagagcaucccgucuuccaguucccaguuuguagaagcuauaccuuccccuaccccuccgagcuucuccucuguggagccccaauguucuguucauggcucuucugagccuuggcuucuuaagcccuaacugggacugauagcagucccugccauucucuuuaggucaccgcugugcagaggaaaggcuucacacacugccugaguugcauuucuugaggguguuuuuccucgauggcuuuuuuuuuuuuuuuuuagcugugcuggggagucaaggauauaugaccucaccaauuagugaucaaaucuuugacacccuuagguguuacccaggauacuaguuuagccauuuggaaccaggugugucuaaccuguggccaauaggccacuugagucuuacgauagcuguuaaugcaguucacuacuuucauagaugacacuaucauaucgcaauagcaaaagguuggacagcucuguaagauuuagcccaucuaucuucugaaaacaggaauaugugcaaggaaugagugacugcugugugccagggaagaaacaugaugcugcgugggacugauuacugcuucgugcucagugcuggcucacacaguaauguguucauuucuuugguguuuuguuguuguuguuguuauugguuuuuauuugcuuguuuuuguuuuuuguuuuuguuuugucccucuuuuguauuuaaaacaaagcaaacaucuuggucuauuuauuucuuuucaagccccuuuucaguaagugucuaagucuccaagugcuugaggcuuaguaacuuauaaagcaaagaugcuuguuuagguuuguguuucugggcuuugggaaguuaguucaugguugggcaacugcaucugccuuacaauauggcagaagucggaaggcggagagggugcagugggaagagauaguagagugagaacagccuugcuuguaacuaccaagcacugggauagcaaacacucaccaugguaagaauuaacccaguucucuaagaaagcuccuuacuaagcaggaggaucaaugagugacagcaguuagacacugagaauaacaaaaugcuuaucaagccccuacugugagcuggggcuguauuguguugacuuccucagcauccaagaagguaaccacggcugcuaucuaucuuugaauacaagucagggucagagaaccgaagagauacuugcuacuuacugggacucucauuuugaccccuggcagccaguguccugagauugucccugaugcuuucaugcuuagccuugauggauuucauagaauucagcaaggaugggagccagguugggccaacccuccuggaaccauccagcuguaucuguauucgaucuuuuucagggccuucuuuggggagagcaaauacccucugacaucacaccugugcucagaaacgucuugguugaacagccagguauuuggcuuuccucagcugcuacaggugccccagucuaccggcccgaucuauuugcaguggucagaugguguuuggauggauuccugagaaauccauccauggucacuuauuuucuagcaggcucauuguuuccugcucaguguguaagaucugcuacccauggcugacugaucguggcaacaucugugcggccauuuggccucacgguccgaguaaacaaccagcugccccagaugaggaagcuaaauuacugagaacagaacuggugagccucuguugugauggauugugucucccaucuccauccuuuaaugauggacccccugccuuacccaggcacugcuuaucuuuguugaagcuccuuugccauuguauauuccccccccaccccccccuugcugcaaagaagauuacauggcccuaccuuuggccuuaugauguggagaagaggaugagggaccugagcauacuuggaauucugcugcagauaccaaagccaaagggcuaaggagugggcuuccaaucagccuucuugucucuuaauucuuaaggaucuuggguggccuggaucugccugucacagauacugaguccuuuguuuugccuagucacagaaaguaugacauaaacuuugggucccagcaguugacauuuugcgaugccuaaaggccuuuagcagacccaugguuugcuuggccaugucagaugucagggagcaagcuacuguccuauucuuggggacaguguuggcagugauaugacaagggaaccugagcagcagcaucugcagcaggcugacccccucccuacccucuuccuucugcuggguugccugagggacuucugaacagauauccucaaaguggacagaugaguccugucacccugugugcacaugucucuuaucccuagcucaucucuguggaaggguaggaaucugugacucuacaaguucuaugugugacaguaagauugagacuuuucuacucuucacugagccccugggacuccccuccccccaugcucuuggaagaaacuuagaaacuuuaauuuccuaauuuucauagaacaucacuccuuauguaugaucaaaaacaucaauuaaaaacacucaacaguuugacugccuugggaagagguccuuguguuuuuuuuccucugucaggagcuaguauguggucuuuacuguguccuugcccuucuccuauugccaaggagacagagagccaacuuagaaaccaacaacucagccauacugauuuauuguucacuguuggauggcuuccuucaaaugucucauuuggucuugcuauugcauauugcugccaccuacccauuccacagaugagcaaacuaagccuguguacucuccuccauggguaaugugaugcaguaagaagggggccgaccuuugggguuuuaaaauccuguuaggagucaaugaagaagucuaaagcuuguaguagcugacaugucuaagugcuuugaacucugcuaagacucacuuuauacccagaauacugcugaaaaaaagacagagacucagagagcugaaauuuuugaugaggugccuccagagaagggacuugcagaucgguaauggugggcugcccucugaggggucugauaagaagagcucaccaacauccaggaagcuaugcgcucggccuuuuagggucacaaagugauugcagugugacacucagacuagaagugcuuuccugguauaaauggcagugauguguggguggccacuugcugaguacagaggugcuggggacaggagggcaucuuucugaguccaccacuagucagcaggacuuucuggggaggggaauucaccugcaucugcugggaacugaauucugggcacuggcugugucgaggcggacauccacucagccuugcaggguuuugguacaagcacauucagaaaacuaugacaacagaccccagauaaggaaauuauggcuaggguauaucugaacuacgagggggaauucaguaggagggauauauacuaugagccaugugcccucuucucccagcuccgugacaaggacaguuagccaacugcuccuaguuuaagggcaacuucuccauggaauguucaaguggcuuuuaugcugagucagcgccaacuaagcuugaucuuauuaguguccugacugccgauacccugggugguuugcaggggagggggguaggaaagaggucuacagggaagggaacauggaauuguauaauguggcugucuccagguaccacacugucguaucaaucucccgguuauggcaggagaagucauguaugaguccaacaagaccuacuuggcacuuugcacccagcuaaaacaguccucccuuggcucaugggaccuaacacuugaauuccucauucuuuacacuacuccuucucuuccagccaccuccugaagcuguugcaaugaucacugaggauuagagucgccguagagacuauggugugugugugugugugugugugugugugugugugugugugucugucugucugucuguucccugcacaguucaccaugccuacagugagugguaaacuuugcuaacacuuaggcuaaguuuaucccauucagcuucuguggccuacaccacuccacuguguguacauaaugggcuaggccaggaacacaaggcuguuaucagaauggagauagguuucuuauucuucagcaccuagaauucuugcaaugagacgaauggaaauaccagugaggaagggaacaugauuggugacggguggggacauggcacucaguaagaccaacuaucagcugugcccuucuuguuugugugacuuaggaacacaaagagaucaaaacaggaauacaaugucuaauaugaagcuuagcacauaagaauugcucaacaacaauuacauuuuuuuuaaagggggguucuacaaaauugcuuaguggguaaagacaccuauugcuaagccugaugaccggaguuugguucccagaacuuacaugguggaaggagagaccugacuccagcaaaaaucugucuucugacuuccacacaaggguguucccacacucauaugugcucaaguaaaaauggaaaagagaaaaaaggagaauuauucaauaaaugcccauuuucccugcauuucuauuguguuguucuuuucggacugagucuuggugugugguacuggcuggauacaauauguggccuaggcuagccuggaaguccuucuaacuuuucuccuaaggauaggauuacaggcucuugcuacccuacuuggucuccucuccucuccucuccucuccucuccucuccucuccucuccucuccucuccucuccucuccucuccucuccucuccucuccucuccucuccuccccuccccuccccuccccuccccuccccuccccuccccuccccuccccuccccucccuucccuccccccucuuuuuuuuucuuaaagaaacuuuguuuauuugaucaaucaaccuauuuuguguguguauauaucuguuuugauacuuguaggcauagacauggaagucagagaauaacgcauuagaguuagcucuuuucuucuaccaugugguuugugugacugcacucaaguugucuggcuuggcaacaagugucuuuaccacugaggcauuuugccaucuguuuguuuuuaguuuuuaaaugaauaaaauauccccuuccccaagccauucuguacugauacuaauaagccucucucuuuuucuugcauuuucuaguauacccuuuaagcguuccagaaggauuuugagauccuuuccuaaaucaaagguggaauauuuggggauuuggaaaauugagguaaguaagggcuggucucauuucgagccuuuuggaaacaaaauuuagcuuugagaaugaaaauuuagcuuuagucuuuguagcaggauuugggguacguuuuaguguguguguguguguguguguguguguguguguguguguguguuuaauaggcuuucuuguguuuaggaaucugauuuccuagucaucuauaucuuggcuuucuuucucagcauuuuuuuccccacuugcuugacuguaaugcuaacaugcucucucugcuccaaccuggagaagccagucucucagaagaaccaguuguguuacuuugcugugagaugccugcccuaagagaggagcagaaggucggaacggguccucuaaugugauaauuaggugagaacacauuugggacacaugggcugugagauguuccuuuaugccuaguacagucuguguuuucuccucacccuccauuacauguuggaagcaugcuaagaccauggcuccucugguggggguaagaagugaagcccaaggucuuucuucaaaccuaggcuuuccuguuguaccugucuuuccuccagugagucuugcugaaccuagagugugaccugguggagcuagguuucuuucuccuugggugcggguggguauugaaugaaagagcagagauagaaagaggaguuguccaucugauuugcugcugaacagggcuuucucuugauuacugccuuacaauagaucaaugggagucuguagggugccuuuuauauggcaggcuauucaaaagauuuggucugaucuuggcuaggccuuuucccuagcagcaagucccuuggggaaauaguuugugaaucuccaaucuugagcagaacugacugcucccugaacuguaccgcagcuggaauggacugucacacuguggcuucuauaguuggguauaacuucugucucucuggccacuccccaucaucagaaagcuauaucagaguuaaaguagucuuacuuuccccacugcuuacagaguaccaugccugguccagggccagucuucucaauggauguggaaauuugaacuggugaaugacucucauggcagcaggcauggggugggguagacauucauauauucuuagcauuguauuagccuuuuuuuguccauagucccugcugacuuguucccagaugggaaaagggcagaggguguccagccaucagggcagagaaacugagagccgaggagcugcccuguguugcuaugacaguagaaaugagccucaugacuugccuucuguaaacugaggagaggccuggccaauccucuccugcugcugaaagucgaggaauguuuuuagaauucgguugcuacacgcaguagccagagcagcuccugagguucuaaggcucacaguccuggagcagaggugugcucuauauaagcuccacauuagcacuuacccaugcgguuguguuuguguaaaaaauacugcugcaauaccaggagccugucuguccauccccugccuuuacuaguaggacagcuauccuuuucuacccuuuugugccccacucaaucguuccuuucucaccugcuaaauaaaccacugcccacuuggguacagacagccacaaggaugaccaaacccggcagggugaaauagcuggaaauggggaggcuuauucuuuccgacucuuucugaucucuagccugucuccuggccuucucaauauuguucuugcuuaucccggaaccacuucagacauucaacaggaggaguucaucccguucugguuggagcuuuggaugaacauguacauuccuuaaaaguucaggaguuggaauaucaagucugugauauacaguaugagagacagcuagacuucccucaugucaugagaagcuuucaugaauagcuauccugccccuuuaaaauacaguggguuaucuuugaugccucuugauucgccccaucuuuuccuuacggauacacucauuucccuuccugcccuaagauacuccccagaagcuuacuagauaaaguuaccuggucuugugcuuccuagugucuagaaccaugagcuaaaaugaaucccuuuuauuaauaagcuaucauaacuaaggguguuauauagaaaguagaccaaagauaccgauagcauauauguguugacucucccccuuucccuuuuggguuccucccuagcgucucuuuccaugucuguuauucuuaguucuuugccugacugugcccuuccuggccuccauuggcuuuaaugauagggcaucugugggcuucugcuuuccugccuauagacacaagccagcacuacucauuagccacaagguacauguugaaagguuguuuccgguugucaguuuucacaguaguaacuguggcucauuguacucucccugugacagcaacgucuuuucaaaccaccuccaauauuggcccauuugucuauuacgguuucuugugguuucauaccgagguuuuaguacagugccuuugaccuagaguguauuuuuagugcuaaaggcggagcucaaugaaugucaaaucaugaaagcaaaugaagaggagggauuuguacaucuagggggggggggaaugugccuaauugugucuuuucugaugacgucugucucugaugaugcccggucacaugcuuucuuugugaugaccaucgugauggguuccguagaggugggagcagcagcuaaagucaagagcauuugugaguaugacucuagcagcuggacacacagagaaaugugcaucccagcuauaacuaaaucaagaaaggccuggcuguggaauucacagggguccuuacuggauucacaggcuuugauauaccuugaagaagugacacuuuuuuccccccuuggcucucagccuuucuuccaggcuaauucauauuuacuuagauggcucuagauauucucucacuaaccugaaccuuuggcaucaacacaggcuuaaaggacauacuuagggucucuagugucaauugaauggcagcauccugacuuuggucuucaaagcaaagaugacacugaagucugccccuuccaaacaagggcuacccugccugcuuccagaagcaaagcacgccuuaccaucugcuuaggacuucacaguucauaaaguucuuuccaucccgucugcuuucuuuuuauugcacaaguguuuacuuuuuauugcucaguauuuacugagauaccgcaggaugccacugugcagggcgccugcgguccuugaggaagagcuguuguucccaugccuaggcaauucagaaggccauggcuggaaucugggggcaauugcauagccugaaaucaggcugcuagcuguaguggcuuucccaagagaacacggggcuucuguuucuggaccugucugaugaggacacccuuuccugucuccugccuucuucuccagcaggguucccccuccuuuccuauucccccacgucuucucauccccuucccgucuccacuuacccccuccuaccagcucauuucuucugaagaugagccggauucuuucuacaguacuuuugugggaugugaaucugacuaugcagagcugggccugggauuuguguaacuucccuugagagcauagccuuagcucuuauucuguuauucauuauuuguaaugaaugcaggaugcuccagugcccuccuuguccucaacucuucugugucaagucaggugcuauagcagguugagguucuagcuauauauaagcuacuaucucuaucauuaaaauauuucagguuguugguggcacaugccuuuaaucucagcauuuaggaggcagaggaaaaaggaucucuugaguuugagacuagccuggcuggucuacagagugaguuucaggacagcuacagccacacagaaaaaccuugucuuggggguugggguggggaaucuagauauauuagucaggauugucuugaacgauagagccaaugugcaaugaaagauagacauguaucucaauaucugugucuauauggagaaggauuuauuuuucauaaggcauugacagagauuaucauggagcuugugaaguucugauggucugcuguguauaccuggaaacuagagaagcuggcugugugcauagacagaauuaugaaagagugucucagcgcaagugcccaggcagagaaagaaugaacuugcuucuccugcuuccuuauucagcuuucuaggcauccuugaguucugauccucagugggcuggaugauguucacccauacugauguaagcuacucaccacacucacucacuuucccucccuucucuggaaacaccaucaucaauccuccuuagaaauguccuuaacugguucccuuuguagcucuuggcccagccaaauugacacacugaguagacacaauguaucuaaccaucaauugagacacuggggagacacaauguauucaauugucugaaucagcuggcugacauccaccucaggccacaagcugaacgcacuuagacugcugagggcacaaaagcacuccuuuccaauccaaguuuugcaacaagguagaccaaaucgagucaucauaaguuauuguccuuaucuggcuaugccccugcuuugauguuuacccaauacagaacccccacugauugaugauauuugcuuccucaucacuacaacuuggccuguaaugagcacugcuguuuuuacagcaucaggcugcuaggacuauguauagagagagagcuuuggcuuugcucuggucuuauaccuugugacccauugaacaccucacuuucaagaccugauggggauucaucuaggacucugguccuuccuucagauguguguauguuguaucagucccucagucccuucuccugaauccugcuaggagaccucacagcacaguauucuaucugcuaaaggaguugcuuuccuucaaugaugcuguagugaugcugcuggaggaguagcugguucuaguaauguugguguugaggaagauaauaauaauacuggggacauugcuuuugaauuaggggacuagcucaaguauauuauuuuucauaucucaucucaucucaucucaucucaucucaucucaucucaucucaucucaucucaucuucuuuccucuccauacuuauguugccuauucaggaauauuuuggcuauuguaccuguggauauucauuacaaaggaggcaguggcucaaaugaagccaaagagccuggcucugaaggacugauggccagguggccagacauagguauucaaaagaagauuugaggcuucuguuuaccucuucgcugauggugccacugcugaaguaguacuucuuuacccuggcagcauugucucagugacagcugugucuuguccacggggccucugugucccaugcucuucacaagcuucaucuccauccucucaggcaugcugcccagaagggcccugggcuccucaguucugcaccuacuacuuugcuucuucccauuccgaggugguguauuugccucaguugcugcuccuccuaucccaccauucccuuucuuacucucucucagguuuaauucuugucuuguccuuucucaccauucuaagauagcccugugacgcuucccuugaugagcccuaaugagacucuguagcaccaaucucuccuuuccuguagucacacgagcuggaauccagauuccacuuugucauuuggagacucagaguauugccacacacaccccucagcgccacccccccccccauaacucccugcagcccccacuuucuccacggcaccuacucccccuugcagcuugugccgggaagcccuguuuccuagcugcagccuauuauguuccagucgacaggccggggggggggggugucaccgacagcccccagagccugcugcacaugguguuaaguaaggcuuuggguuuuccaugacauuggucgguccccagggugggcaggguucaugugucugcaggaguaugugagggcauagacuggaaauagccuugucaaaauagaccaagggcaaaugcugagaggggaaaugaggcugaccuggggcggagcauagggcaggugcuucuccaggggcuuuccucugugaggggcccuguagcuaaaggcugccugaaauacuuccugugacccucuagaccuacaugaggcccccaucagacacaagagcuuccuguucccucuucacuuuccaauacuuacagagcaagaaggguuuacucaguucuucuuucuuucucuuguccccucagcuccugucuuagugcauuuggccugcucuaaggaagugggacucuaggcuguguggcuguggaacaacagggguugauuucuccugguucuggaggcuaggcauccccgacugugugccaccgacgucauuaguguguggcaagggccugcuuuuugacucaugguccccugucuuccaggucuaaccugggggaugagguaaggcugcuugcuggcaugucuuuucuaaggaugcuuauuguaguuccuggguucuguucgcaugacauuucucaucaccuuggagguuagggauucaacauaggaauuuuaugagggcauaaacagcccauaauagccuccuugaaauaucucuugagugcacucuccuuccucaucaggcaugucaacaaaauuucaugucacuguaaagcagaaauaauuguacuuucuauaguucauauugugacuugggcuucuucuucaauaugcucaaacugaugaccaguugcaugccaaacucacuuuugccggugugguaaaguuugucuccauggcuucuuacuuagcuucagccuuucuguauuccaugaagugaggagauucauugguggugugugucaauuaguuuuuuugcugcugugauaaaacaccaugacaaacuuguagccaucauccagagaagucaggguaggaaccuggagguaggaacugaugcagaggccaucgaggagugcugcuuacuccuccuggaucacacagccugcuuucucaacaguagguaggaccaacagccuagguggcaccacccacagugagcugggccuuccacaucaaucaucaaucaagaaaaauagcacaaaacccuuucccgaaggccaaucugcuggaggcauuuucucaguugagauucccucuucccaaaugacugcauaaaacuugugucauguugacaugaaacuagccagcacagggugucuguuaguuuuucggggcuacuaaacaaucugaaacacgcuagauugcucaaauccucugggaugcauuccgguagcuguggaggcagcaaagcugauauggugaugccccuacaauccaggggauccaugggaagagccugcccuuuuuccaugggcuuuuaaugacuacuggacgcucuaggcauuucucagcuugcaggacgcuucucuagcuguucucccauggcuuacuuauaggcuuauauauuuauauauaggcucccauggccuaugccuauaacuuucuucuuauauggaucagcuuccauguacguauguaucucaaauacuauacugugauagugucuguagaacccagguccaagucacaucuuauuugcaaguacugcaggauacaauaggguaugagaaugaaauguuaacucgggaugagauacacaggucaucccagcucuugggaagcaggagagggaugaucagagguucaggacuaccuucaauuacauugugaguuuaaggcuagccugggcugccagagacuuugccucaacaacucuaccuuuacgagagaaaagaaaaaacaagcucuauggcuucucucucucucuaaguaaaguaucuuugguuuuauauuugcaaugauguggacaaucauauugucuuaguguucuaugaagagaugucaugaacaagguauucuuaaguuucagacguuagcccaugauuauggugacaccaaaaacaacaacaacaacaacaaaaacggacaagguucuggagaaggaacugagagucuuauauucugaucugcacgcagcagaagagggagauacugggucugucuugggcuuuugaaaccucaaagcccaccuccaaugaaacaccccuacaauaagaccacaucugcuaaucuaaauccccaaguagugguauucccugaggacuaagcauuugaauaugagccuacaggggccauuuucauucaaagaagcaugcauauguauaaagaaaagcaaauaccugcauagauuuggcaccugucagagaagagguaaauucaaagcagaaaaagcaaccuaggcucuggucugguuuauggagacacucuguuuuggccuccgcucauugcaaugacaaauuauuauccuuggcuucaggguaaaauuuucucagaguuacggauaccgagaaguucaaggacaaaguauuaacaguucauuuucuggugauggugucugcuucggucauggaugucugucuucuuuugucaucacaguggggucaaggguucagugugagagcaucuaauguuucucauucuccuuuaacaaagaaauaaauauuuauguuccaugugugcaugugugucaggguguaugggagcauauaugggggucagaacacaacuuguaggacuuggauuuuuccaacuaccauguagauuccuggaaacucaggucuucaggcuagauagaccacaagcuccauuucccagaaaaccgucucaccagccccauccaaugucucuucuuaugggaaacuuaugaguucagaucucugccaaugcaugagguauuauguguucuuccuaacuucuaucaauaccucuucuccaauauagucucauggaaaugguggaccagagcugauaggaugcgcaagcacacgcacgcacgugugagcacacacacacacacacacacacacacacacacacccucacuuauuagaaugacuuauagguugugguccugucuuaugacagaaaguccaagaacccaauaguuagguuacuuagauacucucacacugcccucaugcucacuggcaaguucauccguccuggagcugaggcauccuucacugauauuaaagccuaccucuucaggauuccaacauacauugaauaguucaguagaccagcuugaucccuuaguuggucuucgguuguaauccugaagaaguuaaaaaaaaaaaaaagugccacuuauuuguuagagcaugggcuuauagauucuugcuacauuggucacaauccaugaauaaaaccacauuguuacccagauuuuucuuggucauuaguacaaucaugaaguuggcuucuauagcccauggcuugcucuuucaucgguguuuugagcucugccuuuuauuuugguccaguaucacagcaugcucugccugccugccccagcucuggauuaagccaagacuucugugauauucuuacauucccccaacuaaauaagaaauaauucuaagaccaacccaaauugagagacauucuaccuaaucacgcuucugaagacaaagaaugauugaggaaugaguucauacuaaggaggcuggggagauggcucagucagugaaaugccuuucucauaugcaugaagacugaaguucaaucccuugaucccaugugaaaaggcugggugugguggcacacgucugcagacccaaugaugucaggaugggaggugguagaucccuaguauuuuucuagcuggacuagacuucuaugagagacccuaucucaaccaaaaugaggggaggcauguuagguugaagaugaaggaugcuguguuaucuucacauauguagacacacagacuuguugcuacaugcauauauccuucccacacacagaagaguaaccagggaccaaaacgugaugacauaggcuugaaauccuggcacuuagaaggucaaagcagagggauugccguggguuuauaagcuaggcuacauagacuagguuauagugcauuauacuggcuucaaacuaaacaauaaaaaaaauaacaaaaccaaauuaagggucuuaucagcuaaauauagcuugugacuugggucagggccuguauuugaaaaagucauuauuggagaauuuaaaugaagacuccuaauuagcaaguagaacuaauuugcacauaaaauuuaauaauuguacagugauaauaguauaaauaagauaccaaaauuuaaaaggccuuaggcuauauaggaguucucuguacauuuuaacuuauuuucuuauauuuuugguugugagccuagccuuuaacggcugagccaucucuccagcccuuaacuuauuuucuaaguaugacauuguuucagacugaaaaauaaauagaaauuacaaacacaguaagcucuguguauguuugcagguauauguaucuuuuucauccacugauugagaaagauagauuguaguacuguuugucuuuuuuuuuguuguuguuguuguuggcuuuuuguuguuguuguugguuuuuuugagacaggguuucucuguguagccuuggcuguccuggaacucucucuguagaccaggcuggccucuaaacucagaaaucagcuugccucugccucccaaaugcugggauuaaagacuugcgccaccacgcccagcaguacuguuugucuugaauuggccucucuuuuauagaaaugaaacagguccauauagcacauauucauguuuaucuacacauggagaaauucuaagaaaagcauucguuuccucuuaacacacauuucugggaagagugcuuggaagguacgaggcaauuuacuuuuugauauguucuaaaaugagcagugcuuggauuuauggaaccaucagcaucuggguuacauguguguauacacauguacguauguauguauguauguacguaccccucucuuacccagauauguuuuucuguauacacuuacaguacaaacaugcuuacuagagggauucucauaucuuuugguuccauugacuauauccucacaucugacccuuccucagguauuuuuauacagaggcaaugggcaauccgugcuaguucagggaugccagcucuuuuucuguuucucagaagccucacaauuguuagacuuuacaaacuuuguuccuaacucgguaucauuucggucucccccagagaagugaauaagcuauaauuugcugugcuaaggaacuaugacucauuccgggcuuuggaucucaagcccaaaaauuagugaaugguugugguucaacucaggauuuaaaaaaguuauuauguuuuuagguacucugugugugugugugugugugugugugcgugugcgugugcgugugugcgugcgugugcgugugcgugugugugcauguguguauguguguguguguauguguguguguguguguguguguguguguguguuuggggugugcaaacagguagcuguucguagcacaguugaaguggaugucauuugucaucauuucucaccuuacacccuguuuuuaaggucaggucucuccuguuauuucugccacugagcuguuaugcaaacuuccauucuuccguuucagccucaaucucuccuugacugugcuugggcuaggacugcagaccagaaucauugcagaaagucuuuaaaacacgggguugaacucagguugugcaucaaagcccuuuuaccuccgagccaccucaccaguucgagccucucaagauguuuaaagaccgugacaccaugagacuagaguuuuugcaaaaauuugcuuuccuuuuguguguguggcagguucuuauugguagcccugacuggccuaggaucugauguguauaucaagguagccuugaacuugaagcucuccucagggaguccagcagucacuguacuaugucuuuuaggugaguucauuuuauagacaagcuaguuuuauaaagaaaggagugugaguagaagcaaugucucuggaaugagggguuucuucaagcugugaacuauugcagagauugaccauuguacccuccugcuacuaugugacauucuuuccuuuauagaugugcuugacaaagaccucaugagcuucccgcuuuggauggucauugaguuaauuaccgaaagagcucucgccuguucuuccaggucuuugccccucuuagguucauguucuucucuagaauagucucugccauuccucucaguguuccaggaugucugucaccugcacaguuccuaguucacaguuccugugaauucuguuucagcuuucugggaucuuccuugcauggucucuccagugaucagacugugaggagugacucuacaggugguuauaaugguagcucaggaauuuaugaaucuaguacagacuguauuucaggaaugcacauucacugugccauugcuucuuccaaugagucuuugaugacuggggcucacugugggcugggcccuaacguucccaguagacuucacuaggaagcagaaaguaagauggggcuucacucuucuuucaaguauucacuuggguguuuaaguucucccaguaguuguuugcaaaguggcaaacucuaacugacacacuauuaucccccagaauuaauggcaguauguccccagacauuaccaauagauguuugaacuggcuauacauucccagacauuaccaauagauguuugaacuggcuauacauucccaggcauuaccaauagaugugugaaccaacaugaauucccgcugacacuuucucacuugugacauuaucaaguuauucaugaaguauaugugggccacuguccagauuaaaagcaugaaauaguagauauccucuuacuucaguaggagaaacacacuggggacccaaacguaagaaaagaauuggagaaaucaacuguucaauaaaaacuaguguuugucccuucaguuugguaaaugacaagauauucaaagauuuggagauuaguuguuauuuuaccuuuacauagcaaaguaucucuauccuuuauuauauuaacuucauaaagaguugucucuauaugucaugugucagacacagaugucagaaaagaggauauacuuauagcucccucuuuagucccccacaaccccucagaugaguugccucuguaggagaaauagugagaaacagggaagcucauuuuauuuuaaagucauuaagaacucaguugcuauuaaauggaccucucccuggagcucugugauuuuucaaaacuuauuuuugagaaaacagcuguacagcaugaggccuugggaagcacacuacaaaaucuccaaacauuugguaaauccaguggcagggccgaucuaaacguacgcuuauguggaugggaagcaugcagaucuaaagguuauugggcaaacuaccauccaguacuaugguuucugucaucagaccuugaagugaccaaaggcagaggggcgaucuuuaucauguugaagacggcaugccauuucucuuugaauucaaauauguguguguuauccuggugagcaugcuccaacucagucuuucuaacuuacaagguuuugacagucaaaguagacucuggcaagaacccuaguauaauaagacaugauuuuagaaaaaucaucacuauuuccaaggcugggcagcaaggauuucuuuugacugcuggauagauugacaggaauucaaaaagagacuguaguuccacuaagcuaauguucuaagcacacguggaagcaggggagaugucauuggacuuacuguugacccagcuucccaguuugugacuacuguaugccuuguauguccuggcucaaauugguguauccauggcagggacuugaguugauuauuuuuaccccgcagacaggguagugcugaccucgaacucucaauccuuuuccccaagugucuggauuacaaauguuugucuacacacccaaacaaauuuuaaugauacaagaauuauccccguggccauuggaguccauuguuaggacgcuguuccuccaauguaucgccacauaucaacucucuaugauaugaaccaggagggcuguucaaauugcaucucuucucaguuaaugccgggcuggucugcacuguaucccucccaagacuuguagccagauaggacugcaaggcggcagcggguuuguucauucgguuucuguuuuacaaacugaaguugacaacauccccggcacuugcguggugagucaucugauaaaggucgccuuggucgcugguuaccuucucuacucaagaauagagucacagguggcuuugauggcuaguuuccagaaccauugauggcucuucuuaauuaacgugcaagugggccuccucugacauuuagagagucagugguuaccuuucagaaaguacuacuggguuuccucugggccaggcgccuugccuuccaccugugguuuuacaagguauuaccauggacuguucugagccacgcacugcaccuaggccagagaggugugagggaagccgggcuacagccacacugccuuucauuagcucacuggcucucauguccaaaguagaaacaagguccagcucugagaggguuuugucugccaugcugacucuagaaacgugcucaaaagagagauagaccacuucuuugucccccuuucuacccugcuuuguuacgaaaugcagauaaucauugcccuuuaaguacaagauuguucuuaacauuaucccuggcuuacacauugcuggcacauacugagguuuccauaauuaccuaugcaccuaagcauucaagugcguugccuuggaguuaggauuucuuucuuucuugcuugcuuuuuuuuccccccauucuguuuuacugguaugacucauucacucauuugacuccauucaguaaaugaauacauccugagacucuguuaaacacuagaguccuuccaaugagcagcccuguuuacccuuucagacuucugggaaauguggaggcgaugaucaguggagagccagcugguccugaaaccuucaggaaagcaucugggccugaaagcaauauuacauuguauucguaaggugaaaagcgcuaucuuuuccacccaugccucccaaggcugaguguacuaccaucuaaaccaacaggcuucauauacagaaugugacuagguuuucucuaggagguugucuucuuuaagcaacauauuaaagcucuugaacaagagccagacacgugguacacaccuguaaucccagcacuugggaggcagaggcacucagagcucugagcuugaggccagucuggucuaaagagagaauucuaggacagccagggcuacauggugagacucuauuuagaagaagaaaaauguucuuuaucaaguucacauuuuagaaucuuucugauuggugcugaauacugaccccccuccaccugauuuagaauugcccaagaaguucauuauuuugugauauccucagacucucauuagugcuagaagaugacuaauuugaaguggggaaguguuuucugaagugucccucucugcaacucugcccuuaaugucaaaucaagcaguuauuucugauaaguucuuuagcuucucugaagcagcccagcuauggcugguuguggguggcgcugauaaugacugaacagacaacacaaaugaggugggguuggccuuuucagccauuuuacaggaaugaggggguuggguaguggcuccauuaguaaaacgcuugcuuuacuguguaagcaacuaagggcugggagguggaacucuuaaaggcuugcuggccagccaguuuaaucaaaccaaugaacucuagauucaaugagagacucuaucguaauaaguaagacagaaagaaauugagaaaccacccgauaguaaccuggggccuccccaaacacaggagcacaugucauacacacacaugaacacauacaccgcaaacugaaaaaaggauccauuuuucuuuaauacucaaugcaauaagaaagcuuugagaauguuuagagauuucuaugaccacugaaaauauaguucuagaaagacagagaugaccaagagagacaggaaccugggcaguacagcugcuauuugaaugcuuuguucuucucaggguauuuugcccugaauguucuuucuggauuuugagcacuugagcucuuggcaugccagcaguugggccuucuggaaagaucauagacucugaaaacugucuaagaaucugauagccaucaauacauuuccagcaacauucccuuguuauaauuaauugaccaugugaguuucagucuucaaauccaaugaagaaagggaagaguggaguguuuaguuagaaugacuguagaugcuauaacaagcaaaccuuaauauuuaacuuaaaauagccucuuuuuuuacauaauagcccagacaggguguagcuagugaguagauggcugcuuuucaugaagcaauuuggaagccauaccucuuucuaucaccaucucgcuaucccaaggaccaaauggcuaguagaagagggcuacccaguuacuuucagaaaacuucuaaaagacuaauauauuaagaagcacagauuuaagggugugucacacagugcauaaauacacauaaacacaguauaaugugucaaucugggaaauacuucuaucucuaaaaucauguauuauuucuuuuuaauuuuccauuuauuuuguguguuaugugcauguguuuguaugcauguguguaugccacuaggcauguggguauccaagucagguugucaggcuugguggcaucuuuacucaaugagcuaucucaaugaucucauuuaucauuuuauuauggaauaagcauucaaaauauuuuucuagcauuuggaaauacacagcauaauguuacuauuauugcuguuuuauuguuauuaucuguacuauaccauggcaaagagaaauguuuacuucuucuaacuauagucugguacccacugcccagccacuuucucuuuuccucccuacuccauccuccaguguggcauuauucucugaauaucugagaucaaccuuuccaauucugccuaugagugaugcuccuguggcacuuggcucugugugccugggucugucaccugucauaaugaccgaagucuucuacuuucauccacauugucaccaaaagcaggcuuacaguuuugugggauuuucuguuguuaugguugaauaguaucacauugagcaugccugccacaauuucuucauugugugauggacacguaggcuuuucaaucucuggcuaauguaaauauagcacugcaauaaacaugggaaagcagauguauguuccacaugcugcuugcauuuccuuuggacacauacccaguaguaagacuauuggaacauacagucuuucuauuuuuaguauuuugagaagccuccaaucuguuuuccauaaugucugugcuaguuuacauuccuaccaacauugugcagggacagaaucuuuuccugaacacucuugccagacuuuaucauuugguuuucugacaauaauuauuagaauaaggucaaaucauuucacugugccuuugauuuaaauuuccugguguuuagugauagugaaaguuuuuugguguacuguugggggcaaauuguguguuuccuugggcaaaguauugauuucuuaauguaauuauaaauugggguauuuuaucaucugccacugugcuuugauauucuuuauauauugugguccucucccccauuaucagauguauaguuuguaaacauuuuauagaauuuuguaagcauuuuauagaauaacucuuuauucugaugguagucuccuuuguguuuuugguuugacauaaucuuguuuguccauauuugauucuucuuuuuguggacuauuuuggugauuguacaaaaaccaucuuuguuuaguauaauaacuucucuuaaaucuuaugguuuuauggcuuauguuuaagucuuuaauccauuuugaaauuauuuuuguaacuuguaagagacaagagauagaaguauaguuuuauucccugccuaacaacuuuccuauuuauugagaauguugucuauuggccuuugucaaugagugagaaaucuuuacucuuacaccacuguuaagaaccaguugacuggucagcaauggugguaccucccuguaaucucaauacuuagggaggcugagacaaggagaauugucaugaguuucaggccagcuugggcuauauaguaaguaugauagcagcagaaugagauuugguauccaaccaaccaaccaaccaaccaaccaaccaaaaaaaccaaauaaccaaccaaccaaccaaccaggcaaccaaucaaccaaccaaucaaccaacuaaacaacuaaauaaccaacuaaucaaccaagcaauuaaccaacuaaccaaguaauuaaccaaccaaccaaaacccaagaaauaaccagcuaaccaaccaaccaaccaaccaaccaacuaacuagccaacaaacuaacuaacuaacuaaccaagcaagcaagcaaacaagcaagcaagcaagcaagcaaccaaccaaccaaccaaagaaacagaaaucaacagacugaagauguguagauuuacucguaggucacuuuuccuuuuucuugauuuacaugucuguucuuguaccccucuuguaauauuuucauuguuacagcuuauaaaugacugaauucaaagauauugccuccuaugugcuuuauguucagguugguuuugacuuuuuuuuuuuuugagauuuuuuuuuucuuucuguuuccauacaaauuuuaggauuguuuucaauuucugugaagaauacuaccaagauaugauagggaauggauucagucuguagauuggauuaacuuuucagcaauguugauucuucucacuuaucaacuugagaugucuaucucucucuuugggugcacccauuuaugugugccuguguguguuuguauguguguguuguuguuguuuccuuguuucuuucauuuuuguuuauuugcuauuguaagauggauugcuuuuuauauauuuacuucauguaguuugcuauagguauguaacaaagcuuuguauauuaauauugcauccugcagcuuucuuacuuuguugcauuuuuauugcaguuuuggggguuuucuauguauacacucauagccacuuuuuaaauacuuuaccuuggaaguggcauauaguuacuccccuucuaaaccauaaacucuagaagagcuccagaauuggagaugauagggguagagguggauagcagccauucuuugucauacacaucuuccaucuuaauguuacacaagaguaaaugagauuggauuguaagcauacuguuguggcauagucugugccuuucuuaguuaggguuuuacugcugugaacagacaccauaaccaaggcaacucuuauaaagacaacauuuaaguggggcuggcuuauagguaguucagagguucaguccauuaucaucaagggaucauggcagcauccaggcaggcaugguauaggaggagcugagaguucuacaucuguucugaaggcaaacagaagacuggcaucccagacagcaaggaugacaguauuaaagcccaugcccacagagacacaccuacuccaacaaggccacaccuccgaauagugacacucccugggccaagcauauauaaaucauuacagucugcaaacuucagaauccauugacaguagauuuucccucuacuuuuucccaaugcacauuuauauuauaagguuauuaauuuugugcauauuuuuaauaaacuaacuuacaaacucccaaauugaugcuauuuuuaauacuuuggaugggauuagggagagguaaaucuucuuacugagcuuaucaaugcuuuccccaaaaaauuguuaauugacagguuuaugauggcuccuguggggcuguuuggccacuuguucuccauuuauaaauaucaccacuaagaacugagcagcaucccagcagcaucugcaggaacguuuggguucagugcugggaggaaguuuuguuaauugauguauucaagcacagugacaauuuccuguugcauaaagggggccaguccuuuggggguuucccugaauaauuaaaauacgcacaauguucaauggggccaagggccaagugauugcaugugugaauuuauuuuugucccaucagcaccuuaaugauccccagucuguggcacuccccaaggugacaaaggauaagaggcucagaaaccgcguuaaaccguguuaaaauguggaguguggcauuugcucugucuggguucuauuuuuuucuggccuuaucagaagguucaugaaagguuuguuuuuuuguuuguuuguuauguuguauuguuuuaaauagcuauucaagauagagauuugaacaagucagagugauugcaaggcacuuccuguuuggcagaggcugagguggugguauuuguagggugaauaaugagauagcauauaguuaauucuuuguaauaguuaugcuuuauaaagggccgcacacacugaauuagccaguaugaaagcacugccccagacgaaacagaguucuguucuugggagccuccuccgaccaauggacuugucagcccuuccauacauauccuuguuuggugugugucuguuaaaggugcuauguuuuauguaucucagucacuagcauugaacccaugccaaacggcaguagaccuccucccgucugaagaagcgacucuaacauagacuuccuucguaaagugcauuguacccauagaaagcuugcgagcauuagacaucacagcaauacagggaaagaaaauguucuucaauagaccgggacaaagauucuucuuuaaaggccaaggaauuggaaccagagcagagucaccugguagggucgguggcuugaaauguucgcugcucugucagugaccacaaagaacuggaaaauuagaaauacauuuaaaugagaagguaaaaaaaucuuaaagacauagucuagaagugagacucugagagcguaguuuauuugguacuguacuugccuagcauggacaaaccuugagguagagcccuagcaucccauaaagucagcccagggacacaagccugcaaccccagcauaaaaguucaagguaaucuuucgauguauacugaguuugaggugguccauguuuacccgagacuuugucucuagaucaggaaauacacuguccaucguaauuaaauacaaccagagucauugcucaguccucugaacugcaaaggugucagaggauaugcaggcaaugggcuugucuagaaccgggcugacuuucucaguacagggucaaagcuuaauggcuauuucugguuuggccaaccacguagucccugucaacucugccaaucaacuauccugauucagcacacaauagccacaggcaaucuauugugaauguaugugguugugaaccaagaaaagguuuggguuucuaugcuacauuuugaauuucauauaauuuuccugucaccgaauacuauguguccucuggguuuucuugaaacuauuuuaaaauguagaaaccauucuuagcucauaggcuauaaagcauaugguagccagcuuuauccugaaagcuacauuuugucaacucugcuucaacacuccuagguaguuuaauuuuaaaaggauuaguuuuuuaaaaaugauguaaugcaauuuaaaacuuaccuaagucccaagacccagaaguuuucaaagacaacacauaaauaugcauacauagacacaugcauccugcagugauggaauguacuuauucuacugagaacaugugguucuucugagcaucaaagauggauuuguacccaaaauguaauggcaaacuuugaggcugggccacucucaauagcauccuuuggugccucuuugguuuuauugcuguuaccaggcacauugcagagauucucuccuauaugcucaauucagagaugaugcuggcucaauucagagauaauccaugggcaggggagaaggucaaaaagucagagcagaauuugcccuucaaauacuuagaguggaauaaguuaggaaagugcuuugcauguugaacaauacgaacuaaucaguaaccccagaacuugggucucuagcugcauauguaucagaagauggccuagucggccaucauugcaaagagaggccccuuggucuugcaaacuuuauaugccccaguacaggggaacgccagggccaagaagugggaguggguggguagggaagcagggcggggguggggguggguauaggggacuuuugggauagcauuugaaauguaaauaaauaaaauaucuaauaaaaaagaaugugugugugugugugcgcgcaugcgcguauguacguacagaaauaggucagcuguucugguacacaccuggaauccuagcaccugagaggcuaaggcagguggauuacagguuugaggacagccuggccuacauggugagacuacaacucaacaaaacaaaaugaagcacaaauauugaaaaauagcuucagucuuauaacuuagaggagugacugauggcacuguaguauguauagugacugaauuuguuuuuugagcauucaaacauaaaaaugacaguuuaaaauggcugucugauggggaaaggacauguaaaauuuuggaauggcacagugguaagaauagccaagaaacauauuaaauaauaccaaggucagcaacaaugucaggcacuagccucaacaauguuucccagggucacacagcuguguuuucucaggagucuccuagaaaccacucucuccaagcugaacaccaaccccuacuacacacaagggccucuuccucacugcauaugaugccguccucauuaacaggugugguggaaucuucacugcugcauauagugacgaucuggugcguacuauccucagcugucagagaagggaguccuagggguaugguccagguagcaaagucacgucuucagcugcuuacaacagugaaagcuggaguauaaucaggagaaucuucuagggggagccggugcuuaguguguagccagcauccuggggaggaaccugcaucuuggaaugaauuguguggucuggaagggauggaccagggaaagaguuacaaauaagaaacccuugcguccucgaaaccagagguuaaugagauugucugcaguccacacuauuucucucccacuuaaauuccauggaucugacaccgagaaggaaaagcggcuucuggagaagacauugcuccuugauuauuagccaucaaguaugauucaugaugacgguagcagauggguccugagcuuggccaucugaggacccugcccugcagggucaagucuagccugugagcuggccugggcuggccaguucugagcaguguggucagcccugaccaguuuguugcuuccagucugaauaugagauucagggccacuguguuggccccaucugugugaucacuucuacagaaugcugucacugcauugcaggaagagaucugcgaggacuagaggguacaauggaccaggagcucuuuuuaacagaagaugggauggugagauggcucaguggguaagagcacugacugcucuucugaagguccugaguucaaaucccagcaaccacaugguaacucacaacuacccauaauaagaucugacacccucuucuggugcugucucugaaguacagcuacaguguucuuauuuauaauaaugaauaaaucuuugggccagagugagcagggacugagugagcggagccaaaccgacuugagugagcagagguccuaaauucaauuuccaacaaccagaugaaggcauacaaucaucuguacagcuacaguguguauucaauacacgaaguaaauaaaucuuuaaaaaaaaaaguacacggaagacaaaggaaaacauugaaaauucccauaaccacacugauuuuuaacaucuaaugcaaaccuaauaacuacacuagucugaaaccuucuugacuucaucuugagaucauuccuauugcugguucgcacuuuguguaaaucuacuagugucauuccuguuagucuucugugggugggugggguuggguggguggaggcauaccaugcacuagagauuugucugccuucacaguuaccaugaaaaguuauugguucucacaagcguacacacugacauaucuuccccuuucuucuuuccguggagcaugauaaaucccucauugauuuggucugccgauaucugaugcaucagcaugaguggguccacuugucuccuuuucccuccugcgaugggcucccgugagaguucagcugcuguugcaagagcaauuguuacaagggcagaacagaccccugcagaagaggaagaacaauagugucuuggugcaaaggagcuagcuccugcuguguugccugcuuguggauuuugcuuagugcuugcgccagcaucuucuaaacaugcucuucuaauaaugugugacccaggagagaagaugguugacauuuucguuccccuuuacuuccagaucccaugagagaaucucacuuuuguuguucggacuuuuccugauaaacagcccuucauucuccaguuguucccagguuucuuucuuugcucugugauuucuuagaguccugccccucuuucuguggguggugaugcccaccacaccuucuugacuauuguacagcaucugccuguuucuugucaagaagcagaagucuucuggaaggcagaaagaguccucucccuaguguuuuaagccuuugaguaaaauguauuauauaccaguaggacuuuguaugcaucaucaagguugcuaaucauguuagccuaagaguuaucuuaaguuaagcacauggggcucaguccaaucucuuagaccagugguuuucaaucuucccaaugcugugacccuuuaauacaguuccucaugauggggcaauacccaaccauaaaauuauucauguuacuucauaccuguaauugugcuaauguuaugaaccauaauguuaaauaucugcuaugcaugauaucaggauccaaaaugaucacaacccacagguugcugucucaaucccucaguagcagagaguuugcucgauuggaaucagugagaaaguauaaaggaagacuuaagagaugcagaggugagaaggauuuuugugaacuuugcuuggcuccuuaaugggagcacuaacacgcauggaacggagagagacuaccgguuccugauggucccuggccaccaauggcuaucugacaaauuagggccuguauccugcuacugcaggggauagaacuaggcaacagccugaaucaccucagaggagauuucuucaccgagccuccugauagagcuaaaucuaccuagcccauaaacucagcuuugaagccucaacagagaaacucacauucuugccaagaaaauggcacaauguauguguguguguguguguguguguguguguguguguguguguggugggggaggggggcaacugcacacaauacaaaaugcacauagauccucaaaggcugggaauauuaucagagcugcugggaacaaagccuaaggccuggcaacccugacaaguuaccgucuuccacuaguccuuugucagacaaaauaaagggacagguaauaagaaaaaaacugagaaaggaaaucuauucagucaggccgcauugggugcuauaugaauagcaucuacaaugacuucaucugauagcucucaacugagcacucaguggguugcuuuugccuuaaaguggguaccucuaaggacauuaggaaucuuaguauguuuagcacucuauaggacguacuuucagugagcuugaauaugggcuaaacauuggccaauauuuuacuauaucccauagaguauugguauucuauuaguaccacuaggacaaaacuguuacacauggaacgcccugcguaguaguagcucugucaaucuugggagcaguucucuguaguuggauggguaguaucugcauuuugugaaugaagaacuuggggcacagccaggcuaaagggugcuauguuuuuguuuuuguuuucaaucuguaaugcuuccccaggaacucaaaaaguaaaggcuuagaccaaaucuagugaugggaucuuuggugguaauggggucuucaaagcucugaccuuauugguagacuaaccuauugauuggcucacaccuuaauagguauuaggaggugguggaaaaauuaggaagugaagucucgcuggaggagcugggccuuugaagguuguauuuugucccugguaucuuacuucuucccuucuuccucauucacucucauugucuccuggccuuguguuucuccccccugucuggguuccuccauagacauguucugcuuuaccacagucaccaagccaaauaagcacagacuaagcccucugaaacugugagccaaaagaggcuaccguuguuuuucuuagcuccuucuugucacuaagauagaacacugacacagugcagcuuacugaaggcugcacaaguuaauaauagagcccaaguucaaacccagguuuguugacucuagaaaaaucuacaaccauauuuccacauagcuguguuccccagucucuaugucaauccauucaucagagguaagaaaagcucgugacucugggugaaagucauuaucauugcagcucauugggacuauuuccaaugucucgagugcccacaggguuuugauccuucauucuuuuaggagauagccucagggguggaaugaauaggggagcaagcaugacuccagcaagcaugacugcauauacaucaagugaacugauauaagccacggauucucccuaaauuccacugaggccugagaacuccccaacuaaauauucugccagcacauucuauaggauguucugccuucugaucccugguccaagcccuccuaccucaguaccugaagauagaagcaaaguccaccuugagauccuccugcaggccuguacuacaaaguaggauguuuucuuugcaauuucaaacuucgccuauggacuuugcauuugugaguuuucgucuucguuugcaaacugcgugguccaucuucuuucuauuuugccacgcugaggagaugagaaguugggaggggaaaauaucuuuccauauuacauccuaagaagucuugccagagucuguccugaggcugcuggauggaggcccaaugcuguucucagaagccacguccacagugagcacgcaucuacagaucaggagccagugcguggccccagcaauccuggacacagagugacaggccagccuucccggcccuggauagugcuuugaaagaacgucauguccuuggcccugacacccccucugcugggaagcagccuauuucccauucuccacucuccuccacgcccccacggcaucaauuuuaauaauuacacaggaaguuucuuuuccuuaagaaaagauggccguagcaguuuucagcuggguguugacuuuuuuuuuuuuuuuuucgucuucuuuaaauucccaagaguuaugacacaaagggaaugagucacaucuuugagguagugacugugcuggagugccacaguacacaguucugaaguucaaguacagggcuggccuucacgccagccucugagcaagccccuuaaucucccaauggagguuuguggggcauuugggaaugaggcucuggagagcagggcccacuuccuucauggcagugcccuuggagagggacuugauagaaaggguuaaagaagcuggagugagaaaggaggagaaagugaaaaggggugaagccacgcccaccagaguccacagcuuugcccaggacauuggucaaagauugagguuacugaguuuuaagaauauaacgagaaauaggcucacaaauguggcauuguucaaagcagaauucgaaaaaacggcuuaucaaauagucuguaguaauuaaaauagcaacugugagcaacaauuuuuuuuuauaaagguaggcuuauuucaaaagagcuggaagacaggauuugaaguguucucauaacaaauaaauauuuugagugauaaacaugucaauggcucuuauuugguauuauacacuauacgcauuauuacuauuugguauuauacacuauauaaauucacugacaaaccgcaccgaacucccuaaguauacacaguuauugugagaauuaagauucuaaaagaaccaaagacuacaacaguacaaacuccaguuucccacagcagauaacaauguuccaugaagacuuaaugcucccccuaaaauaccugggccugggcuuagaaccucugcaucugaaccccacaacauguuagguucagaccuuccuauaccgaggcuuucccaugcucuuucuauuucuacaugauucaccugaaaaaugcugcaccaauaucuucccugucucaaaaucauugugaaguucagaugaggauaugggugcccagagugugacguaguguuuggugugaaugaugcacagguugauaguuaccaucguuacugaccuuuuccacuucucugucaugcgcacaugugucuguuuuccccacaggggaaugugggcaccugauagcuuuuaggcuggcuucgucuuuguggggcauauagugguuugacuccugcauuccuuccucucuguuggguucccagugcgaccugagaaacaccuguauuggagucaccuggggaaacuuagugccaugucaguugcugagcgcuggcgcagaaccucugagucagaagcuggcugucagcucugauuccugccuggcccccuucucucuuucagcucugcuuggcagcacugcagacagugugaaguguuuucuacgugcugugcugucuacauuccugggaaaaccaggacauuugggggggggggcgggaaguggguggaaauggaucaauuagcauagagucuuugcuugaacuuuacccuggcuuuauggagcuuggagacacagggaagguugcauuccucuccguggagcugcuuaauucauccccacucucucaggucgugcuuuuggcucauuccggcuacuuagcucagugauauuugcuuccagaccggaugggcgacgggagcugucaacagaaagguguauuagcuuucgaccugagccaggugagcaccuccaugguugcucaacacucgggccauccaaauuuaacaguuugcuagcaagcuagcauguuucugcugcaggcuugccucuccuuugugaccauacuguaauggcagcaagugcaagguguacuccauacagaucaaauagcugaguuagggacuggagguuuacuucaauucuaaguuuaguauacacagagucuggggguuuaaucuguagcacccaaacuuaacagcagugacaaaagcagaauauaccaaaccaacaagaacaauagcaacaaaccaaagccaaaaccaaccaaaggaaagucacacaaaggagacaaaaaaguaaaucuaaguucaaaucccaaccuggaaauuuaguucuguuacuuuuuuuaaaaaguaguuuuauggauccuccuuugucuaucugccaagcagugugucuaguuggcugcaggaauggccccaaugauuagcuauccccguuaucuucugcagauuccaaucauacaccuggacuucucucgcugaccuguuagcagacauuuugccagacgagcguugagaaagaacuuccaauucuccugucucccaucacccaaaacgagcugcaucugggaugacucuuugguucuaaaagugugaucaaugaagcagaauacagccagggcacucuaucucagugccuagaucagaccucugagcaaaccuagugaaaguccauccaagcugucugccugacugccuugauguguggacaccaaccuaguguuuaugcccugaagguuugguuguuagaaugguuucagugaucuauauaauggggauaucagugauaacucuugaacuuuacaaggacaggagcuaaauagcaucacacgaauuaccuggcccauuaaaguccuauaagggagaggugguggacacccagcauaucugucuggcacuucacccacucacuauaucuaggguaucuguagucaccauuacaacaccugcaacauucgccaccugcaagcccauacugguagagaugccauuugcuggacagagaucaugaaaaauagcaaggagauguugagaaacuaggcucucauuugcuguacgaagcugaagggucucuugagucuuaugugauccacugauuaauugggucuccauaugaaagcaugcucauuauauuguucaggaguacacagucugcugcaggcaucuguuugugaaugcagcauggagcuacaaaauuacuugggguacccguccuccgcccgcauaccuuauuccaucucauuucacucagccgggaggaaucgcucuccugagucuugaggaggaaaaacaguagcucagagauguuaaauggguggccagaagugacagcuaagaauguagcaacaugagcauuuagguccugugcuaccugacagcaaagcauaaauagauuuuacucaggaagaaauuccaccugguggauagaugucacugcugaaugugugaccagguuacccauaauaccuugugugauggccgagaccuugugggcuacugggugccaccgggcaccucugaaaugcuuggauaaccaaccucaaaugcauuaugaguuuacagaccuucgucugagcauuagaaaagcaugcugucccacacccaagguacucugugcucucaucuaagggaagucaaacaaaacuguaaaguaucuaugugccaggaugaaguacaagagcugcuucaaggguggcauggccagcccacccucaaaugagcagaagagaaaagcccccaucccagccaccugcuccuaacuucuuccuccugccugccagcucagaguaagauggggagaucgccaaaggcauucuuaggcuuccguuuuugcuggcacaguggccaggaagaaacccugcuuggcuggcugccuugggcaccugccaccaccaucguguguuuguuugacuggucauggggaggaagcagaaugcuucuguuaggccuugggcauuucagaugcuagagaccagauacugggacagucacauucagggacuuucucuucccuuccaugugccuccuucucccagcuaugugauaggcagaugauaguucuaccacuugcucacgugacccaaggaugaaggcaggaggcaugagugauguacucagaacagacacuguguuucagccuuucacuccuaaugauggagcccccccccuacuuccacccccacuccuacccaggacacacucagcaaucuuauucacauguaggaucucacacaauccccauuuccuuuuauucaggucagaucagaaggacuucuugguccugguggcacacaccagucauuccgauauccagggaagcugaggugaagagaccaaggcucaaaacuagccuaggggacauagugagaccauguuuccaaaacagaaucauaucuucuuauucagcugaggcccucugauaucacuuugucugcuuuuguauagacauuaugaguuaguuuuguaucucaggcuguccuggacuugcuaugugaacuugcacuuaugcuguaccugucuuuccuuuccaagugauaggggguagccaccacauacgcucuucuaugguacuuuuaggcuuucauuuuguuuuguuuuguuuuaaaagugugcuaccuaggauuucagauauucuaggcaagcacucugccaaugaagcugcaaccacggccuuaugaaugauuggaacacacccagagucucauuguagcucccuuccugucucaaccaggcaaagaacuacuuaagagguauaucuuagacaggaggguuuuauccuugauagaacaacguggcgguaauuaacgguguugagugucgacggauggcaagcuuuuuacucugacaugggccuauggcgugaauggcauauagucaauaucccaguucacagucugggcaaccaaagcucagugccucacaagaaggcccagggaaggaaaggaauguccgucucugccuuuaaauccuagcuucuucauuucugauucuuuuguugaaaacaguguaggaaaccugaaaugacuccuacacacauagccugcacucaaagaggcuccgccggcccaugucuccugggaucucucaaaucgcccuuugaagcaggacucuauugccucggcucacagagguagggugaccaucuucagucucacagagguccuacaucaagccgggacuagaggaugagcuccaaccuuuuggucucucucugugggguuuccuauucugccaucugccucguucugaggacuugauguagcaggacaggcuguggagggaaaggagcacccacccacuugggcugggugggcacggggagcuggcugcccucugcaguucaguucuaaggucuuggaagcuccguggccaacuucuuuccuauagccuccuccagcucuggcuagaaccuggggcugcuggacagagaaaguccuggcauauccucugcacacguccuucauuugcacaacaugaaggugcucuggcucuaugcaugguccugucucuguaccaaggaagggcugauaugauugcaguuggauccagauacuccuugcuugugcucuacagcuggcuucuugucuuccucugacugucccccucucugcucuucuucauuuauuccuugagcucucuaauagcuauauguucugacccuucauuacaagcuauuguaugguucucuuaaucccaccaauguaguucccaucccaaagaagaaauggaauacuacagagccagaggccagguuaucauuuugugcuuuuuuguuuguuuguuuuaagauuuauuuuuaacuacaugaaauguuuugccuacauguauguauguguacugugugcaugccuagugcucacagaggucagaggagaauggugggucuccuggaacuggaguuauacauguuagcgagccgccaauggaggugccagaaccggaacccuaguccugcaagacaagcauguguuuuuacuugcugagccaucuuucuagcccccauaauucggaaaagagucagcucuaagugacuugaaucuggguucuaauguaguaguccuauaccaucuguuucaugugacuccugcuucuccuauugugacucugcaacaguggugguggcacucuccaggugggaguuaggacauaccaggaccaaugcuucauccuucacaucuccuuccccuggaacagucaacuccuuccauaccuagaaaugaaguucuuaggugagggaauccucugcuagaggaacacuuggccucagccaggaguccuaacuuguaacauccuaccugcccauacaugauguucuuaguguccguacugcccuuacugcuccugaagguaagucaccugcagggucacguccuaugguggcaucaggaggggagauauuugaucgaguuagugucauggaacacuaauuuguuuugauccacaacagaccuucagcugaccuaccugauccugguagggaugucugagggaagcuaacccagagggacuccuggcugggcccugggugcuccuaugacugguguagcagucaugaaggauggaaagagacccaugugaggaaauuucuggaauguauagacaccuaaaggaguuccuucaaugucuugcaaacagguuugcucuuggacugagcaaguagccucuacugguuaagugagucauucacaaagccuuggauuuaauccagacacuaaguaaacccaggggauaucacaugacuauaagcccagaccguaggagguggagagagaaggauccgaaguucaaggccauccucugcuauguagugaguucgagucaaccuuagauucccagaggcacuguuuagaaccacauaaguaagggacuagagggauggcucuguggaugagagcacugacugcuuuuccacaaguccugaguucaauucucaguaaccauaggguggcucacaaccaucuguaaugggaucugacucccucuucugcugugucugaagacagugacaguguaauaaaaaaaaaaaaaaaagaaaagaaaagaaaguagaaccaaauaaauauuauugccaccccucaaggagaaaacgaaaaagaaaaggaaacagaacaagaaagguuugcucucugcugacuucuaccuaccucacagcucagaccuccucacagcuuucucaccagcuauggccuccuguucacauucugucucccuccugugggcagagaaugcccaacgcagauagcaccuuguacacgccuccccuccucccccucuuacuuugugacucuuguuuccugcccucuguccccgccauggacuucugccagcuuagcccacaguggccucccuuuguuuaagcaucuugguuucaggcagacuuagccagccucuucauucacccuuuagaaguccugacaggcagccaaccaagcuggccaaucaugaagguuggguaucaggguccugguagcugcuuccugucuugguggcuucccacaccuggauacccugaggcccuggacagaaaugcccagauauucaccucagcuggcaugaacauaccaucuggggcugcuggcuggggcuguucccauagucuugauccuuucugggaacuacuccuuccaugaguaaacccucucucuucucuuacccacgccauucaguccacagccugucuccaccaaggaucucuggcagugggaauguaaugagcuggcuggguucugugacugugaggagacaaggaugccucauuuuccucuucuguacauggacauucacccaguacauugauugacacuagcgauggacaaagagguacuaugggcuaggccaguauaagcauucuacaaagaacagcagcuggcaaugcuacucuaugugaguucuacagugauacuguaucauccuaggugucgcauggugcaucaucgcauagaaagaaauggucaagagcauaggaaacaguacagaagcuccgcugcacucucuagauccuuguugugcucccagucagagauccagcugagaaaaggaaguagaacuuccauucuuacuguuuaacuuaaaaaaaaaaaagcaguaaauacucauucuauaauuuaggaaauucagacaagcaagaacaaaacuuuguuguuguuguuguuguuguuuguuuuuugagacaggguuucucuguauagcccuggcuguccuggaacucacuuuguagaccaggcuggccucgaacucagaaauccaccugccucugccucccaagugcugggauuaaaggugugcgucaccaugcccggcagaacaaaacuuuuaagaaacacauuugcuaauauauguagucacgggcacaaagauacacacaugcacuaucuauagugggggagguguguguguguauguguguguguguguguguguguguguguguauguguguauguguguaugugugugcguaaucauuucuguauuuauugucacuucagacauguauaucacucauuuaauagucuuauuccaugugauguggaucucauacguguuuauaaaaaauaagaaaugagcuccuguguuagagccugguuugccauuugaccuuaggugauuuuuuuuuucuuaucuauaaauguuucuucuauguggaaaaugugacagccaauagacuuuccuuauccaucuaacugauaaagcagaugcugugauauacaucuucaagauuuucagggugauuagaggaauagcugacacccagaauuucuccaugaaggucucugggguucccagaggcagauucagcaagcaucugaguucuaggaaguuccccauucccuuuuuugacacuuaaugcaaauggguaucuguucuacuaggagcuaugaacauagaaugcgguaguuaccuuucuauuacugugauaaaauaccaugaccaaagcaacgcagaggaaauagcauauauuggggccuacgguucuagagggugagaguccaucugcgguggcacagcaaaggcagggacaggauaugaaggaucacauuucgaucugcaaacacaaugagaagggguacggggagcuagaaaugacucaggucccuuuacucucaaagcuuacuaaugacacacuuccuucaaaaguccaaaccucauaaaugucccccaaacugcaccaggagaccaagcauucaaaugccucaggucauggggacuauuucucauucaaaccaccauagauguucugagcccuuuccggcccaauuucuugcagaauuccucauguaauacaacauagccuuucacuagcauaugcuucagugaugguuaucuuagaaccccuuggccccaaccugccugggacuaaguauggcacuugugaacuugggccuguggaaggaugcugcacucucccuucgggcccucuugaacucauuugucccagucagaagguuaaguuuccuuaagccaucacauugccagugaucugccagccacugcuggucuaggagcugcuugaaugucagcuccugccuggcacaccuggaauaggcacacuucagcuguugcaaggcagagccuguggcugggauagcaccuggagccguugugaagccuaauaccuccccccuugacucuuccuggauccaguggcagguggcuggugguugguggcuggcagcuggcagcuggugccugguggcuggcagcguauacgggguuggcauaccugccagcugggucuuugaucaugauggcgcuguccacccagcccagcacauuagagaacacaaaagcuucaaaaagccgcacaaagaaccaccaaggaauugcaggaaguaugucuguuguuuccuggcuacaagucuggagugugggaggauccuuggcaugggugacugguagcauggcaguuguggacacagcacugaccuugaaauucagcagagccuuuggccuuuuggaagccucugcugcucacacuguacacugacuuaagggcaaguuacucagaguaaauuggugcaguucaaauaccuaucaaguguguuucuuuaagaacaacagcaauaacuagaagcagcagguaauauuuauugagcauuuguugugacuuggagucccagagucccaauaccugggcuuaacuuaaaccuuuccaaacaccagguucaccuguauucuguaaagacaagacagcggucauuuccuugucaugguggcuaugaacugugaaugaaaaggucuccaaacacugccaugucucccugacaagagaagauccugugguuuaacccacugauauccaacacauccaacaguagcaugcucucuacuguaucccguuccuuccucugcagaacacuuuauguuauauacauggaucugucaauguaagguucugacaugaguugcuaggaugaucaaguccuggucaguaccaaguuaaaaaaaaaaacuauauaaaagcuauauuaggggacagcuguggcuuuuguagaaaagaagguucuggugcuaugaccugcagaugcccauguggaagucuucagaugaagacuuucucauggaguaaacauacucuguuguuugaccauguggacuugguucaaaaugcccauggaugcuccuuuggguaccaggcuucagugggagucccaagcccaugucuuuauuugagcaugagcaguacugaugcuuaccuagucuuauucuuuccuugcccccugccuggaccgucucugguuacaaggaugcugcagugggaagcgguaugaccguuaccuuuaugggacugagaccaacuaaggggaggcugaggaggcugcagugaaguuauuguugggacugugggcuaagauggaagauaacauguuaacaaacucaagugcggaggucucagaaguaaaauugccugguuaguaauuauaucacccuucuguugaccaugcauaucucacuuggauccguuuugaaaaggaaagauaaauuuccuuuucuccucagugucuucagccaagggaugagaacagcgcaugcugcugcugcugauucugugugcucagggcccuucuguggaggagcaggagaauaggugaguguagagaggagcugagccuugcuugcugggaguuuggcugggcuaccccaagccccucuucauggucauggcaaucuuucuuccccuuggccucuugucaaaugcauuucuuccucucugacuugguugugugcaauucuucugagcaucgguguaugaaaucguggcugcacaguucauagcaguucuaggucaccugcuuagguuuucaccuccuuucuuccccugacccgaucaucuuucucucugaucuuuccuuagcuggccucucaacucuuuucccccuucucaaugcaguucagagaauaaucugcauuaccgccugcuuuagacaugugccaaauucaaacauaucacccugucucccuaauccauugugguacucuauccccucuauuguccccauguuaguguccgccacccaccuuuggaccagaauucuaagauaucuugugagcacuccauaucuuccagauuagguagguuuccggaaauggccugucugggugaguuaagauagacacuuggggaggagacacauagucuaaaagaacaaaaagguagcaacucaaggaggagacagggcaggguaagaaguuuccuucugcucucauugagacaauguuaaccaggcuauugucuugcagguggacuggaagcagcuggcucacuuugcaggauguuggaacccccagacugcuguagauauggaaagaagacacugagugguggggaaggcauggggagaugcucugagguucggaaugaguccccaguaugcagccgacuggugguugggaugccaaguguuggggagaaaaggguuaaucucgagcagcuagaaacccgaguugcuacuuagaaucggagaggagaguuuggcuguuuauuuuguucaucuuucaaguaagggguggaauucuuaugucugaaacucuagugagaggguccaauggaaaugaauauuugugcagaggaagaaucacuguguuugcaucugcucuaaagugaucaccuaucaccuuagcuggggcaggggacccagacauugaugaaauaccgauuuaggugucuugggagaaaggagacuauuuguacgcuguauauuuuuuuguuuguuuguuuuucauuuuugguuuugagauucucccacacgaguucaaugcauuuugauuucacccuccucccuuacucccuacauaucccacuuucaaauucauauccucauuuucuguuauuuuuguuauaacuaugauuaguggugcacauauacucugcuguagggcccccaccggggugugaucaaccuaucagagggcuuauuccuggagggaacugacccuuccaucaauagcaguugacugcccuuagcuguucaaccuagaucugggcuaggugagaucuuccccaauccaugcugggauuuugaccagugugggucugugcaguccuuauagccauaggugcuuaauguucuugggugccgcaccucugucauguccagaagaaacuauuuggcagcagaauuucugguccucuggcucuuacaagguuuuugcuccuucuucugugauggggaugaguuacagaagccccauggucacuuauucuguggauguugaccuguuggggauaaacuacugcacacagcaaaaagaagcuguuuugacaaggccugagaguugcacucuacaaagcuagggauaaguauguaggagccagaugaaaaugcuaucguuccauuggguacuucuugcuguuuugaugaugauuguaauucacagggcuuacagcugguuagaccuguugauaacuuuuagcuucuggcagcauucauagcaucuuccagcacucuaagagcuacccacccacaaagaggcuuccaggucagugccaacaugauuucuucacggcccugacugaacuguguggugucuucagcaauagacucuucaacaaagagcaaugagauagcagccuauauuuuuuuuggggggggggucucuugaacccccuuggugguugucauuguugaugcuuugagaaaggucuugaugugucauauaggaugauugauugcaagcaugcauccccucugugagccaacguguuucuucauuuagaugaauacagacugagugaaguuugugacuuuucaugguguggcccgugggccuguuccuaucaguuguaggcuuuaagagaacagacuaacguucucuguggcaaaggaaagugggaguccugacuccaugccaccugcagacuucaacugccugcuuaucugccuugcaaauucugggccugggaguuuucaugauuauguaagccaacaccccccuccucuccguccuccucgguccucugacucucucacacaaacacacccucugggaaauaguaaauccacggaacaaagagauuaacuugaaugccugaaaugugugcagaaaugaauaugauuugauugcauguagaagccuccaacuuaaagcuuucaggcugggugugaucacccuguagucaagaaaggacagagaaaagcuaucaugcuaguucucucuucaggcuugcccccccccacccucuccccccacuugcugaucacuuacuacaagucuacccauugcucaggguugccuuuuccugaagccagggccauuuaucuucuuucauuguuuucuggcagcuugggaugugauccuggcaggcuuuccuauuuguuguuggaugccccaugguccccacaucaaagucccuuugggucccaggcagcaaaaaaaaaaaacauccaggaauucuuuuccuaugucaggcauugauuguuccagcaucuuucuuccaggccauuggcaguuccuuuacccugcagccucuugaagccacuuagugucucuucauacugaguaaucccauuuauucaacgugugcggcuuccguacuggcaagcgugaguaaaaauaguucugcagccccaagggacagggucauuugaacuuagugacucucaaaacacuuggugugaauaauggaaagcacaggcgcaucgauggauuccucucaacccuccuuguuccuuguuugcuugguaaagcagaguucuuagcccauaguuuuccaagaauguguagguggauugcuggggacaauugauuuuuuuuuuuuuuaagagaaguauuguuccuuugcauguggaaauggugaagcaaagaauaauauugagcaagagucauucugaugaccaggcccuggcuaauagcagagacaguguugcaauguguuugggccauugagugcugcagguugagcuguccuagcugaaaugcuuaggaacacaagucccggggauaucaggguuuuuuuuuucccccuccuaaugcuauggaugccuagaaauagcuucaaacugggacccuaaaccuuuauguuuuguauauuuccaauacacauggccugaugguaauauuauguaacauuuuuagugauuuguauaugcaacgaaguuuaugaugaguguuuuccauuugagcuaucauguuggcccucaaccaauuuuguauuuuggaacauuuuaggucugggguguagggguagggaauacugcugcuuuuuuucuuucuuuuuuuuuuuuuuuuaauuaagaaaaacacuggaucuuuuuuucuucuucuucuucuucuucucauuuuucuuuuucuuuaaaagaacaaaaaacccaacaaacaaaaaucccgaagcaaaaacccuuuuagguguaguuacaaauauuuuagguaucagagaggggacccuauaacagaaaagcaccccaagauguucuucucaucuucuccacugagggagacaaccaguacaccuagguuaggcagucacauccuuuucucuuggaaaaaggaagaaccuaaagacaaagaaacugugaacggauugugugugugugugugugugugcgugugugugugugugugcgcgcgcgcgcguguguaaaagucacugcuauaaaucuaaacaaggcuuauuuuuauguuuguuugucuuguuuguuuuugaaaaaguucuaaaacaacaggaaggaaaacacauggaaagaaagcccugguggagaucugguuaacuguggaagagaggcccuuuguaaagagaauauaaaaugcacuggaccccuuccccaggcaggcaggacccauucccgccgccuccauucacccucucagccacccuccguucucaugcccugucacccuucugcaauccuuuuaaaccccgcucuugugaugucacgccgauccuccuucgcccccgcugccggagagagcuacuugguguccaguuuggccaucuccugcacguagaugccgaugcucucgcugucgaagagcaggaaguacacauucuucagcgaggacgagcccgagucguccucgaagugagccgagauggccuugagggucaccugggcggccuggggaagcaguuucugccacuggggaacggugggaaggcgacggauuuaagcuucuuauccucagcugcagacaggcaguuuuugauggucucuuccagcuguucuucacauuugucagagccccaccgggggaugugacaguggaugacaaauuuggcugcgaguccacuggauuggcugacggcagcuucagcgauuucuaaagggccuugggacuugcgaagcuccuuuacuguuuccaagaacucuuuacccccagccuuuuccaaggcuuucccuaucucuuccuugaggucgaucucagcugugguuggauggacgaugcccuccacccucauggagccaauauggcugaugucacucugggucagggauagcuucugccccagaacguggcucuucgaagacaagauggugaagccaucccccggcacauccuccgagguggaauuugauguuccuucuuuauugcuguccuuugcuuuagacuucuucgacgucccuggcuugguggccuuggauuucuuagcccccuucuugccugauguggccuuccuuccucuuuucucugggggugggagaggauugucucugacuugccuuuggucccucuucuuggccagcaguucguggagaauucucggcaggacacccccacuggcgauagucacuccuuucaguagcugguugaguuccuggucguuggcaacggccagcaggaugugucugggggcuauccgggccuucuuguugucccucgcagcguuccuggccaacuccaggauuuccgcugcuagguacucagugaccgcagccauguagaccugagcaccuacgcugauccuguacuugaagguucccuuuuucagguagcgcaucaaccggccuacuggaaagaugacuccggccuuggcugacugggacagcuuggacauuuucuucuucccgcuccggccugacaucuugccucgauuuuccucuuagcuugcugacagaguggucucuuggcacuuacacaauacuggugcugugcugcgggcuccgggcgaccgguggccuagugagcuccaaucccggccgcagguucggcccgcgugccaccggugcugggcaggacccugccuuucuugggguuguaucugugcgugucaauggcggcgagcagcaguacucccggccucggauaguagggggugggguggggggagggagaagggauuccucccucuuccccacauaaccaccucuaggagcuggugcuuucuugaaugcaucacuccucccagaauuggacuuugcgcuggacccaggauaagcaagccuuaaggccuugcuguaguugacgauuccauggaccguuucuuucuccgacuguaguugcuuaggauggggaagggcagcggcucagcaguugguagagaccucagucuucuuaaagcuuauugaguugauucugguucagguuaugggauaauccaggcaagucucuaaccugucugagcaggaggagcuugaccagguaguuccuaggacacaguuuugguccucuugaaagggguauuguauugggggauggggguggggacugaaaacauguccuuuucauuuuaccuuugcuuguagugcgaaauauuuacauuuuguaaugcaacaaaaugugcguugggugagaggccaaugcccugggagcuuaguugugacucaguguuguccuucacagaucaccgccaaccccagcuauggaugagggaagccucuuugacucauuaggguuuuggaagcagaacaaggguugucaggaagcaaguaaagcuuagaagccucaucacaagacgccucgagaaggagaagcagggcaccgcuugccuuccuuuauagauggagauccaggccuaggaaguucgucuccuuccuacugacugguccccaagcccaccucuguguugccaguggcucccaaagcuuuugcauuuacagcuggaaggaagagauaguucagccuccuugcuuuuuccaucacucauguuucuuagaggagcgugugugugugugugugucugugucugugugucugugugugugugugcacaugucucauuuuuuucauuugcugcauagugcuuaauaguuuuuuuuuuuuuccuuaaggcuauacacgccucuuccuuuugauccauuucccccuuuuuauuucuacuucugccuuuacucaggucauagaauuucuuuuucccucauccuaaacucuugaacuacucgauuucucucccuccuuaccuugcaucuguccauccauccaugaaagcugcagcccauauagaugcuggcauaucaggccaagucuaaaggaccugccuccaggugcuaugucuaacuagacaagggaagaucccagaaggggucccuuggcacuggcuuuugcugcuggcugugggguauagaggagagccauuaagacagguagugagccauugagccacuggguccucuucugccuccuguggacuucuaggaccauuacuggcuagucaccgcuccauccuuccugucccaucccaucauuaguuuggaccuuuuucugaaaguaggaggauguguucugguauuguauucugggacacucaggcuaacggguccuuacuagucauucuuaucuuugugcuuccugacaguggggccaagagucucacucaucaccauaucuccaccuucuaauacaauucuggguaugugcuugauacacacuguagggugcaugaaugaauggcauaaaugaaauaacagacaggcuggggaugguguugagaggccacccuggcuaguuaucugggcuuguguuuccgggggucuuauccccucuugucagauucggguccaggacaacgguucuauuguucacagauagcauagccuaucugaaugccucucugggcagcccucugucacacccugagcuccugcccuaucucuggccccaccugguccccuugcugacacccgugcggugggccugaggaaaacuuucauguagccggcaugacugcuccuugaucucuuuuccccuguguaaaaauucauggaagagugcaccugagucuccuucacucucugcaguugcaggaggccuagauaauagcuuccauaacuccucagugugacuaucaaacauacagcuuaaucucaaauauggacguugucugacagguccauuccuauuccacucugccgugggauaagcugagguccccaaugacaucaaggucacaugacaguaguaaaagagacugaaauuagaaccagccauccacccugacccaucuuaguccuuuuuuccauaaguggcccacccacaacacuaaauuuauuucuccuuucuuacuuuccucacuuucaaguggaccaaagagagauucuacaaaugugauaacucaggaugguuuugagucuguuauuaauuaaccgcaucuuguauccuucauguaucugaaggauaucugaaagaugucuuagguacggccacccuaaggagcugaaguagcuccuagagauugccuagcgaagggcuggguaacuucucucuucaguuuuauuagcugugguuauugaauugggacaucuuuauaaaaugaaaugcuauauagcuauuuaaaagagucagcuggaaagaaaaguauaugacuuaugcacauauuaauuaguugaauuuagacuucuacaaugugcauauauauauaaaauaugccauauuauauauaccauauaccaauuauauauaccauaaauauguguaauuuuuauuugucaauuaaaauuguucaauuguaguuacuaauggaucuuggaggcaaugcagaacaugguugaaauaaucacucuaaagaauagcaccaaucuuagccaugaugacuuggcuuuuuuaaaggaggguauaaaauagcagagugugagguucacuuccaucuccuccuuaacacacagccacggucccccacaucagccauucaaucuacugcagacacgguaccccugucauguucuguuaucucugucucuucgcugaccugucagucuuucaugaagucuagucuagcacugcuuacagauacagugagauuaccagggccaagccagaauggacauguaauggauuguccagggauacgaaugaaugaacaaaugaaugaacgaaugaaugaaucaauagagaagagagaauuuucccgcaauuucuuucuaccuucuacuccuugagugcaugaagccaguaucuaagucccacucuccucucucccucuucuggucccaucccugcccccuuccucuccuugaguaucuugacucaacaaggcuuccucauccuucccaggcuucagagaaaucaggagcggugaaugaucgaaauggaccuuugagauuacaguguggagcugacauugccaguuaagccugggcagaucugacuuaauugauuuaguuguuggagcagagacaacccagaggcuuggaucagccuccccaucugacagugugcuggugagucagaucuguugggguuugagucugugcucuggguacggcugccugggugaccuuggcuguguuacucacccuuguugaaucucaauuuccugaucugcaaaagaagacuuaagugcggcuuuggagguccuggugaggaugagccuugauaacgcuggugcaaaugcccuuuagagacagcaggagggugaaagugcuuauuguguguagaguagaggagguugcugucauuucucagggaggaaucccaaggccaggucagaagagguuauaauuugacucuuguucuguucgaugcacuucucaaacugcccaggguuugcagcuuaagcgcauaaauuauccugcuccagcagacccuguguucuguagugagccauauguuggaggagauagagauccuuaucuagcagaguaauauuacccagcaagggaugacauuucuuaucagaggcugaggagucagagauaggagcuuuucuuuucaauggcugccagaccucuauguccugggcuggcacgguggguggugggaagggcuugaugccuaggaguggacagcugaugcuguugcaggcaucagcuggccuucaucucuuaugacaaccaggccugcuaggcuugccuugucagaaguggguccuuuagagauuuuugcauguggaugcucugauagcgacuaggcagaggggagugagaaaggaagaggggaaccucauaauggugcaggccaacauuggguggaggcggagccccagccugugucaggcuccccuuucuaggagcacaggcaauccccugcugcauggacaaagccuggcuuucuaugcaauggcucuguaggguaggguaucucuguuccuacuaaaaccaagcuguuggaacgcuucuaugcuccucccaagucagcuuccuagaggcucugugccuugugcucuguccuggaaguugaguuguauggaugcauccacagggugacugaacugugaaaugcucagcuucuaucgggaggacagaccuggaguuuguucucccucugacacacugcugguacuuuccuaauucagacaguaucuacacagaaggucuacacagaacgugccaucccuguguuacuugccaagugguccccuuaaagccucaguuucuuugucuauagcaggaugaagugaugucagaucuuucuaucucucccaugacuaguuuugagggucucaauuucaaggccauggcuuucugaaggaaaagaguuuaugcagaccccgagaccuguucugaggaaaagcucacugcagaugggguaccaucauggaccugguugacuccaugcuuugggaaugugacuuguauaaaaggcccacgaucaggcuucuuuccuuccugauuuuugggaagucuuguccuguccuguccagcucugcucucaaguaauaaucuugcuucaucaaaaggaaagagaagugguuuucuuucuuccgggaccccuucccaucagcaguuccucucccucugcuucuuuccugguagccccacaucucuguuuccaucugucucuucucucuccgaucaaccuuaucuuggggcuuuggguuuucuugucauacucaauuuugacaacucucauaucccuucucaaugaccaagcacagauacugaaagccuagggcugacuaugcccuucuucaacguaaauauagccagcaucucucaguuagcuucaggauuauaaucacaccucuugauauagcauuuaugggucccaucaacaucuccccuuccaugaagccagcguggucaccuuugacccucccguucuccacccccaugucaggcgucacuccucaaaaccagguuucauuuccuauguuauccacucugcauuuuucucugacuugugugauuuaauccugucauuuugcauuugugcuucugacaccugugccucugccaaguccaccuucaccucuggcuggcuauguggcugugagguuugcaugcaugugucuuugugcuuauuaguuaguguccuuuuauuuccauuugaagggcuuccuuuaacauuucuuuaauacaggccuugccauguguagcccuaccccaacuuccuguuugucuaggaaggcucuucugugccuuccauuucucagagagagcuuucagauauuugauuggcaguuauucuuucagugucaucucacucuguuaauuuucaggauauuugcuggugagucuacagauauucugaaugacaguucaccuguauaugacaaguuagaguucuguuacuguuuucugauggcuaugucuuuggcuucugagacuuugauuacaaugugucuuaguaaaaaucccuucacuguaaccagauugggguucucagcuucauguuuauuucccauuccugguuuuaaaauguuuucuaugauuuuuuuuuaacaauguuuuucagcccuuccccugucuuacuugaugauguacuagaaacuuucuguauuccauucauuguuuugcuuccaacucauuugagaugaugugucuuugaacucagucauuacuuuuucuaguugaucaaguacgcuguggaaguuaccuauagaauuuucaguuugguaauuguguauuggugucaagauuucuauuugauucuuccuuuaauguuuuuggucuuugcuuacuuuuguugguaugcucuuuucugauaccauauaguaguucccauccugaaugguugggcuggcugguaaagucuauggguaaaguuacuucuacaacucuaaauaugauaagauacucuggcgccuagauaauugaguaggugggucuacauauuggguuugugggagccaucauggagccuggagucauuuggauaaauucagaguguaaguuuucuguggcuaagccugggucaauaagcagaguuuaagaucuagguccaggagugcaagcuaaaucccaaguccuugaggguugauucuacacugaaguucaccaggguauuuucauuaaugauaacccaaagccuggauuuguagaaauuagccuaguaauggaguucauuaagguaggcuugaugucuaugucagacucaggguucuuucuucuccuccaaaugaagacaacucuuuccaggguuaugcugauaugagacaguguaaaguuaucccauaugaaauguaaaagacauuugaaguacaucuucuuauuuucuguucuacccagauccuguaacccuucauuuggauucuuuagcccuugugcuugaaugauguucaaaugggucuuucuggggaacagaugcugaaguuccuauucuucaacuugaugcuguggcuuuuguuucacuguugucuuccuccauuauguuuaaaccuuucuuuuuccauuuuuuauuagguauuuagcucauuuacauuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccaucuuuugauacauaugcagcuagagucaagagcuccggggugcugguuaguucauaauguugauccaccuauaggguugcagaucccuuuagcuccuuggguacuuucucuagcuccuccauugggagcccuguaauccauccauuagcugacugugggcauccacuucuguguuugcuaggccccggcauagucucacaagagacagcuacaucuggguccuuucgauaaaaucuugcuaguguaugcaauggugucagcguuuggaugcugauuaugggguggaucccuggauaaggcagucucuacaugguccauccuuucaucucagcuccaaacuuugucucuguaaccucuuccaaggguguuuuguucccacuucuaaggaggggcauaguguccacacuucagucuucauuuuucuugaguugcauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccuguuggggcaucuucuggauauaugcccaggagagguauugcuggauccuccgguaguacuauguccaauuuucugaggaaccgccagacggauuuccagagugguuguacaagccugcaaucccaccaacaauggaggaguguuccucuuucuccacauccucgccagcaucugcugucaccugaauuuuugaucuuagacauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuguuugauuuucugaaguccaccuucuugaguucuuuauauauguuggauauuaguccccuaucugauuuaggauagguaaagauccuuuccuaaucuguugguggucucuuugucuuauugacggugucuuuugccuugcagaaacuuuggaguuucauuaggucccauuugucaauucucgaucuuacagcacaagccauugcuguucuguucaggaauuuuuccccugugaccauaucuucaaggcuuuuccccacuuucuccucuauaaguuucagugucucugguuuuaugugaaguucuuugauccauuuagauuugaccuuaguacaaggagauaaguauggaucgauucgcauucuucuacaugauaacaaccaguugugccagcaccauuuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaccacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuucacaauauugauccugccaauccaugagcaugggagaucuuuccaucuucugagaucuucuuuaauuucuuucuucagagacuugaaguuuuuaucauacagaagcugucugguucucuggcgcacccucuaaccuguucagacuaauuuccuaggucccgcggagucccggaacccagauggcgaccacugcugcugaggcugaggccgccucccaagccaggcggacaccuguccucugguccucugguccggaugguggccgguugucugcggcccgcccaggcugcugccucagcggcucugugcuuccgcccgucccagaagcuguccgguucucuggcgcacccucuaaccuguucagacuaauuuccuaaguucugcugagucccggaaccaagaucauguuuaaacugcagucauagcaacaaaacaagacacgauagcacuguuuuuguucuaugugcugggaacugucaucaauucuuccuucucaccaaauuauuuuauccucaucugacugccaugguacaguugauauuguagaauucauuucucagaugaagcaucuuagggagagagguuaacugcuguguuccacccuccugucuagauuucucaaugguaaaagcaagauucagaagcucaauuggcucugggaugcuugcucuuaagcccucuacaauguucuaaguggcugucagcagcagcgccugcucauccaugaaucaaaggucccaucucucuuucagucuaugcccuggaugcaaagauagcaaccuggcaaaacauaaggaaguagagguuaggaaucuggcagaccugaguugaacuguaaguucuuuagcuggugauugugagcaaacuaacuucacugagccuuggccagugugggaacaaugcuauuuauccgguacaggauguuuaggacugucauaaaccgguuggggaaguuuccauguuuaaauaaaaugcuaccauauucuucucagguaagaguagauggaagggagcaagcucccagggauaggaugaccuuuauuccuguugacagggagaaggaauagaguccaguugcuguuagacucagagggaagccccuguccuuugguucagccuuaaggugucauuaccuuaagucacaguagccacugacauucuuuguaggaccaaguuauguagagaucuuggugauuccugacccaagcuacaguauucaaagucucuucauauuuuggguucucuggucguucugagccuccagacagugggugcuuuuucauguggagauacugcugaguccuacccucagcuuucccgcccugugagcuuucuaaagaggccccagagacggcuucugauccuuuccaggaaauccaacugggugcucugaaacagaguuucucaguaaggcuugcuucugaggauuacuucacuccagggcuccauucucucucaaacugccuuccagugcccaggcacagcucuguccacgacucugucucuuccucaacucuucuacaccucauuaccuccuucugaccucccauugucaaaggaagagaggugcuggccuuauaagccagccugccuuagcagaagauucagccccuggagauggggaagaagcacauuuggcccuguuauagccacggagagcugacucuaucuggauguuggacuugcuguacaaucaucccuggaaagucacggaaccuucuuggccccaggccuggaagggagacuguggccucacugaaagcaacaguucaagcuggcugccuuuccauuggcuugcuuccucuuuuggaguauuguuccuuugcuucugagaaucuuugccacccagagcaaugcaccgacucaaugcgcagacucaauaacauuuagugucaugcagauuuaacucuacucauuagcagaaguaaauucuuagccaucauucucaaucucccuacuugccuucugucuuagcuucuucucuuauugcuuugguuuaaaaaaaaugcucugacaaaacuaauuuacuagagagaacauuuauuucagaacacaaguugcgguccaucaaaguagggaaaucacagcaaugagaacuugcauggugaagcgucuauccaaucuguaguucuuccuucucauucaggccuugcuucuaauccaagcgugcuacccacaauggauggaucaauaaaccucaagcaauccagucaagagaauuccuuguauauacccagaagccuauuuccuuggcuuuccuaggucucaugaaguugacaauuaagacugaccaucacaacuucuaaugcuaguucacucauauacuaguaguaugauuuaggugaaauuauaauucauuuuguucuagccuccucaucuguacugugagauauugacaguacugauugccugugguugcuugaacuggugguuacaauaccgcaugcagcacacacacacacccuucccccauaagacugcagucauaccuuuuccgugcuggcauaguauguuggacacaauguacuuuccuuccuugacuuugaacuuagccaugugacuucuugugcucuaugggaagcauagucuuaucacccaauuggagaacggaauguguggaagguuucucuucugucacggucacaguaagaaggggccuuuggugauggaguguaauguagauaccuuuccacaagcccugcuuacaucagccaacacccaggugaccagcugccaggagggugaagaauaagcguuguuaucauaugcccuugaauuucuuguuucccuguccccaccucccuaguguugggguuacagauguguaccacgaugcucaguuauuugguucuggagauuaagcucaggucucuguacauaauaaagaagcccucuacugagugaacuacaaccccagcccuuucuucuuccuuuccuugaagcccccgugaucauaacuggggccaccagaaucauccagaaucaucuccuuauuuuaaacaaaucaacagcuuuaguucgguuugccuccuaaauacccauuugccauguaaccugguauucauucccagguuugggggguuagagcauaggcauugugguggucuuuauuuuagcuucuacaacccacacuggacacacacaauauuauacuucuaucaauucaucccguuguuauaagcccuaacauuuaaucuacgacaggaaaaugagguggagugcccucugaugauccccccccccccacacacauccccuuuuagaagaguuuguuuuacuggaaagaucgcugcugggaaacagguauggucuuuugccugucaggcacuacaagcaguggguuuaugagacagaacaaagucguauaagauucuuaggugccuuugaugcaaagcagagacacucggauuggugaugcuuaucauguguaauuugaugggugucauguugcuuaggaugucccuugauagguaaaaauguaccauauuagcgauuaacugagcugccucagaggggccacauggcaagaccaaggacagccaacuucuaucucuccaugaugaucuggcagccaggagacccucugaucuucccccacacaauggauuuuagggaaaaagaaacuuccugaccugacugauaucaauuugaaggaaauagcuggcuuuugugggacaagaaaacaaaauccagcaagcaugauagauacccuuugacugguuugcauucugcugaguagcuggcuacagcaugaacaacuaccuucagauuuggggcaaggggugauauguuaaccacuugugggugaacacagggugguauaaguagggaaaggaaaagaaucaggaaaaagcaacucgcaggcuugugggguuccagcaugggcuuuuacagaauugccaucagaaaguagacagauacuuuuggguucugguagcuaguugccugucuuccuaccugguuucugcuauugaucaauaagugccuuuaguccaagcucucauuucuuccaugccuggguuauccuuacuugagauuugggguuauaauagcauuacaauagagguuauauaaaaaauaacuaaaaaaguuguaugggagguggggaacuugggagaaugucuaugcuugcauguaugugaauauaaguaugcauuuguauacaccuauauauauauguguguguguguguguguguaugguauguauguauaaauaugugucuccauauaagcauuaaguauauauagggauguauauguaucauauaugaauguucauuuuauuuacuguauaauucauaaggguauuucucugcuacugauacacucacagucuaaagagaagucccugccugccuuacugugagaucauccugguguucuuugagaaaauuuucaaguugggacugggagauagugcucaguggaauugugaauggugauuuccugagacucccaggccugccuuugggaagcaucugaaccauaucacaucuugauacaaauuccuucuggguguacucuaggcccuuuaccccuaaaaucagacuucgaagcuaauauuccagaguucgaggggauuuugcuggaaauucauaccauguugcuucucuccugacagccugugguuucugcgaggauccucccccccacuucauuuauucacucccccaagcgccaggaaaauugaaugugcucuauguaugugcaagcaugagcuuucuggacauagcaugucaccauuuccuguuuggccagucucaccugcuuuccuucaucccuguaagagucaaacacccucaucguaccuuccuagcuaauaguaaucagaacgccaaagcuccucuguucaucaugagccucuuccccgacggcacagcuucuaaaugcuuuguaaguucccuguggccuuccccugccugucuagugagcagauugucuacugcugucccugcagccgcagagggauauuauugaucccaaagccaggagacaacaaagaacuuuccaaagggcgcagagcuagauugacacucugccaccaccccagcaccuuaccuucccacugcuccagaggccggaaguacaaagccaaagaggcccuaaagccuucucuuaaacguggugaacaaguccugcagagaaaugguguccgguuuaaaauguacaguucaaccuugggguuacaagagucagaaagucaugagccguuugggugcagucuucauucagagacacaugaaaaggcaugugcucucccuacaaggcgcgguagccugacagccuguggcucacucucuuucuuuguaccacguucuguuuuguaaacauguuuucuacccugcaguugagcauccaucaugauuaaaauuccuucuugucaguccuucuucgaaaagagauucagaucuagauacuaugucuucccagcugguguauggggaaggaugcaguugguagguaggaugguuucugaauucaagcauauccucucaguucccacacagguuauccaucuaucccccuccguugcauauaaaaaagucuucugcccagcugcaaauccaauucccagucuccacaaggaugccagaaauccuuccguuuagcagcugguuaugaggguacagaagccuaacccauauccaagucaugggcaagacugcacagcuccuugugaucuggugguccccuaugccagcaccuuauuaauggaacauuuguauucuuggguggauggugacuuggccugaugauccuuucuucuaaaagcaaaaaugucucuguccccaucucucgggauucuccaguguguaauguggucccagacuuugcaauaguucuuucaaaaagaugcaccagaugaauuaauaaacagcaauccccaacucaucagucuaagcauuugugcugguuaucuuauauaucuaccuuggaagagggaacuggauuagauugaccuguggcaaucucaaaacaagagagacugucuuaaucagcgauugacgugggagggcagcagcaucccugcguaggguggccugaguuguguaggaaagccaggugaccaugagccuaagcaugaggcaguaagcagcacuccuccaugguuucugcuuuagauuccugccuuggcuucccuuaaugauggacuguaccuguaugagaaaacaaaucuucuccuauaagaugcuugggucaugguuugucauggcaacagacagcaaacaagagcgccucaucucuuuccauugaaugccuguguaacaguuuuaacuuguuauacaaaacaauaaguacuucucagggaaagcuaaaaauauguaucauuuagaaauaaccaauuaaauaacugcaugaguguaugacuaucaucuaucuaucuaucuaucuaucuaucuaucuaucuaucuaucuaucuaucuaucuaucuaucuaucuaucucaucuauguaguaugcugguaguucauaaauaggcccuuuacuaaguacacaauaaauucuucuaacuuugccaugcauuuuucuguuauaucaccacagguuccccgggccucgguuuuacccaugaaaaaccuguagugguaaaaccuuucauauuucucccaguuucuguccagcccuuuaggaugauugaacccuccccacugugaugaacaaucaugauucucuuagaugccccacaagaugaaguuugugaacuaugaggaguauaucacacaauucaccauaccgugaauacucaguaguuagacagaauaguauuuacugugagucaaguacuacaagcucugaacugccagucaccugauuuguccaauccuugaagaaguuuauuuaucuauuuaguauuuauuugcuuauuuuuugagacaagguuucaugccuuucaggcuggccucaaauccucuggguagccuaggguggucuggauucucuagucuucuugaaugcuaggguuacaggcaugauccaccucacagagcuuacauauuuaaaucauggaucaaaagaaaauaucaaaaagauaguaauuugugaugcauggaaaugacaugaaauggagauagaaaguucaaaauauauaaauaaugaacuauuggaaugcaccaggaucuuuuaaaaucuguuggcugccauauaacacaaguggccaaaaggaugccccaaauacucucagacucuuuuauaaaaaagaaaucugcccauauaaacuuauacacuucuguagcauguggauguuaacauaaucuuugguacauagauuagugaggcucggggaagguaagauauugacuaaaaucucacaccauagaaaugguagcccuggguacauucccaggguuggguuuuagaucuuugaaccauaggucagggcauuggucuuuugagguaaggcagaaagagaugaaguauuucauuagugacugucagaaucuaaauuuagaccucuugcccucuuggggcuauggauguagcacaguugauacaauguuugccuagcauacugaagcucuggguuugagccccaguaccaaaccagacauaaaccaaauauucucaacauccaggagguagauuuaggaggguuagaaguucuaggucauccucugcuacuuggggaguuuaaggucagccugcaauauaugagacccugugucaaaacagaauaaaauauuaucacuaccaauagcacaaaacugucugucccacauaguucuugaucuuccucucugauggauucuucccaccuccccauucuauaggauagucugcuaaacagagggacacaguuuguccuuacagaagaagccaacuggaacaggggacaguacaacaggacuagcugacucuggagaaagggaagggccccccugggaaagacaacaaaccccagagccuucucaugggaaagagaccuuacuggacgccaacucgguucccuggggacauggaguucuuaggccauaaucccaagcaauugucucauuaaauuuucucuacaauggcacugcuauggcuucuccaccuauuaccacugucuccauaugaguaguuucuaaacauguucuuuucaaacagcuuuauuuagacagaacucacauaccauggaauuuaccaauccuaaaacauucauuuccucaaaaaaaaaaaaaaaaugucugggcccuuuagcuaccaaguuucugggccucucucugucuucccuauucacuaucccucaucagggagcuuccuguugcuguggacugggccacuggacucauuuucuauaaauccuaugcuuuuagaacuagucucucacuuagcacagcuuugcaaugcguagucaagugucuugacuucauuuuauacuauggaagaagguuccauuuuguaacuauaucguguuuuauauguaauauacuacucuuaugcauguuuuuucauguacuucuguuuucauuuaucauauuauacacauaccuaggagugcaguccuuggucugcuugcugggcaugucacugcagcaucuuucgcagaucugucaagcuuucgcagcaugccuuugguauuuuaccaucucucuugaacugccuacucucauuccuuauuccugcucaccuucaacauguaacaugcuauuuuguaugaaguuugaacucaugacaaauuacuaaauggaacuagaaauagguauagugguugccucuuuuuggaagggaagauaaacuaggaaaagaacaaacuuuucuaaguagagaauauucuguauuguuguuugauacauuuugguaaauauaugucaaauucaguugcauauuucacuaaauauaaacaauacugaagggaaaaauggagugauacauuuagucaucuugagacacaacucauugcuuaucuacccacuuugccauagacacagggccuguaccuggcagugaaggccaaguguaaacaggcucuuaauuggcaugauuaaccaugucuccauaggagccuuaauaacaccaguggggagcaaaagaggcuguuuuccacucugugaacaagggucugccuagcagaagucauggggcacuagagagcugcccccugcaguagggaaggggccuucuugaagcccagcugcauuuccuuuggaacaaaguuuaaaacuauuucucauuauuuucuauuacugaguauaugucacauucuuccuuuucaucucaguggauaagaaggccaauucuguuuugcccauguguuuucuaagguaaaacuguguauggaagagguagcuuccacaggcuacaauaguccuaaauguauguauggcagagaaacagacagcaagaaacaugcauaauagagaugggaaguuccuuagaauaugcaaaacauuuaugaauugauacaaguucacagauuagaacugaacaaucacuccuaauuauccaaguuaaaaaaauaaguauuauacaauuuuggauagaauugcauuaauucugucauauauagucuaaaagcagugcuuagcaaguacuacagguuauaugauucuggucacuggcaucucuaaccucuacagagacuuaaaaaagcauaugcucauaucucuaucucucugucucugucucucucucucucugucucucucuuucucucucucuguguguguauguguguguuuguauuaaauguauauguucucacaucuugaaccagguacagaaagaugaacaacaucccagcuuuuuacucacaaauuaugaggaaagagguagucucacagaaauagaauaugaaaugguguuuaucaggggguagacuggaagagugagaaaucugugagauauauauuuuuuaaagacacaaaauucaauaggaggaauaaauaugguccuuaguauauugaagucuugaaaacugcuuagagaauggauaauguguucuuuucacaaacaugagagccauaugagguaauaguuauguuaacuggcuagaucucaucauuucauaaauaauauacuucauaacauuguguccuucuugauacauaccaucugaucugucagguuuauaaaaaagguuagacaaaaucuauauccucuggaugaauuaugauugcucauugaacugaucugguuuaguugcuaggauggccaucuaacuaacacacauauguagccuaagguuuggucccuagcaauguauaaaacugagcuugguagcagauacuuauuaguauagcacucgaggaggaggaucauaguccguggguuauacagcaagcuucaggccagcuagggauaccugagacucagucucauaggaaagaaagcuagcugauggagauagugucugucaaucacugaucagaggugggacuagugacagcaaacaucuaggcggcggugcuuuguuauuuccucccucuguucauguuccuggcaguguggcucagucuuuagacauugcccauugcugugucagaaacucuucuugccagucaggaucuugaacuugaccucagguggaagugaacauuguuuuuggaggauggagguggaguucaacagacuaugagucaugguuuugccaacuguguuugcccuuuuagaaugggagcagagucaugcuuacauagaagcuacaacacagcuggguuuuuggucuuccauuuauugggcacuuccauaaugcauccgucauccuaauuugccuccucugguucuuuuaguccuuguccuuuuguuauuagcaagugauaauccaggaagcuugcugggaugcagagauaccugagccuacacugaaagggagagaaauauuaggucccuucuugucucugcacgaugaauuggcgaugacugcaguggucaccagucaccaggaacaucuggcuuuucuggcuccucaugacuccuuuccugcuuaagcuuuugauaaacaguccaggguggggaggaugaccuugguuucugcugagacccaaucuccccgcacuugaggaaaagaauguauaagucacugcaggacacagaguacuuuagcccuguguccuuguugucaaguugacuagauuuagaaucacuugugagaugcagcucuggauauauaauuuaaaaggauuuuuuguuguuaaucguguugauaaucuuauucauguauacaauacacucucauugccugugauuccaucuucuuuuaucuucuucccaucccuaugaaugcuucuucucccuccugacagguucuccccuauguuuauguuuuugauguuguuuucuuuugugguacccugaguuuaaucuugggcagcugaguaaccacagauacggaacuauaaugugcuguugguugaccaauagguacucauuugagccuaaugauucuccucugugagaauccagagauggagcucaugagacccgccugcauccaucaauagcugccuauagauccugccuuguguaggcucagggcaggcauucccagcugcugugagaugauuauaaggacauuucaugauccuucuccuaccucuuaauguucucaccaucuuucaaccuuaccccagggaggaccaagguucuaaccaaugaacuauuuaaauccauaguaauucaguuugagugcuuuggguacccuggauucauaugagagaccuacuuuucugccauuggccuuggcugacauucuucuccugucuucuucuauucccuguugauggaugcuggcugacugagucuaguuuuaugaugagcacccuauccccaugcuggggacugugggagcaucucucuggugcggagccuacaaugaggugaaugacucauaacuugcagccaccuuucauuucaugaguguuguuauacucuuuuccagaaugacuguacuaacuuacacuucuaucagccaugcucagugguuucuguuuccccauggccccacuggcaccugguaugauaagauguguauuuaccaugaugaucaugucggggcucuggguugcuucuuguguugcacaucuuacuugccaaagggggugggggagagaaucucuagugaaaaccgauaucagguaggcagacuaucuuauuagagaagaccaaccuuugcagaaauucccuauagacuucgccuaaucuggguuauuguguagcuugugccgguguccuaccaaacaguccccaucacagaugacaggauugcugugguugcuugaugccaggguucaccauucugauuaucaaauaguucuuuugaacacaucccugucugucccaaaccuacuaaaauaaauaaauaaauaaauaaauaaauaaauaaauaaauaaauaaauaaaauaaacaagugggcagaggcugcucagcaaccaauaaucugcaucaguuguccacuguggucaauuucugagaggugcacacugccuucccugugcuagcaaucuuccccacaucuguaugauuaaccauuuucggaguucaaaagugauauguuaaugggguaccugcccguuaccauuugggauuagaucugucuggcucguuugagaaaccuaauguucuuuagaaauucuucauaccagucagacaucugaccuguuucaccauagcuguuuaaguugaguuuucugcauguccccaaugagagaaugcaacagaaaguuucaagggcagaacaccacaacucuggcccugugccacaacaggaaaggaagaacaccugucaggggcuaggaucucuguagguagcugcuuccacuuccuacccaccacauggaugaugcucugguaauccuugcauuuucugacugaccaaaggggaagaccacucaagugccaccaauuguuaaaguuuguugaguacugccagguggcuugguggcugcuucagucccuuguucucauaagucuccagacagucuucuaagagucugucugugucaugacaaaaccuaaguuccaauaagaaaccugcuuccagacugcgaauuggcuucgguagcagagugcuugcuuggcauccacaaggcccaguuaaaaagaauuuuacuucuggcauuuacuagcaggguggcuuuaagcaaguaaccucacagagauaucccuuggcuuucuuugcauaccacagauaauagugguguguuucaaguacucaguggguuaauaacauaaauggcuuagaauacauccaaauauuagauacuuuuuaucaucuuuuaaaaaguggagaagcagaaaggcuaagaggagucaacuuaccaaauaucagucaccucugauuaucagagccacaauuaaagcccagagcgccugguuccaaagaugagccuuuuagcauccuacucacucugguucuuaagagguaaaguauuacagggacuagcauccugacucucuucagcaggaaaaugcauucauucucagccauacuuuuacacacacacacacacacacacacacacacacacacacacacacacgcacgcacgugcgcgcgccaucucugccauugaccaugaagacuaaugcuuccaagacuuacucaacuucuggugaucaccugauacagaaccauauaccugggggaagacucauaucagacacaggaggacccauuaaacaccucccgugccaagcugaauucuguaaauaaaaggcuccaaggccucaaggaugcugcuuguucacagacuuauucuagugucaaagaagacccuggucucccuacucaacacuccucacauggugucuaacacugucuagagcaccaagugaguguguacacagcucaacuuccucaguguccugggauaugugaugauaacaguacuccuguuuuaauuuuucagaugugaagcguugacuuaagagaugccaaguaacucagcagaugucacacagacgauaaauagcaaagauggaagucuucaugccggaggcaauccuauaagacagcugaguucugcagagcugguagguaagugugcacuugccagaaugcagugugcccagagaugauacuagauaagguguuggaugauuaguggcuuuucuccugaucuucuaagucuagauuccuuuuucagacuuuuuuuuuuuaccccuguaggagacagacuugcucaggugauagauccagccaugauacugacccuaagagaaugagacgcucugcagaagacagaagauuccugaaacugggaaaggugccuagaaauccugauaagagugaagaagguauuucccuccccuuccuaggcaucucccaccauauucaauacuuucuacagggcucuggucauuggcugagcaguccucuuucaauuuaguuggauggaauauuagucuagaaauuuuacuuucaauuaaacucacuuguugaacugccuccaucuucaaaggaucccauuaggguaauuauagccauugcuacaaggcauuauuugcacucaauuucagcuuuuaggcaauucaguucaaaugguucauguuuuuacuauuuggagguuuguauagcuaucauuuucuuacagugcagauuucccaugagcuguuguuagaaacccaaaucaaagcagcaguuuugauaguggccaucccuggucuagccugcugucucuggccuuaugugcuaauaaaaaacaaccaaagacacaauguaugaagcaagaaagcagcccucuccuuuauaggaucaaauauuuggaaacugcgagcuguccuuuauuuauaucaugguaucucuuggcaaauuaacuaaagccaaaggcagugagaauuccuuccaaauugcacagauuuguucugcuaacuguuggccauaauuauucuauuucaaaauggcagccaugacagaguuuaguugagauccuguuuugauggcuacauuucucauaaaauggauuuuuuuuucauuuuuuuucuguuuucgcauauccaaguauauguguauacgugugagguguauguguguguguaugcacacgcucauaucucacaacacagaugagaucaaauucugccgcuguggguucuggaauacagcucaggucauuagguauuaaagucaaguauauuacccucugaggcaucuuuggccugagaucacuuucuuuguauugcuaacucugucuucuuuaauucaugaacuacagagagguagccuagcucaugcuucccgauauacucucuuucccugaaaguuaagaccucagcuuggggaccaggacuauauugucucccgucacaugucuaccuuagaaucaaugcuugcaugaugaauggauagauggauggaugaguucucaaaguacaacuucuauauucuccuuuuuuaaaagucgguguuuuauuauauaacuauugaaugagugugcucaucuuagaacuuuuucaagaaggcggaggugcuuuucacgcaucuuugcugaccguuguugccucaucgucaucucugcuuagggacuaauuugucaccauuuuggagcccaucuuugcaggccucuccuuugcauuuauguguacauccacacagagaacugcggacuuaugagcggauuccuuugcuguguagguucuccacucuguuuaagcaguucugucuuugugucuguguagccacaaauuuccaacuauccacuggagccugguggguccacuuguggguacauuacucaagacaaugucugcucuucuccuggaaucuaccaguguccaauauuucagcaggguaggauaugguccguggagucucucauguauccaugauugacugaugauagauaggccauguuuuggaaggaccagaguaggcaaccacagcagcugugagaucaugauugcaaugugugugucaugcccaaacaauagcaaucacaacccuuaccuguaucuucuggcuuuacauucuuuucacaccaucuucugggacauucucugaaccuugggggacaauguuguuauucuacugagaacucaacaauuauguguucucagcauccucugaaaagcaagaaucugugcauuuaccacaguucauugcaaagggaaacuucuuugauuaaggacaggcaugccauuugucuuuuagugagugugugugugugugugugugugugugugugugugugugugcacgugcacaugcaugugcaugugcaugcuuaaaaagcagcuugacuccauaucacuuuaaugaaauaauuguaguaaaguucccuguguaaccuaagaccugagugauaugguccuucuaugaagcagguuucaaguccagucagggaguacuugguuaccaccguauccgucauaccguuacuguaccacaugggugcaucuuaacaggcagauucauaggggucacagaugguaaaagagcugucuucucuuucucaggagcuggcagagcagccuuccuccgcacuaugaaagacauccaacagagagcaaguucccaccucacuuccagcuugacuccuuuuuaucuccuaacuguggucugugaugucuucagcaaugguauuaacuaguucuggugagcagccaguagcaaugccaagagcuuccuuaacaagcagcacauaguuagugauagaucucacaucugucauagugcuuuuagcaacccauugcuuuuaaagcagcauuuucgagucauagguaauguaaccuuuuuauuuuuuuuuaaagguauuuggaauugacuuaaugugggagguuuccauaugguuuuugcauacacuuguuuugguuaauucucaccucuccugucucuucauuucccccaugucucaccccaucucugcuuacaucuuucuauucuugcuauucucccuuucuacuuucuuaucgccuaugcuucacuagucucuuccguuacaucauccuucucccaucuuuggcuuccauagccacuccauguuaagauucacuccacacaaaugugaagauucaaagauaggaccuauaugugccugguauggugaaggguaaaauauuuggcaaaauaacaccaaaacuguaaaaccacacccacugggaauauuucaccuuguguuucaagucuccccucaccugcagauaggucaucucaugagucuaugacaagacuugagagaccacgaaagcccaggagguucuguuucacaagagaauuuucaggugcucuagaccuugaugacacaucccaagcccuacagagagccacaagaauggcccagaggaaauucuaaaccacuaugacucauuggguaggcuuuucuauccugaaaccuaaguaauaggguauucccccucuauguagcucaggcccacaagggucacuagcaguucuucauaugccuaagguggguugccuugucagggaaggcuugccuugccguuugucaggaaaacugguccuuagucuguagaugaugugguugcaagucaggaggaaggaaagauacauaggagauguaacucugugaugauaucugggggcucugcgugccuccacuccuguguguucuauggguugagcagauuucuauaggaaugaaccaguacauuucucuguauacagaugcuauggacacauagcuaaaccucuuccauucucggcuuccuaccaacuggguacacuaggaagcaugcuauucaauaggugcucuacccauuccuuucccuuuuuuaauugggaaaaacaaacuaaaaucaugauuuuccugugcgugaugggacccaccuguuauuccaucacuugggagaaggggcagaaaggugaagaauucuagacaagccuggguuacagggcaaaacucugucacaaaacuuuagagguuuugaguuacagauaacuggaagagauauacacauaaugggacaaaggggauagauaugauuucauuggcaauguguacauggucaguugaugcuaugacuuagagaaugauggaaugcuugcugcuguuaauaucugacuuucaugacguguauucgaauaucuuuguacgucaaucaauccaacugucuccucccauuccauauucauauucucagcccuuauaccauguauauucacaaccuguaaacuuucacaaauaaaucaaccuacccugugauuccuagauccuugaugggaaaaacuugauguagggaaaacucagaucuaaaucccuugaccucuuaaauugagcuuauaaaaaccuccuuucuucgaggggcuucccuaaggaauagcacuuggggcucacacacacacacacacacacacacacacacacacacacacacacauacacacacagcacugguugagcuugauugacaccagcuguucuagucuccuucugugaguagcauaccucuccuccaucagaaaugucccaaugggaaagaucucaaguuguagacaggcuacacuuacaggcagagauuuccauuuucucccauguauuucccgacggaagguccccugaaaggaauuaggagaaguagagguuugcagguugacugggccagaaagcacauuauuaaucucucacacucaguggauguccacuuccuauugauguuugcaugcuggaagcacaucuggugacuuugcuuuguccccaacaaacaucugaacuucagaugguucacuuugguuucgcauaagcaguccuccgccaucuagcuuccagcugugacuaaguucucccuaauuuguaaaauuuaaagaaugaaaagcaaggguuccuugcccccccaccucuuaaaaaaugaggugaagguugcuauucuuaagcuuuccagcuuuacuaccuauucuuguuuucucuccuuuugcucuuuauauccuagaccuccaauaguuauguacauaucugaguaguauauugaaaauauaagaaacaaaaaacauuauuuauuuauaaucccaugguccuuuguaauauaugaacaauuguuuuauauaacuugauaucugccauucuauagccccuccacagccaaacccacauagaugccauucaguuucccccaucccuuguuuucugccagcaaugccuggguuauuccauaacuugucaacuacauguugaaauuuucuuuuauccaaauucuuguuagcaaaaaaauccguaauuucuuagcuuuuucuuccuuccuguauguaaaaaaaauuuuccuucuagaauguucuauacucaaaacucaugacagaagucuagccauuagaucaaaggaugugaauguugucacaguguaugaguguuuguguuuuaauuagugaacguguuuuccugaauagcuauagauuuauaaggaaauccacugaaagcugcacacuaguggcacaugucuuuaaucccagcauucugaucucugaguuuaagagcagucuggucuacagaguuucagaacauccagggcuauacaaacacgcucugucucgaaaugucaaaaaaacccaaacaaacaaacaaacaaaaaccacugagcuccugguguccuuuccccucacccuaucguauuuaucauauuacuaaauguuacuaauauuuugaacuacagugcuacauuuguuaaaauuuauauagcaguauuaaucccuuaugagugaucaaagguucauuacacuggggggucauuacuccugucuuaugggcuacagagccucaucaaugcauaguguuguaaacccaccaucacuggauuauaagaaaaauuuucauugccuuagaaauucauuguucuuuagguauucauuccucuuucucauaucucaacuuuuagcaaccauuguuccucuuacuaucucuauaguuguguauaguuuugagacugucacaugguuggaaccacguaacagguagcuuuuucaaaccugcuuuuugcaaaugacuccuuuaguauguccuuugaugacuugagaagggucgauugauauauuguagucuagauaagcuggaguugacccaucuucugaaccuucaaguagugaagcuaauaagcaucuauguugauuaaaaauuucugcucauuuuguaaauacaaaggaggcuacuuucugaaucuuagauuguuuggugugaagguucuuuuuauccaaagugaguguaucauucccacuagcaaugaacugugucucugguacauaccagggagguaacucugauauaacacucaccuagcauucuugaagcccuagguuuaacccuagaagcaaaucaacaaaaguuuacucagucugaugauguagcccuauaaucccaucugcuagaaaggccgcgauaacuggaccacaguuucaagcccauguuggguacaggagaucccuauagcuccgguuaccugccaauguuugguggugcugaugaucuagguuugggcuauauggguugcauaguggcaucuccauauuccuuggcaacauuuuuuuauuuuuuguguuuuauuugccugugaaguaucuguucagaucucucuuuugcuuauuuuuuaaaaauauuaaaguguacauuguuuuuguuccuaaguuucaagauggccuuuuuuguacauuaacauuuuuucuuacauuuuuaauuguguguguuuguauguguaugucuacaugcacauugccaugugugugccaugacaugucuguagaguuccaggaguugauccucucuuucuacuauguagguuucagggcucaaacuuagucauuaggcuuagaagcaaucaacuuuaccaacugagccaucuugcuggcuucuuccauuuuaauaugcauuuguauguuucaauagaaacauaguaagaaaugaguauaacaauugugugauugauaggguucauuuugauuuuugauccauauauaggguaccuggaggcacagcagccauguugaaccuaugaggugaugaaaaaccaugcaacuagaaaccagaauggaagaaaagaagaagcuggauccuugacugaauugucgaugggggauaguccaucaucccagggcuaagaccaccuccagauuucuuguuuggugaaacaaguccugauuguuuacauucccucguguugagcugucucuugcuuguagcugaaagcauuucuaauagauauucagauuaucagccuuagcuccaagcuagaauacucuaugggaccuuagcuucuccaugaauuccuuugcucaucuguguaaugcucaauaaauguaaauugaacccugaaugagggacaaugacacuauugaagucaugauugucaaucuuauuaacggacuaacuacuuaacaaaaagguuggaacacugccugacgcacaguaagcggcuggggaaaggguuugccaaauggagugacaagaaaacagucauguuuauaggcuuucuuuuacaucuugauccaucuucaagccucuguggucuuuaagcagaaccuugaccccuucaguacuggggcuccuggagcaugacacgcccccuaaacucuugucucaaaacacccacucuagcaguuucuuuuugacaaaaaaaaagccuucuuagugaaugcuggcuugugaaaaagaaggggcugugaucaucaaaucguguuaguagaugaccaaaauacccaaagcaauucaugcaaauagauucaagucucucugggcaagccuuccugaaggcucuagaauuucugaagcucauuuuugaaagggucuuuccauaugguggccuuuuucuuuuuugcaccuccucccuucuuucucaucagagcuaaagggaugcucagacucucuguccuuucuguguagugagggaccaggcugcugggcgagugugaaggagcgagugugauuugggauauucuuuucugguauggcaauggccagccuuuagagaggucauuugaaguuggccaacaaguagacauuauuucaaaauaguucuugaucauuaaagaaccaaccaguaugucuuaaaaacaaacaaaccaaucuuuuggaaaguuucugcugaaugugugcccuuccgacucacuucuuauccuuucugucagaaacaccccagaaaagggggucuugccuuugaaccacucugcuacuuuaaucuuccugcuucugucugaccuaccuuccuucuuucaguagccaggauccuuucagagugagcuccaaaagguggggauucuccagccacgagugcccucugaaauucuaucuuacuuagaauaaaauaucuagauuuauacaguguccccuuguaugggugguggcuuuuuuuuuuuuucuaucauuuuccugcuuguucacaccacucucucccuggccuucuuaugucacagauuuccugaguacacucuggccucagucuuuccaugaaguaacucuccuuucuagaacauucuugccugcauaacuaucugcuucuguccucacuguauucugaucuguauuucuaugucaauuuccagacaggcauucucugcccauccucuaaagugugcccccugucuucuuugcuguuaccuguaugcccuaagucuaagucacugaccuuauuguagacuaaauuuguuagcauuucuuuccaggaugcaagccuagugaugaaggagucauuguuccauugucagaauagcuacagaauccagccuguucugcccuggaugcuuuauuaaguaaugaagcucaauaaaacaauuugaccaaguuuuaagcgugauuuuuuuuagaaccuuugaaaugggccuugagacgacuucuugaagaguucuggauaugcucucaacacaaggaccagagaugaagaaauguuuggaaaugaguacauuggugaugcuguggaggugauugaaugaaccuugcacucauuagauaaucucccuuccucucucccuagguaucuuugagcagucuuagucuaagcagcauucucuucuauggggguuuauggacagaauggcuuggcauuuaugggcuuucuauuggaacacaggaguucugucuuuuccuugaaauaugugcagacuggugacuguuguaugcagcuccugccuuguguucuuggaguagaagcaccaggagaacauggugagggugaugcugaagagccacucuuaaccuagcuauggccuuggauuagcucccugccagcgauggucaucuugacuauuuaggccuuuggcauuucuguaugaccacaaucuaagugacaugugaguaccagggcaugggaaauccccagugagaaccaccccaccaaguccuucccagauuccugaccaaaaucaugacaagcaguacgaaaugacugguguuuuaaaacaccaaguucugccauaauuuguacucggcaaugaaaugcaguccccacuguaauucuccugcacacuaggcaacugggcaaaugacuuucaguauuaagcacaucaaacuucucaccucuguguuaggaguacucauguagauguugccauugaucagucugaaaguaaguuuuguuuaaaugcaacaggcuuugcagcagcuacuauguuucuuccaaucuagacgccacccaaaaagaaagaaaagaaagguguagcucuccauuaauuuaugcuuacagagagagaaacaaaucuugccagugaaacuacagccugccucugauuggaggauacuucuccuuucaaaagauucaugucugaaaacuucugauuagaaggcugaugagcacaaagacaaggcugugcccagaugaaaaguaaaagccugaagacucaaguuugugauaaauggagagaucagaagaaauauggcuuuguaucagagauguauaacuguugccccauuuuccacaauguaacaccgagguauaauacugcuugugaucugggccagaaagugaucuccuuggaccauugccaacuagaaggagucaaauggcauugcuucauggcucuuuagccaaacugugcucugugagaaggaugaagucagaucucuaaaucagguuguguugagcuguuguuagcaagagcuugucuguggcaaugaugaccagucaagccccauuuccuucugcuucuuaugacauucccuuuuuaggacaugaacuggcauuuccaucugagaugccaaccagagugcagaagagacucuggucacaucuuccuuuuuuuuuuuuuuuuuuuuuuuuuuuuuuuuuuuuuuuuaaagauuuauuuauuauuauauguaaguauacuguagcugucuucagaugcaccagaagagggcaucagaucucauuaugggugguugugagccaucaugugguugcugggaauuaaacucaggaccuuuggaagaacagucagugcucuuaaccacugagccaucucuccagcccccucuggucacagaaauauaugcaccugaauccuagcuguuccgugcagcacaguaguuagccuggucucaggggucuuuauuauguugauucuacuguaaaaguuaucccccugggaccagagauguuaagucuuauccaagucaacugcuuaauuauaaaaauuuacuucauugaaaaacagcacugugcuacugggcaugcucccaagacugggaagaaaaguuucucgcuauuauagcuguucggacagaccagucaaaacagacuucuucuucuucuucuuuuuuaaauccgagacaggguuucucuguauaguucuggcuguccugaagcucacuuuguagaccaggcuggccucgaacucagaaauccgucugccucugccucccgagugcugggauuaaaggcaugcaccaccacacccggcaaacagucuucuauauagcaucuccuuauggccaacaauguaggcuuuccaccaauacugacaaaacagaaaucuguacagacucaacucugaugggaaauucuagauccuuguuccugcacagaaauggcauuggcucccugaagcagugugggugguggcaucucuggaucaugcccaaccuccugacagugucugcagcucuggggucagacugcaugucagcccggucacuacaacuuacaguuugaaugccugggcacauuucucagcuucucaccauugcaacauuaaauaacucuagaaucuaccccauccccagacugccauaaggaagugugcuugcuuagauugcauaucagguacccagugauauuauuugaaaggcacuugcugagugucuucaccaaccaucuccuauagcuugugaucgucaucauagcccuuuuugugacccaucagacaguuuuacagaugaggaaaugugcggagguucuugcccguaguucuguggcugggguaugauagaaccuggcuguuaccugacaucauuaaaauugacuucuuuuuuguccaugagcuauaugcuaaggaagcuuugugucugguucuucugaugcagggacuuucuucuuuagccccacauaauagcugcauuuauuuaugagguacagggugaugauuugggaucugugcucuuugcccaacaaucaacucuggguaucauucaucacuucaagcgugucauuucucagugaugugcacauuccagauccucucucucagcuauguugaacaacacuggaaugcugugaccuguguuuacccuuuggugucacacugugcccaaacuuguaacuuguuucuccugaugaacaacagguuauaugaacaucacggaacaugucaccacauaaaagauaaacucuugccauugguggcaacauggaugaagcugaaggucaaaauguuaagugaaauuaggcagacacaggaagccgagcauucuguuuucucaugcacacauggacucagacguaggaaaagagaggcuacuagaggcuggggagaguagagaauggagagggaaggaaugagauugguuaauggauucaagaguauucuaaguaauacacuuucuauuugugucuauaugaaaucuucauggggaaaugauccugcuacuguuauguugguaaacuguuguuaguacauuucccaugucuguucauuucaugugcuuccuuuuuugggggguucuuccagauaacagguucuugucacuacaaauuguccauuuauauaaccaaagccaaaggucuaggcaaacucuuagguccaauucuuaucccuuucauuucccaguccaaggaguguugcagaugugguugccuuuaucuugagcaucuuggcuuguaggaucgaucgauaaucuuggugcuacuuuuauggaugcucucuagcauagaaggcacaggcaaucaagcguuucuggccaucgcuuuggccuuugggaccacacacagcacaagacucagcaacaagucaagcucaugcuauacuggguaguauagugaaagguagugcuccucacgguggagaguagaguggagcuccacuaugacaggucacggaaaucuucuuaccuagguauaaaucucauuuaaaaaaaaacaaaaaacaaaaaacaaccaaaaaccugggagguuaauuuauucccucagauugacaguggaugacauguucaagacuuuagccauguccuuugucuucaaaugcuacugucaugacaugcaaagacaugucagagcaaaggaugagaagguggaauuaccaagauugaaaguguacuucguguccaucacuggauaaaugugaguuguaugaguuauuuuuuaucagucugauacauuccuaaagggaacagugccaaggugggaaagacugauuuuggccuuguggcuuuuaguucaguugucuggcuuuguugacauggucuaguguucgagaagaacaccauggcagcaaaagcaaguaauagagugaaauuacccacuccaugauagccagaaguagaaauagauugucugcaauaacugacuucuucccccuuuguuucauuggggcucccuggccaugggaugguaccucuccaguucagagaugggcuucuacucucuaugaauggugucucgaaauaaccucacaaacaaaugcaguugugugccuuacuaaucuuccuguguaucuuacuuagaaagcuacugggcuugaauuuggcuccuuccauguuacugcagacuuacagaauggcuccgcaugcaguacaccauacugaauguuacaugugcaguugaaagaauguucugcaauuugggacggagucuuccauaaauauccaccaugagaggcuggguaucugaccugaugaagauuuguuggugaaggaaaguguucuuuuauugcugugauacucaaauaaacccacacuaggacacagggcugucgcucucucucucucucucucucucucucucucucucucucucucucucucucucuccuuucuggguuugggaguagcaauaucaucaguuucauagaacaucaucucuuauaguuugucuucaggaucagaaaaggcaacauccaagugggugaaaagucauggccaggagacagacuuugugccaauguguucuccaugugaccaaauaagaagaaaaugccaggaacucuaaacagacagccaggaccaagcgaaaacagcucgauauuugcuagaggaagauucauucacaugaaugaggagauguuguguuaugacucugucucuuuccuuaucacauucacgugauacuuauuccaaggccuccugucacugucccgaguucuguagaugcugucccagagagagccaugaacucucauaggacaggaauuuauuucucaguuauaccuuugaauaaggcaugcucaaugucuuuucucuuauacagacaaccauguaauuuuugugcucucagucuuuagcagaagggcuaaggagugucuuuuguaaaaauacgaauccuauucacaagggccucaauuucacguucuaaucaaccauguugacuugaaguugaauaaugcucccgggcaaacccccugcccccucccucucccccccuaggcucagguguuucucaguuggcacugcuuugggauguuguggaaccuuuaggaaaugcagccuugacagaaggaaguaugucacaaagcugggggauuuugaaaguucauaacuuacaguuuccuuucuuggcuucuuggguguggauaaagaugugaucuuucugacucccgcucccugccauuguggaaucccugucuggaacuguaacccaaaaugacagucccuuuuguaaguugcuuuuggucaugaugucuuaucgcagcagcagcagcaacaacaaaaagcaaugaauauagcuucuaucaugguucaaaucugacauguagccaccaauaggcuuauguguaaacgcugguccccauccaagagugcagccuucccagacagaucauucagaucacuggagccuuagggagguauuagcugucuagaagagguugguuaguaaagaugugcuuugaaccgagucaccgggcccuugcuucccucucugcuuucugaucugacaaaagcugcugcucacaccaugaauaccaccagccacuguaccucuuucucuuuuaaaggucgaaauccguuaaaaucaugagccaacaauaaacaucuccucccucaggcuacucugcagguacucugucauaguaacacaccaauuaacacaccaccagagccuacccagacacaugcacauacacacacaaacucacacaacgcaucccacccccagaacagaggucaguauuguaucacauggauauggagacauagcauccagucccuaacuuauuuuuguuauaguucaaggauaaaaggauugcccugcccuucaauguuugcacaagggaguauggauauuuuaauacacaauuaugcaaaauaaggugaaagaacagaagggcaaaaaaugcuggaguaggaggggugaccagggacugaacacacauuccuguaagaccuuuggaacuacuguuaggcuugaacuuuaaagguuucaucaaauugaaagcacugcccagggcuggguuggguccuugugggagcacacaggaaacuucagauccaaaguuaguuucaucccacagugugggagaugucagaggcugugagccugagauccuacacaaguuacacaggaacuacaggcaacuacaggaugcuugucaguuaugaacagcuguaucuccauccacaaugccagccuagaaccuguggucccauuuuaccaaugagacaaggcuccuuagugacaugcuuaucuguguauaugcauucacugugccagcuccagcaacccaaccucauguggcagucacuggagcagccuagagucucacuuacauucuacuauuauauagcuuaagggacccgugaauccuaauuucucacuuguaaaauggauauuuuuuuaaucauucccauauuuuaugguaauuguguauauuuaucggugugguaaggcaucucaauacaugcaaacguacaauuggggucaggcuaaugaguugucaaucaucucaaaaacaucauuguguauggaaacagucacaaccuggcggcucucuugugauauguuguagcuccucuuuccuguaugcugccgcagaaugcuggaaguuguuuuuccuguccacucacaccaagggcuuucugaugguuaaaaagguguauacaagccccugggcccaugugccugacacauuaauccacugugcauguuacuuacugagauuauuauuagcccaacaggacagggaggaguauuggggggggggggucccuggggugugaucacuccuguuuacucuuuggauggugccugccuggccagggaucaugaguuuguuuuucugguacggagguugcccugguguucuggagugaccccacagggcugacugagcucauuauacaaagcugugugcuggguccuguccagcuccauccagccccgccuccuugccugcuaagccugugugcccaugagccucagggcugucccuagcuagcauuguuugcacucuggaaaagcgugcaaaccuuuauucagaaccaucccuaagucugcuggcaaauacaguuucuuuccccuucugggggacuagaaggggaaaagcuuaggucuucaguggcuccaagacaauucuuuuaccuucuccacuuucuuuuuccuacaggcucggcucuccagugugguuuuccaacaggagucaaauauuaaaggacaugagcguguuggggaaaaagauggauagugcuaaacagccugaguucauccucacuauccucuucauaaggagagcaagaacaaccccggaaauggcucaugcuuaagguuucuaaccacggucacaccuacaacacacugauugacaauauagguuacaguacacauggcucugcuauuugcuuuuuggucacuuugauauucccugguaccugggaagaaggaaucuccguugaggaguugccuacauuugauuagcccguaggcaugucucugaggccuuuucauaguugcuaauugauggaggacagcuuagcccacuguggguggugccaucuccuggacaugggguccuggcuuauaucagaagggaagcuaagcaugcgccugggagcaagccaguaaguaggucuccuccauggucccugucucugcuccugcccuuaauuuccucagcgaaugacugaugcaaacauguaagccaaacaaacccuucuuuccucucuguuacuguuggucgugguguuuaucacagcaauaggaaaaaacacuagggcagugacguauaagagugcacugugccauugugaggauucaauauccuuagcgaucuucagaaaaaguuuacuauggugccuggagcauuguuauuugcagagaucccuaguggcuccugggccucaguuucccugucuucauucugucuguauuauauaagcaugguguccauagcucuagcucuugcuuaaugauucaacugaguagguacaaccaugcugaccagccaugacauguccugccuggccauagccuggaguuggacacagaaacaggggcauagcugccuacuguguguggcacagugugugucaaacuccuggaggcagccaggcagccaucucuauauucuuccuaucagaauuccuuucacagguccaagccaucuuaagauggauaaaggccuggccuucaggcaaggcuaugccugucaguuccgaaucuccagcuaaguggacuugcagcccucccuguccucuggaugucugcaucauucauacaagggacacguucucuuuagagaagagcgucuucugggcuucucccagguuggaaguguccucuacuucuuucuuccuggcaaaagcacuggccuaagcagcucaggaacaaccuacaauagagggagggccucuuaccucggauggaaguggaaacauagucuccacguuggaacugagucuugguuaugcucugagaaguagccuggauuucuaagaucucaugcucaucguuuucucuggaggcccaacucuguucucaugagcccuggcacguucccuaccagcaucuuuguuuccuaucugaggagugcggaugaugcuucuccugguaagggguaugaauagaauuccugccuguguucuaugugcugaaucccagagccuagaguagggccugggcucuggcgauugacugguaaacacuuguuuuggaagagauaguagagucuuuggaguuccuggcacaaucuucuuggauaguugccugugcccguucuaaaccaggaucugacuaauuacaacuccuccugcuugcauuaaaguuuuauuggaacauggcgguguucacgguuuuauaugaugucgucgagcuucuuugcucccgcacugguaaauuuaauagucaugagagagauauggccgugaagccuaaaauaaaaacuauguggcacuugguuacaaaaauugggcuccuguuuuacauaucaaggccaccuugucugacagugaucauggauuuuguuuuuucuugcgcaggugcuuggggcaauuauaagucagaaaucagaagugagcuggucaccuugagguccauauuuugcuugcuuucucuaugauaguuagaguuucaucgucacuuuauuuuguccuuuuaacucuguccuggcccuguucucccuuguaagguguuacuuucauuucugucuaaagagaaacugaacccaccuguuaacugcuggccuuuucuuuagggacugaccuuaugcccuauaagagggccagggaacuaaaauggacauaacacaguagagucuacuucauagauucaaaggcugggaugcuaggaaguccaggacagaguccaggagagaauagagaauauacagagugcucuucuuuuccagcaucccaaauggcaccuuggucuucuuggagucaacucccccaucauuaaaauggccacaacaauguccacuaaucugguucucaugguggcugaagcaugagaugucuauugcucagagcacaacagaguuguuagauaacauuuagaaucuuuacuauaguuuagaugugagacguuuaaaaagaucucugcuaugugcucuuaaucucuauaauggucaacagccaccacugagagcuaauuagguaggaccuuguuucuggccuagugagggacaucuuccuaggcuaagaagcaucugugaaguaccuugagaucugguccuggaggcugcuuguccuguugcuagccaagcaauccuaugggucagagucacagcauaauauagcuauuagacaauuuucuuuuucuuuuuucccccauccagagaauaauaagcucucaaguuccuccaccucuagcacaagacuacacagggauaucuauagccuacagaacucacugagaaccccauaucugagacucagggaaggagccaagcucaaggcuuagcuugguuggccagucaagauuuucaggugaucagugagcuuucucugucucauuugugguccauuguaaaugaucuagaacuguuucugaguguguagaggguggcuuacucugagaacacuuuugccgguaggcuaauagcuuccaaugagagguccuugagaguaggaucccuugugcuucugcccuggccauggaacuucagagguccuggaccugugagcaagaacacuguuguuuuguuuuguuuuuacuccuagcacaggcaugaacuccugcacuugauucuagucccgcagaacuuguauugcugguguuugugaguggcugcuuucuagaaagcaauaucuuuacccuugcccucuuagagguauacggggagagagaaucagaacuccaguuuacaugcagcuagaguucugagguaaagugacucacuuagggccacccagaaaagagcaguuuggcuguccucccaggcccucucccucugaucauccaaauaugguaacacauggugacacagagccacaugcuccuccugggucuucugaggcagagagcuuccagggacacuuuggaaugaaggaaauagaauccaagagaccucuuucagagaccgccaagcaaaucuucucaagaauccuggcagaauguugucauucucucucugaaagggguggcucuugggauacuguccaggucacugugaacacauagcagaagaaauguccucccagccugcagggaccaccuuuuuccaggccuuccucugcuggaagccuucuuuacucaacgcuuuccccuuugauagucaccucgacugaccuugaagccuccuucaguuuucucuauacacagaaacagaaugucagucuuuuuuuuuuucuuuuuucaagagugacauagagcaucaaugggaggggagguccuuaguccuguaaagguucgaugccccagcguaggggaaugcuaagguagugaggcaggaguggguggguggguggggggaucacccucauagaagcaggggagaugggggaaugagauaggagguuugcagaggggaagcuggggaggggauaaaaauugaaauguaaauacauaaaauaaccaauaaaaaaagagugacauauaaucacuaaagaauauucaaauaagcaaaauuagccuccuuucuuuucuacuuuuuucuccuugcuucccuucuuccuucuuuccucauuucccccucaccucccuacccuuuccucccuccuuuuaaacuuuugucuuuauuuucuucuuccucucccuucuccuuuccuucccucucuuucuucuuccuuccuuuuuccuuuccucuuucuuuaaaaagucuuguuaaauauuuuacauauuuaugcaaaugugcauuuauuuaaauagcaccuggacaccugcucuugguucaccaccagcuugguucuggugaucgacacgaugacacaagauggaugaggcucugcucggcugagcauguggccaguggcggacacagauccgagucaaauuucagaugaaacauaaggagauaacuaacuuggguuuaagaagaacaaagauaagcaaugaagggaaagagaauuaaagcagaacacauccacuuggcaugggcuucaacugagucucuuucuggggacaggauagucaagccaagguuugaaggagcuggcaaugcagggaaaggggaggugggcccacagguuugagagacaccaggcuuuuauuuuaaaaucacuguggcuucugaguggagaauggucuaaagaagggacuggagcagggucagugugugugccuugggacugggaacacucaaacaaagguuugcuuagaagaguggaagcccagaaauccaagggcuuuggugcaauguggcagagaaaaaugagauaaucuacagagaagagcauuguguucuagaaagaguuccaaggcauggccugucuuuacaguacucuuccuagccagcaacaucaggaacuuaaaguuagugaagcugauacuagaauucagagauuggagaugguaagcugugagcuguuauuuugaguccuagaggagucuagggaucagaacagggagacaaccuaccuaaaaucccaguuggagcacuaugggaagaaaacugacuucuugugacccaaauccuugucugucuuccagauuguuccuauccauagcuuugauccuuguuugcccucuccuaucugcagucaaguacuuggaacauuccuuugucaggccugacuucugucaaaugucccccaauugcuucuuccgugcuucugcucagugucuuauggccucagauacugaaggucuucuccauuuccucucuugcaguuuccugauccugcauuuuucagucccuauuagaguuuggaauaagcccuucuuggacuguccucuuacauguccaaucuaugagcaggacauauccaaaaugacaguuucacauuuuccccccuguuccuaccaugguccagccacauuccccuugccuagauuauuaacacagccauuggauucuuguuccuguuucugcuuuaccuuucaauaguuauucuuaaggcaaagcuaggcaaccuucgaaaauggaaguccuacuacaagaccccaacagcuucucaagcccuaaguuucucacauuuuacaaagauggggcuuaaauaaucauaacacccuggacucuggcuuaccaucuccuaaugucauccugcucucucuccccucuaacugcaguucaggguagaauucugucccagguucuuuguaaaugaugacuccucuuucuuuucauugcucaguuccuccucugggccagauaacaauauccccaugauaacauucagacuucccagcaucugaugaugcccgugaguccucuggauagcuuuacuguccucuagugagcuuggugcuuuuucaagugccucacauguuucagcuacucugcccauuucuuugcccaugguauaauaaucucuaggaaacagagauuuggcuugucugucaggaagaagugcacauaagagaugcucuacauagcuauuugggaaugaauaucggguagccuuagaucagaagaagccugcccagaagagaaacauuaauaucugacauaacccuuugcuccuggaccccaagauacccuacuuccuuuuuuuuuuuuuuuuuuuuuugacagaaggaugcucccuauucucuucugauguuugccaggaugucacagggauacuuucuccucagucuccauuuuacugcuaagaacaauuuucucccaucugaaagccauagagugucaggucagucacaaguggggugcuguuuuaaaguguggaagaaccugguauaagacucccugucaagacagcuaccucucugggacaaacaccaguaugagcuaggaccaaugaucgccuuuaucagaggaggaagagcuggucaguuccuuugucauucucuccucccucuccugguacaacaugaucagugugcugcccacgggacucccuuccugcccagcuugggacaggcuggcuucuuccugccuggcuugggcuuugccacugccuaugccacucuguugcucuguguguaauguguggaacugauuuccugucugagauagcuuuuguuacuaaaccuugacagaaacuuaaaagagaaagaauuuauuucaguguauggugucggaaggguuagccuaucauuaaagggcagguggaggagaacagccuaaaacauggagaugagauguggggaaagguaaaaguuuggucuucuagcaacaucccccuuagauuggagucuuccccuuugcuuaauuuucugugacccuuagacaaucccagaauguggucagccucucagggacuguaaaugcagccaagauaauaaugauuaacuguuacacuccugaagguaaggucaaauccuaaccuucagaaccugugaaugugaccuuuguagaugcuaaguucagcuaggguuacacugaagaauacauauggcaagaagguuacaggcagugggaggcaggaacguaacuggugcuuccacaagccauggacugcaggaucuagcagguaugaggaagagguguucccuguggagucaggaagaacaggacucugcucacucauuguuuucauaauucaucucuguugucuaaagucacccagaugucagcacuuugugauagcagucacaagacacuacaugcucccaaucaaguguccccuagucauccugcagucccuggaaggguucauucuuuaagagcccuuacuaguucagaggcauaaccuuugaucccuguaucuacggccccuccuggguuguggcuggggagauguccaggaugguucccuggcagagcccaagccuagcaggggugggacaccagcacguaucugcugaguaaagucauccaagaagaaccuucuggacucucugugugucacaagaucagcagcaguuagaaggcugcccugguguuuccccuggaaauccucuagcgcuuuuauucaaauuaaggcacucaaucugugagcccaggccagagccauaguaccccaguggacuuuccaagcaaguugguucuuacuggauauggguuccuacuaagaacagggacccgaaaugggguucauuaaucagagagcaagccuuuaaauagaaaaaaaaaaacaaacaaaaaaaaaaaaaccaagauuaaaaccuccagaaauggaaauucucucauacuuacucuuccuccucaacuucccuucuuugccucccaucucggaccuccuagccugcuuuccggggucacagugggaagugacccaucucagacuuccccacauuugguugguuuucuuccaugagcuuuaggcagagauguauacauccuccugcagacaggaccuugcccaagugcuaucuaccuaucugacucggcugccgaugcguucaaaugccuugggcgaacaccuacugugugccagcuugucuaugaaguauguuccugcucuggaacuucuauuguaaaguccagaaacuuuggugaucucacuaaugcuccuuugcuggugaagaaauaguaucuuagggaaauuaguuuacuuauggccacauagccaguuagugauggagacauuuuuaaacgaaguucugucaaauucuaaagacaguagguuuuggggguuuuuuguuuguuucuuuuguuuuuuguuuuuaaacuuguaacucagauguuugaaaagggcaucauuguuaggucuuagaccaagcaagaaaugauggcugucccuuugcuggccaggaagguuugggcaaguugauuuauaaacauggcaauuuugacaucuguucaacaagacuucaccauuucccucuucucgggguuguccgguccccaagcugugcuugaggaguauugggcuagccacuuccuucccacugcuuugguuuucuuacuuucaacugagaauuuaauuccauagccagacugacauccggucuggauaaucuaugaucuuagcauccuggggucauuguugcugccacauuuaaaucucuuaaagccaagccuucacauucuguaugaagccagacuugcaaaguauuuaucuaugcggaucccuucugucacaagucccuugcugcucaacccuuugccucuuacagacucucugggugucauuuccacugcuugagggcugguggaugagagaagggauuugggcaaguuccuccgaguucuuacauccacugccuaaaaugaucucagagaauggaaggcccaaccccuuuggucuauuuuaaggaugaaauaaaggaagccauugcucauugccuccugggcuucauauugugcaaagcacuugguaagugggcucugugggugaauggguuggaaucccaguuuugggauugcacugcagaugagcagaguggugagucgaaggggggugggggaugcucacagucaucuauaagguggaacacagggcccccaauugagaagcuauagagagcacccaaggagccaaaggggucugcaauccuauagguggaacaacaauaugaacuaaccaguacccccagagcucgugucucuggcugcauuuguaucagaagauggccuaguuggccaucacugggaagagaggccccuugguauugcaaacuuuauaugccccaguacaggggaaugccagggccaagaagugagaguggguggguggguaggggagcaggguagggggaggguauagggaaauuucgggauagcacuugaaauguauauaaagaaaauaucuaauaaaaauaaauaaaaaaagaaagaaagaaaaaaaugucuccaugccucugucuguccucucaucaugugaaaaugugcugguaagcuuggucuucuuccaggccugugugaguuuaaagacacccuucuuggauggcaugugaggcaacgaaggacauacgaaacauggcaagaguccaugguugccaagcggcuagccuaaucagcagaacauggucugaaaggcacggugccuaaacaguguggccaaagacagagagccaaaaccuuggacccagguuggugggacaguaaacaaaaaggcucauaacauuucgucaaaaugacacuagaaaugagaugacguuacacuuagggcugauugaucuguggugaccaucuuauugagaaauuacugauugucuucguuuucugugcuucauuguugaggcaccucuuuuccucuuuucccccucccauaaacagguucccaugugcccugccaccugacccccagguggaaccugaguucugucccuaagcccagcgagaucauauuggguuccuaaguaccucucuagggucagcuaugcacaucuaugaggaccuguuucucuccucaaauguccccuaggcugugagagagcaugauaucuaauugugaagcccaacccaccauaacaagucaagaacaugaaggaaaaagaagcuguuuucucuucuuugaacacacauguucauuugacaugggccuugcucauuauguagcugugccugggaaccugacaggcugcguugagaaugaaacaguggguccuuuccccuucagagaaauacaaaugcuguuccauguacaguaauucagagcugcuugcucugaccacggggccuccuacaccuuggcucccacucugugacugagauucauacaucucaacucugcccugacuucugacucacaggcaaagagaaagcacagaagguugguccuucuuguuucuucugaagccuucugaagcacccuugagcccuugaauguugguccuuugcaaccccagucugcuugcuccuguguaagagggaaaucuccucuuccuccuccuccuccucuucuucauucugcaucuccuccuucucuuucccuucccuuccuuccuuccuuccuuccuuccuuccuuccuuccuuccuuccuuccucccucccucccucccucccucccucccucccucccuccuuccuuccuuccuccuuccuuccuuccuuccuuccuuccuuccuuccuuccucccucccucccucccucccucccucccucccucccucccucccucccucccucucucucucucucucucucucucucuuucuuucuuucuuucuuucuuucuuucuuucuuucuuucuuucuuucuuucuuucccucagcugaauaguacccccuuuaaaagaagccgugggcaguuuuucaugcaaaaguaaguguacuguuaauuuuccaugaaugugaugaagagagaguuuauuugggcugauggucccagaggguuaagaguccauuuugaaggggagguacugcagcaggcaggcauggcuucugggaaggguaagcuaagaaaucauagcuuaaccacaaguaugaggaagaacaaaugaacugggaguagagugaacuuguauaaucucaaaguccucucucucagugauguacuuucuccaauaaugcugugacuccugaaccuaccaaacagcaccacugaccagggaacaagucuucaaauacuugagcugaugugugugugugugugugugugugugugugugugugugugugugugagagagagagagagagagagaauuuuucacucaagccaucacagaaagcaucucuguaugccuaggaaggcuggugcccagcuguggaagccuaagaaguacacuucaaacccagggguauggugccaggaggaugcccugcuggcuagucucagcaccuuugcauguaugccuguaggacuccuaggagaagacuuugcaccaugugagaaauagacagaucauaaucacauagggcagaaacugagacccaggaacggaagaauuuugacuguucucccaugccagaggaguggagcucauugaggugagagugcagcauuggaagccaauccaagcaauugccaaugucuguccagugagucucagcugcagugaugaaugguguuuaucacugggagcaaugagacacaguguaugaagaggacagaacauuccagaaagauaaguauguagauuuaguauacuaauaaagcugguaaaggaauggaauggggguaggggagagcauugacccagauucuuuuuaauuaaucaauuauaccuauucacuuuacaucccacucacugcuucucucaugcaacauauccugaucaccugaccacaguuucugcuccuuccacuccucccagcucccucugccccccaccccugcugccaccucccuucuucuccagauccaccccuccuccauuuccauucagaaaagagcaggccuccaagagacaacaacgaaaacacuacaaaacaagauacaauaagacaaagcaaaagcccacauauggagauuggacaaggcaacccaacgggaggaaacguuucccaagaucaggcaaaagagucagagacauacccgcuccugcuauuaggaguuccacaaaaccaccaagcucccagccauggcacacaugcagaggaccuagugcagacccaugcagguccuuugcuuguacuucagauucugugagcucauauggacccuuaguugauuuaguggaucauauucuguucuucaggugcugguaaucccaucugacuccaguaaucuuuccugccccucuucugcaaugucccaucugauuccaauagucuuuccugcaauguuuccuggggcuucaaggggagggaccggauggaguccuccacuuuagacuuagauucuugaacacuguucuuccuuugagagaucacugcuuauagggucagucugguccucaugacaaugguugcaucacacaacuucuaaguucccacuucagcaacuuggucuuguggaccaccaaaugcagccaaaccuuuuagggcauaauaagccuguuuccauucuucuuaaagcacagucuccauccuuuccuacuagaaaugugccuguaccagcuaaacaggcuucuuuguuuucccaucuaaauuagaaggaauuaaggguaggggagucagcuuugcccaggaauauuuugagugacuugcuguuucucagagaagauaccaaauuaaugagggucauagcucagcuuagcagggagauuuccacaaacuaucaccaauuuuuaaguccuauuuucuguccugguaucaugguucuuguugugaguccagcacuuccaagaaccaggaggauucaaaguauauaauuuauugagccuuacaucuauuuacacccauauucugucauuccaagcaggacuauaggguuuguccuucaacucacacaauucccauauggguauuugugauuucucucccuccccacuuuuuuuuuuguauuguuuuguuuuguuuuguuuuguuuuuucgagucaggguuucucuguauagcccuggcuguccuggaacucacuuuguagaccaggcugaccuugaucucagaaauccaccugcuucugccucccgagugcugggauuaaaggcaugcaccaccacgcccagcucccuccccacuuuugacagagauuaucacagcuugauuucugucacugggaacucaccuagucugccauaacaguucuuagaacugggaucauuuuuauuguuuuaugucugguuuaauguuucugagauucuccuacaugguauacauuaucaaccguucuucacagauguugacaaugccacugccugacucaccugcacugucuacucuucccuuaugaaaggacuugcaguuguuuuuaguguguggugacaaugaauaagacugccaugagcuuccaagcacaagcccuuuucugaacauauguguuggggaaauaccuagaaauggaaacguuaggucauaugcaaacuguauuuuuagcucugcaagcaagaaccaguuucuccaagugauuguauuauuuuccacucccccaugacugagaccuucaguugcccaaugucuccaucuggacuuggcauuuacaaucuaaacuugaucccucucaugagugugacauggccuuucacuagaguaguaaucuccaucucucucauggcuaaugacagucuggccccuguguugaguccaugcauccucuguguagauguacccaagugucuccugccuuggaaaagcaucuccuucaauaaguauaagaaguuuuuauguuauguauucuaacacuaguuguggaugcaaauauuuuuuuuccagucagugccuggaaguucuaaaaagccuaauauuagacuuuauugucucucacuuuuguuuagacucacagguaugucccggcuucagaccuugcaaugugacaauaucuacaaaguuuaugggcaagagucaugcuugauggaguuaucauugaaccuaccccaccuuuacucccaacaagacgcacaauucccaaacacccugaggcuagaucccaggcuuuaugacauaagcuccucuuaccccugugcacaaaacauucuagauaauucacggaugcggucaucucucaucugucugggaaugccauauuugcaggagugugucucaugacucugcaccaugugaagaagggucugaaugaaauuguuucuauuuccacauugaggcugacaggagcacaccaagcuaggagugaugacgaugggucuaggcaagcuugcagacaguccugaucugggagcauggagagaggcagugggcugugcuaguuucucuauagcugccucaaagaagggccuuucugaauucucuuaagaggagcuuagucauauagccugggaacuggccucagggugcuagggaauugugaaccuuguuggugagggaugaugggguagguucaaugauaacucaaucaagcaugguccuuguccaugaacuuuguagguaaugucacauuguaaagucagaagucaggacauaccugugaguucuuucugugagccuuuucuccccuauagcuuuguccuuucugagcaugggaagaguccccaagaugaauagaacuaugagagguuguggugaccaaugccaaccacagaaaugcagguuauaaugguggaucuuucugagcccuuguuguguagcaacuuugcauacccauugaguccccagguccugaguaggugcauuguacucagaaagagcugagcccuuguaaauccucaugagauaagaugagcuucagagaggcugagucauuugccuaacguuacacauuuguaagugguucaaguuugaauuggguuuagcuaauucuaaagcuccaugguuuuaccguuacacacuauugauucucuauucaaaaucucaugucaaaccauuacacuguguuaugcauggaaggaguugccuuggucagggguagaugaagcugaauauggcccauuucuggcuuuggacccuuuauugcaucaaaaucaugacaccccacaaugaaugucuauauccuggaaaucaguaccaugaccaacaagacuuuugcaguuagggcucuugagaugggaucaucccggaugguacuaugguggcauacuccaggggcacaugcuuguacaaaagauagaauaggagagaggcaagcacugaaggucagacacuggagugauaugaccaaaagccaaggaaugccagcaccgagaucgucaaagacuucucccucagaacauuccauucacugugagugaguuaaagauugauccaacccuccgguggaagagauuggacgaggacaggaaucccugaguuaucacauuguccacaggcagguauguuauagcaccuacuaccucccuggcaguccuaugaccucuggcucccagaaccugacuaagcacucauugggagcuaacauugacugacaccugacugcuggcuaccagcuagacucuucacuuguaacacaccacaugguauauuguucaauuugccacaggaugguagucuuaucuuuagaauauagaagaggaaacugaggcucgucuuaagcuacuggauaucauauuuuggccuugucagucauuugaaagcacagcugacccuguguaugguaugguuucugcuucuguagcuuuggauagggcuugagaaccugugugucagaugaguucucaaaagaggcugauggugccuggcuguggaccaugcuuuuagcaauacugaagagccacuccugcaguuucaaugccugcaguugcaacaagagucagaccccagaguuucaguggguuagcauagcaacugucucuugcuuaccacauugugguccuuugaagugcugugcagcccccaucaugcagcaacuuccccacuugaaauguauggccuccuaacaucucuaugggagagaaaagacaggccacaaggucaugggauguuuacacggcuaagauuagaagugacucuuuagcauuugcucauacaccauuggcccaaaccuaauuaaaggacccuaaaaccucuugcagggaagcugggagcuguagucuucccagaaggacaucaugugauaggcaugcagauggccagcaccaggcuggguugaguccaggugcuuucccccuuucauccuucacuucuuccaaugguccaggggcuuucccaggccuuuucauaugagccaguguucagguacuuuuguguuugagugugaaagugagagaaaaccaaaguggagacaucucuuggguccuucaguccauucucuugcaggaacuuucuccucuaaggggagucgccugagaccauggauauuuacacuacaauucacaaugauagcaaaauuacaauuauaaaauagcaaagaaaacauuuaugguuguguguuggggaggucuccacaacaugaggaacuguauuaaagaguuucagcauuagggggguugagaaacacuggucuaauagcaagagaugcaaggaggcagaaacauuugugacauuggccugagauacugaucucagggauguagccauggagugaaggugcuuguuccacuaguguaagcauguggaugcugaaauuuggucaaagugcacucuuuucaccaauucuuucauugcucuggcaacugaggucugccuguaauuucuaagugcucuagaucaauuaaccugcccuuuuguuauaguuaggguuuuacaacuaugagcagacaccaugaccaagacaagucuuauagggaggcugacauacagguucagaaguucaguccauuauccaggaaggaacaugcagcauucaggcaggcaugggucaggaggaacugagaguucuacaucuucaucugaagacuacuagucaaaugcugacuuccagguagcuaggaugagggucuuaaagaccacacccacagugacacaccuacuccaacaagacuacaccuacuccaacagggccacaccuucuaauagugcuauucccugggccgagcauguacaaacuaucacaucuuucuauuucuucuucuuuauucucuuggcucaucucuugguagaaccggcaucuuaaucuccauggcuuuagccaugaaggaacgauugguguuaacucugggcuuaugcagaagggaacauagacaacagccaagugucucacauggacuccuuaugcuauuggcucuuugugucuuagaggaccugcauacaguugacagauuggucauguuccuggcaauauagaaaauuguugcgaugauuccccauuuuucacuccuuccuggcaguugucaugcuaaggccaugcugcuuucugagcaggaccuucucccuugcacuguaaaaggaagaucaauggaaguguuaguauguggcagagguucugcuggggauuuccacauucuucaccaccauccuaugggaaagauguuauuagcucucugcugcuggugggggauuugugauguaaauauuuccauuuuauccagccaguaagugucuucuuguuauagagagucuaucugcuaauuucuuggucuuguaugugcauucacuuaccccuuuuuuuucuccaggauuuuggcauuagguuuuuaucugcauugugcauccuauguccuguauggcuuugcuugcggcucaggaguacuugcaguaagugcuuccgaaucuggacaagugcuaauuuguuuguaguuauuuccugaagggaaaaaaaauaaguccauuuauguuuucucuucuuuuaucuuuccagacccuuaggggcccauucucgaugguaccuuuggagcagauguaaccaagaaaucaauauagcuguuagaguuagccauggcaaccguaaugccacuauauccccuacuccguaauguugacagagauggcagagccaggaguaggugaaauacucagacaaggggauggggaccucaaaggaagggggaauuaaaaccccauggagccucacucagaaaaugaaaaacugucagcugugcccuguggcauaaucaggucuucuuacagagagugaagccauuaggcuugaugucaggcauggcagggguaucggcaacaugcagguaucaugaggcccuucucgaagaugaaauuggcagcugcagggccagcagccugccccacagucuuaccuuucacuuuaaauaccaggggcucagcagcuccagggguggagggagguugggcagaccaagcaacucccugcuuucguugcauuugggcucuuguuccuguggcuguuacuauuguugcuguaguagaagagaaggauucacuucccacuucuaagaccagagccuggugcacggaaagcccuggcaggguaucugaauccugguagccuugucuacagaguacauucagccagccaggagugacuuacauaccccagccuuucugugugucagggguugcuccaggugaaagacugagugaggacuggguaggaaacagaacuugcucaaagccccaacguccuuccacgauccuggaaucaggcagcucaugucauacagggagcaaauauggaacauacugggguugcauuuuaccucaacguggaggccaagcugccucugggaaucccuccuuccuuuccuuccuugguguguaguuuuggagugguucucaagggaaauuuucuuucuagaaagacuucucuguagucuucuucuucuucuucuucuucuucuucuucuucuucuucuucuucuucuucuucaucuucuucuucuucaucaucaucaucuucuucuucuucuucuucuucuucuucuucuucuucuucuucuucuucaucuucuucuucuucuucuucaucuucuucuucuucuucuucuucuucuucuucuucuucuucuucuucuucaucuucuucuucuucaccuucuucuucuucuucucuucuucuucuucuucuucuucuucuucuucuucuucuucuucuucuucuuuguuauaacuuaguaguagaaggguaaggugccaaggugugugugugugugugugugugugaaagagagagagagagagagagagagaaagagagagaaguugucaccaccaauauuauagguuagguauccauaaucucacaaugugaaauccaaugugcucuaaaauugguaaccuuuugaauucugacagaaucccaugaguggaagauuccaugccauuaaacucugaauuuuaaggugucuuaugaggucaacaucacgugguauauacaaggaauauaugagguauauauaauacacaaauauaucugcugcucagacuuguauccuacucaugggucagacauuagcucuucaaguaguaaauuauucuggauaguuuuaugucaauuuuacacaaccuauagcugucugagaggagggaaccuuaauuaagaaaaauuccuuccuaagaccagguuguaugcaggccuguaugcaaucauuuaaaaucagugauugauggggugggacccagcccauugugggugggggccaucccugggccaaugguucuggguucuauaagaaaacaggcugagaaagucacagcaagcaagucauugagcaguauaccuucaggucucuucgucaaccccugccuccaaguucuggccuuguuggaguuccugcccugacauucuucagugaugaacuauguugugguagugugugccaaauuaguccuuuccucuccaucuugcuuuuuuguucauaguguuucagcacagugauagaaaaccuaagacaaguugguaccaggacuguaggguuguuguuuuggggaggguuguggaaggacuuuggaacuuuggacaagaaaagccuugggauguuuaauucuuguuaagcuauucuguaggagcuuggaagauaagaauguugaaggcaaugcagaagauggaggucuccccugugaaguaccagagaaaagucugaagauucuauuggggauguuugcuauuuugaauuacgauucuuucauucugcaagcuggggcugaagaaucagcuguaauuaacaagauaucuguauggcuagagugaaaucuuuguuuugcuggaauacucggugcuggguuggcuggaacuuagaauuuagcagagauuaagaagaggccagcaucauugaggcaaaaucuucuggggaguguuuccugagagucagcacacagaaguuguguucuagagguggacacguuuguacuugauacugacaggugaacuugaagagucauccaggugguacuaguuuugaaaacauaaaggaaugauagagagcagcugaugcuuggcacucugagaagucaggagagaccaccgauaaaaaugcagccucauaggcaauugaaggcccaggacuaaaggggucaugcagagaagcugagguuuggcaucaagagagacuaugagaggcuaugagugaauguacagcucaauuguagcagaagacugcagcauuuuggagaugccaguaccaugggaugaccacaaaggucagcagcugugguggaguggagucagccagaacccagaagacaagcugugugugcugcagagaguagagguggagaagugaccuaaggcccuuggaggaucccagaugauugugagugaauccuagacauuggauguugaauuauguaaaauuuugcaguuugguauugcuuuuauuugauuaugucuaugcccugauuuuucccucuucaacagggaucuuacuggaccuucuuagguacucuuauuauuccuguuuccuagauaacaaaacaaaugcuccaaaugauugacaacaugugagccccgacugccuauuuuauuccugauucugguuguaaacaaguuccuccuccuccuccuccuccuccuccuccuccuccuccuccuccuccuccuccucuuccuccuccucccauuuguacccauucauuguggauaucagaucauucuuucagaguccugaugucuacuucauugucagucucucugccaucuggguccuccagauugaaacugacugugcucccuucuugccccacucccuacaaugucuuuccuucacacacaaaaaaccacaaaaguccuuaauggagcagaacaguccuccugacuguacccugaggacucuacuauucuuaucucuugugucuucuaccuguuuccaccaguggacugguacaggccucaggcaaagggagggauuauucuuuuccugauguguuuucgcucugcagagagaugcaggguuaacaaaucaaacuucccuguggacuuuaagaguucaagaauggguuguuggaccaucccuugggaacacugcugaaaaaaaaaauccuuguauugggugggagcuucauuccaaucguauauugguacagcuuuuuaaaacacauaauuguauaacguaagagaaacccaguuuuucaacuguguucaggucucaaauucuauuugcucugugaaagacuauauugacuuuggaaaguaacuuggcaauauuacacuacagcaacuuuacucccaauuaugcucccuggagaacacucaugugcaaaggaaagaaugcaguauuuguaauccuaaaaaaaagagaaggcugaauuaaauauccauccaugggagaaaaaacauacagauuugugugaaguuuucuagaugagcuaacccucacauggagacaucucaaaaacauggcagaauaaaaaucauaaauagugccaugcauuaugccugcuaagaucccaguaggaggcagaaggcacgagggguucuagaaagaaggaaugaagacuuucgccccagggauggcugggcuagugggcuauuggcugguuuagagauuccuguaauccuauuguguauuuugcuucaaaauuauucccauuuagaccauuuauuuucugacuuccuuuuaaucuaacauauccuuaugguuaauugugauccacugauuguagcaagugugauuugggaugggaugauuugggaaacucuugcucucacucucuagggcauuuucaaugucaugggauggagucugcaucaguucacaggcgagcccuuaaagagaaagaucugccaaaggucagcacuaggugacccuugcuuacugcaaaugguaagcugagcccaaucaguaccacuugaagcagaaacagaagcucaucccagcucagcaaaccaacccguaugauaggagcaaaugaaguuugguuaccgcuuuuagccuuuaacuuuuguggugauucauuauaggaacauaauuaacacaaaagagcuaaaaccaaagaagagaaccuaugaucucuugaagauagcaagguagguauuaccagaaggaucaagggaagaagcagagcuuugggaacuucacuggagagggcauaauggauagauagacuuuagauaggcccuagaacgcagaacuaugauggcaggcacaggauggagaaggauggucuuuagaggaagaauuccacaccucuaaaauuuugacugugcuccaucagaagcagaaagcaaaggagucuaggaagggucuuucgcugcagcuagauucuguggcauccccuagagagggaucugagcaggaaugggggacagggaagaaaguggacuuucuauuguucuugaucgauuggcuaugugaccacaguaaggagugagauaccucaaaugggguuggaggucaguucugggaaaaaggguuuuuaucuuuaauaggccacagacacaaacauauucccuggcuuugcacaauacugcuuuugugugcuugaacucagucacguguggggagaaguugucaauaccaaguccuacaaugugugacuuaaaguaucagguuacucuuccaacacuguuuuuuggcaaaaugaaucgaugacauuuccuucauggggaccaugugagugugggacaugguuguagaaaugugggcacaguggcuacuaccugauugauuuucagugaagagaacaagugagcaagcuuugaggugugucgguguagagugugagaaggcuugauaucuuuccaucucuguuguacccaacccucuauaucauauagacacauacugcauacacacacagaugagcaguaucuuaggguuuuauugcucugaagagacaccaugaccaaggcaacucuuaccaaggcaaauauuuaauugugucuggcuuacaguuucagagguucaguccauuaccaucauggugggaaguguggcauugugcaggaagucauggcgcuggagaaugagcugggaguucuacaucuugaucugaaaguagucaggagaagacugucuuccgcacuggguguagcuugaccuuauaggugagaccucaaagcccacuuuaacagugacauacuucuucccacaaggccacaucuccucuaauaaggcuacagcuuuugauagcuccacucucugugagccaaguauuuaaacacuugaaucuuugggggucaaaccucucuaaacuaucacaaccaggcaaacacacuugugcacaugcauagagaaaucaacuaauaaggccuuggaggcccuugugggugcaggaagaagucaaugccuccugccccugcuccuauuugucauuuucuuugcagaccugucuucugugagcauagaaguaagauaguaguguuuucaugugguaaagacagcaagugugucaugcuaaugcugugauaggcaccacuuacuuggcaguucuuguaccccaguuucggugucagaacaagggaguagugcuaguccucuccugcgcauguuguuagggcuuaagccacuucaggugacucucuuggcauuaggucuggcacauaguaggugcccaauaauugcugauguugcuaugcuuucccuauguucauagaauaauggcaaaaaugaugaugaggagacucccuaaucuaaguuagaaucuggaucaaccacuuaaaaggagaccaguggccauccuguaaaauacgcaagcagcuuuaugugaaaaaucuguaacuacaaauuggacuuccuggugacagucaccaugaaaugaggcacucugccaacagucagggggaguggccuccuuggacauggaucauagagucucuacuuccagauacccagagcuucagagccagagacacccacaaagccucagccaaauucugaccauaacugggagauaauugaaguguccuguuaugagcacauaaauuuuggcauuucccaugacaccugaaacuacagacccuguagauauugaauuuccuauauauucaugagaaagaacuccuugucuauuuucaagaacucagagaguuuauuuuacuguguucuuugucacaucaugaucaccagccuuacugcuuuugugcuuuggagcuauuaucaacuaaaauaaagaugacuuggcuauaggcucuguaagcaugguuuuuuuuggaugaucacuugcuguguccuaaaggagaagguagugcauauagcaaggcuacgcuacaauaaugccugauucgcaucagaaguuucucugcacugcuaaaaauggcacucaauguaaaagcauaagcauucaauccuucuggaauuuuccuugaucuuuuaaaacuaucgcugacuacaggaaauggaaaccucccaaaaaagaaacugagaggucaaagaggucuguguaagaccagagguagagagggaagggaaagggcuauacucaggcuugcuagggacaaaauccuuagccgugugugugugugugugugugugugugugugugugugugugcgugcgugcgugcgugcacaauuuacguucuuguaauuacucauucccagacaagaaggucagugguggagaaguuuuccuaggccuuuuugcuuggcacagaaguggcagaguuucagacuuaagucuuuccacuucugggaccugugucugaauaaaagccugguacaauagccaguaagucagcuuugccuaaacuuuucugccuucuacgcugcccuuugccucuucccucucucacuccauuccuuuuuccuuugcagcuagggguggggagugugugacaaaaugguccugacacacuauuugucuauaaguaauguauaagguaaaauagagugucuggcuuuuuuuuuuuuuuuuuuuuuuuuuuuuuuaaauagcugucauagcaccuggucuagguaggaggcucagaaucuauggagacugauagaaguguuuuucaaauuuagcugucaaagccagggaaaucauccugccuccugccuggaaagugauuuacaauuuuccucuuugguggcauccuaaagcaaacagacacuucuguuuccauggagaaaccgcucuucucucuaagguagaggaccugccccucccucuuuucccucuucuucucuuccuuuucucccccacugccccucucuccuuccuuucuuuccccauugcaaucuuucucucucucccucuuucuucuugcuauuccucccuucauacucucccucauuucccaauuuccccccauauccugaggccccugcucugugucacgaguuccucuacuugcuaagaauucagaaaucauuucugcucaugagaaacuuccagucuguuuaagagagauaagcuaagcaaauaccggagggugaaugggugagaaagggagucauuaccugggaggccugaguucuucaggguggaguuuugaaggaaagccauuguuucucagaggaugguauuuugggaaacagacagugcucucugccccuuccaagggaacuauaagaggucuuagagcucuuuguaugacauggcauggcuguguuuuauguuuacugcuuuguucuagaaagauucaguugaugaacugacaagagauauagggagugagaucaggaaugggauccacccccuccuuauggugagggaaaggucuaugagagcagacaaacauggcugaucgcuuguguagcucagagaccagagcaccuuuuccaucacucgucauuugugugcuguucagaagcgcagggcucagagucaggcagacuggagauguggguuaaacagcucauuuaagcaaaagaggauuuugcuuuguuuuguuuccggagaaaagagcucacuauggaagccagguuugcuacagacuuggaguucacccccuggcucagucucuuaaauguugggauuaugggguuacuccaccuugccagaaugaaaauaugauuuuaaacuaucguuuaugugauuugguuuccaaaucugcuaauuccccaauaaacaggacugcaccaaggauccucuucagaaaggacagcauugugaccagugggcuucuuguccaggauaauacacuuggaauucuauauaaagucauaauuauuacaguaaaaagaaaacuccugaugcucaccccaucugaaaacauggcaugcuuggcuaaggugacuauuaauguacauugucauuggcaucagcauugcaggcucagucuuugggagagccaagaugcgguucauuugcauacuacuuugcauucauuugcauuuuucuccuaugcaaaaucaaaugcagcuaauuagugcaaccuuguuacaaugagaagcaggcucaaccuucugugccagggcagauggaggccagagcagggauugaaaccaccuaaagccaggggguggacaugcaaggagaccugacaggcaaacauagaccgugaguuaaauguaggaaugugaguugcaccauuuucaaauauugucugucucuuugaaguggguacuggaaaguuagcaagaucagagaaccuagggagggagggagggagagagggaaagagggagagagggagagagggagagagggagagagagacugauugacuuaaagguggguacagauguaccuugcacaugauuugggucucaaagaccuuggaaaaagucagguauggaguucagccuuguuaacuacaagcugugggaugcuguacuuggggcauuguagggaugggauaagaaaaaaaaauggacggcaaugaacuuugucaugucaaugcaggauauaaguggguauucuaggcuauuaacauggagaucagcugacgauggagguucccagugucuucacaggguccugccacuauacuguacgugagagggucgcauacaucucucucucaugcacacauacagauacacacccuuagaugcacucacacacagggagagacuaacuuuuagauuuaauaaacaucuaaaacauaagaaucaugagguacguauauuacaaucacuguuugauugaaugauuuccacggccauucuaagaaccauuuauuacuuggugcugcuaaggaagaccaugcuugcccaggaugucaggagacuauggcaaacuguuagaauacccucucuccugaacaauaacagaaacauucguccaguuuccccuucucuuuuuuguagcuuugauguagucaguggcccaucugcuagccuacucucuuugguccugaucauucugaucugguugugaugguaguucuuugccaguugaggacuccuuuuuuucucaacuggucauuuugguugcucucucagacuuuagcaccauguuguguagcucaggacgccccauuccgcaaaggaaccugccagucuaccuaggggauugcacuaccauuucagugugaccaaaaguaagagaauagaagucaaugcuggacagaaugucaccauauuugacauuccuucuugaugggagagcagugcugccaacagaauuugcuccccagcccguccuggggugggagcaauugguggcagucacgggcaauuggcaaugccaagucacgaaacaaguaaauuguguugcaaaccuucgagauuggcuguaugaccaccacaucugcucugcaaggaaacacccaucucuacaucauaaugugagauuggcuugugcagaauggcuuuucagcccaaagcuccauauggaaauaguauguuugacaugcugaaaguuuagauccauaguccaguaucacugccuugacucgaaauauguuauccuccaagguuugaaagugugaaaauuggaaaaauuagcuuaucauaaaagguaaaugauuuucuuuguaacacguuugcauauaucaccauuuguugaccaccccccacuggucucaccugucucucuguacaucacauauauuuuauuauccucucuuagugcgucuccuacuuccuuucccuccccuucagggcaucuccauagucuccuuucuaccuuugugccuuacagaauaccuguauguauguguguuaaguguugcuuuaaaaccauaacaaucauacugcuacugcccagagcagugaaugcucugccaaauuaucuuauuugguuuucgacaaaagccucacgaggcagguaguuuaauuuccacuucccagacuaauaaaaaacagaaguucaggacuguuccguaaugcauucacaaccacacaugcaaggagagggucaagauugaagccagcauuccucucgugcacagacccuaaucucauuacuuuuuacucaugcauuuccuccccgagcuggauacuaaccagcugagccacauaccuuacucaacagcgauggcugcaaauacuuuugucugcuuauauguaaagcaagcuacuuaggagacagugaaaaugacauuagacauaauacagaggcagagucugugugcaacugugucuugaaugcuuagaugagauguuuucguuucuguaugcuaggaucuacaaaaugcaucccguugcuugagcccacuuguuacgaggaccuauucacaguagucacucagcuguaucaaaaggucaugaaaaacauccuguggaaaggcuuuuuuuuuuuuuuuuuuuuuuuuuuuuucugggcagaggaucuagaguauuuaugagucacuugaaggcucuguuucccucuagagaugagacauucuaauucucccaucuguugaguuugacuuaccacuuuccccagaggagucuuggaggcaaggagaaaucaugcugacuaaauggugguugaaauuuguagggugacuguucaguuuagcagagaauaacuagaaggcacacuguaucaccgcauuugaaaaaucauuaaaaauguuccugcuucacauuccuguggcuccuuaaacucaacccuccagaggaccuuccucccucccccugccagcuaaagcugugucauucugagcuguggcuauuggucauuuccugucucauccauccaaaugcuuguuuuauuaugacugccaugagaaugggcucugagcuagggacuggguuucacagccauuggcggauguguuuccuccaaugugggagcagagggaaagaaugcgggauucgccuucaggaaccugcaugcagucaccagcucucugcuagcacuugugcucauggguguacuacucaagcaugucucuuucaaacuguauuucuuuuuugaguacuuagaauauauuaguccucugcuagauauugggaacuggaaguacacaaaaauacaauaaaaauagauccuccuauuuuuagaauucugcucugaugggagacauaaaguacacuaauaaaauuaguacagauguauguugguaaaauguaugcuuugcaugugcuaauuuagagaaggaagcaugggguuuugcauaguauaguuuucuauauuagacaacuauaaugacaugaaaucagcuuuaaaauaagccuuucuccacuccuuucuuucccuuucccucucucccuuucucugaucaucaaguucugucaauguaucugguaguguugauguuuauuuuuuuaaaaaauuaagaucuuuuuuuuuuacuucauuuaaagugucugagauuuuggccuucaaguauguacgugaauuccuugcucaugccgaugggugguugucagccacccucugagugcugggaacugaucauggauccucuuccggagcaggaaacagacuuaacucuugagcugugucucuagcucccuugauauguauuuugcuaaauaguaauggagacauucaugcuugcuucugcuuacuagcaugauaacuuuuguauucauucaucuuuucucaguuuguaucuuaguaucaaguacgugucuuauaugaaggauacagucauuccuugggugcccuuugcuuggaaucuuuaguggguucagagaauguaauuguugguuugguuagauucggguuagccauauggcuccaugcucugccauucaucucaggcacucacuuucuguguucucauuugucaggaacuuuucagcauuuaauaucuuacuccgccucgugcuuauauuucuuuggugguuuucuagugauuauuuucuaggaauuauaguuugcuucuuugaguuaauguugaacgaggaaaccuguuuuuauuccacuuucaguuuugaaagaagagacuugguucaugauuuggcuuuucccuuccuuuaucuuccugucucccucugucuuucuuucuuuuuuuuuuaauuuuuaauuuuauuuauuuuuguuuuugugccccuuucucuauucuucauauguugaaucuaagaccuaguacauguuagucaagcagucuaucaccaaauuacaucacacgcuugauaauuuuuguauuauagaucuuuuucuucuuucuucuucuuucuccuccuucuucuucuucuccuccuuuuccuccuucuccccccuccucuuuuuuuuuuagugguacuuucaaguacugucccaguauuuucugauucucauaguuuuagaugugacaucagccaucaguuuuaucugugggcuccuucguagcauguacacuuugaccucucuuggagcauuugucuaagucagacacauugcaccacauagauuugcaagauggggagauuuagcauuucauuugggcucuuacagucagucugaauuucuuaaacuuuuuguaugugauguuuauucccagucuuucaucuauguaaacuaauaaagucucuuuuaaccaaagccaguuugaacuguuuuuuuuuuauugcaacccaaaggacccugauuaaaaacuaauaauuuguccugcucagcuccuguguagucaucacuaccacugacccuugccaugccccacaaaugugagaccccaaguagcacaaaauacuucuaguccccaguacaaguuagccuaagggaacugaagggacuucuugcuuacucucaacccacucaccugguucaugucuagauuucauaucuugguucaucucuauccacaguuggcauugugacccacaccagaucaacacuguaaacuccuucucacuauucuuuuauucucugcucucucuuagagcucuuccaggcucuggguucucuucgguccccugccuguggucuuagggaaucauaugcuuucuggaaagaagcuacaacuuccugaauugaguuguagucuucuggcugacucuucuugucuaugauaauaggucuuuuuuccuguuucuaaaugcucuccuccugccucuuucucucuuucucaguugagaagggcuaagacaucuuuuaaaaguauuuuagaagcauagcagacagguagagaggaagcauccugcaucuggaauagauauuucugauagaaguuugugggaaacaaauucuuuauuuacaucaacauucugaaaauucugucaucaaaaacuuacauuaaucuugucuccaucuuuaugacauuuccaccgagauauuuucuuuguguugaaaacaaaaaaacauaaacacuaugcauaucccacaacaagcugauucaaucuccccuucauauauacauaauuuaaaauaucuucucuccaucucauuucacaguguuuuucuuagucuucuuucauauuuccuggaugugacuauguaucacugugucuauuucucuucacccaucuaccugucugccuuucuguagcaugguauugaaaacuuucagccuuauggccucuacuccugauggucuucuccauguguacacagaucuucuuauaucugguuuccugggcgcuuccugguaugucagauacucuccaccucaguggcuccuacaugggaugcuauucuucuuugugauuugaugggguuguaauugcuuucucuuucauuugugcgucugcuuagauaaaauauccuucaaauauccuacuugacuauccacuaacacacccaaagacauaacaaagcucccuuuauuuucuccuaagcaccugcauuuaacccuugacaguguauuacauauucauuguauauugcuuuucucuccaacuaaaugaagaacuuaacaacagaagaguccuuaguaauccacgcacuaucuggaucaguuguuuuaccaacacuuguugauugaacuaaacucuacuggggaaugaaacucauuaugagaaaggcacacauaaaggacagacuaauuggagcaucagguaagugauuggaacagaucccuacuaagaauaagacuuugggaucaaaagugauucucucucuaaaaauuagcuugucuaccaggcuuucagcuacucagcuuuuacaaaugaccacgugcuaagagguaaaguauguugcauguucuuucuccacccuucaugcaccugggcuucgcuugcaugccggcaccaugccacacaucaacacuucuuugggagaagacugccacagauaguuucaauuuugcuuuguccccgguuaacaauaguggcugggaaagaaaggccucuguuuucuaaugucugacuaucuauucagagaaagguucugcaugucuuggaggcaaauggccacaacuggaauggucauuacuacaaggcuauucauuuuuuuagaauggcugcucuuguccauuccugacacugaagcuuaagaugagcagcccugacugaaaucuuaucacaacuauuagaauguuuaguggugguuucucuaaggaauaaaacagaacuugugugugucuucugccucacugcccauauguggucucaaggcauaguuuugaauggggaaguuaguguguauguucauguucuuguauguaugggugccuugugcauauacacguacacauaaacuuucgugcacauauacaggaagguuagaaacauguauuaugcucccaucuaccuuaaaaagaaaaaaaaaagacauggucuuuuucucuuacuuugaacucucccaggagggugaccuuggccaguaagccccaaggaucuaccugacuuucccaccucuagucuugagaauggaaaugggugcuacucuacucagccuuuugauuuggguuuggggcaccuuaccuauugagccauucccuccuucacacuuuugcugaagcaaaagggccaaauauguuaacauggccagcggcaaggcuggauccacaauaauucagagcuguggaugaaggguguuccuggaagagcuggcuagcuuucuggcucuguccacuccucagcacugucuuuuagaugacuguucgagugggcucucagcaaagagcaagcuauuuuccaucuuccuggugauacuuucuuuuccuggaaugauuucuuccuucccauucgucuuaacacacacagaagggcuuuauucuaggugcuuucuaaguaccuuucaaagucuuucuugaugggucuccuccugaauagucauagccucuaauuuauucagauuguuguaugugcaugccuuccuagguuaaaauguuaagcauaagggcuuauuuucauuugauuaauuuuguauucucucuuguacaugaaauuuccuuucaccuagaagguacaauuaauauuugcuggcugacuuuaauugaaccaaguugagcaugccauucuaccuaacaccuacgguucuaaucacucagcuagauuuauuuauuuauuuauuuauuuauuuauuuaugccauuguguguuguugacuggcuucucacacauguccaaguagcacuugcaucacuauugccuagcacgggacuucacagugcagggcuaccaaaugacauuuugugaacggauaaauauugguggugugcucgcuacuauuguguacugcaauuaugacagagagcgggacggccucagcuuugccugcauugagaugcuagucugauuucagagucagaucauaaaacgugcagggauggaauugcauacugaaagcugagaugcaagacagaagcuuccagagaaugugauagauuaagaaauggugucucaauacuuguuugugagauguguggcacugagaaauggccgauuuucaucuugauguaauuaucucuucuccaacuuucugaaugggccaccgagagcuaagauccguuauguacuugucuagguuucuacaacacuguucccugaccccuuugucucugccuuugauagauuguaaugguguguucuauuuguagucugcuuuggcacagaaaacaggugguaucuuccuugauguguguguccuaugucuggcacacuacuugagaaauggcuguugaauaaaaggauagaccaaagagaagccucugucuuggaggggugaaaggcuuaucugaguagggcacagugguggcugacuuagggcccggguaauguucucugagaguuuguggaauguggcuccuuguuacaggaauuaaaauacuugggguagugaugaaggcugccguaguaguguuaugggaaguaagacaaucucuuggcuucaaagagaggaacaugugaccuucagggcuugaccagaggaggauagaccuugacugacaacguaggguaaggcaugcaguuaugauucaccagaaauuccaucuuccucccaguucccagaagccagggccauggccuugucuggggccugucuuauuuugaaggaguguauguuguagcacuuggguuugguuuuccaaaacuacagagccagaugcuuuuuucacuaaaagaaauugucugaguccaugagugaacuauucucugaguggggugagaugccaucauuaaacauugaaaggguauauggaguuaacaggugcccuuggacacuguuggggugcuucaugcagguguagagaagacagagaguagugaggugcuccuacaaacaucaccaauguuguagcuagagauuauuauaugaacggcagcuuacauucauuacaguauaagcaugugccuggcaccacaccaagcaugaaguggccauugacauuuguucaacaaaacuaugcaaggaaacagagaucaugguuauucccauuuugcagauagauaaccgaggcacaggauuacucugagcauuauucugugauaagccauggaguccugucaguccaugccucaaggcaacacgaugcaggagcuaugugauuuucauuggcauaaggcuagcuaaugugauauuucugucauguagacugccuauggaacaccagaggaaucauuuguccaggguggccagugaugggaguugggccuagauucaacaucuguuagaucuuggaagcuugcugaauuauuaugcauuaauggcccaaaucuggucuaccagaugugucuugggacacauaaggagucuggggagguguggugagacuaucugaagcuuaggguccagucuuuuuucauggaaagagccuugcucuuuccuuucaugcaugcugugugcagggacuuuuccugagucguguuaagauuuggccacugcacuaagauauagggaucaucacccucacucugcagaacagaaaaaugaguccuagcaaggcuggucaccugcaaaccuaagccuaagucaugagguagauuugagucugugucacccuaggucuucaguguggauucuucuauaagacauccuuuaggguucuuagggcuguguacgucaaucccauuuugucugccauuuuuuuggggaaaaccaacagaagaugaaguuagagccagaaaggugaugcuguagugauaaugaaaacaucagucacauuaagcauuuuuuuuuuagggguggagguggggucaggaccaccacugacaacauuuugugcaggacuagcuucaugcagaggauauacccauacugauuuucauacuauuacuccuccuccuccuccuccuccuccuccuccuccuccuccuccuccuccuccuccuccuccuccuccuccuccuccuccuccucuucuucuucuucuucuucuucuucuucuucuucuucuucuucuucuucuucuucuucugguucagguugcuacugcaucccuucaacugagagaccucuucagaacuuuucauaaucuuuugaugggaaacugggacauccagacaucaggaguauuuucaacgcccuccgguuguguugguaacaccugcucaugcaucauacuucuucacugcuucagauccuuacauuuucuccucuuuuuuuuccugucccaggaccuuuguucuccaucucuccaucuuugcuaacaacccuuacccccaacuacuggccccacauggcagcuuccugcugacucuucaguccuucaccucagaguuuucuacccaaagaaaccuugauaggacuccuguuugcuuuccucuucuauagaguccucaaagaaccuaaucuauuuuuaguucuaucuuaguuugccuacucagugccuaguuucucucucgagcuguguacuuuacaaggagaauagugguuccacaaucagucacaguuuggcccugugucagguucucagaaagugaauaucaacauuagaugggaggauucagcacuaagcaaaguaugggaaaaagaaagcccaggagugaagaaacgauuauuauccuuugggggacuuugggaacgaggauauauauaaggcaggguuugggagacaaagacagcaaugucugcaggcacaacucugaagaccuguguacuuucuagcuuagccauuccugcagucacagguucccgugcugcugcuggggcuggaaugaaaucucuggggaucuuaaccuugcuugcugggugcaguugccauggaggcugcagcccagcuggagcuuuucggagcuggcagguggaucagccugcagcauuuuuuuuuuucuugccuggacccuggcagcucucagaguuucaaagcuggaacacgcugaccagaacaccaugaccuuuggcacaauuuccuccugucuucucuucugcucccaaagcaagggggaggagcccagcuucuuugcucuggcucucgcucccugcaggacagguuuguuuuaggugcagggaggagaggaaaggaagaaagaagggcacccagguggcugugcugugagcagcaggggugccagauggcuuucuacccuacuuggaacuugagucuuugguaaagugugucagcccauucgauuuuucucacuucaaacucugacucuguagccugcuauaggcguagcugccuggacccuggcgaacucagauuaggguaaccuucugccuugcauccuugccauccagccuuuacagugccaccuccuuauggaugagcuggauuuaaguggcaguuauuaaggacuugcugagccuucgcuauuucaucuucaaauggggauaauagaaaguuucuagcaccauuuagaaaauuagaguuaguaugcacaacaggccuggcauaggccgcaggaaucaauaaaugacaguugacaucauuauuauacaccucgucucauuuaucuucauagauugauaucacugcuuuaaaaauaauuuuuaaauuacacuuauuugugugugcaugcaugguguguguguguguguguguguguguguguguguguaccuguacaauaugccauggcauaguugugaagauuagaguacaacuuguagaaguugguucuuuccuuccacccuguggguccugaggaucaaacucaauuugucaagucugaggguuaguggcuuuaucuccuuggauguauuuuguggguguaauauuauuaauucuuagcuggggaauauaggucuaggagacccuauggccucuauuuucaaagcucagaauaaaaaaauaaacauuccuccauuuccaagcucuuucucuaugugaacuuauaaacaccuuucacuuuguuuaauauuaaauuccuccuaccugguguuuauugcucauccucuauguaacugacacagggccaagcuaugaugaucuagcuaugaaaacaucacugaacucacccucauagagugcauagagguagugaaauuguaaucaugaaggaacuaagguagaacuaaaaaccagaauggguacuaggagggaacagaacagugguaggaaucaugccuguuccacuccaucuuggacucuuuuuauuuuuucugucucccacuuuugccuuggcuuacuucccuaagaaauggaaguccaauauaguuuaugcaauuggcuucuagaguaaguuuuggguucucccaaugucuaugaaauaacauagaguagaaagcacugcccgcaucuguagaggaucuuacaagguguucuuauguuagucaucuguuuuugaauucauagucucccucuguagcugaggaugucugcaguuucauaggagggguuuauucccugugaguuuaggccuuauuaggauaugucuuauuugaguggugggcaaauuucugggcaaugugcuuaugaggcuggcuuuacucuccacucuacaauuuaugagcucauucugcgcgucucucuuugucuauaaaaugaggauaauuacaacaguaugauaacaauuuguaaaaucugcucaucacagugccuagcauaugggagaauuugaucaauaauauaugguaguauugggcucgaaauacccauuuucugauguuggcuuuccuucuuuuugguacggaaccugaauaaauuugucuuacagauaucacuagagaauaccaacaaaaccccuuaucucuuggguacuggguaggggugcaaugucuuaggauagauaaacagaagcaacagggcccaaggggugguuucaggaccaaggacaguauccagcuugcucccuugcccuacuaugcuucucugaguaggacagccucuaucuccacaccuucaacaagcuccuuagcucucugcaccuguccacaacccuuccucccaugugcuuuucuuccucucauauguuaaagacuucgaucgcagcaagaaguauggaagauacggagucccccuaugccauuaucacucagcucuagcaggcacugacauucuacaauuauuucugcacuugacuuuucuuaaaugaaacagagccaugggucccugucuaucaccuuucuucccagaagugaccucaggucuugcuucuuucaucaccuccaguccccccucauccacucaaguccuccacacuuaaaagaagcagacagugcuaaucuccugcaguucacacugaccuucccuguagagaagaguggcauccagcuuuggagggauuucugucauuuauuauucaugacuuuaaucuuguaucaaucaguacccaguuugaggugacacuuccacuugcuggaugugcaaaaucaagcucaacuugguuuuggccucugagagcucccagaacacacaaggcaaggcagcaaucuaaauuaucaauaugaauguuuguauuuaucggccuucuuuguauaugucuguguguauauugcauguguauauucaagcaugugcaugugugcauauaagugugugugugcacauuuaugugcaugcuugugaaaguuuugguuaccacugaguuagcuacauuguuucucaccuuauuguuugaguuaaugucuuucagugaaacuagaccucauugaugaucuaggcuagcuggcuagaaauccccauuuccaucuucuuugugcuagaauuauaaauaugugccaccaugcuuuuuuuuuuuuaauguguggguucugaggauaugaaugagauuuccaugcuugcaugacagauacuugauuaauuaagagcucuccauaauuccaucugacucauucuucagaccccaaaugaguugauauguggaccaaacuuuccagcgcccagcacugcugcuccuuagagagaauuaauuuauaauuaugcauauuguacuaggucucagguuuacaaggaaucaaggauguuuuggcccuguccucaggagcccaugaucuauaugggaggacagcuuuaguaguugacauagugauauaagauaucagugccuacugacagccugggacugcuacucuaacaggagauggaguuacauucucuuugacucuuguccuuucaucacaacacuccaaauuacagagacagucuuuucucaugccucugcccuguuguaccuuugagugacuuuguuuuccucaaaucugacauucuuguccuaccucucugccuauugcugucauccuucagucagugacucaaaccauacacuugacuuucuuuucuuucauugcauauugagcaaauucaacuucaggaccauauccaaggaaguaccauuacacagcucuccuaaucacuuccuuccacugccuccaaacacaggaggaugugccuucagguacacacugugcagaauuccgguaccaagaaucugucuucugugcacuguuugggacuuuaauaugcuacuauacuauaguaauguuacuauaauaugcuaaauugguucccccacuuucauuauauguguguguaugcaucugaauaaaaaagcuuuauaauuuuuauccuuugaagucucauguuucauuuuaugcauuuaaaaucacuccucugagaaaggugugagagauauuucuggucuuccaugauagcuaugucacgugaaaggucaaaaucccguaaaccaggcucugguugggagagccaaguaugaccugagggguucauaccaggaacaagucagacaaaaacaaaaacaaaaacaauaaaagcuaaguaaagggaaauuuauggagacuaauguuugucauaucuggagauauuaucuaccuguuuuuccuuaauucugcuugaagagaauaacaugauuauccguuucauauauaagaaauauaaacauauucauagacuuggauacaccugccacaccaagcaauugguagacagggucucauuuuaguuucugaagggcauugcuuacuagagaacucaaggauaguucuagugaugugaauaucuaccagccauaguauauagaacaagacuguacucuugccuuaaauacuuuuauacuucauagauaaugcauauauugggauccacucuggcuuuaguugaauauucuuuuuuuuuuuaauuaagauuauucuugaauccuacauuagauaucuacauaaaauaccaggcaauuugucugauaauauaaagacacuuuaaaaauauuuuuuuuauuuauuuauuuacuuacuuacuuauuuauucugaugaagaaaguucugaugaucugcugucuacauuguggcauggcaggcuccuuucuuucuuucuuucuuucuuucuuucuuucuuucuuucuuuuuaaauuaaaaaaaauuauuuauauuucaaguguuauccccuaacucgguugguuuccccccuuccagaaacucccuaucccauccucccacccccugcuucuaugaggguguuccuucacccaacuacccacuccugccuccccgcccuugauuccccuacacugaggcaucuauggagucuucauaggaccaaggaccucuccucccauugaugacugacaaagcuauccucugcugcauauacagcuagagccauguguacuccuugguugguggcuuagucccugggagcucuggggggucugguugguugguauuguuguucuuccuaugggguugcaaaccccuucagcuccuucaguccuuucucuaaauccuuuauugaggaccccacacucagugcaauguuuggcugugagcauccaccucuguauuuguaaggcuuuggcagggccucccaggagacagcuauauccagauccuuuccgcaaucauuucuuagcauccacaacagugugggaguuuggugacuguauaugggauggauccccagguugggcagccucuagauggccuuuccuucaguuucugcucuauacuuugucuccauauuuccucccaugaguauuuuguuccccuuuguucucaaagcacccacacuuugcuuuuucuucuucuugagcuuuauguggucuaugaauuguaucuuggguauuuagagcuuuugggcuaauauccacuuaucagugaaugcauacuauguguguucuuuuguggugggguuaccucucucauguggcaauuuucaugcaacuucauacaggggauuuugauuucuguaaugauuugaguugucuuuguacacuaaaugaaagucuccagcucuguggaccucuguuuugcuaugccuagacucuacuguacagacaacucuuaaaauaacucuuuguucccuggcuacuuucaauuuucuuuccaaggagcaggauauauacaacagccuuucucucuguuucccuucucucuucucuaucuccuuucucuccucugcuuccuuccuuauauaucauauaucuaucagcuagcuagcuauccaucuaucuacccaucccuaccuaccuaccuaucuauccaucuaucuaucuaucuacucaucccuaccuaucuaucuaucuaucuaucuaucuaucuaucuaucuaucuaucaucuaucuaucucaaucucuacaaguauuucugccacuuagucaagagauuucagaugcagaucuuuccauuccuccacaucccuuuucucuaaguuccuucuauccaugguagaagccagaaggaggaucuuggaagggggauuucuagugggcaucaaugaaucaugaacaaaucacuguucagacaggcugggucagauccuucuggccaucugaucaucuaaugagucacccagacagauaauaugucagugccucuccucuucuuggcuccagauaucacaauagcucccuccaucuggguccauugcagggaacuaacucaacgcuacaagaaaguuaaaccagugaggaaagggggaagaccuacuguuggguaacugaguuggaguuuaauguugcaaggcacauuuaaaagagaagccucuucuguauuaucuugcaaccacugaauccuggucuugugaauuaggccuucuccauagcugucagggcucuguucuccauuugaauguuuucaguguuaaggucuggcuuugugacaaugaacagugcagaauagauuugggcugcugcauacagggccaaaaugguaacaguuugugagcagcaagcaccuaccaugcuaagcacccauuaggcauaauauccguuaauucuuggguagguggugcucacucugagauucauaguugugaaacugaggcuuaaggcauugcauguucuuauggguaggaaaaucaccacccaagugcagaggaaggugacuauaauugauugucuaagugcgaacguuugggaaucaagugggaaaacuguucaaaauugugucagguaauagauagaaaggcaggauauuccaguaaaccagagauagauaacuguuuaacaggaauguuuggggcuuuugaugccaagugguuuucuguuuauacauuguuucucaagacagcaacagaagcaaagucaguuccucuacuguagcuugguuuucuccccuucucauuucaucuagaaauuauuagaauuauuagaauaacuauuagaauaauuuuuagaguugagcaagauaaaugucacggugucagaucauuauacaugagguugggauaucuuggauauaaagagaaaugagaaaaagguaaacuguggcaacaucugccaggaucguuuuccauucuaccacuaaggcagagccagugcugugucugagcaggaaaaagacacggucugauugguaauuuggaaagaacacuccugugguuguguuccagguuaagcccaagagaaacuggacacugaaaguauuuagaacauguuuuuaaaagagcuacugagugcccagcauaauauaaccuuuuacauaauugagaggcagccaagccugggcaguuccacccuagcuuagcaucagcuucuggacacacccucuucacagcaaucagucaccucuguaccugaaagccacucuuucaggagacuaguuuuucccauuugcuuuuuuggcuucucucacuguguuaguccauguaccauguuaaguagcuaguucgguggaaggggucuagccagauuugagaaauucagagucauuucugcgaccauccugaucuauucacugugacuuuccugacacuauuuacuuuccaugaccuuuaggccuucugagggucaggauguaguguuagaguuuuucagcuggggacaggaugcagacgagagcuauagacauggguguuccccaagccuggcugugguacccaucacccaccaaggcagcucagggaacuuugcuguuugccauccuauguccuggagcuucccacaaagcauuacacugucuggcugggagaccacaggacgccaugaaaugaaagacacucuucacacuuauggcgacuggaaugcuaucuauauaaaccagaugaugugaggaccaauucauuaacaauuuguagccugaugaugaaugguggagccucuuggauuaacucuucaauuggcuucccucaagggacaggcagcaucuaagaugguccugaaccaguacauguugauggugucacaucccuauauuuaaaagcaguuagacacacugucuuccaucugugggcagaucuuguggacugcuucccccauccucuucuagauuucuagauagucucucucagcauccuccuccccagaaucuuccuggaauuccuccagcugaaugccaagucaguccuuucugacaugucuucauucauuccuuagguaucuagaccaguuuacguagcuuuuccuugaguauuucacauugggguuauuuagucauuacuauuugacaggaucaagcugauguucuagaaccucagugagcucacuguaaggauaaagagggcugaaacucugaucuuuggcuuuccacuuuccauaggagauuggcauugggugaaaaauguuggaagagguuuaauagucaaauucacacaucuacuucuguuaaaccaauuaauacaugaagagauagagacacauggauacacugugcucagagucacuuacccagaguggaugcagacaggauuaaccuuugagguugacaaguccucacucugaguuaggaaacaccuucuuggggagaugccugaaugagaaagaggauucaugguaaaucaagaagcaagaugggagucauuuuucuccaggggagaaguuagaaguaagggcagucucagggauaugcuugagagaggacauaguaaagcucaaaaugguaguuuacauaaugauaccaagcuaugaagugaauauaugcuguuuauaugcugguuccaauugcaaauuuuauaucaguaucuuccuuuaaaauuuaauaaaauugaggcucacagugauauaaauauagaggaaaaccugacuucagcugggcuuggaugauuucaaagaauaaccaaugacccaauaauguuccacacccuuuuuacaaugaaaaacaagaaggggagccacugguccacuucugcaaaucgcccgcucuuggaaugccuguccuucuuuccuccagauuuguaaacacaggcugugggucuguagaagccaaaguacacaggggcagaugcaaacaagguuaccagugaggagaauucuaauggacuuacugguaugcaguuuugucccugaggauucuugccuucaccauggcccagauaccuaggccugguggucuacagcuggcugcaaauuaucauugggccauccaguugcugcggucuggucugcaaaacuagcuggcagcuuguuuucacgucuagacucauugcugaguccuuugaaaaagaggcuagaguaagaaaauguuuguugugcuuuggaguuaggacauccuacuuuaauaacugcuaucaguuacuccauuuaugaaauauuggcugaguccugcgauuguugauauuggacugccaaccugauuguaauaagacaugcuugcagacugguaaagcucucuucugugugugugagugugugugugugcugcaugucuagagggggcuagaucaugagggcaccgaucaaaugcauaguuucacuuacuuccaaauaaaccacccaaaagugaugaagccaugaaagguagagccugauuggacaaaaggaggucagugggucaauguucuuuggagcuccaucuuacuuaggacccuuccuguuacuuuucauucuucuuccugcccaccauaaugugagcugccuggcauguuccuccuucaccaauaacauggauucaaacuuccgaaucuacagguucauaugaaacucuuaugguguuuugucauaaugauuaaaaguuucacuaacacaaguccuuucaguggaacaggcucugugccaagccagggaauauagcagugaaugagauaaugccuguccucagauaaugcccaguuuaauccaugcggacacugagaaaaagaugcuggcaaggauguggaggaagaggaauacuccuccauugcuggugggauugcaagcugguguaaccacucuggaaaucaguuuggugguuccucggaaaauuggacauagcauuacuagaggauccagcaauaccuccccugggcauauacccagaagaugcuccaacauguaauaaggacacaugcuccacuauguucauagcagccuuauuuauaacagccagaagcuggaaagaacccagauguccuucaacagaggaauggauacagaaaagguaguacauuuacacaauggaguacuacucagcuauuaaaaagaaugaauuuaugaaauucuugggcaaauggaugaaucuggaggauagcauccugacugagguaacccaaucacaaaagaacacacaugauauauacucagugauaaguggauauuaguccagaagcucagaauacccaagauacaauuugcaaaacacaugaaacucaagaaggaaggccaaaguguggauacuuugaucuuucuuagaagggggaacaauauauucauucuuccaugagaguuacagagacaaaaugugaagcacagacugaaggaaugaccauccagagacugcccuaccugggauccaucccauaaacaaccaccaaacccagacacuauugcagaugccaacaagagccugcugacaggagccugauauagcugucuccugagaggcucugccagugccugacaaauacagaaguggaugcucacaaccaaccauuggacagagcacaggguccccaaugaaggaacugagaaaggacccaaggagcugaagggguuugcagccccauaggaggaacaauaauaugaacuaacuaguacccucagagcucccugggacuaaaccaccaacgaaagaaaacacauggugugacucauggcucuaguugcauauguagcagacgauggccuagucagucaucaaugggaggagaagcccuugguccugugaaaguucuaugccccacuauaggcgaaugccagggccaggaagcaggaguggguggguugguaagcagggcaaggggggaggggagggggguuuucagagaggaaaccaggaaaggggauaacauuugagauguaaauaaagaaaauaccuaauuaaaaaaaaaagagaaaagacacaugucaauauaaaauauguggucuacaucagguaagaacugagaaguucaggaaagacuuuugugauaaaaugugcuguacaguacagucgucugagcaaacugucuuccauugucauuguauccacugugccugcuugaugucuucucagaugaguccaguagggagguucauugaauccucgccugaguauccagccauucuuccuagcccuuuguaugcaauucugcucuauuugaauaaccucauggucucaugaacaugcuacauuacacagacuggggaaagcugacagaagguggucucgauggcaccauuggggagcugccauccaugucagacucagaccuuccaguguagcugcuuuagagaccacgagucuucauuuaugaucucuauuuaugucuauauuccucccuauccccuagugugaacuuuggugaaaccauauuuugaauugcucuugagaccucaugaugaguuauguagguguuauuuacuucuccccagggaaggaauucucacuacaaaaugguccuugaauaaagaugagacaaaguaaaggagcaggccugguagacauuugaggauaggaccugucuggugaaggaaagaaugugcuuagaaauuguaaaaauagagugaguguauacauugauaaccugggacaugugcggagccagugcuggggacucucuggucauugcaaugcacaagcauagagaggaauaugagaugugugggcaacuacaccacuucccucccagaaagagcucaaacuagaagaugugauuuaucccaggugaugccagaaauuguaacaauauaucucuagauuauuacuaggggccaauuucagucuccuaguaggcauguagaauaaugaaugcaaugcuaaggcaucagcuauggagauaaaggaaaaguacugauuaauucauuagguaucuucuaggaacuucuguucuguagucaugcaugcaagagugaaucuuaaaauuugauccauuaucuaaauagcauucauacauuucaauuggcugcuaucuguuagacuucuuugacucacaaguccucuauuagcuugcuagagucaccaaaauaagauaaaacagacugggugguuugaauaacaaaaauuuguuucuuauaauucuggaugcuuaacauccaaggucaagguguuggcaggaaugguuucucuuguggucaguguccuuggcuuguggguuauaauguuuucucugugugucuuuccucugcacaugcuuucuaaucuccucuuauaggacaccaauccuaucuucuagggcccacacacauggcuugucaucacuuaacuuaccucucuuaagcugcuaccuccaaacagaauacucuugugggcuggaagcuuaacacaucaauuuuggaggggcauaaugcuccuucaaugagccauuugcuuugcacugaauugcucugcaguuuucugucuucuucucugggguuuaccauauuuccugucauauugauggugccuagauacauguuggguugcacuuugaauuuuuuuccuccaaguuagaaugcuacauuagggcacgugcuguauacauuuacaagagguggaugauaucugguugcuucuucuuaagauguaaaaaacaaaacaaaacaaaacaaaaacaaacaaaacaaacaaacaaacaaaccuuggaaagccagaaauguagaugagcuauggcauaccuagaauaugcuuguggucacuauaguauggcaggcuuugagacauaccugaagguucgcuugugccuuuccaaucaaucuaagauucauuuacauccaaugucauuuuagcaaccacagguuuauggaauacuuacucggcaaauguaauuaacuuugcauaugagcugaaucuguagcuuagaacaacauccccccccccccccgaucuauuaugcagagagucagacauuauaucaaguagcucugagguguggauuggacauguuccaagucccucagaucccugucuugcccugacacauucuagaauguaguccuacccaagccgcuuaaaauucuugaaugguguaauacacacuaaguuuuuaucuucaaaauugacuucagguguugccuccccaggugacugccucccauccuucuuccaucucugacugacagcuccucucuaggaaguucuucuucccagaugccuucauucuccagccugcucuuugcuaaccuuuugcuauuuacgugugcgucuccuccccaguggauggugcuucuucaagcucuggacuaugccuuuauaauuguugucauaacagcugccucuucuuaggagcugcucagugaauacucgagugacuaaaugguuucuccugaaaagcauucaacauucagcuccaaauuugaacugcuaagagcuuguaauuuuuccauguagcucagucagggaguacuggucuagcaugcacagagccauccccagcaucauguaaaccagguaugguagcucauaucuuuaauuuuagcauccaggggauacaggcaugagaguuuagaaauuuaaggucaagcucagcuacagugaaaauuugaggucaaccugggcugggaccauaaucuccucaaaaauaauuagugauaucccagaacuuauuuccaagcacuuugaggaacaggauuugaagguuuuuuuguuuuuguuuuuguuuuuuguuuuuuugguuuuuuuugguuauuggaauggagagucagaauuaacauccucuuagcucuaguggaugguacuaguuucaauugaagcuuucaggccagccgcaguaugguugucuaccuggaaauuuguuagaaaauagcauguuugaaaauucuuuuagauuuugcauggucaggguccaucucuuugauuaguccauccuccaugugacugugaugcaagccaaugauugagaagcuagcuuaagacaggggucaacaggcauuguaagacaaaaagugagucagugauuuuaaucuuuaucauuauucuagccauucaacauugcuacuguuguuccagaagcuaugggcauaagcaaauauaugucucauguucuaauaaaacuuuauuuaaaaguaaucaugaaguuggcuaagaucuuaguugguuaaccucuguucuuaagaauuacaacugucagcuuuugcuauguaaccaaucacuaugugaguggguuucuagcagaauuacaucugugacugacuaauacaaucuaggauugucugaagaaaaggaauggggaacuauggaccacaucuuaaguccaacugcauuguaauagacauguggcaaagagaaaagcaucagggcaaaaaagagaugacuggggauaccauucuauuguagaauggcuggaugcuaugaaugugcuuaggagauuagacauguggccagugccuuguacaugcggauuacugcuacucgcaguaugguuauuaaucauucuuuugcuugauuucacaagucagggccagguauuggguguaauuguuuauucuuucugaaaggcuguuaccaacauccucagagaugggugucauucaccauuagcacuugugacaacaggcauagggagucauugguacuagcagccugccuuggucauagaacaguuuguucuuggugcugugggcuauuuguucagaggaagcccugggacagguuuguuauuacaugaucacuugcuuuuuauaagcagguaaaucauacugacaguuuacacugaauacagacggagaacuccaauccuggcuugaaagaagaugccuugcuuuaguggagcucaaacaauagaccuccaaaguuaaugagaguauaguuguggcaccuuuuaggagaacaaagugaaggaggauggagcagauugguccuuggugauuuauuuuuauaggcaguggauaacuugcaaggaccauucuguguguagucuaccauucuaccuccauucuuuuucugguagugccaggaugcuuucugggaaccacuuauaucagagucaccugggaacuuaguaacacaagcacauuuauggucuaaugcucauagacucugguuagugagggugaccugugacuuccuuguuuuaaaagcuuuuugauacuugugaugcgcagugccauguagguggcacucaucucuuauuuguacauucagacauauaauuacaugauugcuuggcaacugggcuucaugcagaguugaucaaaacuggagaguucugaauccucagcucuuaaagggccagugccaggccuuauuuauccucauguuugugacaaggugucuugguacaugugaagcccucugucuuacaggacuggagaugggacccaagaaaguggaaugauucacuuguggcuaugcugcuaauacagugcagagucucacucugccucuccacucuuuacacucuggccuucccaagcugcuucucgggacaggaucccaugugugaauuauaucugauguguuagacuuugugcugaguuauuuaagcaugugauugccuuuuaaucuuuauugaguaugacuuguuaaaaaucacauuaucuacucugcuuuauagaaaaggaaaugugcagaaaaggcauguaacuggugaagguagaaugcaauuaaaaacaagguuucuuucguggacauugagaucagaggacaugugagauauucauggagcacuaacgauauugggguauaaauaaccaccacuucccugaggguuccucagugcacauguugucauugcacucauugucacauggugcucuucagugacauaguggaagucaaaucuugguggaacugggcagcagacccgugaucauuggauggacccuguugcaauccccaguaaguccuuugggaaaucuccaugggaacuuacucagaacguaaaugaaaggucuaaaauagaugccagaacuucccccauccugggcaccccuuccucaauucuucccuuaucuucccucccuucccuucuccucugaguuggugggggucccuuggguaugcccccauccuggagaugccaggacuuuuuaucuucaagugguauuguuuucuaaccugugaggaggcccuagcagauaccugggucugacuacuucucagauaaaaggucacugaugcucguguauguaagaugaaggggcuuauguuauuguugauacaacauagacacaugaguucuuaaaaguuauagucaucuguguaauaaacugcauauauuugaaguguauaguuugauaaguuuugacauguggaugcauccauguaauuaagauaaugauuauaucuaucuacccacaaaggacuuuuuguaauucuuuucucuggcucuuccuuaacuacauucugcuuuuuuuucaagguguuuauaauuuguuuucuauuuuuuuuuuuuacuauauguaauuguuuuuuauguaucauuuaauccuuuuuauuccuugaugaaaucccauguuuuagauguacgugguuuguguauccacuuacgaauugaaaguuauuuuauuggacucaauagauauaaaauucuacuaacuuauauuacugaaauaaagagaacacugaaaauuaccauauuuuccacauuacucuaugaaaguauauauaaagauaaagacaacuaguauagaaaauaacaacuuuccuuaaauuuucaucauuccauaauuaugacuaaacuaguaaaaauuaguaaaaucuaacuuugcaguguaaucauuauagucaaacuuuccacaucauuuauaguuagacaaaucagcuuguaucacacuuauuaauucaucuucucucuuaauaacgauccaggagagaaacaaaucucacagaacuguacugauggaauaguaggaaagauuuuaaagcaguuacaagaauuuuaggauauugaccuuuaucuaaaaugaagcaaacaauaucacauguucaggauuuauuuuuaucagaguucuauucuaauaauuuacuuuguagaauuaccauuaaguaugaaugauuuuuaauaaaagacacauauucuacauuuaacacuuucggcuuucaguuggaaaacuaaucauaagauaugcucucauaacggacccugaaaugcucagucagcaggcgccuuugagucuguauagugugaaccuaugucugacuuacugaguauacacaagucuuucuugggcaccugcucacauuuuucuuguguaaaugcucacagaggaacagcugggucaccuggagaaacaaauaugcccuuuaagaagcuaccacaacuguguuguauuucuaagacuuccaguuguuugacauccacaccagcgcuuagaauccucagccuucuuauucuggcucuuugaauggguaguguagauguugacguuuugucucuauucggucucugcugucuaggucugauucagggagggccaucuauguucuuguuauuaucuggacuucagccuucacuuuccaggagagcuugacugcugggcucugagcugaugccugccaacuuccuuugggcaguaagcugaggcagucucugggcucaccagagcugaaagccaaagguuuuuugccuuaccaauaguguucuuuagggcuagagaaaugguucagugguuaaaagcacugacugcucuuucaaaguucccaaguucaauucccagcaaccacaugguagcucacaacuaucuguaaugggaucuaauacacucuuuuggugugucugaagauagcuacaguguaucaaauaaaauaaaucuuuaaaaaaauuaguguucuuuauugccucacccuuuuggcagguacugcuauccuauaugucccuuucugguuuuucuuaagccauugcuucauauuuugcucacugaaauggaugccuuuccagcaagaugguaaaucucagauuuaaauuuagccagaguagaguuuucugcuguugucaggauuugucauucucucuggucuuacauagaagaaggucacauuucuucucuauuugaaaauguccgugacccccaaugguucaaaauaucuguuuguaauaguuauucagagauuuacucgaaagcaucgguacuuuaaggaugaaacuuaggcuucugucuauuuacagccauggaucccuaccugggugauauaaaacaaaauaaaacaagaaugaagaaaucuggaaacaaagcuaagaaguaguucaugagucuaagaguugcaacugauuucuuagugaguaucuaguggguaccacuuuucugacagaugcucucucucucuaaaacacugaggaucaaaucuaugagccaugacugccuguuuucaguaggcacacauuauucuggggacagaaaucaaugaacacaccauuaauaugcauuuauauauaaggaucugaauacguacaaguuaguucaacgucagccugcauagccugcuuuguguagaccuuugaggacccuauuauugucuguacacauaccugugacucaugacaccguaaucaccugaauaacugugucuuuguucuagaagggaaaggaacaugcagaagaccacacaaaggacgucuuuuuaauuaauuaauuaaaaacauuuucauuuuauuacuuauuuauuuccauguguaguguuguuuuggauaaauggguauuugugcaccauguagcugcagugcuuuuaggaagcagaaaaggacauuagauccccuagaacuggagucacaaaugguugugagcuacaauaugggugcugggaauugaacuuaaguccucuagaagaacgagaacucauaaccacuuagccagugguucucaauccuccuaaugcugugacccuuuaaugcaguuccuuauguuguagugacccacaaucauaaaauuauuuuguuauuacuucuuaauuguaaguuugcuaauggcauaaauuguaauguaaauaucugauacacaggguaucuaucugaucugugaccccacagauugggaaccacuacauuaaaacaucucucucuuucuagccucccaagggauguuuuaguauccauaucaaggagugauaauccaucauuccuguuuugucuccauugaccagagcccagccauugguuuacauacucuagaaaggaacuuugggaaauguagucaacuuguguguucacgaaggaaagaaacggauguuuuaaauggcuugaaguuuauagacuucucuaucauuagauuauguuuuuucuaagaaauuugcuauggugacucuuaaagaggauuuaauggagauaggcguggaugaggcugucaugugcaauugauguuggccuauggccuuuguacagucacaggcaggaggauggaguaaguagaguauaaagugguguccagcugggcuacagauaggcaugugugggcacaucugcuuccuacauuuuauaauggucuguaauuagcagguugccacaaaagaacacaaggcucucuuggugaggugguuuuaaagccacgacaggaaguagaagcaacaaaagcagacugcagaaagacaguagugcauaaaucaaugcuguccuuuagugugacacaggagcagggucuuuuuuguuacucuaaauccugacucuaggucucugucagauuuugucuaauugauuauguuauuggaacuuuguacaagacuuuggaguuagacacagccuugaggucuggcuccaaagcuaacuguucuacacuuauugggaaacuuucacacauugggauuaaauacuauucuaguuugguaaauaccuuuguugugugcaugcaguauaccagaaauuaaagagcauugaucacaguguucacaugaguuuaucauguucauuuauuuaaugacguauuuauugccuaucucuuucacuugacucaaaauuggucauaggagcaaauucauuugaauuacuguaauaugucugacauuguagaugcucaguguauacugaauuaacauaaguuuaaaagaacgaaguuuuggcuauccuaugcuccuuuaguuugggauauaaggcacagauggguaucuugggggcugacuggcugaguggaugcuacucuucuaagcagaaaaacagacugcugaguucuaguaauauaguuggaaaugcuuuuugaaaauuuaaaagaacaaauaaaacuagagagaugacuuagcagguaaauguacacuucuuucucuugaauaggaucugaguuugguucccaggacuagguugggugucucguagccacuuguaacuccaucuccaggugauccaaagcucucuucuugccucucaagcaccuuuugcacaugugccauacauugacauaggcacauaaaucugcaaauagaaauaguaauaagucuuuaagugaacgaauaauaguuacgccaaccaaauucuauaagaaagauaugagagugguaaccaggcaagagacaaguccuuugauaugcagaaaauaaauucuucauuggucauuagucuauagggaaaaucugcagaaagcaaacuaguaaguggucaacacccaauauuguggauggauuuugugauuaguuaucaacuucaggaaacagugccaucaaugcauuagagccgauccacacuaguucuuaaaucccaaggauacugguaucuuccaaguucuuccugguagagguuugaaguagauuuaaugagagcauacuuacaccaaggcuggcaaugcuuguguucaggccuuaaggucaagacagcaaaacucuuucuuaaaguuuuggggaaugauuuuaugaacacacaauugcacaucuuuauuuuaauuagguauuuucuucauuuacauuuccaaugcuaccccaaaaguccccccaugccuuccccccucuccccucccacuucuuggcccuggcguuccccuguacugagguguauaaaauuuauaagaccgaugggccucucuuuccaaugauggccaacuagaccaucuucugauacauaugcagcuagaaacacgagaucgggggcaggggguacugguagguucauauuguuguuccaccuauagggcugcagaccccuuuagcuccuuggguacuuucgcuagcuccuccauugggggcccugugauccauccaauagaugacugugaucauccacuucuguguuugcuaguccccagcauagccucgcaagagacagcucuaucuggguccuuucagcaaaaucuugcuaguguaugcaauggugucagcauuuggaggcugauuaugggaugaauccccagguauggcagucucuagaugguccauccuuucgucucagcuccaaacuuugucucuguaacuccuuccauggguguuuuguucccaauucuaagaaggggcaaaguguccacacuuuggucuucguucuucuugaguuucauguuuugcagauuguaucuuguaucuuugguauucuaaguuucugggcuaauauccacuuaucagugaguacauaucauaugaguucuuuugugauugggcuaccucacucaggaugaugcccuccagguccauccauuugccuaggaauuucauaaauucauucuuuuuaauagcugaguaguacuccauuguguaaauguaccacauuuucuguauccauuccucuguugagggacaucugggcucuuuccagcuucuggcuauuauaaauaaggcugcuaugaacauaguggagcauguguccuucuuaccgguugggacaucuucuggauauaugcccaggagagguauugcuggauccuccaguaguacuauguccaauuuucugaggaacccccagacuguuuuccagagugguuguacaagcuugcaaucccaccaacaauggaggaguguuccucuuucuccacauccucaccagcaucugcugucaccugaguuuuugaucuuaaccauucugacuggugugagguggaaucucaggguugcuuugauuugcauuucccugaugauuaaggauguugaacauuuuuucaggugcuucucugccauucgguauuccucaggugagaauucuuuguucagcucugagccccauuuuuuuuuguccuuuuccaauuuuuuauuagguauuuucuucauuuacauuucaaaugcuaucccaaaaguccccuauacccuccccuccccccuccccucccccuccccucucacuucuuuuuuuuuuuuuuuuuugaaggaacuuuuuuuuuucccccauuuuuuauuagguauuuagcucauuuacaguuccaaugcuauaccaaaagucccccauauccacccacccccacuccccugccaacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuuguaacuccuuccauggguguuuuguucccaaaucuaaggaggggcauaguguccacacuucagucuucauucuucuugaguuucauguguuuagcaaauuauaucuuauaucuuggguauccuagguuuggggcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaguaaggcugcuaugaacauaguggagcauguguccuucuuaccaguuggggcaucuucuggauauaugcccaggagagguauuugagccccauuuuuuaaugggguuauuugauuuuucugggguccagcuucuugagcucuuuguauauacaauuguacaucuuaaucaacucuggggggauagaaguagaugguuggacaggccugagaauuuccaugaacugggauuccuggcauugacaauuacagugcuuugcggcauuuaguucaaaagagaaugcuuggcuguuggcugucauccugauacagucauaaagagguuaucugcagacagagacugggcaacacuuugcuagaccugugggggaaaaaaaaagcucagagauucuuagaacuaucucaggccauccagcuccaugaugaguauuuccauguuggcuuuagaauauccugugaucaugauagacugucaucaauuaagccauuugaacagaagccauaagacaucuaggugacauuggaugaaucacauacuuuuuccuuguuuuggcuuugguaccuauuuuguuaaaaaagaaaaaaaauguuuugacgugggaaccuauugcaccacaaaaaagggauagauucuauuggggcugccugaagaauaguuagaguugaaauguuaagagguauuggcuuaaaaagacauggugugaguuuggaaacuggauauauaagacaguauggucucugugcagcccuagugacaucguauagaugaccuccugaugacaaccacugcaaaacugaucaauagucauauuagagcauaacagcccugugugcuaugcucauggauuuguuggucauggauuuguauggagcucagcaaagaugucuuaucucugcugcaugaugcuguggggcuaagcucagaauauagcugagauagcuggaagaggagcuagggugacuugagagcuggcgugcugaagacugccaagcaugugccauuagacaggacaugaacgccccucaagcaucauagauuccagggggucaugcuuccaccauggcuauuuaagguuuuucuuuaaucuuacuuguuuuuuguuugcuuguuuguuuugcugugcugggaacuuaacuuaaugccucacauauaguagacaaaggcuauauuacugagcuguacucccagcuccuucuggagauuuuaagaggaaguguuccaacaagcauaggagaauaacaugaccuuuuacuaugcagccuugaaagucgcaucaugucauuuauguugauuuauguugaacuuuauugaagccaucauggcuuggucauguucaaacucggagaacacagacuccauugcucagugggagcauccuuuaagaacugacagccauaccuuaaaauaauaagagaguuuauauauguuucuugaaauaguaggaagauuuaaaaaacaguauggagaagaagcaauaagaagcaaaauuaaccuccauuauagcuaucauuguaggguauagguaugguagggacuuacauaugcuucacaaaguuuaagucacucaauugccaaaauacuccagggaggcagugauauuauuauaucuacucuguagccaaagggacaggagcacagacagcugagaugacuuuuccaagguucuuaaugcuaaugauuugacauaauaggaacagcaacaacuagcauauauugaguauuuaccaagugccuggcauguggugaaccuacccaguaaaauacacuagacugugccaaacacuuucuaugaauuguccuagauuuuacaauaaucuugcaauguauacacauuugcuguacugucuuaugccagagaaaacugaaggucuaugaaauuaccugcucaaaauuaggauguuagaaaaagcucaguuuuauuuuuuccuuccuugaagucuggggccuggaauguauucaguugagaaaggggagugaugaguuagggguggggcacuucuauagauugugguagaaugagauuuggacaagguuuagagcuucagugggagcaaagaagaaaauauccugagauuaugagauaaugaguauguaauuauaaguguguguaucuguguaugcauaugcauguauguauuugugagugguacguguguaugugugcacaugugugucucugugugcaugugguuuuuuguaaaugguguguguccaugugugugugugcgcgcaugcauggaaauaaaucucuacuaaauucaucaaguaucucugauacuaacauugaguuuauccaugugccaguuccuugcuggaagcagaagcccaugcagggaagcguuaacuuuuauauccuuccuagugcucagcgagggaguacuuccaauucaagguccaugaacuggauucugcuuugugacucuacugcucuguccauggcagagucuucaucucugccuuacacagacccauaggccuggggcugcaagaagaauauggaaauucaauaugcucacucaauauggaaaucggaguucagguaagagaaaguuggccaugguaaugguaucuuaugaagaaauuuguaguaacguuggagauggaagcagaaaucgaguacauagucccuuugugucuggaguuuucagauagccuggauccugcucugcucacaucuguucauuauggcuuccucuuugaccuggaagucaccaugcugauucauccaucagucacuggagucuggauuccccucggcugugcuguucuagaagccuucagcugucauuugaugcuuauuaagaagaaugagucaggaugguggcuuaagacacaauuuccagcccggucugugcucccuuccucuucucuccuugcugaacuauucugagcuugcaugcucacagggcuuuguccaggguaggaagagccugggcucuggcgcaucagaaugccagggaagucgcagcucugcaguuugcuuacugugugaccuugagcagguuuauguccuuugcauuguuccuuuagcauaaaguaggauuguuugagauuugaauaugauuaaauauuagggcuuugcacaagauuuggggaacacucagcauguaaaaauagccccaguuccuuugcauaaauaaucauaugcuagguuuuuuacucuuuggccugggucaucuuaguguuaucuauccagugggauucugagaacuauuuccuccccuccccuuuuuuuuuucugauggacugauguggaucauuucugugaaauucuuuucuguggaucucugggaugaaaggaagcaacagcucuggaaaugggcagcuacagucuugagccuggcaguccaugaccugcauucugcuuugugacucuacuguucaguccauggcagauucuucaucuguuucauugacuguuuggugacaugaacaggcaccagagcaaaucuuuuguaccugagugcugcuggguggucugugcuuccugacuugggugaauucuuaagcucugcuagauggcccagccccacacuaguuccuagacuguuccaauauagaccuucccucagauuccuuugaucucuuuagaagcaaagaaguuuguggacuugcugccuucacauccuuccugcccuaagccugacauguagagucuguacucucuuucacccaugaccucugucuacagcaggcaaaaccacccuuugccauacccaaucuguuccagguccucuuucagccuugaugccccuguucuucacaguuaaugggcauauaaaugcuguccuucucagucagcauaaagaauggcuccuacccuccccugaauagaucuaauggaagcagcuaaggaaccgagagucauaaaauagcuaugcaacucaccaguuuuauacgaacaaaucacuuaacuucucagccacaacuguucauauuugaaagggcagggaucaugcuaauugcccuguuccucccuccaccccauuuacugugagaauccaaugagauaaugucuguggaagugcucuguaaaugcaacacuguuauuagagcaggauggccuguuauuauuaaaaacugguuucccugauuccuccaacucucccucuuccuccaucuucugaguugacugggcaauugagacuuaguggcaguacagcuuuuggggcuagaaaguagcaaaaguucuguccugcuuauccagaagucaaagugagaugacaucugacaccagaaguguucuuggcuugacagcugagaauccugguggaaacagcuuuggugauguggggaagcaucacacaguauccagugaguaagucuugcucagguugguguuuccagagaccuugcugcauaaugcacuccacaaaugcugcucuggucucuuucuuugcuguagugucauuuccuuuuggggaucaccaacaccuccuggaaggaugccuacacacuugcuuaaugcaacugucuaaaagccaaccucuucauuuuaugucaccaacuagcuuaagcccuacacuguaguccauuuccuucaaggcuauucaaauggaagggaauuucuguugagucuucuggccuuuccccuagcacuucuuagcuucuccugucuaaaccuucagcaaucuuaugcuuauaguuauuguuguuguugguucuuuuuaauguuuuaaaucuucuuucuuccagaauagcuucuccuagcuaccaaccacaaauaaagcugacccaaaccccuuugacaaugugaguugccuuucagugcauuucuauaguaacuugcuuuccccuucaggagccauuggugaugcucaugccucacgaccucucuucucugagaagcuggugauuccacaagacuggcuuccgcuugauacucuguugcucacuccuuaacaucauagcauccagcccagggcccagaaaugaacgaaaccacacagaguggaugagcuaauauuuaucggauaauaauuaucagaggcuuggucucugaaacuagagacucucagagaucuuaaugcauaaacacaaauggacagcaugaacaaagcaugcugcucuuacauuuucucuuagauccuuacacaugccaaucagcuaaaguugcuuaguauuuauagagugcuuccucugaguugaacaucuuauaagacucagaaacuucaaacuccccuguuguacucagaaguacugcuauucuucugggacuuagguaacaccacggcccaggaacuuuugguuauuuacccaaggucacccauccaucaagugaaggauagauauugagucagaucuauuuucuucaaaaauccaaauucacuggacuggacugugugguuucuggucugaaaucuugaaauacauuaugaauuaguuucuuuuguuucggcgucgcccuccuccucuucaucauccuucuccucuucuuuugagacaggguuucucuguguuguccuggcuguucuagaacucaauguguagacuaaacuguccuugagcucugagauccuccugucuuugucuucgaauugcugggauaaaaggcauguggcaccaugccuagugguggcauuuugcuccuuucuuaauaguugucugagaauuaaacaagcaauuagauacagauggguuugagagagagagaaaaugugugagagagaaaaugugugugugugugugugugagugagagagagagagagagagcgagcgcaggcuggugccuuuuucaguaacuucccacuuuuuguuuugagauagggucucucacugaaccugacacuuauugauuuggccagacugacugaccggagaccuucagagauccuucugucucuguucucucaauacuagaguuguagaugaacgcugccacacucaacaauuaauaugggugcuaagaaucugaauuuagguauucgugaacgugcagcaagcauuuuauccauugagcuaucucuccaaccugaggucuuagguuacauuuuuaaaguucaagcaguuuuaaucauuggaacuaauugcuuaguuucuuuaugguccuugcagagacuagggacauuaacauauaacuguuucugggauuuuguuggugguuuuccuuuuuugacagaagaucuuacuguguagucugggcaucuuugaacacacugcuuucuguuucaaccucccagcacuggaauggcaaguaugauccagcauauuuagcauaucugaguuuaguuggacugcucauuuccuggggauggacaauccauccucugugauuugaaccuaucuuuccacagaagcagguuguccuagagcagugguucuccaccuuucuaaugaagaaacccuuuaauacaguuccucagguuguggugacccucaaucauaaaauuauuucauuacuacuucauaacugcaauuuugaaacuaauacaaauuauaagauaaauaucugauuuucaggauaucugauauguggccacaaagaagucuuagcccacagguugugaacugcuacucuaaaauaagaccuuuagagacaaucuagcccccauuccauggcaguuaucaugugagcauaccaauacaacuacauuccagguucuggccucuuauuucuccaggcaggaugacaugcgaucucugcacuuuuuucaagcacaaagacuaaagucucagucuccaccagaugagagcuuaggaucaguggcaacccuucauuuccuuaaccaaccauagcugaggccaaagauucaagaauaaggauguucgguguguugccaguuacaacugugggaaauguaauauguccaaccuuuagaucacaccauguucacaugagcaaaugauaucaggauggcuguggaacugaaucccaaacagagaacaagggaagaaugacagauguaaagagcagggggcagaucggaaugucacagucuucauuuauauauggaagaaaaucugaaagugugaagaaggguaaaaguguuuaucuuggggucaugagaauaugggggcuuuucuuguucuaaauucucuauaaggggaggaaguauaacuuagugguuauggaaauggacuucagaaucaaacuggucuggcuugugucugucuuuugacaccugaguuucauuauuuguaacacaagaaccaugaugguguuugcuccuuuaucuucuugggagagugaugacuggcuuuguguuggggaugcuagcuguaugcaugguacuccucugagcagucuguauacaucuucucuaucauugucugcacucuguaagugaagaggcagagagucaaagauauuucucuggaccuccaauagcuuuuaccauucuuggugcacuaguucauugaugauggcugacacagagucucuccugucaucuacaucucccugcugacucauucugggcacaguuucacuaaaaccccagaauuuucauacuagcacgugucuucuauccucuaguuguuuuuuguuuuauauuuguuagcucuuuuuuuuuuuugagugaacuaauuauugagauagcagguggaagaacauucaaaucauaccauugauuaugaggaaguacaagaauaagcuucaugauaugguagugaggagcuaccagucacaucuauuuaacacuguagaggcucaggcauggacuuagcauuugucucuugcuccucaucuggauagaggugcuggugcuaaugagauaguggguaagcagaaaggcuaguccagggagaauaccaucauccugggauccuaggggaagcuagaagacaggggauggugaugugaggacagaaagcagagaacagauauaagagcuggcagaucugguagaucuggggucucaucuuugcuuuuucacuuguggcuuaauacauucuuugaguuucauuuucuucuccucccccucccucuuccucauuccccacuuccucccuucuccuucuuuccaucuuucuuuguaugaggcaugggugugucuauugcacacuugcuguaaugcacauguagaagucggaggacaaccuuguaacaucuuacuuaauuucccuuugggcuaaguauggcagccucacuggcccaugagagucuugacuuucuuggauuuccauugccuaucuugucauaguagcacugagauuacauauacacguucaaacacucagcuuuuuacuuggguucuggggauuugaacucagcucuuugaauucacguggcaagcaguuuacaagccugaacuuucccugcagccugaacuuuguuuucugagcuucaagauacuacaguugggugaacagauuuuaguacauccauguaagcacacauagggcagauaugggcucaacugagagacucugucucaaaagauaagguggagagugaucaagaaggacucucaacauuaaccuagggccuaaucaugcagauggcaccguuucuuggcuuuaguuccaggccuguuuagcagcggagaaguugaguugaccaaucauacauguauucauucccuuccugcccuugacuagcugcuuagaaguuccugcugccuugacugguucacuggccuagaagugaaagcuggaauacuaccauccuccucugaguuucuuuggugaucccaucaccaggagcaaagcagaauaguggggauaacaguuuccuaggaaaugcuggagaggcauuucacacgggaggaacccaacauggaaaaucuaagaagaaggacaagaucgucccaggaggaagccuugacuuacccaaggucauauaugauggguaugagugaacuccagaagugacacuucuucuguugacgccacauuuugauucuuccuuaaauauagugacuaugucacauagucuacaaccaacacugugcugggaucugccaaugucagugggauuaugagccugucuucugaccucaugcuucucuacuuccuccagaguuugagacuauaaaggucaccuuuacauucuaugucuuucgucuuccugagcuugacccucugcuucggaagacgcaugcuuaagcuugccuagaaacccucauugcacagcccuuuaguugccccuucuguaugacucucuuuguagacaaaaccacaaaccccgaugggcaauuagagauuuucaguggcagcaauuugggaugauuuuggcuaauugcuguccugugugaaagaguggacaucgucuuugacagcuggccugagcagucagcagugugugaggagaguuucucuucugacuuugaaagugguggugggggcagggugggcagugaccugcuguagucagucagaaauguugugucugccuuuagcccugcacuggcaaaccccugagcucuggcagacacugcacagauuaaauaggcuuuagaguaugcagaguuauauucucacucacaguuuagcaaguuuaacaaggguugcuacuuugucucagcugaacugggaggaucccuagacaagaaaaggauggggaguuugaugaccucauuauuuacucuccuaacguuuguugggaguaaauuguguggccccuuacuucccucucucccuccuuccuuguuuucucccuucuucccuuccuucucuuuucucuuuucuuuucuuuucguuucuuuucuuuucuuuucuuuucuuuucuuuucuuuucuuuucuuuucuuuucuuuucuuuucuuuucuucucucucucucucucucucucucucucucucucucucucucucucucucucuuccucccuuccuuccuuccuuccuuccuugcuuccuugcuuccuugcuuccuugcuuccuuccuuucaguuauacuuuucugcuucagacaaccaagcacaccaccagagaaagaggaaaucaguuuccauucuuacuuucuucuaaggguaaaagaaugcacugguuuccucccaugggaucccuuuccaucucugccagggucaucaguggggugguguuaagugcugugcgaaggcugggaagguucuuguugccacacucucugccugugguuugugucaccucugggcacuguccuuguucuccugaaagccgugguguuuacagugaaugcagcaugcugggaucacacugugaagcuguagggggugucugaguucacauguccugcauuccaggcaaauguuuuuaauauugagcaaugcuaugguuugccagggugaggucugugcuauuggaaugccaccgaaaaggaaagucccggacagauagugacucaaaucaucuccuccacucacaauccucggggcuuuaauuccuacucaauucccucaugauaaauacagcuccgugugcuuacugaccgcaccgcucuuauugguucugauaaguacaacuuuccaagagauagggacgcaaauugucauauuuuguugagucaugugugcucagcaacucuuucccaaacauugcaucaguaauuggcagcucccuggucucugcuguaugacacucuaugcccaggaaaagcucuauccauuucaugaaagaaagaaagaaagaaagaaagaaagaaagaaagaaagaaagaaagaaagaaagagaggaaggaaggaagaaaggucucucucugccuggcugugauagccugcucuuaaggaagcugaacccccaagggagcaaagacaaacugcauuuucagauaaguuagaaaacuauggcuauuuuacuuuccaccuccacuggucuccuagcaacaagacagcugaugacuucuaccaggaaaaggaagccuggaacuugggggagcccgucugaauucuugcucgcagucugauuuauuugaagcuuggcugcauucuuggguguggagacccagaaguccagucaucggggcauucccugaccuucacuugaccuccaucaaugcacagauagagggaaaacagaugagaggugcuuucacaagauuucuuucacaagaaucugcuugguggggaacagauauuuccuuugauuugaggaagggcagucgaaagccugccugugacauggaaugaaaucucagaaaaagcaaggagcuaaguggguaucagaaaccagggguccuacuggugucaaucucucccugaggaguucaggcagggaguucuugugcccuuguucuuacauaguguugauauucucaacuauaaaguaaggggauugaaacagauguccuuucaggguuguaggccucuauguguucuuaaauaguuucccaaauauaccauuauaucaucagccuuucugauugucugucugucugucugucugucucucucucugucucucucucugucucucucucucucucucucucucucucucacacacacacacacacacacacacacacacagagagucacuacauguugagcaagaauccaaacucagguguggcuccuacccuauucauacagcagcagcuauguggcugacauccgugucuuguuagaugguuuuacuaucaaccgcuauuagccuguggaaguagaacugggagauucuuuuaacagagacuuaaguuguacucugccuuuuaacaucugguagacuuagaaauaggaauaagagccuuugaguaguugcuacaauguggauuaggaaccagugaaaugaugugcauacucagugccuguuccauaguaagagcucaguaaacaaggaagggagcuggaaagacagacagacagacagacacacacacagauuuguucuaggucccuggaguguagggacuuguccuaauuguccccucaccuugauauauuguguggcacacagaucagaacuaacuucuuuagcccaacauauucagcgcgcacacacacacacacacacacacacacuugcacacacacagguacacacagaguuguucacacauaaauacacacucauauacucauguacacacagucacauccacacccacauaggcauauacaugcacaccugcacagguaugcuaaagaguaaugaacacacccagucuugccagaacuuuuaagcaagggccugaauuuuauagccacacugcacagcuaaaguaacugucagaugaucuaacagugauugauauuucauauaccacuuagaauuguucuucaauaauuccuggaauaugcaguuuuggcuuugcccaacacucuugauucugcacugauuagauaauauuagggcacuucuuacugucccccugccacucuuccuugcucaucccuuauuaugucuuacacuuuucuuuuuuaaacuucauuguuucauagcagcuucuccagauagaguuugcuacucuucacaaccgugaggcucaggaugugagggaguaaagacaacagaguggggaaggacgcacaguaauguaacuuucaugucucuauucaaauggaaugugagaugauguggugguacaggccuucaaucucagccucugggagggggaggaaggagggucaagaguucauugucaucuuugaccgagugguaaguuuaggaucagccugcccuacaagguacuugacuuccaaaugaauacauagauugcuaggcaacuaaauguagaggauagaaggaagaacaugacagauaucuuuugcugaagagaaaacuugcuaccuugaagcaguaaaaaacaacaaaucaaaucaaaucaaaacaaaacaaaaaaaaaaucaaaaaccaaaaaccagaaaacccaaaaaacccaaaaacccccaaaaccuaucuuccccuguaucaucacuacggagccuuccuguguuucuagcuuuaagcucacgauauacuuuuuauuucuugccacuaaugaccuuggaggaugaauaccaaugauuagaccuuaauuucaaagggcauacuuauugacacuuagacaaauuaacuagugaacccauauaaccugagcuauacugguacaaugaacauuucugccuagguagcaugacuccagagcaaacccugcuggcaagcaugauccacugacuuacucaggaucccuggguucuuguggucccugcugacccagagccuccuuuuggcucaucuugaaggcaucccacccuuaugguacuacacaucauugccccucagauuaagaaucauuuguccagaagcuagagaaucaccagccacugaaguuuaagaguggaaaaacuuuuucuaaguucuucaugccuagugaguuccaacuguggggcauggccugguuauuggguuguaaaaucaaguuaauaguucaugaccuacaguccaaaaaugaaaugaaauacaacagacaguagcagaggcaacagcagcuggggcaguguggggcaguggcacaguuauaugccaucaauacguguauauguucugagucacuaugggaaagcaacuuuuacugauaauuaugccugcucauuuuuuuucuuuccaauuuauguuuuaucuaaagaggcuucaugugccuuggggggaggggagggacagaaaauauauuaggaugaauuucacaaaagucccucuuccagguucuaucuguccccuguuuuauaacuucauguaauauuucauauuccuaaaagaggcuggcaacacaccacugggagagcucuugccuagcacauuuaaaagcauguaugcucagcacucacuccagagaaaagaaucgaagagucacucaggucuauauuagaacaauauuaguggucuauacaguauuacuuaaacuauauuugcaaugauguucagaauugagcaaauuacuuaaagagacauaagaaacauugcuaucagauggguauagaggaauaaaagcuggaugaaacaguagagacuaacaugaauuggagagauuauacuucgguucagaucaacagcuuaaguacaaaugugacaggaauuuaguugacagcauuucagggcucaaaguccaggguuguuaauuaacuuaucuccgaguagucaccagaucgugcacccaaacucacgguaaggguggcugcacucagcuuuuugcggacauaacauuaugaaguacuacugggcauaucuggggcaaaaaauaauuauuauacuuuacagcuuccaaauuaacucucuuuuccuaauucuuuauuuugguuuagucccauggcuuacuuggaacaucaggauguggcagaaauuauuugucauuugaaccuauuucccagcuuuuggaacucugauaucuauguguaaauaagccaugucuagucuuccggaagaaggcaguuaugaaaauccccaucugcccagucaaagccauccuauaccaaccaaugaagccaacugccaucuguauaagccuaucugagaucaagcacacccaucuugugccagagcugcugaccugagaauugaguccuucuuuuugaaauagccucaaagccuagcagauauaugcacagcccuguacuaacaagcccauucugaggauccuaucagucaggucuaaguacaagaaacauuaacuagaagcauucacugucaucauuuagaaagacacauucauucucucucucucucucucucucucucucucucucucucucucucaggcucucucucucucucucucucucucucucucucucucucucucucucucucaggucagguugacaggagagguucuguggcucucuaaaccuucuggauaaaagguuaagaaagccauacucugcccagguaggccuugaacuccuuaaccuccugagugaggagaugagauuacaacuaccuucugugguggcccagcuuugugaacuucaggauauucaguguagccagcccuauuuccauauagcagagggccaggcacaaauguccuuaucuuucuacucuaggacccaggcucccaugauccuuucauuuuuggugggucuggaaagcuugagugaucuucauagcuaauugugacguugagggcgggauacaccucucuuggugcacagcuggauaguggcucuuucagaaaaugaacaaaaaggauaaauccuccauauuuuccuuuagauccaaugucugcuuguuuuuaucucuaggaaaugacaacuaccuaauguaaaaauaaaaaauaaaggucaguuuuaaagguuucagaaguuuaacuuuaaaagugaagaagguuuguaggaauauguccuuggccucuaucacuugggauuugacauuaguuaaaauaaacaaacaaagagagggauaaagcauuuggaacuuuaacaguguaugaaguaauuggcuacaauucuuacuuaaaggauuguauccauucuuuuuuuuuauuagauauuuucuuuauauacauuucaaauuucaaaugcuaucccaaaaguacccuauacccucccccccacccuacuccccuagccacccacuccugcuucuuggcccuggcauuccccuguacuagggcauauaaaguuugcaauaccaaggggccucucuuuccagugauggcuggcuaggccaucuucugcuacauaugcagcuagagacauagacacgagcucuggggguacugguuaguucauaucguuguuccaccuauaggguugcagaccucuucaggauugcauccauucuuacugaagccauuugguaggcagugugaaucuuccuccuuggaccuugccuuaacauuuuccuuggacccaugacuuauuuuggccaggguguagaggcaggaguuacagagagguagacuuggcauuucaaaugacaucaccuguguccacgugucccucuggacuucuaacaccgugauaacagcauguccuguuuggccaaaucaucccaagcuagaggagaaacaguaaaaccaccugcagcaaacaauaaaaccuucacagcuaguccacagaauuacaucugagaaauuaaugcuuccugcuagaugucaccaaggcuuggauacuaagucuuacccagcagcaguugaagaacacagaucuaaaauuagcguaaggauuggcagcaucacagaaguuccagacuccugauucauggaaggacuguauuuccaagcaagaugaaauggugaaaugauuugucagugcacgaggaggcucugcucuauggaaguuguucauggucuuucaggcagcaauccuaguuucaugcauaaugacuaugguauuuggaggaaggguugugguuuauuucagcuguauuucagcauccaggguaggugaccaucagguuguguucaugagugugcagaaaaggaauuacaaagaauagagacggcggggaagcuuggaugccucacuaaaauguuguccuuggauucaaacuguugggcacuugucauucaaacuguuucugcucccauugaccuuuuaguccucugugauccuaaggaucuaguucaagcuauuacaggcauggaucugaguucaggggccaccugcuggaguccccagguucuucagucucuggacaaagaauuguaucaagggcacauggugacauaggcaaagauagagacaguuuguugaaagagagaaagacagucuugggagugggagugggcuagccaguaggagaaauacacugucaaaacuacuagccauaaguuucauggaccucuaugggucauuuuuguagcaccugccuuucuuguuuguacaagauuaauccgugauaauucuguugaguauaauuuucuuuacuuuccuauucuccuaccacagaguccaacuuuuuuuaucuucuauauccacgacguuccuagccugugagaaccaauuccgcucuaauuucuuucagaucgguauagguguaaaaugucuuaaaauucuucuuggcuuuccaggccgacuuacacuuucccacaugcucacacaauaccgaguuugcugcucucaccagggcccuaccuuuaaagcugagagccaggagaaggcuaagaguguggccuuggcccuaucuacccuuucccugauggaaaguauuuccccaauggaauggauuucgcuugucuuucugcuauacggguaagaccccugcaaacuuugaugugcauagucacauagcacuuuagggccuagcuuucauucauucuuucaaucaucaucugguaauugagucuacugagucaacaaagcacacuuuuugcugcccauauuuugauauuuuuuguauuauucaguugcucccugaucaugugccugccucucucucucucccucccucccucucucucccacuccgcccuuuagaucuuuugaucacucucacauaaggacuucugcugucuuuuugguuaugauuucuucucaguagucuguucucccucaggucucaguuuaagucucccuugagaauacugucccaaguguucauucugaggugucacacugcuuucuuccccgacaccuuccagucuucgaucucugacugucaauacuuucugaacuucuuguauuccucuuucucccucccuucuucucuuuuuuuuccacccccuccuuucuucccucuuuucauauaaugcuuaauucuuguuuuuuuguuuuuguuuuguuuuguuaugcuuuguuuuguuuuugcuaaaauccaaucugaggugccaguaugauagcucaugcuacuggguggaggaugaggcaacagauagaaugagcauuuggcuugaucaguaagcaaagacauggaagguaauaaaaugagagggaacuguagaccuacagguugaaaccgccugaagaccuaggaccauaauguccuccuaauugguucuuuugacucuuuggaagcugguucaauugaaacaugcacacaaccacacuuacagcaugcacacacaucccaaacacccaacauccucaauacccuaaguauaguucucagauccuucugcaauaaauguuaucuuaacguauuugagagcagugaccacugggucuauuaaccuugaguuaccacagcagugauuuucuuuucaagccaaaaaucauauucaacuccauacccaaggucuagaugccaugcaaugaaguaaaacaguauucaacgaauuccaguguacaauggaucuuucauuagacuuaugaggagcacuuagcucuucagcuccagucacucuuaaugucuaccuagaccuaugucuaaaacuaaugguagaaaaaaagagcagcaugcaauuuggcuuaacugggaaaucauuagagcuccucugauagagaaagcaaguggggaagucagagcugaccucugugggguucuguuuaggggccaaggguccagggagugcuucacacaggauaaacauaucuaaaguugcccaacuuccaggaggaucuaauuagcaaacacuuucaaagggaucaagcugacuucugagacaaagucugccauacacagccaaggugggcaaguaaauauuuaaagggcauuucuguguagguagagggaagaaagaaaaaaggccaggaagagauaggugcuaacuuuggagcacuguuguguaauugcccuugacuuauccccuuucacuagucaaacaagcuucuggggaaauuagcuugccagacgcucaaccagccugucuccacagcgaaccaagauacgaacucacucuauucuagugccacaguaagcaucacagugguuuaggauauuacgcuucugcaagagcugcgucagggccuggacugggacacuguugauuggcaaacuccuguuaauaugcaauuagcuauuagauuuggucuuuacccuagcugugaugucaucauauggacugacucugcagggauggcauuucaggccacacuggugucugucaggugcaccucuacagaaggucaggcucauauaaaggccuuuucaaauucuucaugcauuuucaguucuuggggccaauuaucacucagcucccgcaccacccugucuugguacagcaauuagcaggaccuccugggucucaaaaaacagcucuggaagaauggaagagcauguagacaaauggccuauuaccaaauguaccuccacugcugauccucugacugaccugggacagaaagacuuuuggcacugaacuuaaaaaccuagggcccauacuggaauuuaaguucagcuccuggagaaaauucuaaugugagagcagugcaaaauucauuauuacuauugcuacugcugcugcuguuacuacuacugcuacugcuacuacuguuauuauuauuguuauuauuauuauuacuacuguauuuuuguuuguuuuuagaggaugcaugcaugcauguguuugugcacuaugugugucuguguaugagccagagaacaacuuaaaggagucagcucucucuuucuacuauaugggcccuggagacugcacuuagaucauaacauuuggcaacaaccauauuuacccacugagccauuuuggcagccuaggagugagcuucuuaauuugucucauuugaugagucagaggauagaugcaagauaccaaaggagaaaaaaaaaacaacccagaaaacaaaaugcauguucuggguaccugcugugugccaggcagaaugcugucgcugucaucuauugauuaucucauuuaccaucacagcaagcuuggaaaccaggcacuauuagcacuuuacauagaaaaacaagacuuggggacauuugcuaggcucagacacauaaggcaagugcucuaccauggagcuacaucuucagcccaaguuuuacuuuuaguuugaaguggaaauccuaaagaucaucaggcuggccuuguacaucgugccccuaacuauccuuggauuuuugaaaaaaaaauuaaaucauguucauguaucugucuguguaugggcaucuauacaugagugcagguaccuaugggggucagaagaggacacuagauguccugaagcuggaguugaaagugcuuguggagggcuucaugugaauacagagaaccagauucaaaucuuccacaagggcaccaagagcucuuaacuacuaaaccaucucuuuuugucccuagccuuggcuuucugauucuucuguuugagucucccaaguggcagugacuacaagcugggagcagcaagguagaagcuaccucuacgugucacaggugucaguggcuguccucauugagaaugacagauuuagccaaugccuaaaauguaacccacucaauauguucuucuagcuggacuuccuugucugaccucagugggagaggaagcaccuagccucacuugaaaugccaagguuggggguuaccugcucaggucuccuaccugcccagaggagaaggggagagcagaugggagaaggacuauggaagagguaacugggaggggucacugauugggcuguaaagugacuaagcaaaagagaaaauuuaaauuaaaugugacccauucaagccugccaacuuauuucuacaauuugugagcaugugauauucuugugcucugugcuuuauuuuuuuaaauugacuuggaucuuauacauuauaagcaaauacccuaccucugaguuacuccaauaggcuuuuaaaauuuuuguuuugagacauugucuugacaaguugcucaagcuagcccccaaaccacuauacaacccuaaaaguccuuuaacuucugauccuuccucaguuucuauauauaccuggacauauaggcauauacuaccccauuccucacauuacucugcaauugugaaaugccugugccucaaaauuaaguggucaaucagaacuauucacagucaaauacuuguuuuauaagcauucuauugcucuggacuucagauaaccuuucgaugcaagccaaagacucaaucaucuauuuuauaaaaaauuggaaagagaggcucauuggucuugcaaacuuuauaugccucaguacaggggaaugccagggccaagaagugggaguuggggggguauaggggaguugggggggaggguaugggggacuuuugggguagcauuguaaauauaaaugaagaaaauaccuaauuaaaauaaaauuaaaacaacaacaauaaaaaaaaaagaaaaauguuucaauauaaaaaaaagaauugaaguugaagccaggaguucagcuuugguaauuuaggguggcucugacacuucucagaagcaaggaagucauguuucaaggauucaacuuugauaccauccucaugaauggcuuuaggguaaaggagggaucguugcugcuaaugugguauucccacuguuuacuuucauggaauucugaugucagaaagcagagucagcauccuguagauuauccacuugcuuuuaagucacuuacccuuuguuuucacaguauauaauuucucaguguggcucgauaucauguucccguuuuccacuccuaucuuagaagggugaaucagucaaggaaacucuaaagcucuucucaguccagucucgcuaucuggaggcacuggcucuuguuuaaccuuuucaguuuaaccacugcauaagccaguuaucccuuugugcuuuagucaucauacccauaaaccaggcuaauuagcagcagagcaucauuucaaguaagaaauaaaagcaaaaaagaaaaauuaaauaaaaaaauguaacccacucaagucugccaacuuauuuguaugacuugugaguaugugauauucuugugcucuaggcuuuauuaucuuuucaauugacuugggaaucuuauacauuguagucagacacucuaacucugaacuacucugauacacuuuuaaaauuuuuguuuucagacaguuucaaggauucuaucacgcugaagcaguaggaagauucuaucaugaauacauuuacacaauaacaaugauaagaaaagcaaugguaagacuauuaggaaggacuucugugguuugguuauguaccacugagaauacuuggucacuaaauggcuuugagggggcaugggcuacagcaaaguucuguuguuagguuuucuuacucagguagugaccucuuguggagggggggggggggagaaaggagccucagcucuagccaaaacagcauguauacuaaggcaacuaacaguuggguggauaguacugagaugaaugaagucuugaguagagcacuaccuugagcauccagauagaaaacaaacaaacaaaaaacccaaacaaacaaaaaccaaaugcacuaagacuaaaacuuugcucacuaagucuguuggcuagaccugauaaagcuaaucaaaucacuggagccugacuaugcucaagaggugggcacaagcucaaacacaagcuggcuggaucuaagaacauaaaaguagcucuuggagagaauguuccagagcaaguuuagaugggaaaaacaauuucaguguauucauaacugaugaggaagggaugcauauguucuuugguuguuacagcuuugcaaugcugaggaugucagccauggcucccacugaaacucagcuaugagguggagcccuguggccaucauaccaugcucuccuuguucagugagagagggacucagaaaaggacuacccgggccaucucagaaaucuaggcaaagcucucuaauuagacuugaucuucugaucaccuuucccuucguuagccaccaucuucuuuuacccccagcuucuuugugcauaauaauuugguugguaauauuuguauugguugauauucagcaucagacuacagguaacuauaauuuguuaaguaauaauugcaagguauuuacauuaauuuuucauuuauucauuaauuuaagauacauuuaccuugucaugauaauguaggagaugugauggcugcaacagcaugcaagcaucaauuacuaaaguguuggcuggagucacuaucauugugaugaauacuagaaacacagaagggaggaaaaguugacuuuggcucacagucucagagcuuucauuucauugagggaaggagaguaguauaguugaguucccugcauagcaguggaaagagauagauagauagauagauagauagauagauagauagauagacagaugauagacaacagauaaaugguuuguacuacuaagauuuuuucauuuuuuauuagauauuuucuucauuuacauuucaaaugcuauccugaaaguccccuauacccucccccuguccugcuccucaacccacccacucccgcuaccuggcccugguauuccccugagauauucuuuuagguucccccauuuuauuccaucuugacuuuccccauugagugaaacagagccguccauauucaggguagauuauuuaucuuugaaaacaugcucaggcauuuucagauauacgccuuucucaucucuuagggauuuaucaagacagccaugaucauugcagauuguucagauuuuaccaacaaagauaauggggguggugaaguaguugaguuaguagagcugcugccuacaauggaggaagccuuugauuccucugaacccaggaaugguggugcaugcucagcacucaggagguggaggcaagaggaucagauauucaacagaaguucacagucauccucaguuacgcugauguccaugaguccuuccaaaacccaacaagcaugcguaaagaacugaaacuagacacagcgugaccucagaagguaggauauuugauacuguaaauuguaaugaugaugcggugggcuuaguccauagaagacugccuaaaaccucauagucaucuaauuaucacucauuuuccuauaaccuacagccuaccugucgguuaauauuauuacacauugaaaaaauguucagaaucaaucugcuucugaugcuauucuacuuuucacaaacaugcuaguauuuuuuuuauuuauuagguauuuuccucauuuacauuuccaaugcuaucccaaaaucccccauaccucgccccccacuccccuacccacucacucccacuucuuggcccugguguuccccuguacuggggcauauaaaguuugcaaguccaaugggccucucuuuccagagauggccgacuaggccaucuuuugauacauaugcagcuagagucaagagcuccgggguacugguuaguucauaauguuguuccaccuauaggguugcagaucccuuuagcuccuuggguacuuucucuagcuccuucauugggggcccagugauccauccaauagcugacugugagcauccacuucuguguuugcuaggcccuggcauagccccacaagagacagcuauaucaagguccuuucagcaaaaucuuacaaguguauaacaugcuaguauuuuaccuucacuugucuuacggaaacaugguuucuuuauuccucaaggccauauauauuuguacaaguauauuaaaaaucuaaaucauuuaaagucccaagcuauaguccuucucagaggcuuucaaguguucaauauguuaaucaucuuaguaacccucaaagaacagggacaguauaccacaucucucugcuucucccccccccccccaauguaucuuacaccauaggucuucuauugaaugugcuguggaaaacccaaagaguucuuauagaggugaccaacucauguuuuuauucuuugcacaguuuuuguuuguuuguuuuucauuugagaaauguaaguaauauacauagcucacuuuuauggcuacugggagaaucauaggagauacaauauaaaagaugaaaauaacaucccauuuucucacuuuaacccagccaauggugucacucugcugggauagauaccauugauagacucauugauauuucugcguaugccauugucucgguuaggcucuucauugcugugaagagacaccauggccaaggcaacucuuauaaaggacaacauuuaauuggggcugguuuacagguucugagauucuguccauuaucaucauggugggaagcauagcagcauuuagguaggcauggugcuggagaaggagcugagaguucuccaucuuguuccaaaggcagacaggagaaaucugaaucucucaggcaguuaugaggaaggucuugaagcacaaauccacaguggcauacuuccuccaacaaggucacaccuauuccaacaaggacacaccuccuaauaaugccacucuaugggcuaagcauauucaaacuaacacagccccaaacucaaacaaaacaaucauuuggagcuaaggcuaagagugcuaaguagugacaggcauggaacauggggaaggaagaggagcuaucuguguggacaacagaaaaauguaaggcugaagaaauaagagaaucugaaaauaaaauaucaggagaaggcuauaaaaccacagugcugcugauaaagaauuuauuauccauuuaacagauaguauuaauagaguacccuguacugaaucacugaaugacaccaggcauggugauguagaguaggucaguggaguggucugaagcuggcaaaguucugaggauucagagaacuuucauaccagcucaggaacaugcagcucugccaauacaaagaagacuugccucucaauccaaaugcugcuaucuuuccuuucuugucucuacggcuuuuugguggaacugaucugauuaucuugagcucaggagucugaagccuuugcuuaacacacaaucaacaaauaugcccaaguguguuugugggccaaacuucuaauggggaugacgaagauggugaugauaauguugaggauagugauggugcuguuguuaaagcuauaaauucuguaugacaacuuacugaucacguuaccauauaggcauuucaaaauauggcuugagauugguuuuaaaucucuacuaaaugcaaauaauuuauuggacaucacaagguauggaaggcagaggugggacaaggauccaguacuccauuccuuuauccuaaaucuuuguuuuauauaauggaauuucucugcucauaauccaaaggaggaaacaauaguguguuuaggugucuaaaucaggaaagacacuguuuacucucuacuacaagaaacgaagauaggaaguucuauuuuuuuuuuuugguggggcuaggagguggggggaauaaagaucagaauugacagaaaggguaauguguaauugcaucucuaauuaagugcccauaagacauuuuauauaaagaggcaaaauacacuuaagauaaccaacuucauuccucuuaucuggaccuugcuguaauuguauggcaugagucugugacucaguuucccuccuauaaaguaggguuauuaaucccuagagccgugcaguuaucuaaauaaauggaaauaaaugcauaaguacuuggaacugugccaguacaugcugcagaaucagagacacuuggguuuuaagauuugcauuguuggggcuggagagauggcuuagccguuaagagcauugacuguucuuccagagguccugaguucaauucucagccaccagaugguggcucacaaccauccguaaugggaucugaugccuuauucugaugugucugaagacagccgcaguacacucauauauauauauauaaaauaaauaaaaaaaucauuacaaaagauuugcauuucuucucuccucaucauucucacauccuagaacucaucauuucacugguauuaucuaggucuaggagaaugaaaggucuagaagggcaaagagauggguuucuugauuucuguagucuuaguaccuaacacacagaauacccauaugaacaauuguuaauugaagaagugaaugaauaaacacagaaguaucuaauauagugcagcauuuaaaagaauuagauaauccaucauuuauuuuaucaucaggguccuaauucuuuuugauggaguaaauaaaaaaauaacaaaaaaguagcuguauguuuuccuaaagguuuguucuuucuguacauuuacaucaguaagugcaucugcacuugaaauugagccaauguucacuggacaaauacuaggcaaucagguauuuguguuaucuggaauguuuccaguccagauggauaucuggauccauuccccauggacaagaggaauagguucuauuuggauuccccuccauaaaaaaaggauucuacuuuaaucucuguuauacauucagcuaagaacuauaucuauuguuugaugaauauuugguccauacuugagugaauaaacagcuguuagaaacucuuuaauuucuuuguuauuagagcaaaagucauagguauuuuaucuuaucauuacaggaauguuaaagaagcuuuacuuaugagaaaagucuaaauggaaggugcccuuuucaguuacuccugcaaccaaaguguccuggguaaggacucaguagaauuaaaagguuucuguuugcccaaagcuuuuuaccaggguugcuaagcaaacaggugaaauggaacaaaaugauaaaaacaaccuaugauuuguucuugugggauuuucugaguucuaucaagacaaaaccaauaacugaugaaacugaccucuucgagaaagaggagggugacacggauugccaaggucucaagaucuguagucagugaacuucgucauuccagcuauugguuguucuauccagcuuuuguuaaacaggauucucuuggaaugcugugcuguuagagacacaggccaaugacauucccuggaauggagggugcgcuaaugcugggaguacagccugaaugguuugaccuggccuuucucagaaaugagggcucauuaugcaaccgaauccaguagcagcacaaaggacaaggagcauuugguuggucucagguuaucagcaguggcaccuuuguggcccggcucugaaaaggacacaaauauuuaaguagcugcuuggguucucacaacuggcucacugaacaggcugauagcucauuugcuuugaagucaauaugauugcgcccuauugaauagacaagaaaacuucuguugaaaugacacugaaguugcuugaggugcuuagccagaaacuggcagugccuaguuacccaauuuugagcuucggaugucacaucucaauuuuuuuccuuauagacagucauuucagagauuagggauauuuaacucauugccauugugccauugucaacuuuauuaauuugcuuggaauaucuuuuuagucucugaaacucagguagcuuccagguuugcagguuuuccugguagccaaggacgauucggguucgaacaacucacagacacagaacacuuaguaaguauugggaacaaugcugaaggacauacagacugacuuuucugucccuuaccuuugggcucauauccaauggaaggaacuacccuucccuuuaauagugaaacuauuagacuuaaacugaaguuacaagcuugcucagguaugaaguaaauggcauucccauaaacuugaggcugugaacuggccaucuccugccuauaaccaggcaagaugucuaguggaaguauugugacaccaacccagccauauaaccuuugaccuacaauuuguccugcuuacaagauaugccacagaaaagguggugcagaaauugugggaaugguuaagcaaugaauaguccagcuagagaugcaugccaugagagggauuguauccaugauucugccuggagggccaggaaccagucuggauucugaauugcccagagaccuaggauagaacaaagcacaacucucucucucuuacacacacacaaaaccaaugaaaugauuccuaaugauaauuugcuauucucauagauuguugccccacccaauugucauuaggucauuagagaggcuucaucuagcaauugauggaaacagauuuagaaaaccacagacuaacguuagguagagcuugggaacccugcagaagaggcaggguguggagggugguggugaggauuguaggauccaaaaaggucaaguacaccacaagaaaacucacagaaucaacuauccugggcucaaagaggcacacagagauugaacuguuaaccagggaguagucuauaugggucugaccuguaaauaugucugcacacacaauuacagugugcaaguccaucuucuugugggacuccuaauagagugagcaggguuuuuuuuucuuuuuuuccuauuugugggacucuuauccugcuacuggguugccucauuuagccuuaauaugagggaagguguauagguuuaaugcaacuugauaugcuguguuugcuugauacccaugggaaucuucgccguuuuaaaagaagaacaggauggaguagggacagaagagcagugaggggaaggauuagaagaggaggaagccucucuccagaaagcuugugaugggaagagaauuaggaaguggugacauuguagucaccuucugagaacaugguguguuaguaggacagacauuuuauucaagaaaacuuccugagguuaagugacuuggucaaccuaaucuaacuaguaaccaguguuggccuccaaccgucugcuggaguuccuaugcaauguguuaaucuuccccggaaggagucauguagacuucagagagaucuuugaaucaugagaaaaagcuuggcagaaauccauaacuucugauaaguugaugcagaaucagaggagauagaccaguaaguuggcuauuguguugggguugggaguauggaagauaaagagaggacuuggggagagaaaaaaaaaaaaaaacacagccagggaaguuuccagcugcuuuucuagaaacauuacuaucuccucaucuuaaaaucauuaaugucacuaguuauuuccucuaaguaugcuaguauaaagcaagcuauaaaauguaguagaggugaccuugagugacagcuuugacugugaccucaagaagaugacuuaaccucucugagaucaccugccacauagaugcaccauuguuuauccaaggccacuuccuauauucacuccuuuauacuuccuucagcccccaaguugcucuguaugcaaacaccuguucccuaggaaguucuucaauagcuuguacuuggaaagguagcacauucugauggccugacucucuuucucuucugugccucccaaaauguuuccaguauucagagcauccagaaaucauucuugacaccagcuauggagaaacuuugugagggaaggcaguaagaccuucaaagagucucagcugagaauuauauccugauugguuugcuuuagcuggaaaaaaaaaaguuuagucauuuucccuuuuuuauuuuuuucccaaaauacguguaaagggcaucauauuuuauugaaugacugaaauucaccaagcaucaagcggcacuuucugaauguuauuucauuuaagagguacaauguuaucuguggaauguguauaauuaucccuauccuguuaauuagaaaaaugcagucauugaucauuugaauuaggauuuuaaucuaguuucuggguuuagcuuucugucagaugaugucuuaaaugguagcauucuucucaaaauagauacacuaauggggaaacccuugggaaggcaacugguggaaagguugcagaggcagagcacugguuuccaguaacuugaaacugcacuucuuuucaccuuggcaugugacucugcucuacugacugaccauccauuucuguuggccugggagaugagcaauaacacuagugaugggguggggaaggcaggaaauagggagaagucugguuggauaauaccaagacaucacuagaaggccaugaagcagaguacaauuucuuuauuaacacucuucuugcauaggcaguugcuguuuggaaggacugugugauaaggcacugcaggcaaugaaugcuuauguauagauagaguucuccuuuguaugcaauucaagauacuggcucauggaauggugcaaucucauucacagugggucuucucgccgcaguuuucccaaacuccauaauugcuuauaaacauaacuagaaacuaacccaaauaauccuucauaggcauguucagaggccuuucuucuaugugauuccagauccugccauguuaacacauccaucaucacuguuguauguuacuuauccagcucaaacugguuuuguuguuguucuuauuuuaacaaauaugcuuuuaaaauagcucuuaucauuugugguuuuacuuauucuuuagacuuguguacaauauauuuuuaucauauucuuugcucucucccaacugcacccagaucccucuuugucucuuuacuuauccaauuucauauucauucuuucucuuaacaaaauaaaaucugauuuauuauggccaacuauuuugaauauggagcuuucucugcaguaugguugacaaacccauagagaaggggagagagagagagagagagagagagagagagagagagagagagagagagagagagacuuuacauuuuccagacacaguagugcagauggacauaugaauccacagucuaucaagcauguacaagacuugcacaagcucaagccaaacaaaauccagcauggaaaaagguaaguuggcuuccccaguuagcuguuucaacugaguuucugggaaugguauucagauacucacauuuucaaggcaagcccuuuacugacuggcccaucuccccaaucaauuuuauuaucccuguugugagaacaaggaaaggauuuucauucuuauguuggcaauuuccaugaagaggagaaaaugcuauagaaaauguccgaucucgguuugaucugcucuuuaucacuuauuaauaugacacacuggacaaguuacguaauguuucugagccuuaauuucuucauuuguaauguuggguaaugauuaagggugguuucuggcacauauugaaggcuaaguaaaacaauuguaacagucucagguggugcaauacuuaacuagucacugaaauagguauguuuugcaaagagagcugaaguugccuuuggaaggcagaguaugaagugugauaucccagugucaguucaucugaccacagucaucuuccauugugaagaaccuucuugacucuucauaugguccuugaauuauauggaagacuugaugagaucuaaugucuuuaaagugacauugacuaccaauuaaggguggcuugaaaaugaccacaccauggacauuucuuuguucguacagaaguaaguuucuuuggacugaauugacugaucaggucaugccuggauugacucugucucagaugugaaauauaguauuauguaagagagcguguggagaacuucuaagaccaggagcggguccuauuaguguuuaccauuucuguuugcuaaaacuuggcucuucaaaggaaguugccucaucauugugaaguucaguucugaucucuacaaugagcuaauaucuauccauaccauuuagauccaucuuguguuguaaaagaauaaaugauuuuauuuuaucaaugauuacaguuucucugguguauaaguugaauuccuccuucccccccuccucccccuaaagcaagauguucugugugugacgaggagaacacuuagucuucucugaucagugcuuugccccuucugaauaaacuucacacuaaguguaagaauaggccccccaaaagcucucccucuggucacuugaaaaucugaauagaagguacaauguuggcuucucugagaaacacacaagagaagauuuguuugaggaaacaccugugaaggaaaauagggaggaaguaagagaaggcagagagagucuucauaccgcaugaaggucucccagcugugcaaggagaggaagaagaaaggaaauuagguagaacaugauucagacuauuuuucaguauucaacuaaacuacugggacuacucaugauagaauuacccauuaaagcaacucuccauaguagagacucgccugaacuacagucuccauugccccacuuaguuagaagcuaggagcauaacaauggauucaacagggccccaacagcuggacaugcagcuaaucaauuaccuccauagcagaucugagcagagcauuuucaugacuauucauuaaauuggaagagauuuacuguugaaagcagaaauccucauuaaaaaaaaaaaagaaagaaaaagaaagaaagcaaacaaaacaaccccgaccauucaugguuuuguaccuaauaucaauguucucuuccuuucuuuggcuuucacuuccuuauguguuucagcuaggccaaucauguuaaaaaccccacccaucaugguagaguuccucauuugacaauuccuacgaaauuguauguaaauaagcaagggagggggcacgucuuugguuuuaccuucucugugaauuaugauacccugcugggguuucacauguuuuauucauuggcauaggaauaaccuccugugucagauuauuauaguucuugccuucagucuuacuaauaugaaaccagcuauccaaagggcuuuggcaaaaacuaucuauguaucuauguaucuauguaucuaucuaucuaucuaucuaucuaucuaucuaucuaucuaucuaucuauccauccauccauccuauuaccuauuuaccuacauaccuacuuguaggaucacacaucuauuuauauauaucucuauaucaaugaggggaagcacucuaaagaaauauuuucaaagaaugagaaaguauuacaggguuugcuaaacaugaaauauuuuuaggauuugucuuuauuucaggacaugacgugaagaaucacuggggccuucauggggauuggcauuuuaaucccugaauaugauugcuuacaagauauuugaaagugucugaauucuuuaugcagaaaaugaaugugcaccccuucccccccuggaaaauaucauugugcagauaggcaauugcgcagauaggccaggaugggaugagcaggguacagagugaaucucuuccaccacuuucugauuucauacuugaauggacuuuuuuuuuuuaaaucaucuuuaguuacaagucauccucaauuggugugaaguggacaaaacuaguaaccaugauucccaggucugccacacaaggggcaagaaguucucauguuccccuuaauccuuugcccugucuagugaaaaauaccauagcccugaacuccaaaguaauggagggcaacaagggucccuaaauaaccauaagggacagaauguccugaugacuuaugugugguuggaaauugagugagaaauauauacuucuugagcagaguuucuugagucuuuaaauagauugugacagccaguguuucuggaagaaaagacacaggaaccuuuugaagaugaauuguacauaaggaaaggaggucugggugcaagguaguauaauuugacuugacaaacucgucuuuagugauauuuugaaucaagccuuguugugggauuagugagagauguuugcugcucucaagggcucagagcuaucuaugguagugagauauauagacagugacuuaugauauaacuccugaagacagcuacaauauguacaaugaauagaggaggcugagggggcuaguucccuuggaaaugugaucccaggaaauuauaugggaaacagucugaaggaaagcaguaggagaagagagaaagacaauggaaaaaucuuauacaagcuugugauuccucuacgaccuugaacuacacaaagcuuugggaagcacaauuccguaacucauuuggauagacacuaccugacaguucuuugucagcuguaacugugaagaaugaaguucccuguaguugacuaucauacuugguauggauagucauacguuccaugguagaacuaguaugauuuugagauauguucucaucccuucuugagcuauuucaugauucuuguauaugcauuauauuuuuuauuuuuggaaucuagaaaaccaugauugauaaaucacauaagaauaucaguuuauagaucugguucagucuguuauuuuauaguaugcuuaucacccacaacuacuggcacucaggagggagagacugcuucucucagcagagcaacuuggcaucagcuugaacuuaccugcccuuugucccacccugcuuggccacacugcuauccuuuguucucuaaugagucugacuguaccaaggacuucagcuucauuaccagagcuguucaucugcuuggagggcuuucuucuuggcuuacgaugaugacgauuuuacucucauccacuauuuuuaaauucagugucuauuguucaaagagcccugccuuaauucuauaccaaacagguuucucucagguauucucaacuguaucauucuguuuaucuucauuacaauacuuguuaagguauaccuuuucccuuuguuuuguuuguuuguuguuguuguuugcuuguuuucuuucuguaauuuaauguaguuucuaagaugcccgaaaagcugcugguucuuuucucccagguucuagccaucaaauacaguguauaggaaagcagugacaaauacagcaauuaacaugccaugauauuaaagucauuuuaauucucuuagcucuuugaugagaggauauuuaucuugggucgacgauauuagaggaaaaggcaauagauuuuguuucauggucaagacacaaauagcuacuuguccuugggcaaauugccauccuuucgagccaagguuuccccuuguguuuaaugaaacuaauaauaguccaccuaacccaacugguggaacagaaagagagaaaccaaagguauacuuuugagcacagugcccaucacaugauaggugcuuaacaaaagcuugaaaaauggauauaugugaggaguaaagcauaaacucuuuuguuucucuucguguguuuucagaaugccacuauuguucuauagcuaccaaagagccaagcaaaggcagguacauggaagcaagaaaguccucuuuaaguauuuacccuguaaacaugaggucuaacguugcagaggaagagagauaccagugucugucccagucauguaagaaaggguauucuaccacaguaucagguauuugaagauuuugauggauagagaugugggguggugaguacuguagucaaagacaugauuauaggauuagagucauaguuugaagaaucucuguugugagacaaaaaguuagaauaguucauuugacaucuaugugucuuggaaucaaaucuggggaagcuccuaaauguugagauaaagacauucaacagaucuacuuaucugugaguauauaccauguguguucuuuugugauuggguuaccucacucaggaugauaauuucuaguuccaucuauucgccuaagaauuucaugaauuuguuguuuuuaauggcugacuaguauuccauuguguaaauguaccacauuuucuguauccauuccucuguugcgggauaucuggguucuuuccagcuucugaguauuauuauaaauaaggcugcuaugaacauagugaagcauguguccuuauuacauguuggagcaucaucuggguuuauggccaggagugguauugcuggauacucugguaguacuaugucuaauuuucugaggaacuguaaaacugauuuccagagugguuguaccagcuugcaaccccaccagcaauggaggaguguuccucuuuuuccacauccuggccaguaucugcugucaccuguguuuuugaucuuagccauucugacugguguaacguggaaucucaggguuguuuugauuuucaucuucccgaugccuaaggauguugaacauuucuuuaggugcuucucaaccauucauuauuccucagugagaauucuuuguuuaucucugugcccuauuuuuaauaggguuauuuuguucucuggagucuuaacuucuugaguucuuuguauauauuggauguuaaccgucuauugauguaggguugcaaaagauaucuuccccacuuucuuuucuuucuuuucuuuuuuuuuuuaauuagguauuuccucauuuacauuuccaaugcuauucacuuucuuuucuauuaguuucaguguaucagguuuuauauggaaguccuugauccacuuggacuugagcuuuuuauaaggagauaagaauggaucuguuugcauucuucugcaugcuaaucaccaguugaaacagcaccauuuguugaaaaugcugucuuuuuuccacuggaugguuuuagcuccuuugucaaagaucaagugaccauagguguguggguucauuucugggucuucaauucuauuccauugaucuaccugcuugucacuggaccaauaccaugcaguuuuuaucacuauugcucugcaguacaagcuugaggucagggacacugauucccccagaaguucauuuauuguugagaguaauuuucacuauccucgguuuuuuuuuuuuuauuauuccagaugaauuugagaauugcucuuucuaauucugugaagaauugaguuggaauuuugauggggauugcauuguaucuguagauugcuuuuggcaauccugccaguacaugagcauuggauaucuuagcucagaagcucggaauacccaagauacaauucauagaccaaaugaagcucaagaagaaggaagaccaaaguauggauucuuugguccuucuuagaagggggaacaaaagaucuaugggaggagauacagagacaaaguguggaacagagacugaaggaaagaccauccagagacugccucaccuggggauccaucccauauacagucaccaaacccaaacacuauuguggaugccaacaauuacuugcugacaggagccugauauagcucucuccugagaggcucugccaguguauuacaaauauagagguggaugcucucagccaaccauuguacuacgcacaagguccccaaagaaggagcuagagaaaggacugaaggaggugaaggagcuugcagccccauaggaaaaacaacaauaugaaccaaccaauacccccacagcccucagggacuaaaccaccaaccaaagaguacacauggagggacucauggcuccugguacauauguagcagaggauggccuuguuggaugucaaugggaggagagguucuuggugcugagaaggcuagaugccccaguguaggggaaugccaagauagggaagugggaguggguggguuggggggcagggggagggggauaguauaggggguuuuuggaggggaaaucaggaaaggggauaacauuugcaauguaaacagagaaaaugucuaauuuaaaaaaaaagacaagagagaaaaaaagaguucaaaauacuuauguggauguuggugagacuugagcuagcuaacaauacaaaugguggaucaaaaaacaaaacaaaacaaaaaaacaaaacauaaaauaggaaacuguuuaauccaaaagauacccaaagaggucauuuuucuguauugagucaaacacauguuggagcguguugacauguucaguuucaguggagggagucucuaaccaugcuucucggagaauugcuauguguucuuccccgaagugaacguuucaaucccugucacaaaguagcuuacauaaaaaaacuguagucuagaaaacauggauggcuauguuauaagauuugggugguauguaucugaaucuacauuuuaaaugucugauaguucauuagaauaaguuguucuaugcuucagacuccucaccacagaaauggaaaaagugcucagggacucccaaauaggcuuguuguaguaauacaaugagggucagaaaaguuuuccuauaaauagccaggcaguaaauauauuaaauauugagggugaacggucugugucucagcugcucaccuuugacaucauagucgggaacaacuauaggcuucaggucaggaaaugggaaugacugaauuggacaaacucaugacacuacuaagcugugcuucuauauguguuaugaaauauuauugugauuuuuuuccagucauuuggaaauacauaaaaaccaugcuuagaucucuagccauauaaauucaaauugaaugcuagauuuaguucaugaaccauggcugccaguccugacaguaauguauauaaauauaucaacauuauccaugguauuaguaaccauucuccuuaucauaacaaaauauaugacaugaaaaauucaagggaggaagagcuuauuucagauuaaacugugaagggggcccaguccaucagggcggggaaggcacgaugguugcagacgaaggcugcuagucacaccaacagccuaaucaaggagcagaggguacaggaaauggggcugggcuagaaagccuuaagacaggcauucaguaacccaguucuagcaugggccuaccuucuaaagguuccacaaucuucuuaagcaucaucaccuguuggagagcaagggcucaaccacaugagccuauggagacauuugaaguuucaaacagaccaucaacccaagauguggcuuagaaaauggaggcuguuugcagugauggcugacuaggccaucuuuugauacauaugcagcuaaagacaagagcucccggguacugguuaguucauauuguuguuacaccuauaggguugcagaucccuuuagcuccuuggguaauuuuucuagcuccuccauuaggggccgugugacccauccacaggacugugauccuccacuucuguguuugcuaggccccggcauagucucacaagagagagcuauaacuggguccuuucagcgaaaucuugcuaguguaugcaauggugucagcauuuggaagcugauuaugggauggaucccugcaaagagaggcccauuggacuugcaaacuuuauaugccccaguacaggggaacggcagggccaaaaagggggaguggguggguaggggauuggggggguggguaugggggaccuuugggauagcauugaaaauguaaaugaggaaaauaccuaauaaaaagaaaauggaggcugaagugugagucgaaaaauuccuaccagauuccagaaaaggcuuuuugccucguggguauacagcugugaauuguugagcauuguagugaggcagaguaccgacaccaagucccuugcuucccucagaauucucuguacugaugaguuucuugggugugggcuauuuucagagcucucaggaugacaagguagaaagauagauggaaagaggaacugagaggaagagagugccuuauucagagaguacuaguuguuaucuuggguucuacgccgaauccuaugcaggaaugaaucaaacuuuacccucaggcaucugagcaugaaaaaugaagccgaugagacacggcaccauccucccccaaacuacucaaccuuguuaaccuuucagggggaagauucggugcuuugaggcaaaaaaaaaaaaaaaaaaaaaagagguguaaaccacuguaugaaugaaaugaauaaacaugaguaccaagaaacaauucuuaauuugaagccaugcccuucccauggcccaagggaagcaucuauuacauaugucuguuggcucauuacuuuuaagaauucugaauguaguaagcucauuuccuuuucacagauuuuuuuuuuuuaaaaauugggaaaaaaguguuugcuuguuaaaaaaaaaaucuguuucuauuucuuaaaccccacuguaacucaaaagccauuguguagccaaugaaucucaacagacauguuugucucucuuacugcuuccaggccauguucauaagacaauccauauucaucuuuggaaauuaaccuuugacugcccugccuagcaucccugggaggucuaaacaucagcccagucguuucacagggcacacuuucuccagccucugaggcuucuuauauuccaguuauuaucucuuuucucacuguggauuuaagucauuacagguuuuggaagucaagucucuuguucauaaguucugugucugagcuaugcuguucuccuagaauugauguuuuccauccaagaucagcuuaauucaugugaagacaaauuaugacaaaagagacaauuuaaagaagcuuuguagcaaccagaccucgaaauuuuuuccuagcuccagacucaucaauuauuuugaagagugaguacuauagcagggguuggcaaguccaguugauucuacagaguguugagcaucuucuauuuaguacuaguugaaaauccaacaauggauuuuuuucaaugaagagaaaaacuaugccugaacucugaacucucuagguaagaagcuccaagaaggaugccaacaaaaagagggcuccacagagagcccagagaagggagaacuggaucgagcuccuaaagacugccuagugacacuuggaucuugaaaguaagaaagaguugaagauucagaaauuguugaaaaaguaagugugggugaguuugguugccagauuuuucgguagaaagguaacaagauggaaugaugcuggauuugagagagaacugaggagaggcaugcggaagcaagggagcacugaaaaaugaaaguggggaacucgggaacagauggagaguaaguauccugcagaaucacagaugccaaauugcacguagauguggaaaaaaaaaacaaagaaaaaaaucucuccugcuacaaauugggugggcagaagccuggcgauguagccaaacuugaauaagaagcuggcagugugcuuucugcaaucagcaaagugaucaaugacuuagaguugucuuccagacuccugguccacuauugccuucuguuuauuuuauuaaaaauuauuaaaaaccauuagauaggcaguauaauauucuuaaguacaaauuaaacgacaccugguagugagaaugcugaaaaggauggagaaucaaucaauuaaucucucucucucucucucucucucacacacacacacacacacacauggccuuuaaaggagaaaauuagacacaugggaaauaaacaacaauacuaaauaacaaacucccaacuuuacacucauauggaaauggauugucaccuugcuuuauauaguccccaugggagacggugcuuaauuggcuaaagguggucuuuggaauuaguacugacuggauuggauuugauucugaguauguccuuugucacuguuucucucaaaugguauguggauugcuucuucuaucuauucaguuagcauguucugaaccuauacaaagcaggaagaauuguaccauauaccuagguauuauuguuacagauguaacaauagcuauguccuagaaucagcccagaugcccaucaaugggagaauaaagagaaugugauguauacauacagugaaguguuauuccaccaguaagaacaaaaaugauauuuucagaaaaacaaauaaaacugaagauugucauguuaaacaccauaaaccagacuuagaaagacaagaauaucuuuuuucaacuguguagagucuacccaugccuuacuccaaaggaaaaaugaaaguagaaguauauuuagaaagaggaagaugaguaagagagagaggauaaaaggaggcucagugugagaaauaaggacaaaucaaaguaccuuaucuauaugauaaaaaugucaacaaacccacuacuuuguauaagcaauauaccuuaauaaggaaaagaauuaggcuauguuuuaagaaagagaauguugaugggacuguagauauaucauuuuaaaagucuuuaucuugaagaucagauaucuaacagguuuaacuuaaccuguucuuugaaaaauucaugcaagcauagaauauauucuggucacuccauuacccucaugaagucucaucuaguuucuaugucuuuuuuuuuuuuuuuuuuuuuaacuuugugacuugcuugguuuagucagggccaccaauauggcuaugaagucauuuacuggagcaugaauaacuuaucaguaucuacagcacugaagacaaagucuuauucuuugccagcagcauuugauuucuagcauuccucuaugugguaucccaugaacuccuccaucugucucugaauguuuaggguguuagucaugcagaagcuguauacaggcaacuccaccuucagugaguucaugaaugccaagccaugucaugacaauauuucaaaaaacuccuccucauuguuugguucauaccuucuuucugucccuucucacaauguucucugggcuuuggaggagaugaugaauguccuauuuaaggcugagcacacaaccuguucucaucaccuugaacaucugugcgucucuauauuaauugcuguccauugcaagggaaaacuucuuuggugaaggcugaggguauaacccuaaguguuuaggaggcagccugaaaacaugucacuuuauaacaaauguacauuuuuacuguuuuauggcuagaaguggguacuaaacauccuauagcuuagaacaaagugccucauucagccuggccaggggauguuuggaagagccaaggaagauuaugucuaggagcugacacauaaguacaauuagcuucuucuuucuauugguccagauucaaaaccauggccuucaaaacugagaucaauacauccaucaaacuugauugcugucacuuguucaauuaucugaucuccuuuggaacuuccaaggacagagacuauuuccaaauugcucuccauguguaacaacaucugacacauaaugugugccuuuuaaauaccaguugcuuguuugggaagaaaauacuaguuagugaauuucuaccccuuuucuggagagcuaagggggaauguugcuguaacuuuuaaugauugcucuuuacuuuccuaacucuggaccaguucuggaaggaaacaaggaaaugacaaaaaccauggaauguuuggacuguguggagacuuggguauaaccugacucuauacuucaaaguucaaagauguuaccuguuaaccugaucacaaccauaugauuaguagcuaagcaaaucuaaaagccguguacccaaauuccuucaggugagccacauuuaguggggagugcaaaggacugugaaagcacuucuuuugccugaauagaggauguauuugacuaaugaagagucucaucuugcaagcgugacuuuuuaaaacaaaaauauuuuaugugauagaauuauguucuacaaaacuccaaaaauuucaaccauguuugcuuuuguucuaugugauugcuucaggcaaguguguguuccugauuguauaaagaaaaaaggguggcuccuucuuucaucugaugucucaggccccagaaggaaauguuggaaacaaauguuuccuguaacuguaaugcucccuugaaacauaagacuugaaaaccuuuaaggucccaauggaggagcucgagaaaguacccaaggagcuaaaugggucugcaacccuauaggaggagcaacaauaugaacuaaccagaacccccagagcucaugucucuagcugcauauguagcagaagauggccuagucggccaucauugggaggagaggcccuuggucuuaugaagaucauaugccccaguacaggggaaugccagggccaggaguugggaguguguggguuggggagcagggcaggaggaggcuauagaggacuuucaggauaacauuugaaauguaaaugaagaaaauaucuaauuaaaaaaaaacaguauuaaaaaaacaaaaaacaaaaaacaaccuuuagggaucccaguguuccuucagaauugauuuugacccaguagaguuacauucuaaauaacuuucaugccaaacuaaguuaagaggagugauuagacagcuuaaaauaguuuuuuaaaacuaguuuuccuguuaagaggaagaagugcuguguauccuaugacuugagaaugauuuuuaagcugcugauguuucuuccuccuccucuucuccuuuuccuccuuccuccuccuccuucucccucccccuuuuccuuccuucuucuuccucccccucuuccucuguuuuauucuuccccuuucuguaccccucuucuuuuuuuaaaugcaugggguuauaagcagguaucucuagggauguucaugcaccauagagcuguaaagaaauaccaaaaauaagaucuagagcacugguucucaacuuguggguccugaucccuuuaggguugaaugguccuuucacagggaucaccuaaaaccauugggaaacacagauauuuauauuauaauucauaacagcaacaaaauuacaguuauaaaguagcaacuaaaauaacuuuaugguugagggucaccacaacaugaggaacuguauuaaagggucacagcuguaggaagguggagaaccauuguagaggauauaaaauaugaacacauuauuguauuacuaauaaaccacugcaaauucuaacauguauuaaauauucauuguauguuaaccuguguagguggaauauacaagguccauaauaucccagugaagguaaauuauuauccuuauuuuaaggaugauagaaugaggagccaaugugauagaucguauuacaaacacaaggcccugagcucagucccccagaagaaaaagccagauauuauggcacaugcuuaucauccagugcuagagagauggagacagguggaagcuggggucucacucuuuagucagacuagcauuuuucaggacagagggaaaucuugacucaaaaagcaagguuggagagcacccaauauuauucuccaccauuugucaacacaagcacaaaggcaugcuccagaaugcacauacaugaaugcccaucccccacauaaucccacaagaacgaaaugagcugaguggagugauauauaccuguaaugcuacuuugagcuacauuauugacuuaaguaugggcacuguaaugggagcagagaaaacaaaaaccaaaacccaaaaagagagaaugagacugagaaggcaaauauaauuuucucaagaucagagagggaggaaaucauugaguucauguacagaggcacacacagauauuuaugggcaagcaucucaucaaagcauugccuauaguaauagagucuggagaccauccaaauucugaacacuuagaaauggccucaguggccaggccaaaaauggaaaagggcaaacaaaacacaaagaagaaggaaaucgcuccaaaccccaguuuuuuaaauaaccauaaggagaugucagugcguaucuuuggaaaucuuuucuaucugaaccaaacuuggagucauacuggauauauuaccuugaagucacgcuuuuuauuuuuauuuuuuauagagaacaccacacacuguuuucaagucauuaaguauacuauuuauuuuaacaacuccaugguauuaucuuauuaauauauauuauaucuuacuacaaaucuuuuuaucauugaaucuacuaucuuuuaacuauuauuuaaugauaccgcuacugucccuaauucaucauacccaggaaguaacucugacucucuagggccuuuugccauguguugguaccaacuaugcccacguagucacuguggugguuugaagaauuguccuauagacucauguguuuaaugcuuggcucauaaggaguugcacuauuaggagguacggcuuuguuggaggaagugcgucauuguggaggugggcuuuggggcuucauuuaugcucaagcuaggacuacucucagucucuuucugcugucuguuggucaagauguaggacucucaccuccuccagcaccaugucugccugcaugcuucuugaaaugaugauaauagaccaagccucuaaacucuaagccagccacaaucaaauauuuucuuuuuuaagaguuacagugguccaggugucucuucacagcaaaccccaagacagucaccaauccuggauaguauacaaagaaguauauuuagaagugaaauuggaggucucaaaaagcaaucucucuuacuguauuuuaucuuuuacauaaucauacauuguauuucacuaaaacucugcaaagagaacuuuuuuuuuaauuagacauuuucuuuauuuacauuucgaauuuuaucaccuuuccuaguuuucccucugaaaaucccuaucccuuccccccuucuccugcuccucaacacacccacucccauuccugguccuggcauuccccuaauacuggggcauagaaccuucacaggaccaagggccucugcaaggagaacuucucuggaguggcuuuauaaccugccauaggguuucuauugcugugaagagacaccaugacggagguaacucuuauaaaguaaaacauuuaauuggggcuuacuuaaaaguacacagguuuagacuauugucaucauggugagaagcauggugacagauaggcagacaagguacuagagagguaucugagaacccuguaucugggucagcagacagcagaagcaagagagauccugcucccaguuugagcauuugaaaccccaaaguccacccucagugacacgcaguuccuccaacaagaccacaucuacaccaacaaggacauccuauuagugccacucucuaaugaccaacucauuaaauauaugagccuagggaggucaugucuauucagaacaccacauaacucuacaugacuguaccaugccuuguuauuuaauuggaugaucaguaagugaaacaggaauaaaggaaggcaauguaauauauccagcauugaaaaauuaaaaauaauuaaaauacuaguucuaaaaauauugacaacaauuaaaaggaaaagagaaaaagaaauguccauaaguaaugauagagaaaaaguagcagauuugauaaaaauaugugauagaaugcuagcuauuuugguaguguaagccugggagaauuuaaaaauaugauuuuuuugagaggcuaagguauaguuguauuauuugcuaaauuucccacaauauuuuaggaaagaugguaaauacaugaauuucauuugccaacauauuuccaacucugagcugauuuuguuagauaaugguaugcacagguguuuuucuuagacaagauacuuucaguauuucucuauagccagaaagcagugaauucuuagaaccauccaaugaaguuaguauugcuuuuguuucaguuuuaccacacuauggcccuuagauacucaguagcuugcuuaugguaaccagcuaggaaauaucaagguuacgauuugugguaaguuucuggacuucaaaguucaugugucuucugacuaaguauuaaaaugguuauagacucaguaaaaaaaaauuaguucauuaacugaaaacuuuuaaauacucucaagagacuuaaacuauuaccuuugaaucagcgauuacauuuaugaaguagcacggggaggaaguguguggcgauugcuucaugucaucucuuugcucuaauaaccuauaaacuuaggcuuaaccuguagauucuuuuuuucuacagaaaaugcuucuccacuuccccuccacucauguacgcauccuauucugguuccuaaaaguuuuguguucaaauuuccaguguaagauuuagcugaauggugcuguguuuccuguagaaaauguuucaccaacauucauguguucuguguucaugugguauaguggccacuacauaugcauuuacauuuuucuucaaugagagccuuuguuauuccuuuacuacaaacauucuuuaaaaaaccccaaaccccaaaaugagcauugcaauuuacugcugcuauagaaacgugcaaauucaaugucuguggucgcccaacucuuccugcagaagguuugcuuucuuaaaaucaagcaaauauuuaauuugucacauguauaaggcaaguguuguuauaacuucauugugccauauuuagugucaugacaguagcgacagaauuuuucuuauggcuuuugauaggcuuuuuuggucuguugucuugaaaccuaucugacaacaaauacaauacguuguuaucauggugggaugggcacaucuuguuucuuuuuugaaacaguaguaauuuguucuuuauuuucuugucaugcagaaauuaugauccuuuauuaaauucauguuuuucaccccagccacucucucuuuuuuuuuuuuuuggcaguauuauuucaccauuuuuuuuaauucgguauuuuccuuguuuacauuuucaaugcuaucccaaaagucccccauacccucccccaccccccaacccccuacccacccacucccccuuuuuggcccugguguuccccuguacuggggcauauaaaguuugcaaguccagugggccucucuuugcagugauggccaacuaggccaucuuuugauacauaugcagcuaaagacaagagcucccggguacugguuaguucauauuguuguuccaccuauaggguugcaguucccuuuagcuccuuggguaauuucucuagcuccuccauuggggggcugugugacccauccaauagcugacugugagcauccacuucuguguuugcuaggcccuggcauagucucacaagagagagcuuuaucuggguccuuucagcaaaaucuugcuaguauauacaauggugucagcauuuggaaacugauuaugggauggaacccuggauauggcaggcucuagauaguccauccuuuugacacagcuccaagcuuugucucuguaacuccuuccauggguguuuuguucccaauucuaagaaggggcaaaguguccacacuuuggucuucauucuucuugaguuucaugcguuuagcaaauuguaucuuauaucuuggguauccuaaguuucugggcuaauauccacuuaucagugaguacauauugugcgaguuccuuugugauuggguuacgucacucaggaugauauccuccagguccauccauuugccuaggaauuucauaaauucauuuuuuaaaauagcugaguaguauuccauuguguaaauguaccacauuuucuguauccauuccucuguugaggggcaucuggguucuuuccagcuucuggcuauuauaaacaaggcugcuaugaacauaguggagcauguguucuucuuaccaguugggacaucuucuggauauaugcccaggagagguauugcaggauccuccgguaguacuauguccaauuuucugaggaaccgccagacugauuuccagagugguuguacaagccugcaaucccaccaacaaugcaggaguguuccccuuucuccacauccucgccaacaucugcugucaccugaguuuuugaucuuagccauucugacuggagugaaguggaaucucaguguuguuuugauuugcauuucucugaugauuaaggauguugaacacuuuuucaggugcuucucugccauucgguauuccucaggugagaauucuuuguucagcucugagccccauuuuuuaaugggguuauuugauuuuuuggaguccaccuucuugaauucuuuauauauauuggauauuaguccccuauccgauuugggauagauagguaaagaucuuuucccaaucuguugguggccuuuuuguucuuauugacggugucuuuugcuuugcagaagcuuugcaauuuuaugaggucccauuuaucgauucgugaucuuacagcacaagccauugcuguucuauucaggaauuuuuccccuguacccauaucuucaaggcuuuccccuacuuucuccucuauaaauuucagugucucugguuuuauguggaguuccuuaauccacuuagauuugaccuuaguacaaggagauagaaauggaccaauucgcaaucuucuacaugauaaccgccaguugugccagcaccaauuguugaaaaugcugucuuuuuuccacuggaugguuuuagcucccuugucaaagaucaagugaccauaggugugugguuucaucucugggucuucaauucuguuccauuggucuacuugucugucacuauaccaguaccgugcaguuuugaucacaauugcucuguaguacaguuuuagguccggcauggugauuccaccagagguucuuuuauccuugagaagaguuuuugcuauccucgguuuuuuguuauuccagaugaaucugccgauugcccguucuaauucguugaagaauugaguuggaauuuugauggggauugcauugaaucuguagauugcuuuuggcaagauggccauuuuuacaauguugauccugccaauccaugagcaugggagaucuuuccaucuucugagaucuucuuuaauuucuuucuuuagagacuugaaguucuuaucauacagaucuuucacuuccuuaguuagagucacgccaagguauuuuauauuauuugugacuuuugagaaggguguuguuucccuaauuucuuucucagccuguuuauccuuuguguacagaaaggccauugacuuguuugaguuaauuuuauauccagcuacuuuauugaagcuguuuaucaggcuuaggaguuuucugguggaauuuuuagggucacuuauauauacuaucauaucaucugcaaaaagugauauuuugacuucuuccuuuccaauuuguauccccuugaucuccuuuuguugucuaauugcucuggcuaggacuucaaguaccauguugaauagguagggcgagaguggacagccuugucuagucccugauuuuagugggauugcuuccagcuucucaccauuuaauuugauguuggcuauugguuugcuguagacugcuuuuaccauguuuagguaugggcagccacucuaucuuaugcucaucuccuggauggucuuucauuguuuugucacuauaucaauuuuuuuuuuugagacaggguuucucuguguaggccuggauuucuuggaacucacucuauagaccaggcuggccuugaacucagaaauccaccugccccucugccucccaagucuaaacuuuccaaaguggagaaccaguuggauuauuugggagucaggugucuaucuuugucucuacauugaagaagguuacauagaauaugucuauaaugauuucauaaaugaaccugagauuuaaugcugaccgaguugaugaaucaacuauaggaccuuguaacucuuuuuuuuuucaagugcugauuaauauacuaaacaucucucauguguauucucauuucuucucccaccccuauuuuuuugaacuucauguauauagagagaacuuagaggacuaugguaguuuuuuauugaucuccuuguuucuuaagcacucaaccacacccccagauucaugugcacuccagaucccugaauugaaaaacaccaagugacuacuucccuaauucugaguucaucaauugcuugagguauaaaauacaaacacaaagauuaugcuguacaaauuucuuggaaccaggcucuaucuuccuccuuuaucacucugauccauugugcuguucugagugaccugcuguucacaugaccacaccuucucagcuuccuucuauccuagcucuuucuuauuauuucuuauaaugguaacuccuugauuuaccauggauugcauucuaacaaacuuaucauaagcuggaaaauguccuauguuggaaaugcauuuaaugugucuuaccuauugaacuuuguagcuuaugccagcuucucugaaucauaaaccuacaguuggacaagaucaucuaacagaaguuugauuuacaauaaaguguuuagaaacucaaguaauguuuugacuagaguacccuauagaguucuucuuguuucugcccaugaucauauaucgaucugcuacaagugagcuuuguaaaccaaguucacaauauuuauggcuaacacagaaaaaagauuagaacuugaccuuccaauuaugaugucuauugcaugcauauuuucaccugugacguuuguacugccaugagugacagcauuauaaaaugacagugucaaggugagaaccaucugcauguguggccauaguauggcugggguucauggaauggcuguugagugaaagaaauuaggggcuaagauagaugggucagcagaaaaucaugauugccgcaugguugaggaccaaguucagugaaugagcuaugaaaggcuauggcagaauacaagagcagccucuguucuugacauuggcaggauuauuuuuucaucuuugcaaguuuuccugaaugugcuccccgaaucccuagauacacaugaaaguuaugcaaauuaucauaaaguuuagcuuuccaagcaaagcacacucucagcaaaaugucaucuuauucuaauuuuuauaaaaugaaaucaauuucacauugcagcuuucccucaugugacuuagaaaaacuaauuggcaccuucaauuagcaaaucuaggaaauguugaaauaguuuuuaaaacaguauuuuuaaagagauuaugucauacuucugaaaguuguugggaucaaauaauugauauaagaaaaauuaaacugccuuaacauuugugagacucaauuucauuaucuguaaaauggaaauuaauuaauaccuuaguuauuuucaaacagauauguuuauauaaauuuaaaucaccucaauuuuuauuuuuaccuuuuguugugacaaaaagaucaauauucuaucucucaauuucaaauuccuaaaucuaagguugcagguauuuauugaucgaauaacuggccaagucuguuuguuauguugaaaaagaagacaaaagcuagacaugguaacacuaaaucccaaacuuagaagaaggaagaaaaauaguuuauauccaaguagauagacugacugcuuaggagacaagaugagugugaucuuauuuacaaaagauaaaugggagauuggagccacacaguugaacauugauaacuaaauuuuuagauagauggagacucaauggaauaaauaucccuuuaggagcaaggauagagaaaacaguaagguaaaacagaaagaaguaacagggacaaacacuauugcuuuccacugaacucaauucucccauuuugcuauccacacuuuguguguguguguguguguaaaccauauuaagcaggguaaacuaaauuugguacugaugaugaugauggugguggugguuaucaacauuuucugacaccuuccauuuaaacaauaucacuuaucauaauauaggacaugacaaagaagagaagaugacaggcuacuuaaauggaaggaacuuaaaugaauugucaagucgaggcugcagagauggcuuggaaguuacaagugcuugcugcuguugcauaggaccaagugaguucaguuucuagcauccauauuaggcugcucauuacuaaugguaacuccaacuccagagcaucugauuccuucaucuggccucuuagggacccuauauacacauaugcacauauaaauaaaaacauuuaaaugucaaauuaagaaauguaugucaucuuucucuuauaacagauaucugagauaacaaguuuucaggaagcuaagauuuaucgugacucagaguuuuauagauuuuacuccgugaucacugacuggcuugcugauuucagcuugugguagcacauuaaggauggagccuauggugaaguagaaucccacuuucucugcuugguaaggaaaagguaagaaaggggagaagaaaggguuucauuccguuauagucuucagugaccaaaaucuuccuguuaggccccaccuguuaaagcuacacccaaaucaucauuuuggaaaacauaccuuuuuuuuuuuuuaagauuuauuuauuuacuuuauguauaugaguacaccauugcucucuucagacacaucagaagagggcaucagaucccauuacagaugguugugagccaccaugugguugcugggaauugaacucaggaccucuggaagagcaguuggugcucuuaacugcugagccaucucuccagccuggaaaaccuaucuuaaauacacgaauguuugcuggugggggaaacauuugaucuuuaaacuauagaauaauacagaaugaauuaaucuucauuugcuucuucuuucuucuucgggcaccaauagauuuacacuagaagauacuaucaaguaguacuuauguggacacauuuuaaaacauuucugaguucagauuuauuaucccuaaaauauggaaaauaauucucaacaagaacuugcaacacuguugcgagucuuaaauaaaauauguccagaaguaacuugcaaacuacagagcauuaugcauaugugagacuucaaauguuguuuagcauggcacucaacggugagaugaucauuuacaaacaacaguggauacauugaaugugggcccuacggugauaaccugaugagauuucagugaaaugaugagguaagagacauaauggagauggguucacauagggucuuuugagucauuguauuaagaaacauugauguuugcaaagaauaaauaaauguaauauuguugaaugcaggguuagcauaagauauacuuuaagaugauguguuaggcugcuaagccuagggcagauuauaguagggugaagagaagauggggaaaugaguggaguuuuccugucauaugggugacaggaggggauaguuagguuggaauggugaugguagggcugaugagagagaacacacaauggacuuaccugacaaauaggaugugggcuaugauggaaggagggaaccauacuagaaucguaguguggccuuugcacagcaaagccagauugcuauccuaugugguguggaggcugcgagggguacagguuugauagggaggaggaagaggacaguuuuggauaugugaaguuugagggguggauuggguauccaaguagauaacuaguagugagcuggcugucauacucuagagcuugggagauagggcuggacaagagacugaaguguuacugauaugagacaaaugcaugcaaacaacuucaguccagguggcaaggagguuuucccaagcuugcuuauuuauuuauuuauuuauuuauuuauuuauuuauuuauuuauuuauuuaacuauuuaacuauuuaacuauuuaacuauauauauauaaaggaaguguguguguuuaugccccagcaugcuuaugaauagaugucagagggcaauuucuaagacucauuuuucuguuccuaucaugaagggucagggaacaaaggcucagccuuuacucacagagucaucuugccaacccuauuuuaucuuacuuucauguaaguccaggaacuagagguuucuaacugcuuucccucucuuucucccuuauuuguccuacaaaggacuauccauguauaucauagcuucuugggcuuuucuauuucauuuugucacuucuauucuguuucucaaguaguuacugacacacuguguugagauuuuggucuaagcuacaaagaaagccauggugaugucaguuguaggaaacgagaaacugguauaccgaccacugaaaaccagagaugagauuguugcacaucugcccaaagacuuaagugugacucagaaguucugcuaucaucaaagcuccuguccuaaguguaagcuaauauggucugugccuuugugggaccaaacauuugugguucuuagaaagcauaccgggaggaccaggcaaguugcuuuuuuuuuccuuucagaaaguaaauauuuuaguggagaaaagucacuguuuaucucugagaagccuuaaggcuuauucaggaaaaaugagaguugauagagaguugcuuagaaaaaacaaugacuccuauuuaguuacuuugcaucagauuaaauguuacaucaucucuaagucaucauugauuuccaaaagaaugaacagcaaauccauggugcucaggagguauaaacaagauuuauuaccgagauaguguacuucacuugcaaaaagcuaucaggaaauaaaaagccacccaggccaggaaugaccuugagaagauucucuggggaguucuuucuaugugugaacuuauuugguacaaaugagaauguaagguauuucuguguagauuccucuucuccuuugacaaaagagcuaagggacuucaguauuucuaggcacuugucuacagcaucauuugggaaucucuuagcgauguuuuggcugucuuacacugguaugacuguagcugguuccuuucgucaucuuuuagcacacagggccagaugcuccuggagucacaccaugaguuugaagcccucaggcaucuuuuaguugaguuuuuauuucagggauuggacaucugaggcauuuggggggggggggguuaaagggauuaccagucaaaugcacaaaagcuauagaucaagaaucaaaagcaauaaucuagacuguaugcccagugcucuuuuacuucaucucugaauuacagguauguucaaagcaggguaacagacuugauaggggcauugggggaggacaugauaacagagaucuccagcguuguuuuagaacuuucaguuuuacuucauacccugagaccccaaauuuucacagaugagugagguuacaggguggaguauguggaggaagcagguuugggaaaggaacuuuugagcucaaguuugcaaaacccacaguuguacaacagcucagugcuagccaacacccuagggugugcaaaaagcuaagagaguguacagccaccugggucuuaauucugcuuucacaacguaucugcagggccccaccaacgcucaccacugcacuucauaaugccuuggacauuuugacuuucugaauagucagggcuggucuuccauuugagucuaccaagcgagaggauucccugagacacuuugcaagccucccugcugugaaagaagaggacuauguuuggaaggcuucagacuacacucaacagugagugaugggcagagguggcugugugcuuugucccauuauguaaagaagacacaaccuuucaguuaucuuccacaguuucacagcugugacuuacugaagaccaaaucuggccaugcuacucuaugccuaacaucuucaggaucaagacccagcucuagaguaauuuuguccacagucaugccuuucccccacuucucucuccgcacugccacaacugucaacuugauacaagcuaaaauuaucaguaaagaagaaaccucaauugagaaaacucucccuaccagauuggccuguggagcaauuucuugguugaagacugauguuggaggacccaucccacaaugauucugccguccaugggccagugguccugauucuuguuacaaagccaacugagcaagcuacaagaagcaagucuuagaaaggauucugcuucaguuccugcuuucacgaaccuuccaugcuuguuuuccugcccagacuucccucagugauggaucuuuaucuagaagucuagucugaaauaagcuuuugcucaguguuauauuacagcaguggaaacucuaagauuccacauauguauuggucaggaucuggcagaaucucuuaggagacaguuguaucaggcuccugacagcaagcaucggacugagcauggggaccccauggaggaguuagaugaaaggcugaaggagcugaagggaccuuaucuggcaucaaugggaggagaggcccuugguccugagaaggccccuugguccugugaaggccugaugcuccaguguagaggaaugguagagcaguuaggcagaaaugggugggugggagagcauacucauagaagcaggguaagggaggaugggauaggggguuugcagaggggaaacugggaaaggggauaacauuugaacuguaaaaaaaaauccaauuaaaaaaauaaaugguauuuaucaggcucugguagagucucucaagagacagcuauaucaggcuccugucagcaaguacuugcuggcauccacaauagugucaggguuugguagcuguauauggauggauccccaggugggacagucaauggaugaccuuuccuucaguuucugcuccaaacuuucacucuguauguccucucauggguauuuugauucuucuucuaugaaggacuuauguauccacacuguggucuuccuucuucuugagcuucagguggucugugaacuguaucuuggguauuccgagcuucugggcuaauauccacuuaucagugagugcaugccauguguguucuuuugugauuggguuaccucagucaggaugauuggacugaacaagggucccccaauggaggaacuagagaaaggaccuaaggagcugaagggguuugcauccccauauuaggaaaaacaauaugaacuaaccaguacccacagagcucucagggacuaaaccaccaaccaaagaguacacaaggagggacucaaggcuucagcugcuuauguagcaaaggaugaccuugugggacaucaaugagaggggaggcccuuggccuugugaagguuugaugccccaguguaggggaaugccaagacagggaagcaggaguggguggguuaaugagcagggggaggauggaugggauagggaggguuuagguggggaaaugaggaaaggggauaaaauuugaaauguaaauaaacaaaauaucuaauaaaaaugaaaaaauaaaauaaauuguauauaauaagaauaaaaaaaccuaccuuagcugccuuugauguugcuucucuuuacguacacaacccuaagauucauuguauugggaccuccaugccaacguguucuacauuuaagaauuuaaacaccucagaauaaagaaaaauuuacaugucua

SEQ ID NO: 7778 - RNA, 1913 nt, Mus musculus
ugcggccgggauuggagcucacuaggccaccggucgcccggagcccgcagcacagcaccaguauuguguaagugccaagagaccacucugucagcaagcuaagaggaaaaucgaggcaagaugucaggccggagcgggaagaagaaaauguccaagcugucccagucagccaaggccggagucaucuuuccaguaggccgguugaugcgcuaccugaaaaagggaaccuucaaguacaggaucagcguaggugcucaggucuacauggcugcggucacugaguaccuagcagcggaaauccuggaguuggccaggaacgcugcgagggacaacaagaaggcccggauagcccccagacacauccugcuggccguugccaacgaccaggaacucaaccagcuacugaaaggagugacuaucgccaguggggguguccugccgagaauucuccacgaacugcuggccaagaagagggaccaaaggcaagucagagacaauccucucccacccccagagaaaagaggaaggaaggccacaucaggcaagaagggggcuaagaaauccaaggccaccaagccagggacgucgaagaagucuaaagcaaaggacagcaauaaagaaggaacaucaaauuccaccucggaggaugugccgggggauggcuucaccaucuugucuucgaagagccacguucuggggcagaagcuaucccugacccagagugacaucagccauauuggcuccaugaggguggagggcaucguccauccaaccacagcugagaucgaccucaaggaagagauagggaaagccuuggaaaaggcuggggguaaagaguucuuggaaacaguaaaggagcuucgcaagucccaaggcccuuuagaaaucgcugaagcugccgucagccaauccaguggacucgcagccaaauuugucauccacugucacaucccccgguggggcucugacaaaugugaagaacagcuggaagagaccaucaaaaacugccugucugcagcugaggauaagaagcuuaaauccgucgccuucccaccguuccccaguggcagaaacugcuuccccaggccgcccaggugacccucaaggccaucucggcucacuucgaggacgacucgggcucguccucgcugaagaauguguacuuccugcucuucgacagcgagagcaucggcaucuacgugcaggagauggccaaacuggacaccaaguagcucucuccggcagcgggggcgaaggaggaucggcgugacaucacaagagcgggguuuaaaaggauugcagaagggugacagggcaugagaacggaggguggcugagagggugaauggaggcggcgggaauggguccugccugccuggggaagggguccagugcauuuuauauucucuuuacaaagggccucucuuccacaguuaaccagaucuccaccagggcuuucuuuccauguguuuuccuuccuguuguuuuagaacuuuuucaaaaacaaacaagacaaacaaacauaaaaauaagccuuguuuagauuuauagcagugacuuuuacacacgcgcgcgcgcgcacacacacacacacacgcacacacacacacacacacacaauccguucacaguuucuuugucuuuagguucuuccuuuuuccaagagaaaaggaugugacugccuaaccuagguguacugguugucucccucaguggagaagaugagaagaacaucuuggggugcuuuucuguuauaggguccccucucugauaccuaaaauauuuguaacuacaccuaaaaggguuuuugcuucgggauuuuuguuuguuggguuuuuuguucuuuuaaagaaaaagaaaaaugagaagaagaagaagaagaagaaaaaaagauccaguguuuuucuuaauua

SEQ ID NO: 7779 - RNA, 1132 nt, Mus musculus
uuaaaacaggaaagcauguggaugcaaaugggaaaaucuaccuaccuuaucuacaugacuggaaacauccacagucagaguugcuggagcuuauucaaaucaugauugugauauuuggagaggagccuccaguguucucccggccuacuguuucugcauccuacccaccauacacagcaacagggccaccaaauaccuccuacaugccaggcaugccaaguggaaucucugcauauccaucuggauacccucccaaccccagugguuauccuggcuguccuuacccaccugcuggcccauacccugccacaacaagcucacaguacccuucccagccuccugugaccacuguuggucccagcagagauggcacaaucagugaggacacuauccaagcaucucucaucucagcagucagugacaaacugagaugguggaugaaggaggaaauggauggugcccaggcagagcuuaaugccuugaaacgaacagaggaagaucugaaaaaaggccaccagaaacuggaagagauggucacccgcuuagaucaagaaguagcugaaguugauaaaaacauagaacuuuugaaaaagaaggaugaagaacuaaguccugcucuggagaaaauggaaaaucaaucugaaaauaaugauauugaugaaguuaucauucccacagccccacuguauaaacagauucuaaaucuguacgcagaggaaaaugcuauugaagacacuaucuuuuaccuuggagaagcuuugcgguggggaguaauagaccuggauguguuccugaagcacuucagccuccugucccuuaaacaguuccagcuaagggcacuaauacaaaaggcaaggaagacugcgggccuuagugaccucuacugacgugugcugucagcuggagacugaccucuccguaaagcauucuuuucuucuucuuuuucucaucaguagaacccacaauaaguuauugcaguuuaucacucaaguguuaaauauuuugaaucaauaauauauuuucuguuuccuuuggguaaaaacuggcuuuuauuaauucacuuucuacccucuguaagugucugugcugugcugggacugacugggcuaaauaaaauuuguugcauaaaaac

SEQ ID NO: 7780 - RNA, 1132 nt, Mus musculus
guuuuuaugcaacaaauuuuauuuagcccagucagucccagcacagcacagacacuuacagaggguagaaagugaauuaauaaaagccaguuuuuacccaaaggaaacagaaaauauauuauugauucaaaauauuuaacacuugagugauaaacugcaauaacuuauuguggguucuacugaugagaaaaagaagaagaaaagaaugcuuuacggagaggucagucuccagcugacagcacacgucaguagaggucacuaaggcccgcagucuuccuugccuuuuguauuagugcccuuagcuggaacuguuuaagggacaggaggcugaagugcuucaggaacacauccaggucuauuacuccccaccgcaaagcuucuccaagguaaaagauagugucuucaauagcauuuuccucugcguacagauuuagaaucuguuuauacaguggggcugugggaaugauaacuucaucaauaucauuauuuucagauugauuuuccauuuucuccagagcaggacuuaguucuucauccuucuuuuucaaaaguucuauguuuuuaucaacuucagcuacuucuugaucuaagcgggugaccaucucuuccaguuucugguggccuuuuuucagaucuuccucuguucguuucaaggcauuaagcucugccugggcaccauccauuuccuccuucauccaccaucucaguuugucacugacugcugagaugagagaugcuuggauaguguccucacugauugugccaucucugcugggaccaacaguggucacaggaggcugggaaggguacugugagcuuguuguggcaggguaugggccagcagguggguaaggacagccaggauaaccacugggguugggaggguauccagauggauaugcagagauuccacuuggcaugccuggcauguaggagguauuugguggcccuguugcuguguaugguggguaggaugcagaaacaguaggccgggagaacacuggaggcuccucuccaaauaucacaaucaugauuugaauaagcuccagcaacucugacuguggauguuuccagucauguagauaagguagguagauuuucccauuugcauccacaugcuuuccuguuuuaa

SEQ ID NO: 7781 - RNA, 750 nt, Mus musculus
aacauccaauugcaguacauugagcuccauagagacagcgccggggcaagcgcgagccagacgggcacugggcgacucugugccucgcggaggaaaaucaacuaaacaugggcaaaggagauccuaagaagccgagaggcaaaauguccucauaugcauucuuugugcaaaccugcugggaggagcacaagaagaagcacucggaugcuucugucaacuucucagaguucuccaagaagugcucagagagguggaagaccaugucugcuaaagaaaaggggaaauuugaagauauggcaaaggcugacaaggcucguuaugaaagagaaaugaaaaccuacaucaucaucccccccccuaaaggggagaccaaaaagaaguucaaggaccccaaugcacccaagaggccuccuucagccuucuucuuguucuguucugaguaccgccccaaaagcaaaggcgagcauccuggcuuguccauuggugauguugcaaagaaacuaggagagauguggaacaacacugcaggggauggcaagcagcccuaugagaaggcugccaagcugaagaaguaugagaaggauauugcugccuacagagcuaaaggaaaacccgaugcagcgaaaaagggggugguaaaggcugaaaagagcaagaaaaagaaggaagaggaagaugaggaggaggaugaagaugaugaggaagaagaggaagaagaugaagaugaagaagaugaugaugaugaauaag

SEQ ID NO: 7782 - RNA, 11892 nt, Mus musculus
agcagaacacagggccuuugaggccauuugaaacaggcugugccucuaucuaaggcguccgaggaaagagauaggauccauuugaaaggcuucauuccagcuaccucaagaagagacaggauacagaagcaggggccaauuaagcaguugguaucauugaggcaaaaacugaucgugaguuuguaggcaaucugugugagaaacaaccaagauuaggaugugauuugaauguguggacaaugagggucaaagcagagaauagacuuggccugagugccuggaaguauggguggaaaugggaaauggguugaggaaguuauuagacugaacagcgacaacgcaugggagcaugagagggccuggggaaaaagcaagggguaugcagaaagacagcuggauagcccaaguagaggaugaaccauacuguaaguucuaguucccuuucuauucugaucugugacuucccagaguuccaccuuccaucucuguaaaaaucccacacacgcaugguggcuggggacacccuuguuggagaauauagguuuuaccagaaacagucuaucacagaagaaacuuguagggagaagcugagacuaacucagguagugcacaauuaaaaaggaagacugggaagagcuuggucuauuagggaagaguccaccuucucauuucuucuuuucuccugacucuaucccaugcucugacauuguauagucguugggugcaguuggcuggaaccugagcaguuuguuuuacuugucauguuaccggugggacaaagaaggucaauguaggaaaugcaaggcaggacagcuccuguuacccacaagagcuacuucuccgugaggccucacucaccuuccaccauacaauaacagcacucuuguaagcaugucacauauaauuuagaaaguucuugugcccugggaauuaccacaaaucuuuuacaauggcugauuuuaccugagcacagaagggacuaugcuaccuaagauacacagccaaaauguuuuacagguagccugcacugcucagaaauaacacugauucaggauauuguucugaauagguguuucagauguuugaaaccagucuuaaagugugguguggggcuucuccugguggaaccgugucaucagcugugaccacuagugagggucagugacauccuaggcugccaggcaucagauuggaugagaccuuagggacaaaucgguguuuccucuucagacacuguccuagaaagcccaggacaugggucagcuaguagcuguagcccugugaggcacccguagagugcagaaagcugaggcacgacuguagggucccaggugagcuggcagccagacugcuccagcuccagcccacagcccugcaccaggcuuaggaugaggaucacguccucacucuucagagcacagaguacuccugucgggagaggagagguuauuuccuccaccugauuacaguucugcuccaagaugcuugccaccugcaagaaacaacucagaaggaugguagggaaccaccuaggccuuagguggaggcaucuacccucaaucagcagccaggggccucugcuuccuguccacagccaguugugguuuggggguuuaugcuuaugcauccuugcccuugauccugggaguugugcaaccccauuuccacucuggugcacacugcccuugacugcugcuggcugcagugaagcaucccuagcacucacuacccagggccuuccagccuuugcuguucugccaggcugccugcccaccacucuagcuguugacuuccaagaacuggcuccagaaauauaugagcccauuccaauccuguccaucuacggaggggucaguuggaugggacauuccucuuacccuucacauucucagacuuggcagagagcgugagugaaaaugguuguguaaaaguacuucaggaugugggacaaagcaaccccaguaagagacugcucagagcuacaggcugcaaggccagacccagagccugcucccucugaguaggggcuguacaaauaagcucugaacaggcucucgaggaauggugaucagaucuuucuacaaagcugcuccaucugucccacaucucucccuguaccucccugcacuccaguacccccucuuuguggcucucaccagcuccaguuccucacauaggauuugucucucuauggacugggccaacaggcaacgcugggguucacucaaugcugugagacauaagagaagggggguuaccaaguacaggaggucccagguagcucuguauuguguccuccuuugugggcucugauagagagagggcugcaucucgggaguccuuuggugaggagaaacugcuaguucugguaccucuggaacuaucuuucccaaaagauucuaaaagguagaaacuauaucacccugcaacagccuaccuagagcuggccuacggaugucagacacaaaggguuuuaacacauauaagcucuuccaccgauaguagucuugaacgauagugauuaaccagggucuaggaagacuugaucaagggugcucguacuguuaguuuagacccagggcaucauauccuagcagcccaagcuucagcaugggguccucccucucguucacccuucagggucugccuucagucauugacccuccucuuaccugccagggcuccaagaaugaagaagacagccauacuucucgagcaugacaaguugccuguagagucuuugaggaugcuuaagacacagccuccagggcccucuagauguaccagcagcccuguguccagagccuguuccagcugcaggaaaggguauuaggaagaggucccuguucaugcauucaaugccccuguccauucaacgaacuguuccuggcccugggaacccacuagugugcaaagagccugggucuggccuugagcuuagcugaaucagcuucuuccuaacugggugggcuaaugagggucuagguuucagggucugauacaguccauacagagcccugccuuacauucucagaagagugugugagagccucaguggagcucuguucaugaccacuuugcccucucccuggucuuuucccaagucuaguaaguaggcccaucaccguguccuccagcuccuggagugccugguggucuuguaguagcuccuggagggcacccagcaaugugucccguugcucugaggacagcgugaccagguccugcaacuggcuaucuacuuggucucgcaagucguggaagcuagacuccucuccugauuccuggcugaaggcuauaccuguagagaccagauggacagcuacuuaguuuugugacagucaccuucuuggggguccucucuguucccagcuuccccaggaaauccaguggcacaggagugacccugugcagcucccucacacaaaaggugccauauauacuuacuucauucccuccuaggaucuucaccagacauuugcagggcgucuuguccacacgaggcaauuacagaacucagccacccuuucuaccugucaugucacugccuuccuauuuuuccuccacccuuucacacuacucccacagaaagaacaaaggcuguccuagcuuucucucccagggcugcgagacuccucuauuucugggaccccugguucugaggcuccagcucucauccucuaggcuggagagacaacaucacuccuguauucagagagggaaccagggcuuaggacaguuaggagucuccaauggggcauuucucuuggaaguucuggcucacuuuaccuuuucagguggaggccuccacaauggccuagggacaccacauagcauuuggagaccacagaaccauaucagggcagucaccaaccuugguagucacucaccuaccccagcguuccugcagagcuuucuuucagggauguaacagacagcugcacgugaccgagcagggacaggacaaaaaacccaaagaggaagcaggacacugggucagagccugcaucugcacugcugguccgcagggcugggacucugcagucuuacccuacagggcauccuaaagcagcccacacccugcaacagagagcgcuacaugggcuuggccagggcaaugggugacaaugguuggcuccugaacucaggcuuuacccucccauggggacaaagaaggguuguguccccuauuccaggaacccccaggagaguucaagaacugcugggcccgaugcaauuaugcauaaaagucuuuuuaucauuaugagucagacuccgacccacugugcaggacaggggugcaacccugagccuaaaaggcuuggcacuuauaguaggcauaguuugagauucuuuggaauuuagggugaaggggaaggugacaaggcaagucaguuuucaaacaggauaccuguuugguccugcagcaggguaaaucacauggccgggaggggaacucuucugaccuaaagaguaucuuuaugguacuucucaggaacuaguguguguuuuauggcuggcuauagcugucugcgaccucugauuaccucccuuuuaugaucuaaaucugggacucaaaucuucccaaggauguuucucuucgaaggauaggggccagcugcaccugggaagugcuuagccauuuaucagugacacagaggcgagggagguggccauuuuucuacucaagcuggcuccguuugccccuuucucccacuucaaagccaagcagagagauccaguggccagagugagugcugggagaugguaucauccaggcaguuucuagaugugucucugcuuugggacauggaucccgacagcaagguccacugugucucuuugcucguugucugacuacagauaugcagaacgacuuuguuccaaugggauaacaagaguccuuugguagaauucaucccuacugcagggcaggcaggggcaagcuggguuucagccuccccagcaugaccgcagcagcguucuauaaaaaucaagucuuuuuggguggccugagcugcauacugcucagccagugggacaggggagguaggaccuucuuucugcuccucacucuuugcugguaucugucuucugguaggagguggguaggguagggagcagggauaaauaggcuuaccccagccaucuucuuccaccagcagcugcagaacccuguaggccaguacacugcccugugggaugcucaccauuuucucuguguccacaugacucugucccuggaccuguaagggaggcagggagaaaaggacagcagcuaucuauccagccuccagaagcuucaguuuggaggcagacaggaaaaauaccagggucuugaugacaagauuccuggagggcuggauugauagguaggugaaggugaggucagacagaccccuaugugcagcaaggacacaaacuaugcuuguguaaauggucuuucuagaaaacaaucuaaggcacucagaacucaaacaauggaccugguuuggucaaguucuaagaaaucacacaagggagccacuaguguguuccguccuauuaaauauggauauuagcccagaaacuuaggauacccaagauauaagauacaauuugccaaacgcaugaaauucaagaagaaugaagaccaaaguguggacacuuugacccuucuuagaaaugggaacaaaacauccauggaaggaguuacagagacaaaauuuggagcugugacgaaaggauggaccaucuagugauugccauaugcagggauccaucccauaaucagcuuccaaacgcugacaccauuucauacacuagcaagauuuuauugaaaggacccagauguagcugucucuugugagacuaugccggggccuagcaaacacagaaguggaugaucacagucagcuauugaauggaucacagggcccccaauggaggagcuagagaaauuacccaaggagcuaaagggaacuguaacccuauagguggaacaacaauaugaacuaaccaguaucccggagcucuugucucuagcugcauauguaucaaaagauggccuaguuggcccucacugcaaagagaggcccauuggacuugcaaacuuuauaugccccaguacaggggaacgccagggucaaaaagggggaguggguggguaggggauugggggguggguaugggggacuuuugggauagcauuaaaaauguaaaugaggaaaauaccuaauaaaaaaauaaauuaaaaaaguuacacuccauuuuggauacucuuggaaaaugcugaggugcaggcacugggguauggcuggucuaucuauaguccauacggccacaaugccccuuuugcccauuuuccacuuugcaaccaaggcuuaaagcaguaaaggcauggaggaaguuggcccugaaaggcagacuuuuaugauguuuguccauugucacagccuucugccuucucucucaggcaagaacuauguaacacaccuuaauaaaacuacauuuucaucagauaacaugguuauccuggauacaggucaccccugcagcaagauguggccacaaagccaaguucuggcugacaggacacaacacacgaagaauuucuucccuguuuuguuguguggugugcgaugcuuaugauaacuaaauaccauaaccauguugacacaugaggugagagccacacauuggaugacagaaucgaaaaauugaaagaccagaucacuaaaaacugugcagucuacuacuggggcuuuuuggcuccugucugaacuuuugugaaagggcaaaaugcuuuucuucuuuucagucaauacuguuuuuuaauuuccccuuacuugccagcaaagaauugggugucaugguauuccugggauucuggguuguggcacgaagugcuguguccuugggaaacccuacuuuuggcaaucugggaaggcugaucaccuuauucuagaacccagucuuagaacacucaguaucuccauggauuacgauauuguaagaaggaaccaaacagaagccauuuugaauaaaacuuccaguuuggauaggagucaauuaaaguuuaaguucccaagaccuuccuggguaacugacaucuacuuggcaggaagagauguguaccuggguaaguagcauccugguugacaaacugaggcaugaaagguaggcaagcuaccauaccacaguggaauaaacuaaccaauaacaacaggauaaauguaccacaaauaaauguuuccucuaacccugauccugauuguuggaaaauguaacuguaacuuggcacagauauuucugauuuucaagccuaaaagcucuauuacauucucacuugugguugcaguucagcucacgagucuguccuuugcccccgguccaucacuaguggccuuauuacaauaaaccuuucuuuucugcguaggccuaguguuugaguuguguuggaucuaccuuggaccccuuaacaauaucagcaauaaauguuuacuuccuagauacgguccuugucccagcugccugccccauugcaugcgcugggucagaagaccgucgcucuccuugaggaacgugcuuagaaggcaugugauuagcauuaccacuugcaggcuaugcugcuguccuauggcuugaccaaaugugugcugaaaacacauaucagacuugaacuugaaccccaccucuuacuggcugugguucucagcaaagagcuucuuugaguccugguuuccucagauuggaaaacagaguuaacagacacagcuccuggaaucaucaguaggaaugaaugaggucuguugagugcuuacacucaguacuccaucaugggagggagguuuucucugaaagugauaccuaccuguaggcaccugcauucgugggcaugcuaaggggaucagccaccugggccuucaaauaauaggugggaggcagagagucccagaaccuagaauguucaugugaugucagccuucccgugcaaggggcugaaguaaaugaccuaagaagggguguuuguaaccaccugugcaaaucuuccuacucuaaaggucacaugcaggaaucauccagaaaaacucaaacaaaaccagugauugugugcuauuucagacccaugauaacggcauaggggcuuacacugugucaucuguaacaccagguaccugggagguagacauaggagguuauuugggucccgauuggacaauauauuaagacccugauucaaaacagauggaagggggggcucuggugugcgaacaugagaaaccucagaaaaaccugugcaggcagggcugagaccaugucaucuuccaaggccugcuuuccccuucaggguaaggagacuucuagauagagcaucuucaugaaguugaugauauuccaaccucacugcccaccauuggcccacucuggcacaaugcacaccugaccauggcccagcuguaggagacagcugcccagccccuacauguggcuguggcucugaagcauggcaucuugcagggucuccacagccucaguuaccacguauagacucucccucuccuuccggcuguguagcuccuggaggaaggagggccugggugaccucaguuuccuggaaggcacagaaagcagagaagaucugagcugggaggggcaucugcacagcuggggagucccuccuggcuuggugcucucugcacugaucacaguagcuagggagaaacuggccugugugguggugagaggucuguuuguguaaagugaguggcagucaacugaaaaggggaaaacugaggaaagccaggaacaguccucuucaagguuucagauauccaaacauaggcccacgugagauuuaaacauuugggagauaauauuaaaauggaugaaagggucccaaauugcuaaccugggaaaccuggcagcaagggaguauccaccagcuucaggcaggugucuccaguuugcugcaguugccaccacucccuguugccacacuucuauaguuuaguucccuuuccugucucuggaugcuucuggcuugaagccucugagucugcaugugggcccagggcucaaucccauugguuacuaucucaugugccuccuggagcugugggcugucagcauccuuggcuuucuccacauaccuggaguaacuguggccauugucccccaucuuggaguccagcugcccacaaaccuucccuggcucucaccucuucucuagcagcaucucccagguacaaggggagacccagagugucugcacagccaaggcagagagguggguggucuugccacuuccagucgccuggcccuguagcccagcacucaggcucacagccccugucaauccuccugccuccuucucccagguguagauaggcccgcugugguucaccucugcagagagagaagggcaagcuacaggugccuggcaagguaaggagacagguugcaggguggcucauggugcaguuuuggccucagccaggucucaaaauggcugccaccaccuauacauugugugugcuaugcagaaaccacugagcgcgcaaagccucaauuuccucaucuacaugcagggaagaaagagcaucagggcuuccucuggggggaugaucaaaaggagauuuaacaaugugugugugugugugugugugugugugugugugugugucugugugugugugugucugugucucuguguguguuuaugacaugaaaguagaaagaggaagaaaucuaaaggggggaaggaagaacgggguaaaggcaucuucaugacaugaaaacagaaggagcacugucugggaggaaggagagcagcaagaggagggggaaugcugggggggaagguacagaaacaucaacaaauuaauagauguguguuaaauggcaggaagggccacucugccgaccagaguuugauccuugggacacucaugguaaaaggagagaacugauuucugaaagauguccucugaccugcacaucaguacugcggcacacauaugcccaacacaacacccacaaagaguaaauaaauguaaaacacacaaaaaaaucuguuaaaaagaaaaggccauaaugacauccacuguuuuguauucuuaacuuagacaauuaaugaaaaccaaauaaugauuugcuuauauuacaaggaggaacacagggggcaaaagagcgucucucuuguacauccagccacgugacaugacuaugggggcccugcuccugcuagccucacccagugguuucugggaaccaagcagcacgcuguucagugucuaggcacacucaucugccucccuugggagucccacuucacuccccagcagccucuuggagauaccugggucaggacagccagguuccagcacaucgaggagggagaagucuguggggaugaggggugugucccaaggccagagguagcucuugugcuucuuccucaccaggcagaaggggcgcaggcgcugugagcugcugaggcuguccacaggcaccagcucacccuuccugcccagcucucucaccaggcucuuggugcuccucaagaauaaggacgacaugccccuugagaggcaagggacaauaucauucagggcuggauaggggaggccucgcugauagcugcaagcugggugggaaacagagccaugagaaggcugggagcccaggcugacugucugggucccacugaucaccccagagcuagguuccaaacucuggucuuaaaguggaagccauggcuggccaaaaccacugucagguuucccugcugcacaacgguggacucugagaaacucggggccacuugacacacuucucugggugacagggcuguuccuuugggaacaccacugaaucccucugugccacuuaaugcggugguuuagucacauuuagaucaugccgccucaacgcaucucugcaaggacuccgguaguaauugugaagaccuccagcacuggccuagggccauacacuacagcucugcauccugaccccucuuucuuucucaaaggaauuggggaggcaggugugguuuacagagggaggaguuggguugagaaaggagcaggaauucuacuugccuucccugugauuguacaaauuccuauguggaaggacuuagggugagacaccagauuccucucaucuccagcugcguuguaucaugucuuucuugcuguugaagccaggaccucggugaagugggcucugggauucaccugucacauuugugccgggcagggcguugauauuagggugauccuuggacugcggagggggugggagaaaagaaauuuggcaggugggaucucgucuaggggugacugggaggcugaagaggagagccuggcacacagcccuggugauggccggaggugcuggcuccaccucucucuagaguaauuccuagguucaacagucacuuugagggauucagaaaaaaaagucugacuuauuuaaaaaucggaagaagggaaauuaaaccuuucaaguaugucacaauacaaaaaaagaugguauauuauauguuuuuaucccaacaguacuaaaugauaauuuauaauauuucugugguagcaggguuucaauaaagagaaaucaccuggguccuccagcaucacccucuugguaccuagaagagagaggaggagaggaaucugggcccuaguccugggcaauggcgacacuccuaugggaagcagaaggcucacacuaagggucagcccaagucagggaggccacagagggaggaggcacgcugaacugcuguucagagcacccagaacagcagcucaaggacuaaccugaggccuuaggacaugugccucagcuucccaccucgguguagcggcuggugggugccaccuggcugaccuaccggauaccaag

SEQ ID NO: 7783 - RNA, 1373 nt, Mus musculus
aagucaagaucuccacaucuccaugcuuacuggaaaugucuccaucaccucuccuugggaccuuagaagagaaucuugaugcuguagcacuauaagucugauuagauguauguagccaaguagucaucaguuguacagugccauauugagagcucucuggagugugucaggccuuuucaguuuaucaucuugugggcuguaugcacaguaauaugaagccuacaucccaguccuccugguaucaagacugcugcaggcauaaugguagguucucaaacccaaaucauaacuuuccuuugcacugaggcaagcagagaagccugguguuacuccauugauuauaaagcuucugccuuuguugcauuacacagauugacaggacacaaaaguucucugcuuccaaagaaaaacccuucccuucuacagaugacuuggcucgggcaugcuggauucugaaaaauacagcugagcuggaaaugaaaccagggugaagguuuggugccagaaguuacuguuaggugcucacacagacuugcagacauucucaagacauuuuugcuucaaggcugaaagagcaagaaagggcaucaagauuggaauagaacagagacauaaaaucaaacaguaccagcuauaguucagguucuucuugagggaaagcacaggucagguccauucuaagggauucuuaggagagcccccuugcggcagcagaguggaggaaggcacagcuaugcguuuucacuuucugcacagcugcuauugcccuaauacccaacuguauccaacucaucuccccaauuugcauuuaagucauuuaaacucauuaauacacucaucaguaaauguaacguguuuacagguuucagcagguuaguaaggaaagaugagauauuagauaaugugcgggcuagcuguucuaugcccacacaccaaagagagggaguucuguccuugacuucggaacccucaccaagucaauggaggauuucuuguccucucugcuuuaaauuauuugcauauaccuuggaugagaauuccaauguuuggugggauuuguuuucuguuuuuuuguuuguuccuuuagcuugcauuggaacucagagccuaagaaucuugccuggguucacacagaggcagcagugagugguuagcugacuccaaagucuucuguacuucuugcaaacacugagggguugacugaacacuaggcugucuugacuugauaauaucucuaugagcuaccgcagcccucuggucuugguuaaggugaggcaaccuaucagacucacagaaccuuccaucaaaugcacucaccacugagcaaucacaucaguaagcuguguacuuacuucgagaaugggacacccucu

SEQ ID NO: 7784 - RNA, 3329 nt, Mus musculus
aggagaagaaagaguuuauuucauuuuauagguuacaguccaucauugggggaaaccaaagcaggagcuuuauguggagaccaugggagaaauucugcuuacuccaaguuuaccuccagcuagcacagggcaaccuaacuagggauagcacugcccgcagugggcugaguacuccuacacugacuagcacccaagauguuuauagauaugcccuaggccaaucugauggcaguaaauccacuuuugagguuggcucugcccaggugagucaaagggacaaucaagaccacucaugguuuuucuaugccuuuuuauguaugcccugaggcccaucuugugugcuuauuuagugaggcuuuuuggacacuaucaauguaaauucaguggucuuaauuugaaauuacuaagccuuacugagaacagagacuuucccaauuaaacaaaacaaaaccccuaaaauguucacaugaaaacauauguugacugcgugcugguggcuugacccugcuccuuuacccaucacuuauuuaugcuucauuugagaaugaagaggcuaucccaggacauaucuacuucuaggaugcuuaggccuugaucuuguuuagagggaauauuagcuacuuuucucaucacugugacagaggaucugauaaacaaccuaagggaggaaagaugucauucuacccuucacuuuagagagcucaguucauaguugcgugaccccaugugucuggccagaacaucacaguaauaggguagacuucugacuuaaugguggacaggaaguacagagagauacagaaaucagugaugaauggaacacaucaggaacucaauccccagugacuuacuuccuccaauuaggucucaccuccuccuaaguguccuaugauggagccaucaagugggagcaaugcacgcaaugcacagaucuguggaggacacauaaaagucaaaccauagcaagaaaacaacaggaaaugaggaaacaaaauauaaacacgauaguuuuagguaguggcaaauacaaauagcaaauaaaauaggccaacuaauaaaauaggaaggaauugaggaggaagggcaauuuucaaacagcaacuucuauauaugggaagauuguuuugugaguguuugguguugaauugggucagaaaggauauuauuaugaacuacuggaggcuggguaucuugcaaagaaaagagguuuguuugggcuaugauuuuguccauagacaagggccuggaucuuuaaauagucuucuuuagccuuaauaccuggaggcaacucaugggaagagaaagagaugugacuuauguuuuuuuuucucucucuuccuacaaagccaccaagcauccauuaugacagccucauccuguuguuauuuucuaauccugauucaaucccaaacaccagaaguugauuaacuuaauuuuccacucuguauuucacaauucaaaucucaaugcagagcucccugggagauacacccaacccaucuacagcacagucaugugugucugcugacagguaccauaggaaagcugggacauguugcugucuggugugugugaggguguuucuaauccagacaauuccuuuuccuuuagccuuuucucuucagaauuuuuuuuuucugauuuguuucucuguuucaacucauccugaaucauugauuuacuuauaaagggaccagggcuacccugcucugaacuaaggucaggucccauaggcuguuucagacacauaccucccaucuaaccaauaaauaucuuucucuauugaggauggccacaagucuuccaauucucuguuucauucucauacuacaguccgcugcugggaaaaguauucuagcauaacaagcaguuuauugcuaugccaauccuagagucaacacuuucacucuucuagagaaucucuggaggcuccucccuucucugacuucuuuuuuuuuuuuuucuccauucuacaggugcccacugugauggcuugaauauguuugacccaggacuggcacuauuuggagguguggccauguuggaguaggugugucaugguggaggugggcuuugagauccuccucccagcuacuaagaauauagaccucucagcuccuccugccuggaugcugccaugcucccgccuugaugguaauggacugaaacucugaacuuguaagccagccccaauuaaauguuauccuuagaagaguugccuuggucaauggugucuguucacagcaguaaaacccuaagaugucccccacucuucagcuucuccuuggcccugcucauccaacuuuccuaggcagacaccugcuuuuucccuguagacuaagacuggauucccaacuuuacucacagcuaucuuguccucucuacuccaccugacagucaugagggaagacugggcgguaaggagucaugguaccccagggcaggaggagggcuucccuaacuugccuguuggguaaugaggcacuugcccucugccaauggugccagugacugaccagacugcuuccucugccgucagcaaaccugaacuacguuucuccuccacaccgcugucuagaaggcucuuuuugaaauugucauaacugcucccaccuugccacuugaaucucaccuuaaggcgugucaccuccucaauggggacuccuaggacagagcccagugguuccugugauucuguuuccacacuaggaauaauuuggcucacacuugcuuuagcucuggccuucugucugucacucagguuuuaugaauucaaggguuucaaaccuucgguggagagcaguacucugucguacguaggacaaacucacugccaugauuucaguguuuucccugaaggaugcuaauggagucagagggcaugacuggcuugccugcagcaggauuuaggagccaggaagaaauuaggauacugauucugauguucacaugcgcuucucagcugucuucccaccuacuuguacaaggggcuaccccaaaacuaccagaagcaguagcccccaggagcccggaauagaagaagcauugcaaucaccgagccagugggugaggugugagcaugucuaaccgagcaacuuggauuuuuaccugcaaaggcaagcagaggagguggaggguggagacugaacauaaagcugcagccucagccucuaucuacucccuuuuaauuucuccucucgcucaggggaaaccccaacgcccacggggucuggggagcucccgcuucacggccucaggauucaugacccagcagaagcaguaguagaggccucacagcccuggugaugcuggaccucaaggcugucuug

SEQ ID NO: 7785 - RNA, 31896 nt, Mus musculus
gggcuggagguggggacagaggaaagaaaaagagagagggggagaguagcagaaaaaguuuuuuuagaggaaaaugcagggcuagucuguuggccugacgucagaugucgcuuugacaaacgcccccgggggcugaggaaggcucuccgcugcucugaugggccagcccaguccuggcccagcucccuggagaggcauccgcauccucugggcugagccguagcuccugugacgcugacuuccaggcaugagguggcuccugcccuggacgcuggcagccguggcaguccugagggugggcaacauccuggccacggugaguccugcuuagaagggaucagugaggggaccugaucccuuccugccugguucugaggcccgagggacuggggggucaagacaagguggguuggaauaaugaacagcgggaggagagagauucuugagucugaagaaggugguggaguggggcagaaggcgcaucccuugagagagacacccuguuuccuauauucacagacaauauacaacaaaauaagggccuggggaucugcacccuggacuggcccugugaucuugggugggucacucacgaauucaaagcagcauaaaaugagggguugcuaagaacauccagagccuaccaguuuaaaaacuccaggacucggagcaucugaggucccccaaagagaggugcuaagaaaccccaggacaagaugugaaggagcacgccagcuuuuagcaaaucuccaccaagcaagcaagguuuggguuuaccaccaugagcaccuugugacccuccauggucuguuccuguccugccauuuccagaaggcaucuggguccuggagagagggacaucaguuugcaccuuccagagacagggaaggagacacguggcaaagcagggaagccugcuggagcaaagccggggguggcugggcaagagggcaagcugcuaggggcagugagugaugugggcagcugaacagaagggaggcagcuuccagcagcagggugagcugcugggcagcugcugagucugagguugccacaugagggccaaagacaaaggcugacacugacacugaguuauaccaagaacuucuuuggggugcuaacaugcguauuccaggagacuuggaguuacgguacagcaaucugccugugagcacaggaacucaguccauuuccacugaagcucagaacuagacaugucugggacuggguaacaggcaccuugagguguuacguggagacaaugaacaugugcaauuuguacccaaguccucuagccugugcacgaugcuuguucaugauagcaucuaacccuacgacaagaaagauuaccagcucuauucacaaaggaugaccagaagcaaaugaauggcccagggucggaaugagcaaguggccugggucacacuggcaucucuuguggcacacuuucagcacucagccgucccaacguucccuaagccuagaguccaggaaguuaagcaagcaggccugccucugccuugggacugguugugacuggguacaagccuacagguggcugggccugggagggcaggguguggauggagaauuggugacaggggagccagcaucagagugagggcacaagaggggaaauucaaggcgagucuugcacuggagccagagucuugcacuugagccugcugcuggaacagccaggacugagggaugguggggaacagagucagggcuuuuuagggggucucaguaaagagaccuggaguccagagggaccuagcagcaucaguaaggaguguguccccagaagcucccagacugcccacccuguacucuuaggagucucccagcaucuuguuuuccaggaugcccucgaaacccccauccacugacacaguaccucugaugguacagagcugggcugugcccagaagucagagcccggcuuuguaaccgaauuccacacauggcauccuccagaacuaauacagacagggaguucaaauccagcaaggggcaggggggccccauggaaagaaugaugugcauuggccauacggaaggaaaaguaugugggaagugagcacugccaagaagacuuugaggaaguaggcugggaggggagacgcugucuggugugcauguagcuaaaugggcuguuggcaaaaagcaggaggccagcuggggagggggauguucaaagugggggagggaggcagauucugggcucagaugcaaagccugguaccuaugacaguguugugguugacgcucugugugaagaacagcuuguuuuaucucuuuucuuuuucuuggacaaguggugagggcccaccugcuaagugaaaggggagaguacgugagccaucccaaggacaauguacauggcaauacccacccaugugucaugucuaugcagagauagaauccuugccugagaacaaccaacauucacugaugcucagagagguuagauaaauuacccaaggccacacagcuaaugacauuugaacuuaaguggcagcuuucuacuacucuaaauccuuguauagaaacaggcuggacccuaaaaacacuugcaaguuggagacauccacccauguguucaaaugagagauaagagagggaccagccaaugucuuccaggauaaauaggcuaggaugcagggucugccacuaucuucucucucuaaccauguguguggggaguggggggcuguucacacaacuguauguaugugaggggguggagagaaagcugggggcagggugacucauuguuuggauagggaaugccaacucauuuucuauuccaagaaccccuuacagaaucccaggccuggacacaugaugaaauccucccuuuaauugaaaaagcaagcauaaccccacagacagccuccauguaccuagccauuucgcagcugugagucagcagcucuacccaccccacccccagaucagagucugcagugacuuaagccccugucuggcuuagccccaccaggaugcuucaggaaagcugcugagaguuagucugccccacuagccauagcauuugucuaggguuggcaaauaggagggcugccccauacuauuccugaaagacgugagcuccaccugugagcagcccucugguccuuuggcaaauccacauaccacacgccacacgccacaggguuuagugacaguucugucuaugccagcugaguggggaacuaccaccuaguacaggaaucaacucucaaggcugcuguagugucccccuccccaccaucucucagggacuucaaggcuauguccccagugugacuccacugagaacagaggaguuaaagccacagccagacuaccauagccauagaagccacuuaggauugggaaguggggggggagugacuaugaggucucagcguuaggcuuuggcauaugaguucuuauugucaucaaaccauugaugccucacuaggcagccgcaggagaauaagaggcccacucgguucuggcacacagcuuuacccuccauguugaccaacacauuugaacacuguccgcugagaagacaagagcgugcugugauccggacgcucauugcccauugcagcuuuuccagcaugggccacuggaccucugcgcugcagccaaucccucgggcacgcugaguggugccuuggacugcaggcaucaguggagagaguccagggcaguagacucuuucauuccuacccuaacucccauugaugggauaugcuuagacuguguuuuggguuuaacaagacauaugagugaaguccauuucaccugcuucugauuccuuuugcuauagcuacuagaaaauuccaucuguggcuggcaaauggacacaaagguauuggauucagugagaggagggcauuuuggaggguucugagccaggcuuacaaggcaaauaucuugaggggaaagugucccuggugcaccauuuaaaaggacaagcaugagauucuggggauggggagucccuggaggggaaggguagagagagaacacacgaggccugcagaagcaagcccauucuccaucccagcaacaaugcuagaucccaagcuaguggaggccaggauucagucaggccuccaacccaggagugcaggcacuaggggaacuggacucaguacuaugugugugcagagcacgacggugaggcaucugcucgacuaugugcagugcaggguaucuucuaaagccuguuauccaggacuccagccuugagagggagguuggugagcauccuaggagacugugaaagagaaaggaaaacgggcgaggugaugcugcuacuguuaagggagaugaugaugaugauggugguacuacugcugcugcuacugcugcugcuguuguugcugcugcugaugacaauagugguaaugaaagaauggugacgauagaaaugguggugauaaugguauuuaugaugauugugacacacaugguggugacaauagaaauaguagagaugauagugaugaugauggugauuuuuaaaacaaugcaugagauaagguauucucugcucuagugcugacauccugauuccucagcccccucccccuucccucccugcccccuucucuaccuucuucuccacuuucuccucuucuuucuagucuuucccacugaaaggaaagggaggcuagagggggaggagaggcggaagaaggagaaacugggccucugaaaggggauaaugagcacuccagggaugugauuugaucuuggcccgcccaccagucugagaucuggaggcaaguccaggcgaaauuuucaccaccauugcagaucugcugggggacaggggguagggagggcagaauccagacucugaggacuccuccagggacccugacucuggccuaugaauaaagagaaggaaaauaggcugggaaccuccccaggacuagagaggucuaagcaggcuggcaggauagaggaauauuuagaaaaagcuaaccuucaacccuguauuuaagcaaaaugguagccuccuugaauugcugucucuucuuccaugccagccuugucuauuucagggcaccuacaagggucaccuccaagaagucuuccucacaucccgcaagcagggcuacagaugucuccauaaaucuuacccuugucggguggaaggggucacaacucaacuacacugacuucaccccauccuuuucccaugccacuuacuccuacaaaaccauuacaucucucaucucucaacucucaagcuaccugggcucaucaucccaaggccuuuguacacugacuggccuggcuuaugcuagguucuucccugaucugaucuguccccuacuggucugucaacggcugugcuaaaacacuguaggugcucagaacaggcauuacugugacuccuaagucuaggucagggcugaugauggcuaguuagauuguauguguaaaagaugaacaggaaggagugaccaaugaccuaucuaaaguagagaugccugauggagagggccagagagcauuagaagagggccugaugcaguugcuagguagcccagacaacaagcagugacuuccagucuugguaucaaaucaaaagucaggagcucagcuuuuccaggcccugugcuagccucaagcucgaugucccuaacugggaaguagacacgaugguucacuguuccuguacaccagguugaauuggacagcggucaggaaaaggugaggcuaagcagcccagggauaagagucagcccaauccacagaccaggcaaugguuuauuagccacaauggauggagaagcccucuucacagagccuuguuuuaauauaagcuguacuggguaugagugagacuagagcucaaguuucuuguagauuggaggaggguucuuuugguuguggguacaguaugauuugcgagcuggagucaucaagucuuccaguuccugccuuucucacugaaaucuacauccauauauauguguuucacacacacacacacacacacacacacacacacacacacacacacacacguacacaccuuuguagaaguagaggaagaugagcaacaguucaaacaucucaguuucucuauuuguggucaccucccaagguacaucuaccauuauaguuaccauagcuugacugcuacagggaaggggccuuguguucuccauggaccauggccccugccugccaucaccacauccuuaaaccccaggucuaucuuuucucaccaauggcugccugaaucucaccccaccucaucuaggauugucuccagcuuagacacccuuccugaacugaauaauugauuggucaguuauucuccccauuuaagaugccguggaaaucuucccagaaacauuuuaugcucucucgccucucucucccuucacuuugccucacacucccucugcuaccaagugaggaauccugaguaugaucugaaggagcaaugccugagaguugggauucagcuccauacuagaggccucgagcaggucugacuuccuaugguucauuucacucaugacauaagagagaacuuggcauucugccuuuccucugcaguuaucaccaagauagaaccgucuauugaaagccagauuuuaaacagggcaugguggcacaugcuuguaauaauagcccaugggagguaaaggccugagaaucaggcauuuaauaucauucuuggcuacauagugaguuugaggcuagccugagcuacauuaagacccugucuuagaaaccaaaaauaaauaaauaaauaaauaaauaaacauauaaaauaaauaaauuauacgcaguauugauucaaagaagccauuaaaaugcucuucaagguguccugugccauuugagcaugcucugaggauucauaugaagaaaugauaaaacagcaacucguuguguugccaucauaauuguauguagguugcaguuucuagaacucucucccauuucacagacacauuaagaaucucugugaaaacacugggugccuacgaguuccuacauuucugugugugcgcuugugcgugcaugugcauguacguguguacguguguaugugugugaguguguguguguguguguguguguguguguguguacaugugucuagacaacaaaaaaguaacaaggucaacaaaguacaggugaugaugaaggcuggucauggaggggacggugucauuguuucaaccuuaggagauucaaaaucucauuugaauauuugucucacaaucauuauauuucaaguuuauauauguuaaguuacauauauaaacuuguaagcacaauauaaguuaauguaagcacauauaauuuaauuauaucaugaguuguauauauauucauuauaaaauauguaauuauacauaauauaguauauguuauauguuauguaauguacauuauugguaggcauagaaagaaauaugaagaaugacagugaauuauuauaauauuaguauuauuauuuuggauuuuucaaaguagaguuucuuuguauagcccuggcugaccugguacuacucuguagaccaggcuggccuccaucucagagauccaccugccucugccucccaaguacuaagauuaagcucauuacccugccuuauugugguuuuauuaaaauucucugaaaguacugaaaccauuuuuacccuacauagaaacccugagauggguguagccaggauguggcugcuauaacuccagcccuuggucuuuuucacacucucgucuccuuaggaggaagggccuagagcugguaccaaucauguaccguuguaccuggagguuaguagaggcucuaagugcacuguccuuucccuuugagauggcaugcugauagcccagaacucaugauccuucugucucugccucucgggggcuaggaucacaguccugucuacccugucuugccucuuuguacauuggaggaaugauuaaauuagugcuuaucguuuggaaagauccucaacucuugccccuuuuauccucuccauacaaaauugccuuguccagccagugacuccccaaaugcaguaaaauggauggguagaaaacugcagucuuccacggcccuuguucuuacccucuagccagcuagagugaaaauucggggcaacuucacucccugaaaauccucuugaacaaagccugggggaggggggaauccaaugcuguguuguaaagugaaagggucucccacgcaugccuggcccaggucugcaaggcugagagcuaagauccucccauacaguagucuaggggaccugguguccugaaguucccaggaggcacugaaaaaguggcaccuucccuggcaugguccuuuggaccagaaauauggcagcaaaacagugggaccccuagguuccuguggugcaagccacugccugggcccagaccuacccuaucuccuaucucccacagagccucucuuuucagcagcugcuucuaggcccagagacuccucagcauccccagacauuagggggugaucuaccauuucugccucgacacugaccucugguggagcaucuaagcacagucgcccaaaggcuucagccaggcuuuccccacccacaccacucacuacuguucccugagcauugcccaagucuguucucacaccugugggcacucaggugauuuccccuuucuggaguucuagauccagccauucucuccucuuccggggcccuuuggaauuagggaucaucucuguugugaugcaauccugcaguggcccaugcuuugccucuuaagggacaagguaccugguagagacguaguguguagguauggugggaagaugggagaauaaauaaaugaacauggguggaugaggguauguauggugcagcuagcaaugacaaccacuguggagggaccccagagucagaaggacuggugggcacuuagaccaacauguugcuucagcucugagucuuuguuucuuccacuggguauggaaauaacacuagugccucucauuagguugaugacgggccacugccacccuuucuaaaaugaggaugagaguucugauagaacuacaguccccauugcccagcccuggcagugguaagggugucacaugagauccccccacuucccuguguccucucgacacucaugcccugagaaaagagacuagcaugucacccaucacugggugaccuaaaggguucucuccacccaggcaagguccucuauucugauccuauguuccuagugaguaccuuuuuuaaaauggugugaucguacugugugaagccccaaggaucacuuaguuucuggguucaucuagagcgcuggaccaugcugucccacccuuagccacugcucaccuguaaacagcauauuacagaugcguaugcaggcuuucccauggcacugguacaaacgcauaugcaggcuuucccacaaugcugcuacaagcauuuaugagcuucccuacagugauagacuuuucuucucaauuucaaucagcuuuagcauuccuguaaguuugacagcagggaucaaaaaauacuuuacccugcuuacccauauuguuccuuuuguccagaaguaugggaaucuuagggacauugcuagcaagcuaugccuuucuuuuucucuguuuucagguacuuuaacaaacucucaagggcuaagaugaauuucaaaucaucacuuaacagcauuuugcccugaggggugaaagaaagauaugucccaaagccaugucugguagcucucuguaggacacuuggagguacuucauacuaggcguaaagaauguuaaagcagaaagaugacccgaggcucuguucugacccuguccuccauccaguguucucaagucauuguuccuacccucuuaagaaucacaagcacuacaggccgacucgugccugucuagaagaauccagaguccaagugugaucagggccucuguguugaugguugcugccuucagaacuaucuagaagagccuugaugcccuguauccccuccagcagccuaugaauggcucucuggagacaacgcugggcaucaguguacuaggacugucaaggugauucugguggggaagaaaauccagggaguucugcugggcugugcuucuaacgauuccugagcagggauugaaggucucagagugagcagagacagacaggcaggccugcagccauguagcugggcaggccagcucucacugagcgugugcugugcaugcgguuugggaggcaucuugggcacgccacucucuucuugucauccuguuaacacuguggcaucugcagaauucagugccagaagcacauuguaaaaggaguuuuaugugaaccacgucaauuuggaaggaccaaggagcuuuuauucuuauuucucuuuuccuuucucaguccuuccuacucagccuucuccuuacuugaugguuuauuuuucucuuuucuuccuucuuaaggauacuacagggucccaggguacugugucugcacagaugcaucugucuaguuugggguaggcgcauugacugcuuguguugugacagccagggcucucuuagaagagggcagggauccuguagggacagaaaggacagaaucccaagaaaaguaugggugcagaaaagggcuuguaaugcucuaagacaauguuccucccaagcaaggugcuucugggaaauucuaugucaccuuaaagugcacacggggcugcuccucccuuugagucaccaggaaauuccucccauccucucagugcacccagggcccugcucccagaucuugugaggcuaagcuuugccagcuauugggcuugccugcaugccuguugcuuccacggggaugucuacagacuuacaauuuguauucugaguccaagguucaccaggucuuguucuauuuggccaccagaggccccaggagaaguccuccccaugguuuuuucacaaaagcaaaugaguuauuuacuuaaaagcuuuagagaaggugcugagaaacuggcucuguagucuguaguaaugggcacucacuucucuuccagaggaccagaguuugguuccuagaaucuguguccagcagaucaugaccccucuaugauucuagcuggaggggauccgauacccuccucucaucuguaugagcauaugaacacacguagcauacacacagacacacugacacacacacauauauauauauauauauauauacauauacacacacuaauaauuguuguuguuguuauuauuauuauuauuauuauauaaaacauuuuuuccuaaaccuuagggcagagaagaacuugaucccuuccccugacuccuuaggugaccuucuacagaccaauuggcagaucacuuaagacucucuaagggccccaguuccucaccacucugaggaaaaucagcaggcccacuuuguaauuuguuagacaauaugugagcugguguauauucacgugcugcagggaacccuccauaaauauuagcuguagagaucucagaaaccuguguguuuacucauaccacaaaacaggggaguggcaagaagguaauccugcccuuaagaguucaaaguucacuugaggauauagauugaacucaucauuucugcugauaggggcuuacugacaccuacuaugugcccagcuccuucugccugguugaggcagaugucucuugccaugucuguugcacuacacaccuugggcugguugguccauggcuucagagcaauccuccucucucuugcguccaucucauuaucggagcuauaggauuagaacugcgugcugccaugucugucuuuuacacguggauucuaagggguggaauucaggucaucagauuuuuacuggcuaagccauuucaccagcuccugagcaccucuugguugccuuccgagaugguucuugagugaguaccuuuuagcuaguuucuuccaucaggaaauucucccuccauagaccaucaugggggaaaugcuaaguccaacagaucugaguucuaauccauguucagaggcagauagguacucuagucaucucacugaucuaugaaauaauauguccaucuccaugcagaagaugagguagucugagaucuuuacuaggcucaucucaagugucccugggcugguagcccucaguagacagacuaacuagagacuagacuuagccuuggggggaaguaagaaugccacuugcagaggagaaagccaagccucagacagaaaacccucgugccacgggaaugaugauaaacgaaggcuuggcacagggacucacugugauuuacuccaagucuagaccuuccccgagcaucucccacuaaaaucucucagugagugaggcauuugggacuacucuuggccgaugcacucuauaagcaucagcagccagccagccucugccuugucagccucucugauuugcacacaugcuccugcaccccaggcacugcacgccaccaacuuugccuugcguuccggcugcuccauguacuucgguccccuacccuccuuccuuauuguggguccauucuugcucuuccaucgugguuuccacagcuuuaccaccuccuggaagaaguuggccccacucuguacccccaccacauuuuuucuuucuacuccugaaaucgaguacaucuguuugcuucccucuacuguguccucagcacccagcacaaagcuagagcugugcugaguaaacaaaaugaauaaguaacaucacuguagugcuuaucaccuugguuacaguuaucauguacaaaucaccauugguuauguuagugaggagagugacucuaugcaaugcugcuuccuucaacccaucacagagccuagcacacaguagguguuugguaaguaucuguagauucauuauccaaagagcuggugugaauuucucugcccaaacagccuuuuuuucaggggcaaaaguucccuguguauguaaccgaggguuaucacugggagucugaacuaaucacugcccuguagucauacaucuuggauauuaaagcugggcaagacaucaggaaucaggcagccauacaucaaagucugggggagccugcggagcucuugcuuaggugaacuggaagccuugagaccacuagauggcaccaacagcuaagacuugguccaaggaagguuuugcccauccagucacugucaggcaacccuuccuauauuccuuacccagaugccugggggccucuaggcagguaccaagaaagaaggcugccuauugagacugcuuaccugggauaaagggaugaggccgcugauguucucauagagucuggugcaccagcuucuagcuguucaaugagcagcacagguuuggggagggaugcucuaaguguucuucauaugcuaaaucccuguguuuccacacugaguagaccuguuccuacauaacugcucucaaagugacaucuuguacccaguuacagacuucagaggggcugauauguguuucuaaacccacuuggaaacacccccaucuaacccucuuggacucuguauucuucuugagucccaagcuuaacccugagagaagagauugauucagaauaugaugucaaguaaucccacagcacuuuuaucccucugcaaguugaaaccuagagaacccuacacugugcacugugcacuguguguuauauucagguagagagagaaacaaaacccuaacagaaaagccacugugucaaggcagccuguugcuccaugcacacugcaagcaucuaguaacuaagaacucagaguggcauaacaggucauagagaguagggacauuuaucucagacauagagaagaugccuugaggcaaggaaaggaugcaccaagcugagcccuaaauuaauccuggaagugauaugucugggccucaaauagaggcuaugggcaaugcaggcugaccagagucacucuguaagcuucuaggccuucuuuucuuugcaucaguaucuaugcacuugugauguuccaggaccaggaccugcaggucagauuaaugcaguaguucaucucugcuccuuuuuagccagagcuauuccugguccaaacuacagagagcuucuuugcacuuuccacggcacccagagccuuaugcuaugauucauaacuucuaaugcuugucucuccuauuauguugcauaagcuucauguacaggauccucucauuuuugucuucucuggcauguagagaaggcuacaugcuagcucuaugaacaucuguuuaauggcugaaacagcccagaaggaacauagagggggugcaggggaaucccucuccccuucagaccucaguuuccucuagugcagggugagguacucagauggggccaggaaggcagucauccagguugggauguacauggauuacagagauacaggcaucuuugaggaguugugcuuagauaccagaguccuuccaccugccugcuauccaggugagaggcccugucucaaaacaaaaaacaaaaaacaaaaacaaaacaaaacaaaaccaaaaaaacaaaaaacaaacaaaaacaaaaacaaaaaccaaggucuguagcauugauuaaaaaaagagcugaggaugucuucuggccuagacacacacacacacacacacauacacacacacacacccacacacacacagaguuaucugauuccaccagguacagaagacucugugaaggaagaguuuggagucugcauagcccaaauccagcucucucucucuuccauaacccagugccaccacagguacuauugggaccauggagacaccaaggaaagaaggaagccaagauggaccaagguggauacuaggccccaguacuucacuggcugagaauuguucugauuccucugaacuuugaacuccuugaucuuucuggcuuuauugaaagaaaaucgauguuugucuguugaucauguggaagucaauaauugugaaauccucuaaacacacugaagguggaaaggcaauugcagcucuuugggcuuggaaacucuggacucaacaaccccuuuucaccucugcccuuccuccacaggcccucucuccaacccccacaacaaugaccuucaccccagcaccacuagaggaaacgacuacacgccccgaauucugcaaguggccaugugagugcccacaauccccaccucgcugcccacugggcgucagccuaaucacagauggcugugaaugcuguaagauaugugcccagcagcuuggggacaacugcacagaggcugccaucugugacccacaccggggccucuacugcgauuacaguggggaucgcccgagguacgcaauaggagugugugcacguaagugagagacuccauaccuuccaacugccccccacaccuuaucucuggcccaugaacacccacagcccuucagcugcccaggcuuagcuggucaggaaacauaguccaaccaauccacaguuagaggccacaagauggaucauacugggaagagacuaauaacugcauucuucuugucccuaagauauuaugucuugcucucuuccuauuagagacaucucccucccccaaagaaggagauucugccaagcaauacucaagccuaguuccauucucuugguagaaaagacucuucaguagauguccaauggccuaucaaaugauauggagacacugccauacuucaaaugcauauauauauacuuaagaaagccauugaccaugaaauagaaaaaccagcagccugcaucauuucccagcaacccugcuuuuccaguugccaccacuacuuuuaacuuguuggcccuuuauugcuaucacuacauaguaaugucuaaugucuucugugagauuuuaccuaugcuguacuauacuauacuauagcuugcuauauuaauuuugugucaccuauuaccauucguauaggauaguugaaggauuagcucccugaugccaucagauaccuuuguuaucuuccaacuguccuuguccugauuuuuagcuccguaaucaugaauguauuuuauguucugacgacguucacuagagccugaauaauauacauguuugaauugccacuuuucauaguaccaucugcucuuccuggugcuucuagcugccuuuguucucuuugauuuggguguguacaguauccuuguguuuggaggaagacuguuguucauucuucacgggcuccauccugugucuucuguccuggcucuucauagagaccauguuucugggaguucacuaccuccuucuucucucuauuuauuuagucuggauccucucagcuuugccuggccguguagugugagccaacaugacggcgaacaauggccugccauaugacaugacagucuaucuucugaaauauuccuccaaaucuuguaaauacagaaacucucccccaugaguauucaaucaagacuccuccauaauucuuggaacauguauccccuaauauccguucauauacaguacagucccuaguccuacccaacaccuuagauucccauggugggggggggcauguugaugagauuuguguacacaaauccaagucaguaaacugugucugagccuucugguuccuuuguggcccuuccuguucauuuucuuuuauuuuuuucaucuguuuagauuuacaucuuuggcuuuucaaauaaauaccccugcuucucccauucucugugaucuuuuccucuugcuggauuuguuguuguuguuuuuaaugccauaaaacauguucaaagaagacuugcaccauaaccugugcguaugcacugauuaaaauguauuuccugagcauuagcccagaccuguuuaaauaaacccccgagucacaggucaucucugcuugcugugcuaagacugacauuauaagcagucaucuacguucuuccauaacccagggagaugucaccaucuucccugggcuggaaucccuuauaagaccaggcacaggagaccagcuccuaauuccucucucugcuagcagguacuuuaaggucauuugagagguaacucaguucacugcgauuacacuaaucuccaaagccauaaugggaucuuacaugccauagacauugugucauggauccagagauuuucuuuccugcucaccacccauacccaccucacccucacaguuuccaaaugcagaucucacggcaaaccacucucgucccuuagcucccugccaccaggaaauuuuccuuuccauuuauuuaggaaaaauaaauaaaacaucaauaaucucagggaagaauucaguagguuuaggcauuuggcaugaguucccuggauauguggguuuacagaccuugaaauaaauagaguaaaacaggaguuacaggggcuugaaauauuccagcccauuguuaaguuccaaaagguuccuccacagagccauuuucauuucuaagucuaacacuuuacucuuucauccagguauagucuuacccaugagacucaccacagcacucacacagacacacaucaggugcguuauguacacacauacaugagagagagagagagagagagagagagagggagagagacagagagagagacagagagagagacagagaggcagagagagagagagagagagagguggguuuguguguguguaucauauguaucauauguaaacauaugcacauauauacaaaauucacucgaguccccuaagcauucccccagaaauaugucaugucagaauucaugagggccaaauacaaaaaacaaagcaagucauggaagugcagagcggcugugagacccaagaaaacagagcgucucgugcacacagccugucagcacgugaucggcuuagcuaguggauggaccccaggaugagcuaaaccugucuacagagaauuaggccaagacaaggcaagugaaaaacaagccaucagcugcugccacccagggcccagggagcacagaagagccaucggcaagccaguaaaugccagcuuuggcuguccauggucaccauccugggccaccgaagccaagcagaacagugagucuagucuugccucgucugcucagcugucaggaggaaacuaggcuugcguaugauugguaaacacuagagcuacauucagagaaacuuuuuaaaaggguguccaggccaaccuaaacacagggaugggcccagugcccucuacuucaaaagguuccacuauuucaguugcccaaacacugcccuaacagagcuugaacaggcaccagggcaaaaaggucuggcaaaggaaacauaguguuuacaggcugaugggcuugggguuucaaucacugcucugcuucuugcuacagcuggccuugggucacacaccugaggaucuucacuaaaucagccuugagcagggagagguaagcagggggaugguaacuggcuuuugcuugcaccaugggucaucucugcucuguccacugcuauccuccuccauagugaggaggucucauuccgggaccuccguacccugcguguugcuaaagggggaaaaggaaaauauagcaugguacuugggauuaaaaaacucaaguuggagucuaauccuuuuaaaccucauaguccucaguaaggacaaggugaugaagaguggagaccccugugggaauucagguugucacaugcuuagauacaguaggaacuuaguggaggccagcgguccuggcaugugugugccucuauccacccaucugccuacuaacucagaacaaugugaagaugaggguauaggaccaagccacauuccuacuccaacaaggccaaagauggugaggggcaugaaggucccaguaaaggggcaugguggcugcaaaucuuuuagcucuaagaagccuagccagaucucaucugaacuuucaagagagauuagagaggcgcuggcugcuuccccucacccaugaccagucucccugggaaaguggaaaggcuauaugugcacaaagaggggccuucuucugcugauggauaaugcaugcucaucacagcccugaucuccccuuggucuaugugggacaguuuuaucagcugcccgugcguccccauuaaccagucuacagagaugccauuuccuaggcacaauaguacuugacuuuggaugcacacuagacucacacuagaaggcauuaaagaagaccaacacugaggaaagcaguggcccagcaucuaggccuaccucauguuauguagccuggguauuagcauuuuuacagguuguucugugaguuccuguaagcugaugaaaggaaagauagauugcuuugucauugacuccagagcccaggaauggugucuuuacacaugagggcaaaacauaaacuucagcuuucucaccaccaauacacacacacacacacacagagagagagagagagagagagagagagagagagagagagagagagagagagagagagauucauacagucaugcacguaucuguuuacacaacauauacauacauggucuuguaaacaaauacauauacaaacuagcaagugcacauucacauguacacauaugcacauacacaccuuccuggcaucugagagaguggcagggugacugaggaggcaaagcucaagggccuccucacauccugcuuucuguuuucucuuccugaucaucccccuuccucuccucucaucucccuccucuucugaugucagguaaaaagaaggacuuggguuugcuguuuccacucugucauucaccagcucuuugagccaaugaaucccuuccuuucccagcccucuccugucccugugaaguaaacaaagcucuccugaugaagucaucacuggagaccugagugaggucauggaccagaagcugugucagcgugugccagcaccugcuuccuggcuauucggagaaugguagcaauggagagauagacguacauacuugggcauacugcuccuuggccagauugcaccaaugucaccuugcugagacugucuuguuauacauaacaauggaaacaacaaaguguuuccuaacaaaacaaaaugugccaggaaacacagaagucauugcuccugccaggaacucugaugcuuacugccagccaccacucccaccaaucccagagacgcgacagaguuacugcaaucagcaggcucuuaacugucccuucucugugggcauucuugucccaggaccccuugccuacaguuccagaugcuauucccaaggaacacauagcaccaagguuagagucugacccagugguuugccaagccacaaaaggccagcuugcauaaccaacuacacaguuauaucuuaugucuaaugaagacuggccccagucucagguccuccagagaugauggaagaucucauuauuucagacugaguacagagugcugaaagucuuccuugacuccuaagagucuuugccaaugugucuggaagcugagcuuccucauugcuuugguuugacccaaucucugcuugggucacugugaugccauccuguagccuucuccggccuauuguguacuuaguaccacaaguuuucuugugaaguauauaauucaucucauucauucaaguuacuuauugaacaccuacuugugccaggaagaauuauagaaacugacaguuccacuuccucuaagacagaaggaagcuauaucuggucuucuccaacacaccuauuucuuucucucuuccugucucucuuccaccccaaccucccaagguuacuccaucaccaggcucuuacaccucuaauagauguccucccuagcagcaagaaugucaucagcuccugggcuggcuuccucucuuucuggucuuugcugaaggaagcccucucacauccauaggaucuuccuuacccacuugcucucagucuauagccacguguacacccaauacccuguucccuuaucucccaacacuuaucacaguggcugucaccaucaacaaucacuccuacaaccacugaaccaucuucccacuauauugugagaacuucaaggaccaguccauuguuauucuguucagcacugggucuccggcuccacagucaguacugaagaaggcagcccacuucguuccuggguucugguuccuguguaugccuuccuccuucagacaggcaugcaccaguaccaguguuggcaacacuguaggaauaaagauaucugagcucuagcacuaaggugcuugacccuuccacccaacauucagcauggucaucaauggcuguccccugaugucaugggcaccuucacaguacccucucucccuuucucccuguugcaccccaucucuucacaugacucucucuuuguccuuggggugcagccagaugauauguggaccaggcccucuuuucucauaugagcgauuucuuggcauggcaucuuaggcagagggaaacugcacagaaguagcuuggcacagagcccauaccuccuggccugacaugucugcuaccuguguuugcagagguggucggugugggcuguguccuggauggcguacgcuacaccaauggcgaguccuuccaacccaacugcagguacaacuguaccugcauugauggcacggugggcugcacaccgcugugccuaagccccaggcccccacgccucuggugccgccagccccggcacgugagagucccuggccagugcugugagcagugggugugugaugaugacgcaaggagaccacgccagacugcacuguuggacaccagagccuuugguaagugugggcaggggcaagugaaaucccugaauauaauagagcuccuaaauuccaaauguucucuucauaaaucaaguccccaggccauuacucucuccacaacucaccaguuauauggccuuauggauauguugucuggaacccaaauuuuccaucuauaaaauccaaaugacaccaucuuuccugccuaccuuggggggggggggcuucuccuaacuuaaaagccuggcaugacauuuucaguccucuauuaucuuauuaaaguaucccagggaguggguagggaccuagaaagaggagcagguggcagugccuuggaaggaguagaugaacuuuccagauaacucaaggguucuacugcuauggucaugugagcagaugaaaauuuaucuaggugagucuaagaagaagaagcccugugagggaagacagggaugugauuuauucaccauuuauucacaggugcacuugcuccaagauauuuggaaaauauccagcugguauuugcagagguagccagauagguuuuuggcucuagguggcuagauagaugaaugaauagaucacagauagaugauggguguaugcuacaucagcaauauauagauauauggauagaugcuuagaggagaaguggugggagaaggggagugaaauagauggauaacuggauauaagaugaaugaguggguggguggauggauggauggauggaugauagcuaaaucaauggguauaugaaggcaugcauggagaugaaaugguuauagacuagaugaaaacagauauguggaauaagauucauacauacauacauacauacauacaaauauacauacauagguagauacauagauagaugauagauaauuacaauggauggauaggugacauauggguagauaaaggauaaauaugcacagauggugucugauuggaugaugguggauauuuaugcauaguuaggcuuuugaacuagggcagaggggacaacagggaagagaggauaaggacaagaagcagugcuggagaacaccucaaggccuggcaccugugcugcguguggcauggugggaggaaucaggguggcuccuggggcuggccacugcccaggagagaauacaacaaaggaacacguuuagggagaggauaugagcagguaugagcaggcugaguuugaggagcgcucagagggagaaauguccagucagggcaaccucacagaaggagucccacaggaagagagcucugcugagagcagcugcuggucuuuaauauguccugggaguagcacacacagugagacggaggaguagaggucuagggagcaugacuuuugaggaguagacaagggaaaaggaggccagggacuaugaagaaacagagucuggggaaaugaggagaauccaagagaaucugccacaguggccacagaauccagacacugcuagaggaaaaugagucaggugacgccaaaggacagaagacugcuuaccacugggauuuggggugcuaauguuuuuaaaauguuuuuuaaaguguguggguuugcucagagccugcgcagagcuguguucuuggccuuggugccagcagcacuaaggauuagaagauuuuuguuuuauuuuauuuuauuuuauuuuauuuuugaggaaagggccauuccaggcuuggcaguaucccuagccagcccuuuuagaugacagcaacacauccucaaguugugaccaucugaaacaacuccagaccuuaacaaaugugacuuaggggacaaaaucuuccacauggagaaacaaugugguagagaugaaagccaguagcagggaagguuuggucccugguagcucagggaagcgugacugcucuucccacuaaaccugccuucaguauagcacaauagucccugggugguggagggaggcagaggcugccugcccauugugugugacccagugacccaguucuuagccaucccaggcggaggcccuggagccuuauggaggagacccagaaaccaaagcccuuuauccucucauccucccuggcaaaucccucccuccaugccugcuacaggcucccagccagcucaucccagacugucugcuucuguccuuggaugccuccauugcugucuccuuucuaugugugggugcccucccuaucucaaauucacucccaaauucacucaccagcaauguuugcagcauaccugcaaguuccagggacuguauuucuguuaccugaaauagauuccucgucugccugguguguuuuuccucucuuccuuccccaauguuuugauuacguugucugcccuugcucucauucucuucugucuuucuuuaucucuuugucuauccaucucugugucucucucugucucuccaucucugugucugucucugucucucguguguguguguaugugugugugugugugugugugugugguuccucucccuaaccccuuucuuccauuuacuaugagugcacaggugggaugucugucugucugucccacauuucugcaggcuguucugccucaccuaccaucuaauuaccugucucccuccauagcucaccacucuccccugcuuaccucuggcuaaguaugcacugaucagaugcuacauucuguauguucauaggaccagcaaggagcaaauaauacaacuuguccauaguugaguaacaggaccagcugccauguagagggauucacuaauccaaggacaucugaugcacugucacaugcaugauucuguccucucagaccccagaccugggaacucuguucuuguucucuuuaacauagcggaacuggggccuauaggugagagccagcucacuggaccccacaauuugcaaacuagugcagugcagagagaugaacccagggauugugacacagaagucuauggucucuucagcugcuauguucuggauuuacugagaugggaugucagauaccggacucaccuuugaacuuucagauauauacuucauuucugaggggcuguaggauggacagugucuuaaaaaagcaaaaaaacaaaaaacaaaaaaaacaaacaaacagauccugcucaaugacuuguagaugcauggcauaaacucagucaaaaucuccacccuuuccaguagccccacaagguagauauccuucuaauucgaugacugaggcccaguaaguacugugugaaggucccagagcuuguagguggucacuguauucuuacuuuucugguugcuguaacuaaauaccugaagaaagcaauuuacaagagaaagggcuuauuuugcuucgaauuuuaagaagggaugcaggggcuagagagaugacucauguuucaagagugcuugcugcucuuccaaagaaccuaauuugguucccagcacuuauauauagcuaccuggugguucacaguugccuguaauaccaguuccacggguucaaaugcccucuucuggucuaccccaggacaagcacacacauggcauucauacacagacauaaacacagacacacaaguaaaaauaaauguaaaaauaaaaucucauguuaaugaaaacaaaaagagauaccauccaucguagugggaaaggugucaguggcaggagauggugucuggucauguggcauccagucuggagagaugaguagugguacucagcccacuuucuccuuucuauucagucuggaaccccaguuuaugcccauaguuaaagugggucuucucaguucucuuagcccaauguagaaaauccuugccagacauccccagagcucugucuccuagguggcucuagacccuguccaauuuacagauaauaguaaccaucauagaaaccugggguccacucagcucuaacgaugauuagaucaaugauucuucugugauuuuauguugcaucacuuggucagagaagaaaauguuaaggaggagaauguaaucccccuaccuagguguggcuacuaaguagaagguaguuaguccuccuguggggaggaagagcccaauucuuucugucugucuugucuaaauucuucaccugucuauuggucucugccucuuucugcgucuugugaauucuaaauagcuuuuuuuucccaugguaauggugagggcugccggagcucguggaggcuacagacucauagguucugugguauuccucuacagcagcgucaggcgccguggagcaacgguaugagaacugcauagccuacacuagucccuggagccccugcucuaccaccuguggccuagguaucuccacucggaucucuaacgucaaugcccggugcuggccagagcaggaaagucgccucugcaaccugcggccaugugauguggacauccaacuacacaucaagguaaguucagggcagggcuaggccccuuaggaagguauaggcauggugagcauguauagcugacuugagccugaccacuaaacuucuugggagucauuuaagaaaaggggcuuggcaggccuuggggcugcuaggcuuguccaggauggauuccacugaaugaaugcuuuuguaguugaccauccuaucagaagcaaggucacuccaaggggauaucaggagccaucuggguucuuuguguugugauucugaaggaucuacaccaucuuucauccccuuagcuucuucccacauccaccaacacaggacagcuaccugggcaaugugaggacugugaacuagagcuugaaacacauggugucagaugccgcucugcuguuaguguucacagguguggccagucuccggcuaucauuaagcuucaguuccuuuccugugaauauaacauugguauuaauccccgaaucuucccccagcuuugagagucuaagaugauacaaguacaacaucaaggacauguauacuaaacugcaaaagaaaugagucuuuccugucuaacucaguacccuucacucacgccuuagugcuugaccuaccugaugaucauaucaagcaaagaaaacuugucagggcucaucccuggcucuauuugcggacgaagcaggguagguucuucagaugcugaggaaaggcugccaguuaccaggacaacccuguuucccaccaccaucaucagacauggggcuugcuccuuauccuuaacguagcaccuugucaucuuugauggaugcauacuuuccuuucuacucuucacacucugcugugccaaccuuuggugccagcagguccuuuaugaaugucuccuaauuggaaguaugggugugaaauacccaguauaaggaacaauaaaacaaggacccuaaucugggcucuaaaaaucuaucacaagucugggcccuucgcuagaagcucaugauuccucucccaucuccaccaucaucuacccuggguagguuuguucccccgauuggauaaucugcaagcucuacccgcacuggauguguucugagcccagcucugcuaggaugcugauaauagaaccuaacacuagcacagggcauuuaguaauugccuacuguagaccagcuucaagguuauauuagugagauacagaaagaggccagaguaucaaggagcccacagccuccuagaaggcuacaauuguauuugaauaacgucaauucugaauuugugagaaagagagguggugggguagaugggacagaugagagcaaaaugugccucugauuaaugauggaauuccaugucagcucagcugcuugcuagcuggggagcuugguuagcuaaaagaggauucuugugcuggugacacugacacauggguaccaaaauggaaaaaaaaaucaggagagaagggagacugcuagcugugauaucugagcucagcaugguaaugcccuccugcaauccuugguuuacauguguuauguggcaaggucuuguuuuguuggcugauguccuucauuacuuaaagagucugugaaucuggagcaaagaugacgccugccaugcacaaugaugggaagggaggauuuggcguuuggagggagcaugguggcuauacaucaccaguacuaaccaaggcuccuuucccuuccugaaggcagggaagaaaugccuggcuguguaccagccagaggaggccacgaacuucacucucgcaggcugugucagcacacgcaccuaccgacccaaguacugcggagucuguacugacaauagguguugcauccccuacaaguccaagaccaucaguguggauuuccaguguccagaggggccagguuucucccggcagguccuauggauuaaugcuugcuucugcaaccugagcugcaggaauccuaacgauaucuuugcugacuuggaaucuuacccugacuucgaagagauugccaauuagguggguguguggcucaggguaaaguuccaugcugcaaagcagccagcccuuugugguccaggacuucacaauugagccuuauuucaucuacuuccuacucgauucugaauucccaguuucuguuccuguuuugacaaucguaauggcccaggagagugcugcucaggcucagacaauggguuccuccuuggggacauucuacaucauuccaaggaaaacacaucucugacuguucacaauggaagcaaagccuggcccagcuagucuggcuccagccugggcaaguugucagaaguugugaugggauuguccaaggaaaagcaucagcugaagaaccaguaucaugaaguccuuccucagaugccaagccuagggaugcugggauccuuucagacagauggaugggauuggggacacaggaauaagcuauuauuuuacccuugccaaaugauacuauccuggguauuucugccuaaaacauaccaaaaguguucuuguuccacugaucuguauaucacaagucaccaaacauuuuccaggugaggaccauaguugugucauucuguuuugcuauugaaaaucauuuuaaaaagaaggaaaaaaaaaaaagaaaagaaaagaaagucauuucauuaacuugggcacuuucuccucucaccccauauucuauaaagggcuaaacuuggguucuuguugaucaggaauguaauuugagaagucuuacuuuugcagggagaugguagcccucaauucaucccguagggaugggacaaggccagccaaucuuucaagccauagcugggcaggucacugaaucugcugcuggccaaguucuuaggacaauuagccaaaaucugggccucucucucccuaggguucaugggaguugguagggaccguagagugacuugucuguugucucaaaaaguaagauggaaagauguucucauggcccuuagaagacucuuuugaagucuacgccagaccuaacagaauaugugcaucaaacaaacaaguggaucacccucccauggccugggugaccucuagcagucacccagugacugugguaaggccacaguagucccuggacccaggacaaaucuuuuuuguuucagugaccuacuuuacagccucagugucuaugaagaaaguuaacucaguuuucucaucugaagacagaagucgaccagccauucagaaauggggaucuauuuaguagugguaaacguuaaagaguuuguaagcuaaagaaauauuuuuuuuccuaagugauaaugagguuguuaccuauuuuagagguagaauuuucugucaucauccuuuuauuguguucuacauacuacccauuguucucaauauuugccacacauuuacucauugaaacuugcugauaacacagaggacuucccuuaaugauuucuguucuugacacugugaaauaucaauucaaagaggcuaauaaguucaaucaaagucaccuaucugaagacucauagccagagaagauugccuucauauuuccccuuugcuucuggaccuuguaaacaugucagggcaggaaagcauacagaagucagcagcuugcccucuuaguauuggcucucuagccccuuucacguaagaggagagugugucuagguacuaaggauccaaccuaaacuggacagaaaagggcaugugcauuauccccuguggcuccuccugcccuggaaucagaacuagcuuacagcaugcuuuuauaugaugauucaguuugccccacaccauacauaugggcauaugggagaacuauacacacacucauaaauggauuuguaaguaggaaaggggacuugagauuuccccuccuuccugcaacuucccaaaggccuggccuuaugcaaggcaaacaguggugcuuaagauguauuuugggaagaaaauacuauauauauauauuccuauuuuuccuuagaagccuuuucuuccaggaucucaucuuaacaguaagaaauccucucuuaagagaggccuaguauuuugaguaaacauauguucauauguguacaaguacuuguauguaaauauaaguuaccacuguggguuauuaauuagguaaauuuuaugugguaucauauuugauuuucuucuauuggaaaaaucugccuuaacagcuaacucuguaagaacuuccauaggagccauaagcuagggucuucccagguauccauccucuuuugggaaacugagcugagcaucuucaaccaaaggaguuagggugaucauugggaauaggagaaagggauggccaggguagcuccaucguuauuuagaaacagaccuggcauacagaacgaccagaggaaccaaccuucuuugaaccaagggaaaaagacuuggauguaauauauagaagcuuuuucuaauagucagaaacagacuuuaauuguauggccugguucaaggaaaguuaagaauguccauuaucguuaaaaacaaaaguccauuauugauagcuuauuuggugcuaagcccuacggugcauuuuguccggcuaucacuuagcagagccaugcucaguacacagucuuucucuauucaauaaauagaaacgcugaagcucaaaggcacugaggagcugaggcucagaagcauguuuaguccacucuaucagggggggaagagaucuugacggaaccuaaaugacuacuauuggaaacucauauuugaaagcuuucagaagucccacccccaccccauccccagaugcuuagaaacuaaagaagcaaugaggaugagcuagccuucagugaagagguucacuacugcaccaagagugaaugucuuagguguacuuagucauuggacagggagaccugagugaguuugugaaccugcagcuuacuaaaccuuacaaugagcauuuggagagccaagacugcuucucggcgcuuuacugacauggcuugcuuaaucuucucagugagcccaagagucagggcguuaccacugcccauuuuagggcugagaaagcaaaaucuccaggaguuaagugauuugcucaaguuuuuaaccaaccgaggcacugcagauaaacuccgaagcccagugucauguaacaugcccaugccaucucuccggacacgcagcccauuuuccuguuccuaaaccaaaggcucagagucaccagaaccaacucacaggacagugcagaaauucuaaugucgagggugauuagagacugaucaaagaaaguaauuucaaaugauaugauuguuuguaagcacccuaguuaauucuggacuacauaugcauagagauugugaagaacauuacagccugugacuauaacguugacuucugucauuucuuuuuaaagacuuguuuuuuuuuuuuuacucaaaggacccacagugacagcccugaaugguugagaagcauugauuagcugugaguccugcauauguauguauguguguguguguguguguauuuguauguacuuaucuauuuucaaacugugauuguguauuuaaauauuccuccugccauuuuguaagugauuacgcauaaagaaacaccuuugaauguccuaauaaaggagagcuagcccuugggcggccugucacauuuugccacuuuccucauuuuucucaugaucuguguagcagggaauguguuuguucaaccaugaugaguuuucauuguucaaauucuuuguuuacagcuuuucuccuuaaagcaauaaaucaucagcaacaguaacuucuuugauuug

SEQ ID NO: 7786 - RNA, 40331 nt, Mus musculus
cggacauaaacaaaccuugccaggcuacccucucgcguugcaggcagauugcucacccaucuucgucucccucuucaccucccgcggggcgcugcaccuccaaccuugugguuggcuccuuuccgugcuugcuugcucauuagguaagcccuccggacgccuucuuccuccggagcaagacaaggacccccagcaaagcuugcuuucggggugcuacuggacaccccgcccgucuuuuguggcccuugcgaagaccacaacugguggucuucgguggaaccggcgccggagggauagcuggcaucacuggagcggguuucgauuacuauaaggcacaaaaagacguguugggucucgcuuucucucuaauuggggaagugggauuaaggggucgaaguuggggcggagagccugggaauaccugggucgcacuuccuggcgucaacccugagccacagcugacuucucuguccacugggcucaaggggacacuuugugugugcucucgcgugugaagggguguggaugggugauggggugacuaggaaaagagcgacuguagcgcguguauccaggggaugaguaagggugagcagacuuggcggggaguguggagaagggggcgagggugugucuacucuggagccuggucccgaaccagugugaucugaguccagguucccauccaguccagagcccagugcucucuccaagcugugcgugugagagaacgugugugugcugggggagaguccggggugugucccggcgcgugcugcacgcgccacugcgagugucggcggcgagaggagcccaggcaagggugcggcccucuagguaguaccggguuggcucuguaacugcgcgggaguggugguuugugccuccagggucgcgcgggcaucuggcagccccagaguuggcuggagcucugagugucgucauuuucgccuccgccuccccccgccccaccucccuuucuuucucccaggcgguccucccugcuguuuuagcccggagagcagcuggaaccgcucguccguucccgggagaccggucgcggucucugauucagccuguaggguagauucgggaggggcgugaggaaugcugcaggcucuggggaaacaugcugucaccaccgccucugucaaauuaguagcugaagcuaagauuuguggauggcuuccuuacucugccaccuuccgucuucccuugucugucgccuuugcuggcagucaucacggauccccaugcacugucccuugggcuuuaaugugggaggacaggucggggagggaaguccagugguccguguccuagaacagccuucagcucucccucacagacuuccugggcaggucagcuuauuugaguccuugaaacuccugaagaagaugggaaauucaggacagccaauguuccccccccccuuacccccuucagugaucuccuacaccaccuaaagugaacggacaggcgcuagcuauggauuucaaggcaaaucuuucagguugcuucuuacuguuagagauccuagcaauuugucuauuucacaugugugaagugaaugagagaaagcuaggugcagaggaaaaccccccaaaaccaucuucaugggacuugccaacuucuggacaguggcagggaggggccacuguuuuauggguguggcgcaaccagccccaggccagaaggguaccaagucggagcugaaaggugugagggaggcuuuacaggaaggucuggaaaagcuccaagaggugagacuacaguagaugcugucagggagcuaaucccaccugggccuucuuagcuugguggugcuugguaucuccguggccaguacuggggaaggaggacuuuuucagccauaccaaggacaguagcuugacccauaggaagagcucugacauuauuaaaaaucauugggacagcucugcuuucugcccugaccccgguagguaccugauacaauccuauggcuggaggagguaucgcuuaguuccuggguccauuguagagucuccucuccucguaagcuuucucuuggugaaagcaaaccagaaauugcuaacuacuggcugggcuauuucaaaaggaaaucccaacucacacacauccuuuccugucuuuugcuacuuuagagaugagaacugagaucagagauggagaggucuguggcugaggucagccagagucugaacuccguucagagucccuucucagaagucucuugguuaggacugaacuugaguuuugccugaaugcaacggaaugaauaggaacuuaccuucuuaccaaguuuugggugaggccaguaggagggagaggcagaguauauguuugcuuuuuauuguuuguuuguuuugaaaguguuuaaaucauguguugaaguggaagcaaagucaguucagugagaaagagacaaggguaacagucccucuaccugguguuuuuuuuucaguuaguuaccuccccccccccccugcccaacagugcuggggucccugggugcauugaccccugguggcuugaacuaaccccagcaggggacagaaagaaggcaguguuuuucugaugucccaaagcugcaguacuucccuuaugaccuagauccagaggagucaucuaaggcgugccucaaagguccuguaccuucugaggcaagccaacguaaugacuagcacuggggguguagccauagcagagcgaguauaggauaggaagagagucugggacaggagccacagagcauccaaaggaucauuugcuaccuuccaccuccacaggaaugccgccugggcuguaucaucucuauugagguggaugagaaaaccaaaagcuuaugugaaacuauaagugggagaaccagacagacagaaccuuuugagucagcccucaaaacuuuuguguucuagcguaacgauauauccagguguuugaagaaagcagggaagcaguaugacacaugcagagauagucucgggcuuuggaccuuaguuuuccucuucuauaaagguagaauaacacaaacaaucucaucuggguguguagagcuugcuuuggcuaauccacaugaagugaggccaguggucagcacaugaggagcacuguguggaagcuucacauaacaacuagagaggaggagggcauaccugcuaugccuccuucacccucuaggucuagaaguuuauaguugcuuaguacauagcucuucccuacucagaucgcuaugcagccuaucauauugccucauacaauggagguaggaggaggucuuaauucucagguuagaaaaacaggcugggcaccagucuagaaucagguuaauggaucuggaccaaaugacuuuauccuuagccacuucuaacccuaaccuugccccuucuggacccagcuuugggaugggugguuaaucugguggacucacugcaggcuguggaccuucuuggucacaucugacccuaggcuagcccuucucacuugcuuuuucucuccaugggagacggagcugcuaaacguggccuccaguuguuuuguuggaaggagguuuguacaagagcaggaugcgacaccguggcccagcaggaagcugacugcagagguggagggucacguuuagauguuggcauggagcugaauucucuaagguggguguuguagaggagaguucaggcacuuaaggagaaugcgaggaaguccgccuuggcaccucagaauaagaacaugcuuacaaaaucaggcccacaaacaggcucuuugaaacaagaguuucuuacuguccucucuauuuagucgaucuccaugcccacuggcuaccucugcuuucucaugcucugucucucggacuauaggucuaacuaguucuucccuacccaaggaaguagaaagaaaggcguaugaaccugaaggcuugcaguucauuaaguauagcuucuccuuuccuucuaucugaagaaaccuuuaauuuuucacuuuguagucuucugccuagagaggcagggugcaggccagcauccaucuucacugguuuccauccucagcagaccucuccaaauacagaucugauaggcccucuuaagagacugaugacucugaaccuuucucagcuagccagccucgacccuucuagacucuuccacggcuucuccgugguugguagcugggcugagugccuucccguucucauuuguccuguggaaucacgcuguccugucaucugucuguuuucucaugcccccucccagggccuggcacuuagugagugcucuauccuugucugcccaaaggacacugaugagggcgacaaaccagcccaucuguacaggaaugacuggagaggcucuucugaaguguggaagagacagagccauuuugggggaaggaucugauuaggguggccagcaugcagucugaucuuggggacaaagggcucuguaugaagauccauuuccguccuaggcuaacacugucucuaugaugucaauaaauugucucagccucgccagcauagcucaaacccaucccacggauucacagaauaguuccucuagugcgaccaauguccuucuuuggacuuccaguuacuggcuuauccuucagacagugccaaaccacuaacugccagaccucuggugccaaaacaccaacgagcacuccgggaagaucagucaauguaggcauauuccuggcacuuccgcuuccugcuguuacauucuaggcagcccucuacucugccuaccucacugcucagagcucaggggacucugauuaaauacacaaaucccccuuucagcuggggcagguagugcagcccuguagucucagcugcuugagaugucgaggcaggaggauggcaaguucaaggccagccugagcaaacugagacugucucagaagaaaaaaaauauagaaagaugguggggaacauaguucagagauagaguccuauaugcacacacacacacacacacacacacacacacacacacacacggcucaaucuaaaacccaaaaguuucaguccccacagaugcuaggggugacaaugcagcuuuaguugccugaugucagguggcuuucuccuugugaccuuugucccauuuuuccauuguggagcaaagcaucaauguugaguauucuauggagucccgaggcuccuggaggaaccccuguuuggaaaucucuaaggaggaugguuguaccaccuuuuggucuuuuaauaucucugagauuuuacaucccacucuacacucccccuaaguguagagccuucucugauccagccugucugcagggcucuuugugagaugcauuacauaagaaaaucagcccagggcuccacugccuugcccuucccagaaucuucacuuucaaaaguucagaaaacaccaagggagcuggguaagugcuucacagagugacuugagagucuuuuugaacugacauaggaauguccccacaggcauguaggggaaccugggcuugucccaagguaguuuuccuggguucacacagaagugauacugcccugcagaccucccugggguugcaauuuuaaaggguugcuaugcuaccacugguagcacacauugacccucagugcacugcaagggacaagcuacuaaaaauacccaugcuucugugacuccuaccuggagggcagaaucugggccagcugcugacauaacagucagugcugagccagcugugguccccucugguuuuccuuucucuguuucucuaaaggacuccugggaccuguuauuugccuccaacaauggagugagguggcuggccaucuuucucuaggucagaggauggagacacggaaccuuugggaagucauguaagggagauuuacugggcucccuaucccugucuaugaaguuggcaacgccccugccuaggacuucuuugaacacagaaaucaguguggggucauggaagugacuuacggcauuuacugugguguccaguccccauggaugcucuuccugggacaccggguccuggaagucucagagcaguucaugaaugcgucuuugcuggauuucucuuuuguuucaccccacgggaacucuaggggcccaggagagcuuggccaagagggcaagcaaagggguagguuccacagagcagcuucagcucuggggaaugacagaacuagggagcccaggguaagcacagaggagucugagaggagucaagaggaaggaagugagguggggucauugggccagagcugagcacuuugcauagggcacuuuggucucagagcugugccuuccuaccugggcccccaugucuaccuaguuugucgggaauccgaaggacaaacacacauucuuugcaagugaacacagggaagcucauagggguuaugucuucgagucaugaggcaagaaagugaccugauucccaugcugcgaacucccaagccagguucaaucaccucucugaggcuucuugagauuuccagauucugucuucacuacccucacagacuggcuaaugauucucacauggccuuggguugcugugggacacucaaccuauugcccuucgagacccaggguuacauuucucccuguucccagcacauguugacuugacuugaccaggggcccuugaauucuuguuccuugaugaccaagaugugcuugccuagccuuccugacccuugucacucacgaucuagcaucagugguguuagagagaccucauggugcugcacugugggcuggaggacuguucggcauuugcugagcaguuuuuacacauccucuuccccacugggccacucugggacucugggacgagcaauguguaaagcacaggcuguguccucacagugccccagggacuccccagcaccacaggaaggaagggacacugguucauuaaauagcuauuugcagguccuuugaguuguucaguuuaaccuucggcuugcugggagccugggcaccaaguacacacagaugcacacacggagguggagcugaagcucacaguaauacuagaaucugcucauagcaccagguggccuucacuccucuuugaauuuucucugaauuccuggagcaggcaggugggacaggaagaagcaauagcagccaggcugcuggcugguguuaugaccuggggcuccaccucugugggagacuuucacugggaggaaaucugcccuccucuaaucccugcagcuggccaugugagcagaagccguuagacuuggggcaagagugugugggugugaauguguacuggaugaaagaauuguuaucuaacagacauuuucuggaugcucuuuucauacuagggaccgcuaaacucaagcagucucagacagguuucauuuugcaucccggggacauuuggcagugucagcgggcauuuguaguugucacagcuugaggguguggucguccagggccggggauauuuccuagcaucauagaauguguaagggccugaaugucaguacugaagcacacugguagggcagguuuuuuuuuuuuuccaugcuccuggagguccuuuuaggcuacagggggagccugagagccaggaccucagucucaaggccugugugugauucucaggcuugcccgaacccacacugugggaaauuugaagaccuccacuuuacccgggguucuuggcugggcagaguuuguucagcaucccugugaaaugugaaguccuccacucucagcaugagaggugguggugccagaggccagggcuucuggaaggucucucuaggcugcguaggcgaggugucccacggcuaaggucucgggacuaucaacaugcugaauuagcaagacucucggagcauagcuuuucaugccugcugccuccgagcuggcggcagcccaggaauguucacagauauaaaacugacuuuguuuuucgaauguucuggcucccagacccgaaaggcuacauaaagacauucuugugagauggucaucuacuggggagagucacgcuggggccccagaccagcacacccugucuacccacugcaugccguauauuggcaugaauauguguauuucagaggccugcucuugcaggcugaccuguagaugagggucacagggcuccugugagcuugggcaacuggcuuucaggaaguccugagacuuuagcucccauuguugcaguaucuauaaagccuugaauaccuggacuuauaacucauauuuucccuguagguagugagaggcuauauccugggcccaucucuuggcauucuccacccacucugaccucugugugccaccugugacacuucuguucucuggcauuccuuaggccccacucuuacuuuuucagcauuuacuuuuucagcuagacuauggauccggaagaauguguguuuaucucccagaucuauaggcauugccuccugcccucuccuuuccccacaauccccagcucuuccgagcucugcaccuguucauuucuguagcccuuaucuauuggcccuuauggggaauguguccuagugccaacuaaagagaucccuguugccacccuuucuugcccuuuuggguuuggcucagaaguaccauuugcuauagggucauuuucccacauccuguuaguguuccaugucugucaaaccuuuagcauugguuuguuccugucccguucucuccacuguggucaggcagcucagagucuugcucagagguacauauugcaccuguacgugguggcacccaggggccuuuuggucccuuugauuguuaaucuggggacaucuggcaucagcagagggauguccuucuagagugcaucaagaagcaucagagugggcuuggugggucuggacuaggugugaaccugcuuuugggucuccauccaucugcuuguuuguagcuguaaccgugaaccaguuucaggggaacgagggcuuccuuguaguccacgaauggccaugggugugggugggaaaagcuggggacggaggagaggccuggccuucuuauuuguuucauuucugcauuagcuuuuuuccaggaaaguuaucucacugagaagugcugaccuccuggccuuuuuccccugguaggugugugauagcacggaaaugucccgagagcuacaugacguggaccucgcugaggugaagccucugguggaaaaaggggagguaaguagagcugcuuuaggugacgcuaucacaugcuccuagugggcacacauggucacauauuggcauggacacucuugagcaugccuucauuuguauauagcaugcaugcaugugaacaagagcauagcauauaagcuauguaugaagugcacacacacacacacacacacacacacacacagagagagagagagagagagagagagggagagagagagagagagagagagaacagguauuggcccccucuauuucuaucugcacuuagugacucuugcucuucuugucuauugcccagucacaaccccuguaacgggccaucuguuaggauugguuuacagcguuccagcccccguguuucucuguacccuucuuuguuuuccuggccucuugggcauuuggcacugaugauccauccucugugcugcaggcucuggcuggggcccagcuuucuauuggauucagucucugaguugggcagaaaacagaugccgacuagaagagugaggguccagguccuccccgaaccgcacugcccuggcuuccuuggagucaacacacccuuuccuaccuuccuggaccuuuugccugucccagaaaguuguuaaagaugaaagcugauguagcuugaggaaaaggcauugagguuuccauugcccucuucucuccacaaaagacuggauuuuaauccagaacgcaggcauuagcagccacgagaaaauuacaagagcagaagagacacggcuccauuagagucaggaguagcacacgcgcaagguguauggacuaccuagccaccuccagcacucugucacccaagcuugugcccugcuucugucuucagaucucuuuuggccaaguguccuuggaaaagaaucuagcagauagaccaauuuucuacugggcugcuguucccugagauaaaacagacaauaucucuuugcaaggacaaagggacgcccacugagcagaguuuagauucaggcaauggaaaagaccaugaguauugauugauguucaucucuaaccaaggauaguaaccuuguaaccauggcuuucaucucuccacagagcaucacuggucuccugcaagaguucgauguucaggcaaguagaaaaugugaucucuuuuuuauccuccagucuaccuuuucccuuccuuucuucuuuccacuggcaugaaguagaucgcuuuuauaaauguggagucagcagagaucagggaguggccucagccuauacugauacuuugcagcuucuccuggaagaagcuaguuugaguucuacccggggagucaaaaauugaccagcccccaacagggcagacagacagauuaccauguggcccuggagagcugggauguguaugggaaauaacagauguccaguggaucuggagacccugugauguggacacauaguaaucuuggcaugucaggaaaucugaaacuggggcucuaggcauaagguuguaguauccaucccacucagagccagauggaggacuagccaggauguguuucccagcuuugucuaagagccaguuauagagaguggagaaacccugcacucuccaguguccugugccuucauccccaagccugaguacccuggagggcugcaggcaugcucauuuagaccuccaugaguucccagucacacaucuugauuucauccuguucucugcagacagaggaaucaccuaccucugguuuuuccaggggcuccugcuuugaugcacacucauccuuccacauagaggugggguucugcccuugacucuggaagguaaagaaaaaaaaauuagaacaagaguuagaaguuggcuugguuccaucacaggucuaaaggcauaaagugggccuuugagggucugacaccaguaugauugcuggauacuuugaccuugaggcuccagaaauucccagcaugggucugaggccaaagcuucugucuguucuccuuuggggccagcuuauccuguuagcuggcaacagaaaugaaguauuaagccauugcuguauaucagcccuuggaguccacuaagagagguagcaaccuuaacagcacagagauaucuuugugaaccccaagaacccuauaaagcaggggacuuguccuuagguccaaaguagagguagguggucuagcccacacuugugcaagagacccugugggguuuaacaauacaagcauacacucaucuuggcccuugaaauggaacccugagacaggggucaguaucaaucuaaaggcuauucagagaugacaguugcuuccauuggaggguggagccccauggccucauaagccugcaccccccccacccacccccggcacagugaggauucccggaggaacagguugugguuucuaccccagggcuccuguugacagcggcucagccuagucuccuagaggagucuccuugacacacagcccaguuuuuacuguccuuggauguccucaaccugucucuguaguugauaacuuuccaguagggauagcaucccugcauucuguggggaaacugaggcacccaaacagagacuuaccugaaguuauaucauagcucagaccucuguaucccgaagaaacugaccuucuuaagagucugcaaugcuguuuguucuaacuaaccugacaagcugugugccuuuggcaaguuacuucaccuugcugaguaagcuucauccaguugaccauaaccaaguuccaguacuuaacggucuacuaggcacuguuacgaggaugcugaguccaguuaaauucaaugcuuuaauuuaacugugagauguacuccuucacucugcacaagagcccugcuuucagacuucucaucccugcuucaucucaggucagaagaccaaguagcgauggguucuguggucaucucuucaugggagcuuccagguugacuagguggugacuggugaugcuaggacacugaccugggguuacuguggugcuguauaugcugcggugccucccaucugugacagcuuccuaugaguagaauuuccaguagggguucaaagcaaaggcuguggugugcaaggaagcauggcagaagcacaagugggcagaaguggccuuuaaaguucagggacuugauuucuuagccaccagcuucuuagucuacaugcuccuauuuacaugaggucaagguagagacaugcuuccaaggaucaugggugagaacaucagaagccccucccccccagauuaguaggguagucugcauccacccuggaacccaccagauaaggaagacaaauaagcagacaggcucccuaaccccauguggaaaggcagaagagggaccauggauggggugaaggcagcuccuuggguggagaguaucuaaggagggguuuagaggaucaccaguccacugaggacugcuugucacuucaucccuucuuuugccugacuagguauguucuguuugacucccugugaccugguccacugucuaucagcgggcuggggauguaggagaaucauuuuaguagcaaggagagcugguggggcuuccagaaucuuccacguacuuguugcaaaaagggagagacagcuccggagaguggcuugccagaggccacccuguauuugguagaggaggcaaugucccagccuguaccugucucagacccacagaugccugggugguggugauaaagucacugccuguucccauauacaagguaccauacuaagggcuucccagccagcacugcauuucacaccucaguaagcaccuguccacaggcacacguggagauaaugagagggggggugguugugcuucgggcgggggggggggaggggcacagcaggucuaguuuugccuucauuagaggaaauggacguuuuuggcucacuguuuccagguccugaaccugugaguuugcucuccuugcuuccuaugcaauggccagaacuccacaccauccaucucacugucuaggacucagggaugggugugugcuguggugagcuagaagccaauggaauguccugagggcuuugguuuaucuuguucaguccugaucugcccuauuggagauguggagggacagaggaagagcagacauuguacaucagugguggcuaagguugugacaccccaucuugcuccuaaucacugugccaggguaaugagagcuaugaaacuguccccugaggccuugguuauucaauuggcugugugggcugagcagagagauguaacugacagcccuggggcccccugugcagugagggcugagccccacaagucuuucacugauuagggccuggugacuugcuuucuuuucucccuuugccucccugcucaguguaugauugguaaagugauuauuuuuucucagaguugagacugucccagagagaguggaaggccaaugccagcugccccuuucugguuaucaacuaagucccuccagccucuguuuccuauuuaagugacuuuguauuuuagagaggauaauguuggagcuauaacaucacagaacauauuccauccucuauugugucuucccucugauuuuuauugugguaaaacacacaaaauaguugacauagucaccauuuuuaagugugcaguuugguggcgauaaauacauagauuuuaaaaguccacguucccucuccccaaggcccuccccccaccauuuuaccgucucugaaggaauuucuuguuuccaagcaccuuguauaaagggggccuacacagcagcugcauuuuggugacuggcuaauuucauauggcauuguaaucuccagcucaaugugugguaaaauggugugauuugucggcuaugagguccaugggcaagccaggcaggugcccugggauuucucuguccucuuggugagucuuugggaaccugugcuaucagcucauugucucuccugaugguuggagagaccauaacugaaucuguaaggugggccaauugguccaagccugacugggacucuccccugaagaccuuuccuauaguuccagaccuauagucccccaccuccacccaccccccuguccguaagacugcacuguggcucaccucugccauaccucuuuggucugucuggccaaccacaugguuuguacuacauugaucucuuguuuggucuucggaggggaggaggugaugugagguuuagaaugucuguuucuucuugauggccauucaguaucuucauccacuuccuagucuucgcaucucauggggguuggcuuaaggaacccagaugcuuugccgugcccaccugaaagcagucugcgaugcuacaugggggacagcuccuacuuuggcauuuucaaugaaccuagaugacacuuccuuuuuccauagucuuagggguguaaguuuuugcacauuucuuuuaaagcaguagaaaugugugccucaauguucagugcuaaccagaaaagacucucccacccauagcuggguugcccaagcaaguauuaugggccuugucucucccugccugugucaccuugggguuucuucuugucugaggugggcacuguucuagcucauagcaaugcaucucccuuugcuaaagggcuucuggauccuuaggauuucagcuuguggcugcuagucuguggugcuucaggaaggacagaagaucaguuugaucugguccugcuggggcagcuguccuuaaaggguaaugucucugucucuaaguuugaugagcaggcguugugggagcauuugagauuugagcuuuuuuuuuuuucuuuuaacuacaauucuggaauuuguguuuguuaaaacugccagcugccuuugagaugguccugcucuucugcuccagaugucuaaagcacuggaugcacaucuauuccagggccuccuuacuaggucacgcacaguggaaccuaucuuugcagagagaucuguuugaagaugcccagagguacuauugaacgucuucuggaaacugcucugugcucuccccaaaugcccauauaugagucuccugccagccugguaagggcaaugcccugcccuccuugugguaacaucuaagauauaacucuagggaaaucacauggugaugaaauggguguugaagcugacucagcuccuacauccagagauagaguuuccuccaaagguaguuucgggagggcacuucuggcuccaggcugguuggcuuccauuuacuguuaggucuucagugucuaauuuagugguucucaacuuuccuaagacugagacacuuuuauacaguuucucauguuguggugucucccaaccauaaaauuauuuuuguugcuaccucauaucuguaauuuugcugcuguuaugagucguaauguaaauauuugauauguaaugccagagugguuccaaccaacccacagguucagaaacacuugucuaaugccuucucccuaggcucugcuuguugaaauggcuucaucugauuugguuuccaugggaauauguucguauacacgggacacucuggaaaaugaacagauguucccuuuggggccuccuagaggguagagagccagacaggguggcugaccuccguaacuccugagcuuggucccuacuccuuguaccucccuggagcaagcuaggcuuggggcuguuucuuugcccuucuguuagcaagcccgucuacucaugggaaaugcaaagaguggccauuuuggacuaaguucugucccugcaccuuuguuuucuguuuucauucgccaguuaauuccuucuagagugggcagaacucccacagaaaguuaugaguucuuaguucccccauuuccuguccuuucccuucucuggucccacuuuccaagcaagcuccugggauucagaaacuccacuggcagauggcauggaugcacaucuggggcaugugacaugccagcugccugcucugguguuuccuagcaacaucccuggaacaguaaaggaaagccaucuaggcugaggcuuggaguuggggcagacgucugccccaggccaagaucugucagacucucccagguagaccuucaucuggcaacagaaaaaguugcaugcuuuucuuucucaaggcuuaguucuaaucugugaaacauaugcaggggggccagggaguaucaguaccaugaaggccauggccagccuuccauccauguaccuugacccuaugcacagaccacgguguuucuccacuggauuugggguagauuggucacuccuuuuuucuuuuccuugucugaggaacauucuuccccugucuggcuuccuuggagaauaugacccuagguguuuuuuaugaccagggcugacacaaagccacaacaacaggcugugaccuguagcuucucaucucugcuuuggugggaugguaacacaaagggugguggucccuuaggacauuguagucucaucccucaguaucuccuguggugugacuugcuggccuggaaaaggggugguccaugccacuagcugcccuagagucuuggagaguaacauccucuagcaucuaucugcccagggccuccagggaagggugagauuaugguggguguagcagcuggucucuagagcccuagauuauccagccagggacuuaagccauucugucuccacaguaaucacaucuccaacaguugccauaacaaccaacagggagagagguaguuguuugaaaggcacuucuaggucuuagcugugguagcagccugaggagaggcaagcuugccuuuauuuauuccuguucugguuggcauuaacugucaaccugccacgacucagaauuaucuggguagagcaugucguugccuggaccauauugcccuaugagcaugucguuggggaauuugucaugauuauuaauugaugugagagaguccagagcacaguggguagcacuauucccuaggcagauucgggaacuguauaagaaagcuagcgaagugcaaaccugccugccagcaggcaagcagcauccucuggguuuuccaccauacuuugacugugagcuaaguuccuuagcugaggauagccuugugaggaauagcaaaaagggccugccuucacguuucugccuugacuuccuucaaugacggacuguaaaauggacucguaggcugaaauaaaccuauuccucccuaaacuccuuuugucagagauuuugucacagcagaaaagucaguuaguuaugcaucuucccuccccucccccaaaagcuggucugagugcuaguggguacuaaggguuccuucaguauggcuauauuuucacucuucucgccaucacugcugaucaggcuccuagguuggagauaugcucucccuuuuuagagaugaccccagaaggcguauguaguaggacaaggauuugaaggguaguauccacagggaggcuggccugaccuauuuuuagauggagccauguggguuagccccaagacaauaaagaauguagccccacaauagaccauuguucccaugguggcuucagggacagcagaugacccgcgucccacggggcugggcuauugcuccugucuuauggauuuuuccagugcuugcucuguguaggagagaggugccaagccugaagggaaggggcggggcaagggagacagggcugggcuuugugucccaggggacuuauuuugaggaccaauaaggcauaugguucaggagacccccuguacuggggguucaagaagcuggguauucgugccugugcuugccagugccuaccuacgauugacuguguccucuggugucugucugugccugccugcacccaugccaaugggccuaugaaugcuguaucaucacuaccucauggacacuaccacagguucaaauccauauuccagagagugaggagggcucuggcuugcuugcuucagaagucuucagggauaggacccccuguaucucucuguccugguuggaaccgagccagguuaugaguuuaugcgcucacauguguuugagacaguauauagcccaggcuguccucaaacucuccaucuugcugcugucuuacuuuccucggugcuaggauuauaaaugugcacaaccacaaacaccuaggguaaggucuuggugagaugccacacuggggacuaggcauguagcacagugguagaacauuugucuaguuaguaggugugaggcccuggguuccaaccccaguauaugcacacagcagaaaagaaaauauagcauucagagacuauacuuuaaaggugggacccuggaaggaggguucaucccuuguguuuuguacuagugaaucuaugugcguucuuuuauccgggugugcuauacuaguacauccaugugcacuucugugcacauacagacauuuguggguacuauucacuaggacaucaguguguacuguucuauuuaagacuaguauauccauguccaugugcaugcaguguugugguauucuauuuauguguaucauguuaccaguauuaucuaugagcacugcuauuccaggagaucuguuauucguacauccauguuuacugcugugcuuguacauccaugugcauugcuguaauuaauucccaccugcucgacugcuacaaacauguguucugccauuuuuguuacacgcaugaggacugguaugcaaguacacccaugugcacuguuguauguguacgaauggcugucugugcugcaguugugccccaguuggggaaucccuguccucaugggcuuuacagccuuauucugaccaccccaagucuuguaggauggaggcuguucaugugacagguuagggugacuuuuccagaacacagcuccugaguggguggcccucccuaucuauucuucucucacauuagacuaugggugcugccucuccuaccucaugagacacauggguccuagauucuggaaggauguuuuuggcaccugaaauuuucugugccugugucaccugcaugauucugaccaccaguuguagcuuggaggugucacacagcccuuuagggcuuuugcaagagaugaaggaucuggagagaaauggcccagcuacacggaaguccucaguguccccagcagaccucgggagggcagccaagagccaaccacagcagaggaggaagcuguugcuuucagacgaggaaauugcuccugggacaugcuuccucagaagccuagagugacagcaaagaggacaggcaccaagggccaaaggcagggucacagagggucauagauguucacaaccggcuucaugggagguucauuugacaucgggcaggguaaaugagccuucugggagcugaggacucggaacgaaggugaagccugucuuuuugaggguagaagaaagagacauauuccuuguucucucaagugagcauggggggugugggggugcuguggauugcuaagaacuggcuucagaguagagcaggagagagaaggaauuuagggggaucguugcagguucucugcucaauccagaaugggaaguuguuggcccauuacacugacagucccaggaaguagaggccaugcugagacuaaugccuccuuucugucuuuaucaaccccaggaugaugguuuaaugcaggcaaauauuugccuauuggcugcuaguuaaacauugcuaggucaagcccagccccacuuccacagugagucagguuagcuccacuugguaucaccuaacagugccuggcauuugagaggugcaaugugagaauuggccucagucugugaaacagagugugucaagggagcugguguuuguguguguguguauguauguauguauguauguauguauguauguauguauauaugucuuaguagcucuucuauuuugugaagagacaccauuacaaagguaacuauuuaggaaaaaaaaacacauguaauugcagcuuguuaacaauuucaguuauauccuggcaaggagcauggcagcacaaauggugguggagcaguagcugaaaucuauaucuugacccauggcugagguggggaggggagaaggaaaggugaacacugggccauguaugggcuucugaaaaccucaaagcccacccacagugauguacuucuuccaacaaucuuaauucuaacccuaucagagcucccuucucugcugacuaagcauucaaauauaugagccugugggagccauuuuuauucaacccacccauugcauugugcuuugccacaggaaacugagguuguucuuugaaauggggagugacuucuaggaagccucaaagagcaaauaccuauuauccaugggauaagugagacacaggaacaagaagucaaggaaacucaagccagaugcagacaacagaguacuuuucaggcaaugugacuggggccaccugucucuggauuguagcgcauaaccugccaggguccugucuucuaccuccugauacagcuuugcucuccuuaccuuuucauuuucccuuccccucuucucuccuucuucuuccccucucccuuccuuuucuuuccucuuucuccccccuucuccucccccucccacuucacauuccccuucccuucccuucccuucccuucccuucccuucccuucccuucccuucccuucccuucccuucccuucccuucccuucccuugcucucuccuccucuccccuccucuccccuucccuuucauuaucuccccuucccuccccuccccuccccuucccuccucuucccuccccuccccuccccuucccuucccuucccuucccuucccuucccuucccuucccuucccuucucuuucuuuuccuuuccuucccuuucucuucugaucucagacaucugcuguugccagugcagagcucuagagaccauaggagguguguacuugggguauccucagaacacaguugggagcauggcauguguccauagucagugggucagccacccuaaaacugugaaucccaggugaugggccucugucuguggucucuccucaggagcaggauauugagacccuacauggcucccugcaugucacccugugugggacccccaagggcaaccguccugucauccucacguaucacgacaucggcaugaaccgugaguuugggaagcuggaaugcuuggggagggcuggcggaagucagcugcucuuacugcuuuugggacuucuuguuuccagccucagccugggaaaaccugaaacauacucugcuguuaguacuggaugcucuggggacaggaagcgagccccacugcugccuaacaaguguuacaaugacuuaaagauuaauauaugcaauggccuuugauacuguagucauucugaaaagaagccuuguuucuguucuccacugcccugaucuuccauauuccccagcccugcugaggacaccucgucuccucuaugucucuagaaugucauacaagcacaguccuccaguguguaaucccucaugauuagcucaugaccagcuuaguccauguuuucaagacugauauauguuguagcuuugucaauacuuuacuuucuugauggugaauaagacccuacugaauggaaaccacacuuggucuuccauuuuuuccucuaacacauagcauuaucagaccugucacagcaauaccucacuucuaguaccaauuucugucuuagucacuguucuacugcugggaagagacaccaugaccagggcaccucuuaccaaagaaagcauuuaauugggggcaugcuuauaguuucaaagguuuaguccauggucaaugacagaaagcauaaaucaggcaggugcuggagaaguaccugagagcuacauccugaucuggaagcaaagagagagagagacugggccuggcaugggcuuuugaaaccucaaacucugccccucagugacacaauucuuccaacaaagcuauacccaauccuucuaaucuuuucaaauagugccacucccugaugacuaagucuucaaauacaugagccuaugugugugugugugggggggggcauucuuauucaaaccaccacacuggaggauggauacucagggucuuugcacuuaccuguauuauaaacaguguugcagugaauuuucacgcaguggauuuuuaaguugaaagggaguaagccaggcuugauggcuuaugcauauccucuuagcacuugggaagccaagucaaggggauuucugugaguuggaaaucaaccuagccuacauaaguuacaggucauccagagcuacagaaaacaaacaaacaaacaaacaaacaaaagucaagugugguaguaguguugcaucccucucuaaucucagcagucauggguagugguaagaagaacaggaguucaaagacagccucaacuauauagcuagaggucuuugccucagccccuuaacaaaugggagacuuauccuaggagacacagguagauaccucuugcuuuaccuaacauacuuuuuguuugaaaauuaugugugccuugaaagaugucccagaucuuaaagccugagagacccagagaaguucaggaguggauacaucuuguacuauccccauggcaaccuuuccagagaggagacagagccagacccucagccacuucuggcacuggcugcaaauugaugauuuaagaagcuuaggggcuaguucuacacugcaccagacauuaguucuaugacucuuccuuccucuaucaccagagggaggucugguaggaaggggugaagacuuauacuauuucuuuuuaagacagagucucauuauacagugaaacuugucuagaacuccauggguauagaucaggcuggccucgaacucacagagaugcacacuuucuugggagccccucugcugcugcuacaugaagaaaaaaaaugaguguauaccuaacaucuuucucauuugccccuugguguguccugcagacaagaccugcuacaacccccucuucaacucugaggacaugcaggagaucacacaacauuuugcugucugccauguggaugccccuggccaacaggauggugccccuuccuucccagugggguaagagcagagaccuucaccccacaagcagaugaggugcauguagaggaagaaaugccagccuggguaaaacaaaauuauccaugguaaaagacuagauuugccaucucuaagcagggcacagggaugcaugccuggacccccaacacuugggaagcuugagguuagcuucaagucauagcaaaaucauauuaaauuuuuuuaaaaggaaaaggaaagaaagaaaaaagccaagacaauauaugugaauguaucauaacauuuacuuuuaaacuaguuucuuuucuauuugugugugugugugugugugugugugugugugagggagagggagagagagacagagacagagagacagagggaaagagagagugugcaugcaugcaugugaacauuuauacugugcaucucacauagucugcagcuaggggguugggcucgcugacucucauaauaucucaugcaggaggucuccuccaacacucgaugauagaacauacaggaauagcccuuucccuggguuuacgggcuuucugugguguccccaggaccauuuacagacacauguaaucuuuuauuacugaucucaguucuuaauuauuaacuuuuaucaucaaagaagagaagggacaucuggcuccucagggacagguccagguuuaaagagcuuguucaacagugggguacaguuaaccguuaaccagcugacaaaaccaggguucucuaagucacucugagacuccacuuagucugagagaugggggggaugcagaggcucuuacauguuccuaaaccuugcgccccccccccccccagagauaggugaaguguauuuguagauuaagaugugaggugugugcucccaaguuuaacuggugacuuuagggugcuuaaaauagaacacucuuggaacagaauguggcuucucccugcccucucggguagggucugugugacaccccuugucuuggggcuaucaaagcaggauuagggaucaauggcugucuucuccucuuuggagucuucuuccugcuuaggaaucagccacucucuuuuuuuuuaaaaauauccaucuccaggaagcuaacaggaaacugaagcguucauaguuaggugacuuuuucauuauuguaccugggaggcucugacuccaagcugagguaugaccacucccaaaggagucccaugucuuugccccuccuuucuccuaaaggugucuccaguuaaguaaagucacaccauccaggcuccucccagcucuuucaggguccuccacguaucgucucugucuaggguccauuucucuacugggcucugucucagcaucacuuccuuuaggaaacccuuccugaacaguugaacaaaguggauccccuugcuucuauguccuuacagccuaucacugugccuucucaguucagagcuacaguguuagggugggguaugcuuacccaguggaucugaggggugggguuguaacgucucugugugcaagggccugcugguaccugagcuuucagaauauccuguaugggcgauuuguuucucccagggucuggguucucaagaucugccuccccauauacccuacagguacauguaccccucaauggaucaguuggcugaaaugcuuccuggaguccuucaccaguuuggguaagagcaaaggacccuuuuuuccaagguugucaggaaagggcagcugcugaccuccuucucuaccuugaccugacuacuaaagugcagguuggaguucucagucaggucuggaaaggaacuugcuacagcuuguacucaccguuuccucaacuggacauugugcucuguguccugucacuguggccuugcuucuugagugacccccaaugcacauucugucccugccuccugauccuauggaacauucuggaagaguguucccugggaucuuggcuucucuuuccagacccucauucugccccugcaggcuccccuuucuuucucacuucagccucuccuuggguggaacucaaugguucuggcccaauuuguucucauuccaaguuucagaauccagaaaaaagcuuggaaguggggugaggcaacuucuuaaugggccuuccuguaaaugcuaggcgucucagagccugggcuggccacagucaggggaaaacgagcaagaggguugaggcuuucaaggccccagcuguggaccugcagggcacucagggcagccugccucucauggcaugggcaggcuugucagcauccucaagaaugacaugcaagggguggagcucucaggaguaagugaggaaaguuuauaggagugggcaggggcuccaucacaucucccuuuggcgaccuaaaucuucauuugguuuccaggcucaagagugucauuggcauggggacaggagcuggcgccuacauccugacccgcuucgcaguaaguucuuuggcaguuugugaagugacauuaaaaaugauuuaggggccggggagcuagcugagugggcaagagugugccgugcaagcauggagaguugaggacuggaguuggaaucagaacccguauaaaagacaggcauggcugcaggugccuuugaccucacuauggcagugggguggagacaggggcaucuggagaagugcauacaugcaucuguacuaacagcuuuggucuuuuuggugcugaaaugccacacuagauagggcuuuugaucacugguccuguucccugaaccagaaauguggauggcuucucacucauagagaccucugauuuuugcacuguuuuaucucugaguuuugugacccaggucaucuggaauucagaauuaagucuaaaucagagucagacaugugcuagugugacagugaccacugcuagcacugucuuuaccaguuaucuuaaagaggugcaugcccuucagcccaagguauuuugaugcuuaguaagugucgcaccuuaauggugcccaggcguaccgucaaccugggcauccgugucaccuagaugcuagcaugguuuuggaguccuaaauacauaggaauuccaggaaucgagccacaggguaucucugugcccuucucacuuaguuguggcuuggcuauugcacacugggcauucuuucuuuuucuauggcuucuuccuccugcucucuugagggccuaguccaguuuugaauggaaucucaguucugcauggacuaugcaggagccauuaacaucugcucucagguccccacaguugcuaacauagcccucaguauaugucauguugugucucugauuacagcucaacaacccugagaugguagagggucucgugcucaugaaugugaaccccugugcugaaggcuggauggacugggcugccucuaagguaagggcggacagagaagauugguggggucccagccucuacucaggguagcaccuucuugcccccacccccgccucuuuccuuacuguccaagagaguacccuuccucagcccuuuuuaggcuagcaaccauuugcugcucucaaaggucuuagagguuucgcccuggcugcugucccaaggaacccuguugauccuguugauuuuuuuuuccuaagugaggauugcuuucuuuuuuucuguaaaguccccauugucugccaaggauagggagaaauuucugauuaaagccacacaggcuaaugugacaagucucuuacugggauaguaguuuucuuaggcagcuguuggggaaaagggcaugggcuacaccuaucccuugcugucugcuagaugcuguguuucuuccuaaagucuugauauaauuugggagcccuguccaucccuguagggcagccaggaaugaagaauccugccuggcuuuuauuuuauuuuccagcugagaaagggacauuccauuuggguccacuuggcugcugguccacuguucuaagccaaacaaggaaggcuggggcacuggccuccagcugagagauaggcugugguuuuaaugaauuccccaugugaagucaagacagccugcauaucuaaggccauugguaccaaaaaugaguaucagagccuuugaugccuggugacuuacaggauccuuacuauggccugaugucacgguuuuuaauaccuucaguuaaaaacaaaagaccugagaucuagggccuucagcccccacuccaucuccagugcuccacagcugcaaguggccauugggccaguccaggaccccaggucaaguguucaucucccuugccuaucucuacccaagcagaacuaccuguguuaucugccuucuaucuauagagcaccuaggcugucugacucuucucuccgcuguugaguccuaguugcugauuucuuuccuugguucauccuccacagaucucaggauggacccaagcccugccugacaugguggugucccaccucuucggcaaggugagugguguagaccuguguccuguguccucacggagcaguuaaccaugugacacucagcacagagccacaugggcaugugguacaaaugagaugcagucaaggggugacccaggcugaagucugugaauuauugugaaguauugacuaauagccagcaagccauucauaugauuuuucuugucucucccacauugagaauuuuauacauguguacaauguuuucugaacaaauguacucugaguucuuucccuucagcucuucccagacuucccuccugacuucauguguguguuuguuuuaaauuacaaaacccugcugguacugagucugguaugagcgaguauauaggguuauccaccagagcaugaacaaccuaccuggggcacauuccuugcugaaaacugaucucccuccuccccuugagacaccuucauuagcuccucaccaggggugggguuucaugauaaacuguuuuuuguugaagcacaguguguugcauauuugaacaaaucuaccagucaucucagcaacugagaugauggaaauguccuucacccuucuccuccaugucauugcacugugagccauccucuucucguuccucccaggcacccucugcucugcuuuuuguccaucaagugacuccuguacuccucucuuugccauggcuucugucccuuagcaugauuauuuuagaaucuacucauguuuuuuuggacaccauaauagauucaguacuguguaauauuccacugaauggacauaccauugguuuccuguugaccuguguagggccuucauuuguaacaguuuggggucauuaggagugaagucugcaguguacaugucugugggaugagcucugugucugugugaggcacuaucaccaguucuuuccaaggauuagcucagggagccuguucaggaacucucugaccaugagguaaacaugacauucauuccaguccgagcugaagaaauucagaccagagguugaauggcuuggguaaggucuccaggagaccaggagaaguaugacugggauuugaacuuguaaguguaacuacaacauacagucuccuaagcugcuuccuuugccugugucuuacaugagcugaagacagaauaggcacccauguagccauguugacgcaaggccaacagccaugcgcgaggcuguccuuuuggcucacauccaaguucaaugccuggaaaaccccucgguuguccagacccagugaagcacugcuuacuggauguagcagucucugcugcugagcuaaugaacgugacaacacuugaaugcccucuugagucucagggcagcagaaaauacccugcuuugguguaacuccuuggcuuguaguugaaauggcuuagagcaaccugagguuaucaucacacaguccagacuguccccaagucccuugaggcuuugaugaugcccccaaguuauugcuguuaauucgaccagauuccucagaccacuuucccccagaaugucuuugucauggcuaaggcuccuuacuuuugauccccuaaggggcagguugcucugaggucuaccaugaagcaggagucccgaguuuagcugaggcuccugagggaaagcugguucucugguaccaguaguuaucacucagcugucuguaccagacucacucaguuaguuaccccugccucaucugugccuucccuucuuaucucuguggcuggagaauggugacaagccuucccccucucuucccucugucacuacaggaggagauacacaacaacguggagguagugcacacguaccgccagcacauccucaacgacaugaacccgagcaaccuacacuuauucaucagcgccuacaacaggugagagcccugugcaggcacagaagcugccaggucacacugggguccucaucagcuuccugcagcaaaccugggauggaagcagagagcaggacuggccgagcagcuguagguugauaggguggggcccagggaaggacaauggccgugugggagcugccucgcucuuugcacugagugagcucugcugggaucugagcucccacccagacuguggggccagaugagugggauguagcugaguggucagaguggagagcugaggagugugcccaaggcugacucacaauaaaagccccugagaguggagcugagcaaaggauagaaacauuguaaggauucagaacccuagaggcugcugggaggagaggcagcugaggguaaaggaugagguaccugagguuuccugggggagaggacuacacaaggauauuagcaucagucagaaguucuagaaccuucuagugaaaacgugugaaguaccucggccacacucccaauacagcggccagcagugagccuugcauacagaucugaccuagggcagugccuaagacuuaaccugcuggaacugaguuugcauuuguaaugaguuuagguucucugauggacucugguaccuuuuccccaguacugucagcaucucacugcaggggccccuggcauucucucugcugucugaagacgcaguuggguaccaagaagagggagauggaugggcuccugacuggacagugggaaucacaggagucccugcacagcggcuaauggaaaggggcucuuaccaaggcuauuucccaaugagggcgcaaaugcacagaaagguuuagucugcuuccacaagacacacagcuaggcaguggcaugguguggugacuuaaauccugccacgcuggcuucagucucagagcuucggaggguagagaggccagguguucacuugcagggaucagcucuacacuagacaucugcuaggcaaguggaacaccaguguaggcuucagcacacauagaagagcaggucugaguuuuagagaugacaucagagcugccgagggaaggcuucaguuagcaguggaggggugcuaggagucaauuccugagcuuuuagcaaugauagguagggacucuagcuaggggcacagggaggcagggaccuuuagugaggaccugauuuguuuuacuguagaaauaauauuaauacugauaucaaauuuugggcaaaaugaggaggguuuugcuagaaacagaugaaaaccugcugcucuuaacugcuucuauggacaccaaguagccauggggucuugaaagcugcaugaccucaugaagaugaccuguggaugguuuuuuagaauggucuauggagguuccugcaggguugguguagugggaauggcugcugggguagguuuguucaugcuaaccacgugcgaaauaucugcagccggagagaccuggagauugagcggccaaugccuggaacccacacugucacuuugcaguaaguggcuacuuucuccuauguugucuuccuggcuuuauucagggcugcuggugggggcuucugcugggugggagaaacuccaccuuaggguggagcacuacaguagagaugacuaucuaugugcuaucccagggaucugacuugaacuuuccccuuugaguagcugaagucagcaucaggaccaggauugugugaucauaucuaaagcccuuggauuaggaggcugacugccuucauauccaacaccgauggcuucccaaagccuauagauuaaaaaaaaugcaggaucugacaugagagaguccugaaugucuaguaggaaaggucacagcuaacauauuccacuggcauugauggugucuuucuaugugugucacacuguuggguaguuaagaaccuggcuuugucauuuaugccagacauuuuuucccccaucuuaauuccuagaagauuccuuuuucuccuuccuuggucagaggugcuuuggaaugaagucauuaagacacucaaucauugggcugaaaguuuauacuuauguauaaguaacugccauaccauuuuauucagaguucaaagcagaggaucauaccauagagacagaggcacagagggcucuaggaaaccuaaagagccuuuuagaauccugcuguagccugaagucugacaucuaagaaccuggagauggacccuaggcugacuccucuuccccuuucccaugcaggugcccugcucugcugguaguuggagacaacucuccugccguggaugcugugguacguaucaguucagcaggccaugggugcucaccuguaugacccuccaaaugcgaagacauuguuuaaaaugugacaucaccucggggcagagcucagaccagcuucucucuguagccacugguucucacugccuggccauccgcuuccccugcccuccugcuuuucaugggccccucgucuacauggcggaaucaaugcuaggauucauggcuagggauucuuucucagucucagccgcaggugaacguuucugcuuagaagaagagcacggcagcugcggcaggcagagcuuucugccucagucuauccuuuaguucacaccugcacugcuagggaagcucagagaggaugccuacuuucugucauucccacgucuggggagaugugugaugugaaauuguuguucagaguuaugacuaucucgcucggccucugcagugcuccauggaguugguugucccugaguuggcuccaggucacagagccagucaugauaaggccaggcuccaaagccacaugcuuuaacaaccuaaauguuucaggugguaggacagggugcaggggacucaugacauuggcugugagucgaguacuuaccuggccuuucuccuuguuuagguggaaugcaauucuaaauuggacccaacgaagaccacccugcucaagguaaugaacaggaguuggccugcaguugucaugguuucaaggacucacauauuuugagagcugagcuaugcuuauugaagcagagaacuguuuuaggagccauaaaggcagaggcaggaggaugucagcuacauggcauguucuaggcuagcccagaucguauauuaagacccugucucugaaagacaggaagggagggaaacaugaagagagagagguagggaaggaaggaagcaagcuuggaauccaucugaggcugcuaagugguccaucccagggacuagacugcaggggucuacacacuuugccuguguagcuaaaggaagagagacugggagcacaggacaaaagucuucuuuuccuaggaugaggcaaagauauccuugcaccagaugccucuggguagugagagauuguaaggccaaggaaacagccuccagcaaagucuccugacuacagugugauugcuaccuugugcuuagaggucuacaacccccgccucccccccagcaugcagucaggacuguuugcacacccaaagccaccuguguauggcagcugugucugggaugugccccaggcucgggcuccuucccgaggaucucucuucacuggguaugcucuggagguugggaucuugaaaguuccauaagccacuuuggcuuccauaauagcacaguugagucuguauguaugcucuuagggguugauauggagugaccugugggggauauugcucuguauaagcuuugagcaguaguugccaaggaagauaagggguuacagucaacagcagcacccacucaagagcagugcuaggugggugaugcuggggccagucccacagagcacagaucaccacagcuaugcccuggguguuuggugcuaaccagccucccuccuuccuagauggcagacuguggaggccuuccucagaucucucaggugagugaaauuguggcuuuuucauuuaaaaccuguuaccuucuacuggugggguguaugugccuuuggggcccggaaacucacauuuuccuacugucucugugugccaaaaugguaguuuauaaauauauucuacaugaaaugugcuuuauaaauguuguggagucacucgaucccuaucaagcagccuuuggggacuggaugaccuugagggccacaggcuuaagagauuugccagauggaccuggcuuggcuauggguucagaaucuugauugcccugcccuagccuggggccacugggagcucgagccacgagcagagggagggauagagaauauaucacaccaaaauguauguucauacacccccuccauacacacacacacauacaugcauaugcacaugagaauugagcaugugugccugugugugcacauauguacauucaugcgcaucuauaugcacauggauccagguguguggggaccugcaucuuugaaucuacacagcuuccuugcucaucuuccuccugcccauguucugcuuccuguucucuuuauuugcuugcagccaggacagaccuagccucgucuggacuauuaaacacuauguaaacaccagugggaacugagcuucaagccugauuacaauguauccccucccacaucccuucccaggcuagguguguuagcaaaagacuuucucaccucuggccacuuuguaccucaccuucuuagaggcuggaggugcuggcaucucagcucagcaucauuaggggaaacugaggcugcagagaaggauuguugccuaugguaacaguugccagugauacccagcuggcccacuuuucuuauucagaagaaguccaacuccaaaacaaaagacauccuuuuucucugcagccaacucaugucacaaaaauccuagggggcaacuuuugcauagucaaaugucacuuggguucuuugccucauugcagaugaguggcaggauugugcagggaccacacggucucugugaggagacugagccacuggguggugucuuccugaacugggaucaagggauaacacacauauaccguuggaggcaccuugucccccaguucaguuaauugaguuguguagaggagacagugacucugaaaguggccuuggcacugcccugaucacuuauccaaggauagccugguuaaccuagcuaguguuauagcuacccacccauagccauuuauuucauucaucuuuccuuguauccuuuuuucuuccauuucuucucccaccuaucuuuuuccucuucuucaacuuaguuuucaucuuccagucaaugcacaaucugaccuucuauaccuuuuccuucuuugacccuuguuccagcccuuccuucucuguuucuuucuuucccacuucccucccccuguccuucccuccaccuccaucccuucuuccuucccaccuucuucccuccuuccugccaucucuucaucucuucaucucuccaugcuucucucccucuaucccuccguuucuccaucccccucuuuuuauaguccuuucuuuuguucuuccaucucucuaucccucuguccuucccaccauuucucaucucucugucccucuguccuucccaccauuucucaucucucugucccucuguccuucccaccauuucucuacccccccaccccggccugucuuuucacuaauauuuuccaaugaccauccuuccuucuacucauucaaccuuuguaucauuaaccugacaugaaccaccucgggcacaaagguuccuggcacagaggccuccgguucauccauacaacuugcacuuauuaguuccgguccuuggguccaggcagcugccacccauuuuauucaucuaugccacccacaugcacuugggaguacugguccuggaaggcuggugucagguuuccuggagcugguugugcagagucccuagcaggccauguggcucauggccuugggcugugagcacagagugugucuucacccuauaugcaguugaggacacugucugggggacuuuugggauagcauuugaaauguaaaugaagaaaauaccuaauuuuuuaaaaaaaaagaaagaaagaaaucuuggaaguuauccaugcccuuucaacaaugaggcagguuuaagcuggucaaaacugauucugguccccacgagcauccuggguuuuucuuccacuucuaugcuuuuccuguuuacauguuguggcuccaucuugggccagagcucuagcuuacagguacaggugacccaggaugaucuauaucuccagccauugacuucacucucucucucuccuacagcccgccaagcuugcugaggccuucaaguacuuugugcagggcaugggauacagugaguauaacaucuugggcacagaaagguguuggggugguaaugucauagucagugggggcuggagagggcucugucaucuuggcuggcuucagcucuuaagcacuaggcaagucuaagaaggaguaguaacaaucacacauggcugaaugaggaauggaucagcacccaguuugguuuuugugcugcauaugucacacagcaaacuaagauggugcuagccuaucugugcagcguguucucagaggaccucaucguguguucagucugauuuuauaucuauauagauauaaauauacacauaucuauaucuauauagauauagauagaagaaguugcuucacaucugacauuuauuuagcuuuacaugagaacauuuaaaaaccauuugaugcaagaaugagacaauauuguuguuggcaaggcuggucuuugaacuccuaauaguccucuugccucagucgcccaagugcuaggauuacagacaagaagcacuauucuaggcuaggacuaucucuuuaaacaccaccauugccaacaauaacaacaaaaaaccacaaacccaacaacaaccaaaacaaugaccagcagcugaauaaggaaugccccuaauuuugaucacaugcucacucaggagaccagcaguuguagcaacgauagagaugauaacggugaugaaggauuaauaaggauuuuugucuccuuuaaccauaccaucauaauaauccuagaagggagaggcuaagcaggccgcaaagagguuugaagcugauugagccagagcucuauguaagagggagcccagagugccugagaucgaagguagggugcuuccuugauagaucacuuuuuaaaaaagaucuauuuauuuauuauauguaaguacacuguagcugucuccagacacuccagaagaaggagucagaucucacuacggaugguugugagccaccacgugguugcuggaauuugaacucaggugcuucaagaagagcagucagugcucuuuaccacugaaccaucuccccagccaucuuugcuagaucauuauaucaaggaacugaaggacugagcaccccgcuguauccugcuuuaagcuuagagugagcuugucauucaggcagucccauagaucuaggagaaaaauaaaagggagagacacagacccaaaggguggguugcugaaacagaagguuccagcucacaggcugccugccugugauccugggcuccuaagacucguccauugugugucuggugucaugggaagcugucauuuccuggugaggucaucaggacucagagauuuggguggagaaaucgagacgcaggaacaaacauaggggucacagaugugcccugacccuaccucuuucugaauuaaaaacaggcuguucugagaugguauacuucuguugucucagcauuuggaaugaagaaguggaaggauagugaauucaaggucuucccagcuacacagagaguuuaaggccagccugggauaaauggagcuuugcucaaaaccaaaaacuaauggauaaaaacaacaaccaggaagaaaaggaaagaaaggaaaaggaaggaaaggaaaggaaaggaaaggaaaggaaagaaagagggaaagaaagaaagagaaggggagagagaaaagaaggaagaaaggaagaaagggaaagucagacagacagacaaaccaggaacaacacuaauucuuuaaggagugaauuccacugagcaaggacuaauccaauuuugggugucugaucuagggcugugcuucauugggguguggcauuagucaccccaaugaguaaccuaagagauccccacaaauaaagcucuuaagcgucaagaaugcauuuuuccuacaacuucagaggcugcaaaucugaggucaagguuuggacagggcugggcucacuuuucaaggcccuuucuugccuucuggauucugcugacuacaucauaggccuucuguggcuucuggcugcauuacaccaaucucuccauccauaugggguggcucucucuuguuuucuuuuuaaugauauugggcuuuagauuagggaucauucuaauccagaaggaccuugucuuaacuaaauaucucuaaguauuccaaacaaggucauauucugaaguuucaggugagcaugaauuuggggggagcacugccacccuagauaggaggaggauugucuuguaucccauucugucagucaucugcugugguaugcgcaguuuuggucaugcuaagguuugagagcuagcaggcuuuuggaaggcagacagauggcuaacauuuccuuaggaaccauguggugagaccuuggggguuauucuugggaugugcaggaacuaaccuugcuggcuuccacauucuacugccuacugacaguacauuuaagaggagguuacacgaagucuucauuuugcaaaugaaaaugggaaggcuucaagugugaugaucugguggucaccuagcuaauaagcacauaacaaacugggggucagacccaggucauggcucaggacucuugccauguaauuguuaugugccuuucccacauauuggacuuuacuguccucuuugugagugacacagaagguagauggcucacaggaugaagacaauagagaagugguguucagcugggcucuuacgauuaacugucauggcuggcagccagggguagagucccacaccuguagaggcuuccuguauccuaaccauauuugucuucuguguucccagugccuucugccagcaugacucgccugaugcggucccgcacagccucuggcuccagugucacaucccuggagggcacccguagccgcucccauaccagcgagggcccccgaagccgcucgcacaccagugaggggucccguagccgcucccauaccagugaggaugcccgucucaacaucacccccaacucgggugccaccggaaacaaugccgggcccaaguccauggagguguccugcuaagcaaucugugcaucagucacccuggacugguggccucucccuuagcccccaacccuugccugccacccuacgcuaaugcgguauuaaucuaaagcugcuuuuguaagaaugaacucuggcgguggcagacccaggcuguucugacugccuccugggaccaggguggguggugguggaccaaaggcaagaagcaguucagcguacuguucugcuaacaaguggccugguggacccucucucuacccucagacaccaaacugccaaaacuaagaaauagauagcuguaacacugccuggcuccaagcccaggcugauccagcauucugguucauaggcguuuugccaaccugccuacuuccuguuuccuccccacuaaacucauuccuggaaacaaacuucuguuuugaaaggagagagagaggcaggaaaguugggcgccuuauuuuaaguagagaaaccaagaaaggaagagaaaaaaaggcagggucuagggcagguagaggaaaaacacaacaagucuacuaggcucacuugaaggaauugauuuuaaaguucuggacacugaaacccacaaccuguuuuucuggcaaccuuuuaacgugcaagaaaaacugguaacaaaccccaggcuuuauagagaaagugauccagcaaauguggggcaucagugauuuaagacucuugcuaugcagucuacuguaccccgcucccauuccacagugaaugaguggaugacaccucugucccucgggaagaugguuuugauuuguuguugcauucuuugaggcagagggagaacccagcaggugacagggguccuugucugggaugagucuuuaggaugggaaggguggggauagaauggcccugggauuuugaggacucaugguagggccaagugcuagaaccuggugggugugauuucauugaucuggaaucuugugugacugagucacaccuugucucccauaauugaugucuggcauugauuugaaacuugauagcugaaugucucuuaacuggcccaucgcugguucuucagagagaaccguauguucuagugggggaaggacugguuuuggguucuguacauuccacgggaacuugcuucccucuccugccccuccugcugacuggguuuguagcauuggccucuuaagcaaugccagccuaaugcccaugcuccauacuacugccuuuugauucuuacuguggcuaaccuugaaccuuuccuauaggaaaugugaucagaucagagacacuugaucguugggagucagcccucaaggccuggcgacuuccaggaucuuggaguugcuagaggaaaaguaguuaugcccuauaggcggcaugagagacaagggaucaguuuaccugccaacuccuaccguggaggaggaguuccacugaccuuguguagaaagaucaggaauccaggccagggugauugaaugcugacaagaaaucacuguauaugucucuccagggcaguuucuuaauaagauguuuguauuuauuuccagaccaauaaauuuguaacuuugcaguggc

SEQ ID NO: 7787 - RNA, 4955 nt, Mus musculus
uuuuuuuuucuuuuuuuuuuuugagacaggguuucucugugcagcacuggcuguccuggaaaucacuuuguagaccaggcuggccuagaacucagaaaucugccugccucugccucccgaguacugggauuaaaggcaugcgccaccaugcccggcuuuucaagcaacuuuuuaaaauccucuauacaugugauuccuacacacuucacacccuuuuacuaaauagacauuuucuuccaaccuuguuuuguauuuucauucugacuuguuuucccaauuaucagcuauugauuaggcuaccaaauccccaaauauuagcuuaaacagggcauauuuauucuuuaaacucugacauagaguuacuaagcuaguuuuguggcucuuauauuuuuauuaaagagagaucaugauaguaaugaccaaagcacuagcacuuuguagccaguguucaggaauggucaacgaaaugaacagauuguccuuccagugcaauuuccuagcuccagauccagauguuagacaaguagguacacaaccauuuacaaagaaagggaaaucccuucuuccagagguuaaaacacacccacauuucccccccccccccacacacacacacaaacaguacugacucuggagcaugaugauaugcagcuaugacccuugccaauggucucugggaguuuaagcacaagagcuggggugugguaugauccaagaaaaauggauugaccaagcuaaagccauggaagauauagccucauaaagagaaugaauagaguucuacaguccaggagaacuuuaaaacuuaggaaacaucaagucacuuucugauuaacagggcucuauaauaugccacauauaugggauguuuaauuauauucaugauacuuaauugaaaaaauguuauauacuguaucuugucuuuccuggguaccuuguaguccccuuuucuaguuuaagguaccuuucuguaguaauaaacuauacuggcaguguaaccauauauccaauuucuaugagccacugaccuggacagugaucuugagagaacuaauagaacuauauaaacuacuuaacuauuugaggagcaauagagaucauaugugaccugcagggcuuaaaauaucugcuaucugguuuuuguaggaguuugaacacuuggcuucuaguuggugauuuguuugggaagguuauaaaaucuuuaggagaagauagagcuauguuggaagaagugggucacuaggaguggucuaaagauguuauagcccuucccacuuccugcucacucucagcuuccugacuugaugcaguguaacuugcugcugucucaggcuccugccaccuugacuucccuaccaugauguacccucuagcuuugagcuaaauaaaaccuuaaauuguuuuguuuagguaguuuuucacaacaacaagaaaacaaaguuuucuuuuucucuaaaucaggaaguaucagggcuggccugauagcuuaauggguuaaaccuguuuauugacucuaaggacaugggucuuguaguucaaacacucagaaagauggaagagaggaccaacaccaugacuuaauggguuagacuguucguuuuaccaugcugaagaccugaguucuaaccuucaaccuucaaacaaacauuaagguggaaggagagaaccaauggcacagagaugucuucuaaucccagugguccacgucauuuacauaugcacacaaacacacagaguugaaaauacauccgaagaugaaagaagugagaacaccuugaaacaaaaagguuaguauuuaaauguagauaagucaucuucgauuagaaguuauaaggauugugcuaaaacccucagcuucugaaacuaguuuuaaggcuaaaaacaggucuugguuagugacuugcccaaggucauguguaauucuuaucuucauugaagacaccuuccuaccagaaguacuuuaguacugauagcuuaguuacuugacugcagaaacaucgaaguugaucuuuggaauggaaaaaaaaaaugaguacagcauagaaccacagaggguaaauauagaauaagggacuagaggcuacagaucucauuaggaaagggaaguagaacagguaauuauggguggaugggggucuagaauagaggagagggagaggagaagguugaaaaagaaucugggugaggguuauuauggaaacaacacagaagcuuccuaaaauauaugcaugcaugaaggugaucuaaauaaaauagccaaauaaugaccaauuaauuaucucuucucaccaaaugaaguucccaguaccaggauuggguuacaucuaguugaguugcuaacuaaagggaucccauuggacucccuaaacaaucugggcuauugccaggacaacagguuguuuucugcaaacugauagcaaggccccauuacugaagauaacacuuauauaauucauugaacauagagacagcaagcugaaguuuacacugagcauucaccccuaagucuaguaucuuugguaccggaugguacugugcauacuaccaaaagagaaacagaaauaccacauaacaaacgcuuuagucuacaauaguguacugcuugcacuaugcaagggcaguuuugacaaaaagcuugugggaauucccaaguaucugauuugauuuucagcccacuccacaggaugaacuauacuugauagugcugggugaccaagaaccagagauuuaauagcccagggaccuagaguaaaaccaaauacuauuaaaaacaaaaauagugauaaaaugacuccuaaugacauucuucgauauccaaagguaagugucuugcuuaaccaucaucagagaagccuccuccugcagcagauggaaacaaacacaguccuacagccaaagacugcagagaaugaaaaacuuuggaaaacuagcacuaaauggcaugucugucaaaaaccucucccucagagcucagggggucccugcagaagaggugggaagaguuuaagaaccagaguggauggaggauaccaagaaaacaaggcccucuaaaucaaccuagcaauccucaugguaauucucagagacuggagcagaauacacagggcuugcaugggucuagaccagucgucuugaguauauauuaugaauuccaguuuaguguuuuuaugggcuuccucaguaugcaaacaagugggucucagucuugugccuucucuugggcuguuuucuguuugccuuguccaacuccaaugugauaguuuuuauuuugucucacuuuauuucuuuauauuaacucuuaaaauccaucuuuguagugagauaggaguucaucuaaauaggggaugggaagaaaggaggaacugggaaucuauuuucaauaaaagguaaauuaaggauagauuaagcuauacauucaagagaugugaagacacuaccuaaauaggggaaaaggaaauuuacuuucuaggaauacuacaguuuuucuacuaguaguaaagaacuuaauucccuuuauuuuggcagcaagccauuacauucaccccaaauuuacaagaaaaaaauccugauuuguauuuguguguguguguguguguguguguguguguguguguguguguuaacagauaaacccaaguuuaguguccacuuguaauugaaaaacuuuuaagggcacuaaauuuuuauuauaagugucuuuuuuuguuuguuuguuuuguuuuuuuagguuuuuugguuugguuugguuugguuugguugugguuuguuguuguuguuguuguuguuguuauuuauuuauuuauuuauuuauuuauuuauuugagacaggguuucucuguauagcccuagccguccuagaacucacuuuguagaccaggcuggccucaaacucagaaacccgccugcgagugcugagauuaaaggcgugcaccaccacgcccagcuuuauuauaagugucuuaaguaaucaagaaaaugcuuuguaaauuauaauuagcucagcuuucuagaauacaaagcuuaauaauucugggaguuaguaaggaaaccaaaugggaggcagcaucccaauacuaacaacaucucaccuuuauaaaugugcugacccuggcaacauuugaucccagggcuagaaauaggaguuguugauuggagaaauuacugacacaaauuacaagagugaagauacauggaaaugacugacgauuauuccagagccuacuugaagguuggcauaauguucauuacauaauauccuuaauuuuauaaauaugccacacaggaaaauggcacauucuauagauagcaacugauacuuuuaaagccuuuuuauucuauuagguagcaugagguagcaggaagcugggguuugaaacacugggauggaauucagaggacuuggacuuuguuccucuuaaucugauuccagauuguauaauuuaaugugaguguuacauccagugcccacacuauuuuagguuuuagcauagacugaaaugcuuucaggaacucacaguuguacaggacagguuuuauuuucaaguaaccugugaaauguucucacagaagguuuuguuugcuuguuuguugauccucugauguggccuuaaaaacuuuuuucuaauuauuuauauuuguaaauuucuucuuuggguggugaucuccaaagaaaaauaaaucacaccuuugucuaaauuucccaaauaagaagaagcagauucagugacagaagacucauuuaugaacuaagacuuguuguacugggagugaggccacaggccucucaucccagcucucuggagguggaggcaaguggaucucucugaguuucugaccagccaagguuccauauugugacccuaucucaaaaauaaacuaaaaaauaaggcauuuguaacuuugauuuucuugucuuuaauaauaccuuuauaaaaguuaugcauaauuacuaucca

SEQ ID NO: 7788 - RNA, 2718 nt, Mus musculus
cagcugucuuggaguauccaccaguuaacauauugauacaugacuuaaguggcauuacaggaguauaucaccaugcccagcuaaagggcacuuauuauaaauacuguuuauauuuagguuuucaguaaauacuugcuguacuauuuaaaauagauacuuguuuaucuuaauauagaugauaccaauauuuugauucagaaguaguguaaaucuuacauaucacuguaauuuguugcuaaauagccuuaagccuagcuucagguucuauaauaauuaaggaaaguauuaauuuuccuggucuccacuucuuugucagcugaauugcauugucauaguaccugacaggauuguugaugaagugagucgaugucaguugaauguucuugacauacgguaguuaucauuauuguuacuauuuuaagauuuuuuaauccauuacccuuuucacagaccugauuggucuaacugcuacuuuuauauuuguaccaggcagacagguugaucaauguaauagaauugaagacucagaaauaaaaccacacacuuauggacacuugauauuugaaaaagaagccaaaaaauauacaguggaaaaaagaaagcaucuucaauaaaugguacuggucuaacuggcaguuaguauguagaaaaaugaaaauagauccauauuugucaccuggcacaaagcucaaguccaaguggaucaaggaccucaacauaaaaccagauucacugacucuaauagaaaagaaagugggaaagagccucaagcucauuggcacugggcuggggagguggggguggguauuuccuaaauagaacuccaauggcucagacucuaagaucaagaauuaauaaauggaacgucaugaaacuucucagcuucuguaaggcaaaggauguagucaguuaaucaaauuggcaaccuauagauugaggaaaaaaaucuucacuaacaccacaucccauagaggccuaauauccaaaauauagaaagaacucaagaagcaaaaacccaaacaaccgaaucaaaaaaugggguauagagagagcuaaacagagaauucacaacagaaaaaucucgaauggccaagaaguacuuuuaaaaauguucaaaguccuuagucaucagggaaaugcaaaucaaaugacccugagauuauuuacacuaaucauaauggcuaagaccaaaaacucaggugacagcucauguuggcaaggauguggagaaagaggaacaauccuccauugcugguggaauugcaaacugguacaaccauuuugaauaucaaucuggagguuucucagaaaauuggaaauagaucuuucugaauacccagcuauaccacucuugggcuuauacccaaaaggugccccacuauaccacaugggcacuugcuccacuauguucauagcaaccuuaucugugauagcuagaagcuggaaacaacccagaugcaccacaacugaagaauggauacagaaaaugugggucauuuacacaauugaauauuauuuagcuauuagcaaggacaucaugaguuuugcagguaaauguauagaacuagaaaauacucugacugagagaaccuagaccccaaaggacaugcaugauauguacucacuaauaaguggauauuagccaaaaaaaaguacagaauacccagaauacaauccauagagaagguuaacaagcagaagggcccaugaggacacucacuugggagggagaagaaagccaucaagggaagcaaagggagggaggagggaucuggggaggggaggggaaagggggaacaugaucagauauaggggugguagaaacaggagagaagcccugagggccagcagaauaaauggagauaugcaaccuugagggggggagugggggggggaacccucuagaaaguagcagagaccugggaggugagauacucucagaacuuaaaaggagggaccuuagaugaaauguccaacaguggggagagggaacuuguagagucuaccucuaguagaaagacagggcaucaagugaagggaugggguugccaucucacagucaaaaacucugacccagaauucuuccugucuaaaagaacugcagggacaaaaauggagaagagacugagugaaaggugguccagugaccagcccaacuugggcuccaccucaaggcgagguuccaagaccugacacuauuacugaugcuauggugugcucacagacaagagccuagcauggcuguccucugaggcccaagaagcagcugauugagacagaagcaaauacuuacccaaccaauggacugugauugaauuagggaaaggcuggaagaagcugaggagggcgacuccauaggaagacagcagucucaauuaacccagaccccugagaucucucagacacugagccaccaauaaggcagcauacaguagcuggucugaggcccccccaacccauaaagcagucgggccucagugggagaagacuggccuaaccuggagagacuugaggcuccaagaaguggggaagccuaauagggagugggguggggguguggaggaguugaggggagggacauccucuuggaguugggagaggaguaggaugaggaacuguggcaggguagaccuggagguggguagcaccuggacuguaaagaaguaaaaguaaccuugcaaauucaguauuuagcaaauuaauaaagaaaaaaccuca

SEQ ID NO: 7789 - RNA, 863 nt, Mus musculus
uggaaaccuuuuauuaauaaacuuccauagcagagacuauaauuacaggaucaguaaagauaaguccaaugguuguggccaaagaaaaugcagauuauuuaagaugaauuugcuucuuuuucaucugauucgucaucauccaucaccugcucuacaccuuccacuucuggaauauaaaacugcagcauguucgaaucccgcucuucagggugaugauggagcuggggcagcuggggcaggagcccuggagcuucagccgcacaaugccaucuucaaaggcccuguagaucacgucgcccccauccuccugcacaguuggccguauucuaguaucuaacaguucuuuaaucauugccacgacuccgucaucuuccucagagccugcuucucccggaggcggaggcgucuccucggucacuagggguaagccagaugcaaagaaguccauaauuguggcaugaaugucugguuucaguaaauuccagucuaacucuccauucuccuuugugacugugaugaaaucugggccgaagaagacgcucuucacaccuucaauucugaauaacugccuggccagaggggagcggaaagcugcagcagggguggagaaauccaugguccucgucucaagaacccgcuuuccugguauaaacuuuaagcuguugggauuuggggugucuuguguuugaauaaacauguuacacaaggaugcgcgcagcgggaaaaguggucuccguacauauuggugcagagguuguuucuuaaagguguguggagucgcuacaugacagaaccaccugcacagccgggcuacaccgaccgcugcuccccaugcccgcucggccgccgccaucacuucauuu

SEQ ID NO: 7790 - RNA, 863 nt, Mus musculus
aaaugaagugauggcggcggccgagcgggcauggggagcagcggucgguguagcccggcugugcaggugguucugucauguagcgacuccacacaccuuuaagaaacaaccucugcaccaauauguacggagaccacuuuucccgcugcgcgcauccuuguguaacauguuuauucaaacacaagacaccccaaaucccaacagcuuaaaguuuauaccaggaaagcggguucuugagacgaggaccauggauuucuccaccccugcugcagcuuuccgcuccccucuggccaggcaguuauucagaauugaaggugugaagagcgucuucuucggcccagauuucaucacagucacaaaggagaauggagaguuagacuggaauuuacugaaaccagacauucaugccacaauuauggacuucuuugcaucuggcuuaccccuagugaccgaggagacgccuccgccuccgggagaagcaggcucugaggaagaugacggagucguggcaaugauuaaagaacuguuagauacuagaauacggccaacugugcaggaggaugggggcgacgugaucuacagggccuuugaagauggcauugugcggcugaagcuccagggcuccugccccagcugccccagcuccaucaucacccugaagagcgggauucgaacaugcugcaguuuuauauuccagaaguggaagguguagagcaggugauggaugaugacgaaucagaugaaaaagaagcaaauucaucuuaaauaaucugcauuuucuuuggccacaaccauuggacuuaucuuuacugauccuguaauuauagucucugcuauggaaguuuauuaauaaaagguuucca

SEQ ID NO: 7791 - RNA, 4188 nt, Mus musculus
uccugcugugucggccuuuauugccugccuuaggaaguugcaucugggccagcugggaugcagaccgccuucaggauugcagcagcuucugggcucaggcagcacgaaggccagcggaagcuugauuuccccacagagcccagcagcagccccauugccuugauugcuucugaucaaggcaaacugagaaaagcaaagcagagacaucuguucucuucugucacuuaaagucagcaaaagcccacagucaguguggucacucgaaaccagugcaaaagcgaauuccgaauaugggaaggcagacagcacgaguaugccuggugacuucacucuacccucaguugaggggaauccacaugcugauuaauuccacugagaugcccaugugucuuaguuacaaaugcccauaagcagcauugauggacagcuacauuuaagugugacuucaagcuccaucuuugccacuuguuauguaucacaccuuugaugaauaccuuggcucaaaucaauaaacuuuuaauuagaagcugcugggaaccaucaucucucaccucaguugcuacaaagcucuccugggcuccccaggugccuucugacccucuccaucugcuccuuacaaaaucaucagaaucuuaaaauugacuccuuccucuccuccuuuguagguccuguuuuccaaaacaacaucagacaucagggauauaccauuuaauccagcaugccaagcuuccuuucaauucucugccccuggcaugauugugcccuuuuucuugguuauucuaugaccucaaccaucucauaagugccacaugagccaccuccuguccuuccaucagcauccacugcccauccugucugaauuaauuaacaauucuccagagagucgugagcccacauaccaaccugggguaguuuaacuuuuauacuggguuguuuggccaagauucugcagaaacauaaguuacagauagacauauugccaggguagaaacacaagugggaagacaaauguuauccaacagcucccaccccagcccaagaagcuuaugguggcaucugugagguucuaacaccucagcugagucagauagaauaaacaggcaucagcuacaugggaagagaaaaaagggguccagggaagggaggaauggaaaauguaggucugagcacucuaaugcuaaugggaauauauuuguagaaacaaguuucacaucugugaaauacaccaagcgaugagacaaagguggccagcccauaaagaucuggagaccuggauuugaugggcaugaggaagcuguguccaagaaaaggaacgauccacacaacaaaugugcugggaaggauggauucuggggagcagaaauugagaaacugaguaaauugaaggaagccuagauagauaacagagagagagaaagagaggggggagagagagcaagagggggcagagaguggggagagaaagagaaggaggaggggaaaaaggaggaggaggagauggaggagguggaagagcaacaagaggaagaagaagaagaagaagaagaagaagaagaagaagaagaagaagaagaagaagaagaagaagaagaagaagaggaagaagaagaagaagaaagaaaggaagaaaggaaggaaggaaggaaggaaggaagaaagaaagaaagaaagaaagaaagaagaaagaagaagaaagaagaaggaagaaggaagaaggaagaaggaaggaggaggaggcugaugggaagccaaucaaagaaauaugcagagggaaacagaaauggucagcuucgaugucacugaguggccagacacuaucagugaaucacaaaggucuaggaagacaaggcuucaggcuauccaacugcagugcacugagaagggauaagaagugaugacacaggaaauagacucagggaaaucucaacucacccaaguucuauugagcagaccaaguggugggaaaaacuuaaaagcagagccuggaaaggguaugugcaaaagagaaugaaaugguagaauuauaaauguauaguuaucuuuguaggaagcaaaagaaugaagcaaaaggucaaggaugagaagugacugauagguggugaauuacagguagaccugggucccacagaaaagagggcauggccauauugcagaaggaagaugacuuggccuggagacaaggugaacaugcagggauauuuugaggaagggcaguggaagcugacagaauccucaccuggcucucuagaugugaauuucucuaggcugcugcauucuucuuugccaaauguggaggauauauuuccaguaugaaauuaacugaaggugucauaguguucuguaauccagcaauacuucuucacaaugaccaugcaaacuguaagccuauagagcucacauaugccuggagaaagucuauauuuucacuuaacucaaggaaaugaagauuuuaugaagacaggccauacuaaucucuuuuguaaguuaaaaguuucuuuagaugagucaaaguucugucaauguucuuucucuugaaauuuuaagguucacuagcacuagucugcauagaauagauuaaaguagguugaaugucaacaaugucauggcauuugaccuaaugaacaccauugucaaccauuauuuuccuuccucaaaaaucuacacccaggcuguauuccugcuuuaaugccagauacagaaaggcauucccucugauacagccuguccuuccccaguguccuuggccaaccacuguccauuuuccauagugggcaugggcaucauuuccaccuagaaagguccuccagccaugcacccacugcucuggaacuguaguccugaagacuucaccacuugaaucaagauauauauauuaucucacgguuucuauaggucaguucaugagcccaggacauauucacacugguucacaaaacugcauuucaagucuuaacuguuuucaccgcaagccucaaagaagagggacaggaagcaaagagagaaauagaaaggaagaaagacaaagaaagagagaaggggagauaaggcaaauaaggauaaagaagugaagagguagaggaagaaagagaaugguaaagagaaaggggaggagagagauggaaggagugcucugugauaaguguucugguuugccuucaguugaugugaaaaacaccauaaccaaaaacaacuuggggaagaaaggaguuacuucagcuuacaacucccagcuuacacucugucucugagagaagucagggcaggaaccaggagucaggaacugaagcagaggucaugacagaacccugcuuacugguuugcuucccaauccuugcucagcauggcuucucauacagcccagaacuacgaccagugggcuagauccuccuacauuaaucauuaaucaagaaaaugugaggaaauuagucugaacagauaagagggugcaccacagauugggugagagucugcaccacagaagcugacagcuucugggaccugccaaagcaacacagcuucugagaaagguccuguuuugggccuucuucuuuggccaggaggagguccaaacacaagauaucugcccaccuucccuguaagagagcuugccagcagagagugcucugagcacugaaacucagaggagagaaucugucucccaggucugcugauagacgguaacagaaucaccagaagaacaaucucuaaacagagucaacuauaacaacuaacuccagagauuaccagauggcgaaagguaaauguaggaaucuuacuaacagguaccaagaccacucaccaucaucagaacccagcacucccacuucccccaguccagggcaccccaacacacccgaaaaccuagacucagauuuaaaagcauaucucaugaugaugguagaggacaucaagaaggacuuuaauaacucacuuaaagaaauacaggagaacacugcuaaagagauacaaguccuuaaagaaaaacaggaaaacacaaucaaacaggcagaaguccuuacagaaaaagaggaaaaaacauacaaacaggugauggaaaugaacaaaaccauacuagaccuuaaaaagugaaguagacacaauaaagaaaacucaaagugaggcaacacuggagauagaaacccuaggaaagaaaucuggaaccauagauucgagcaucagcgacagaau

SEQ ID NO: 7792 - RNA, 1611 nt, Mus musculus
aucaagguacaggcacuacacacaugguguuggugaagccagagccaggguaucaauugggcaacacaaugaugacaccucccuucuugaagaagccucgggccuucgggccuugcccaaaauccauggccaaauuuacagaaaggucaacauuaucagcccaggcauucaguauggcaggcauccuuacacagcacagggaagaugccauggaacagaugguccuggggaguagucugaggauugcagugucacaguaauaauaggagcccaaguguauuaccuggucacguguugagcauucuugccagauuuggugagcacgagaauggccccacugcagcaauugcaggaggccuccuuggcacuccuggcagcagcuucuguggggucgcugguaauguguaccaggcagcagaauuccucgaauaguugcaagugguagauggcagccucugccucuuuggcaaucagguguugcaugagaacagccuccagaggguagucccccuuggcuguuucuccagacagcaugaugcaguccucuucauccaggacugcauugaccacaucacugccuucagcacggguggggugaaacuucucgaucaugcucuccagcaucuguguagcacagaugacagguuucccaccuugguugcauuguccagucaucaucuucugagccaggaagaccuucucuguaggaaucucaaugcccaggucaccaugagccaccaugauuccuucacuggccuacaagaucucaucaaaccaguggacacuuucaugguucucaauuuugcugaugaucuugauguucuugcccuucucuccuaggaacuuccuaacuucaugcacguccgcugccuuguggaugaaagaugcaaacaccauguccacauccugcuccaccccaaaguucaggaccuaguuguucuuuuccgacucagcagggagguccacagcagugcugggcagauucaugcccuucuugcugcccaaggagccaccauucuccaccuccgucaccaggaagucagcaccuuucuccuucaccugcagugagaugagcccaucguccacggagaucuugcugcccaccuccaccaccuugcagauguucuuguaguccagccacaggguguucucaucacacuucuccauguaagcguuguccagggugaucuucagagugguucucuucuucagcuccaccucugcagugccucugcccuggaugaguccgguccagaucucaguucccuuuguauccagagccaccgcaacaggaugguagagaaugggaucagaugcaaagcuuucgauggcugcagggacauucuugauggucucugcaugguacucauggguuccaugagagaaauucagccaaacuacguucaucccagacuuaaucaucuccuucagcaucuccauaguucgggaagcagggucauugguacaaaugaugccaauguugcaggccgugaugggcaaagagucaauguucaggcaacacaaguguuccaggugguguuagccaugguugcauggagcugcugggucagaauaaaggcagucccugcuucacuguguggcuucugcaug

SEQ ID NO: 7793 - RNA, 1785 nt, Mus musculus
uaucuuuggaucuaugugcuuuguuucuuuuauuguuuugggggaaucacauuauugguuuuuuuuuuguguguguaugugugugcgugugguaugguacagugcaauaccuaaguuugguucuaaaagugaagcugccaaaggcuggcuagaaugcccucacggaaagggugauaaagacguggagaguuccacaggaaacgggguugaagaacucucuggccagugucacgguccaggagggugccauugugcauccugagccuuggugggaaucgaccuuuuuguccuaggguuuguggguacauuugcaugacagguccaacacagagagcaggccuuuagcggaacccugcaccagaagaggcaacaccagcgaucccugcccaacuccagagucaucugcacuccuguguguguccuguauucaucgucgcugccugcucugccuucgggagagagcaccuucacaaauggccuuagaacacaacaaccaucaagcgaauaucagauguauuuauuauguagcuuaaccugaaaaaacugaacaaacauaccuguaucaccaauguuuacacaucuuagcugucuagcucauguauaauauguaccucaugcagggacuacaucuuuuuuuuuuuuuuuuuuaauuuucuuuuuguaacaaauucaguaaacaagcuguauauauuuuacaugucuuuagaggaaaaucaccugcuaucauagcauuguaaacuaucgcacuuuucuauuuuuuuuuuuuuuuuaauuaaagucucuggcauguucccacuguguucuggcuuucuuuccuuaagcagcugaccagggcugggcacguugguggcaaggcauggaugcuuucauuuauccuguugcacagagcuuguaaagauucccguguucauauuuuggagaccaaagcagucuucucuuccuucacacaauggcagccaccugaguggccaagcacccagauucuugggccuuguauguguaccagagcuguggggccugugaacccaggcagcucaccccugucuucauuccuuucacccaaaccuuccuaaggacuccacucgacaccgucaacugcuguugucauguuuagcccuucacacaagugaauucuucccucauccccacucaucaaaggccacucccuuuccagaggcuccuguggauggacuuaaggacucuuagcuuaccucucccauucccaagcugaccccucccauggugacagaagcaacagaaauccuugcacccuauccucuaccacauucuuucuagcauagcaggcaaugcaucuucucaaggcuauuaagguuuauauuuucaccaggguugugauggucugagguaagccagagaagcacaugcagccgaugauauucccagauauauccaccacucacauagcaggggagugguucugaagaggggagagcaguuuucuauacugagggauauaagggacuaaggugaugagguagcucugggauccauaguagcaugccacugaaugaaagucacuugacauccuagcuccuguucucccucuguaccaaugggaauuccaucaucagaaauauaaggaaggggggggcauuugacagcaagguggagaguuaaauacaacuacaaacauaauaacaucaaauaaaauaugaggagaugaauaaacaauacacugguuuguagacaggaagcugaagggaagccgcagaggaaaugucagagugauuagccucauggccauaggcagccaugauggggccu

SEQ ID NO: 7794 - RNA, 2462 nt, Mus musculus
gaucuucuccaaugguugauuuguuccuuagcguaggaccuggugauauuguucucugggcacauccacugaugugcucucuuggggugagagcagggaggagucaaauucugaaggacucuccauuuuaccauaugggaguaggccauuucuaugaagaguccaccaguagaguugaaggggcuccaagcaggggcagcuccacuggcuccuucauuuucagaggaggagacugagauuuagggaagucaacauaucugaggucauguguaaagaauauaggucuucacacuuccuuuugcuguuguccuagcugcuuuguugauguuuugcacagcauuccaaagauucccuacuacuggacuuuauugugucucuggccaagacccuuuucccucuguugugcacuuggcagcuucuuuuagccaagugauuguuguacccuucccuccaguuaaccaaaccccuucaacagaccucaugccagguuguuugcagaagggauucugucccaggaacuggaggcuggcuugcuguccaguuccuggaaguuaauuugccuuguauauauauauacuuaauaagauaucugacucacuugaacucuucacuaagugaucuccaucuuuauuucaucaaggacaguaagaaguaggcaaugauauggaguaacccagagcucugggcuugcugauuucuaguguucaucccauuuggauccuuaaagguaccccaucccaggaagaaggugcugucucacccaccugccuguuagacuuugaacaucaagagaacuucucucucuggguuuugagauucucuauuagcccccaaacuggaaccagaucuauucuuccugguugccccauucagucuugaggccaaggcaauagccucuaagaccugagcccaugaugggugauugacugacagaggugcuggcuucaguauggccauagugagaugggcacaccuguauguucucuguguaccugaugaaggagauaucuggagaguagauaagcuaagacagggaauuuuuaucaauuucauucagauaugaaaacuguacagaucuugaauuccagugccaaucuaugucagcuggaauguagacggauaagggcuccucagagaucuuucuugucugugugcuuugagagaaagaaaguucagaaaaugauuacccaucacggaggcucucagcuuuaccucaauauauucuuucuaaaauaaugagcccaauucagagacucauugagugucuacagagcuaugugaucugagaugccugcuugaauguguucacucuaccagcuccuagcgucagcaucugugaguugugacuuaguucugaaaaugguagcugcauuuccuccagagucaaggucuuaucaggaccagaaggcauccuagaugaggaagagugguagggcagggacugguucuucugccuugccuuacugggcucuuggaagucauuucacuucuugagccucuguaguuuuucuuuaaucugauggucuaguuaugguggggauuuugcacaagaugaggaccuuugguuuggaugaucuggucacacaugaagauugauccaccaaaaaaaaaaaacuuagcuaaaauuguggcaggagauagagagcuggugaagaaacacaaguguugacacagagcauuggaccauggaaccaucauggguucccuaaagugcuaggcuuagauugacuuucuguggucccaucuugaccacauguugguagagguugcugcuucaggaaaaugaaaguauaugaucaugauuucccugacaccaacuuugaaaaaaaaaaaugucugaaggugacagaaaaguugauagacuagcacuaugggauuccuuagaccucucacccagagccccaaccucaguaccccccccccucaacacugagaugguuggaagauaaaguaucauggugucuacagcuuuuaggugguucagccaaagauaacauuguauaucucucaugaaaagugcauucucuuacauaguaaugguaauuauugucacaccuaagaaacuuagcauaagaauaucuaauauaauaauauaaucuguauaaagaauuccccaagugucccuaaaauguccuacugaacuuguuugugaaucuaagaugccauccaagaucacaccccacaccugcuugucuuguuguucccugaccccccuaauugagggcaucucccucacuguguuugugucucuugauaauugauauuuuugaggaccccaggcccguagucuuguagaaugccuaugaucugcugucgucugcuuguucccucggcuugaggaacugucgacaagaaaaugauguaguugauguuguuuagcccugauuuaugcauuugauguuugucucucuggggaccucugugguuacugcuuuguugugaauaaauaagacauauuaaau

SEQ ID NO: 7795 - RNA, 516 nt, Mus musculus
gaaaauuugcggcccccugcccggacugacgggucggcccggcugucccgagcgccaugucggguucuucuagcaucgccgccuugaagaaggugguccagcagcuccggcuggaggccgggcucaaccacgugaagguuucccaggcagcugcagacuugaaacaguucugucugcagaaugcucaacaugacccucugcugacuggagugucuucaaguacaaaucccuucagaccccagaaagucugcuccuuuuuguagucaucuaucuugagguuucucaaaccacuuuucaugaaccagugaauauucaagagaacuaaauuugaagucuguacaaaagcuucucuuuaacacgugccauaauacacuaucuucugcucaucaguccuuaacaucuaccucucugaauuucauggguuucugucucacaagguuuaacuauuuuauauacacuggcuguagcauacaauaaagcaucauacaaaaaaaaaaaaaaaaaaagaaagaaaau

SEQ ID NO: 7796 - RNA, 843 nt, Mus musculus
uuuucuauguaucauuauguuuuacuuaauuuuguucugguguuaugcuuuuuggaccccaauagucuguugaaagaaaaaccuaaaaaguuaguauccuuguuuucuccccccugcaguaugugguucuaaaggucaccccccccccccauuaggaaucucccccaagcacacccgaggaaaaggguacgacgggcgcuucucagcgggccgugccauugagaucuuuuauauucaugcugcuucuagucccuucuccacaucaccuaaggguggguaccuccauugcgauguuguggcaucuuaacuuuuacacacagaccucauggguguccacugaggaaguaguaugagccuaaagacacuggcagcgugcagccuggccugggaguggcggccuucgcaucucucucucucucagcacucagccacgcugaccuggccgggugguccgcguggacaggacagcuggugaagcaagccggaugcucagaacacugcgcgucuccuguccuguuuuaagcuuagcuggguccuuuguuuucacagcuuccuagguuaaauaguuugcacuauuuuugcaauaaauucaugggaaaccuaauggcuacuuauguuguuguucuuacuguguguauaaacuaacacuaaagguuugcuauaguguuuucuuuucaccuccuuauguagccccauaacaugcacagaaugcuguaaaccugauuaagauaugauguggauauuuuauaaaguuauuuuguauggugucgauuuuguuuugccgcauagugugucagcaaaaaauaaaauaaaauaaaauuccucguauuuacagcugccuau

SEQ ID NO: 7797 - RNA, 813 nt, Mus musculus
cucgacaacucaaagcguuuuauuauaccugaguaaauuacagcucccagguauguagugguuggugguucuguguucaccuuucacugccuguccugcuugcucguuggcuuguggucgaagaucaaaaugacaccauuaaaaaugaaaguuccccgcuucugguuucauuuccuaccgcaaggaugccagugauuuuuuuccuuuuuuuuuuucagagaucacaaaucagucaccacuuccugcuuaagacucuccguaggguugcugcacaaaaacaaacucagggaaacuaggcacggcucggaaggacagggccaccugcuugauucaggcaaagguguccccccagucucacguuucgugguaaguuccgcgcuggaacuggcucuuaagccagcagccauccacaguggcucucccguucuggcccuccuguccacccaguguccccgaaaggcuuccccagucuuaagaucuacaggggcugcgggaaggggcuggaaugugaguggccccaggcacuccuaaacgaucuuucggaccgucuucagagauccauuaaaauacucucugugccucaguuuccccaucuacagaaagcccaugaaccucuauugaagcggugaagccuggagaagaucagggccggcgugugugcggcuaaggaucuccugugaccgugagggacccaggccuaguccgcagacccuggggcggccacaggggccaccucgucaucccggaacagcgcuauccgcggacgacgccacgcccgcacagcugggauacacuuuacuaggagccgggcgc

SEQ ID NO: 7798 - RNA, 1465 nt, Mus musculus
aauuaagugcucacuagaaacagucuggaggaaguuuccucuacucaauaaggcugcacagaguagaaagaccugugacucaugucaccucccgaacuucaugcugaguacccaccaccugccugcuacucaggauaucccugugcuagacacagugaagaaaacaggcugagggaggcugcgucuggcucccgcucucacagccauugcaguacauugagcuccauagagacagcgccggggcaagcgcgagccggacgggcacugggcgacucugugccucgcggaggaaaaucaacuaaacaugggcaaaggagauccuaagaagccgagaggcaaaauguccucauaugcauucuuugugcaaacuugccgggaggagcacaagaagaagcacccggaugcuucugucaacuucucagaguucuccaagaagugcucagagagguggaagaccaugucugcuaaagaaaaggggaaauuugaagauauggcaaaggcugacaaggcucguuaugaaagagaaaugaaaaccuacaucccccccaaaggggagaccaaaaagaaguucaaggaccccaaugcacccaagaggccuccuucggccuucuucuuguucuguucugaguaccgccccaaaaucaaaggcgagcauccuggcuuauccauuggugauguugcaaagaaacuaggagagauguggaacaacacugcagcagaugacaagcagcccuaugagaagaaagcugccaagcugaaggagaaguaugagaaggauauugcugccuacagagcuaaaggaaaaccugaugcagcgaaaaaggggguggucaaggcugaaaagagcaagaaaaagaaggaagaggaagaugaugaggaggaugaagaggaugaggaagaggaggaagaagaggaagacgaagaugaagaagaagaugaugaugaugaauaaguugguucuagcgcaguuuuuuuuucuugucuauaaagcauuuaaccccccuguacacaacucacuccuuuuaaagaaaaaaauugaaauguaaggcuguguaagauuuguuuuuaaacuguacagugucuuuuuuguauaguuaacacacuaccgaaugugucuuuagauagcccuguccuggugguauuuucaauagccacuaaccuugccugguacagccuggggguuguaaauuggcauggaaauuuaaagcagguucuuguuggugcacagcacaaauuaguuauauauggggacaguaguuugguuuuuuguuuuuuuuuuucuuuugguuuucuuuuuggguuuuauuuuuuucaucuucaguugucucugaugcagcuuauacgaagauaauuguuguucuguuaacugaauaccacucuguaauugcaaaaaaaaaauugcggcuguuuuguugacauucugaaugcuucuaaguaaauacaauuuuuuuuauuaaaaaaaaaa

SEQ ID NO: 7799 - RNA, 3499 nt, Mus musculus
auaaguuucauaguuuuauuaacaaaaucauauauagauauauaucugucuuugagguaagaugguaugggcagacagccuggcuggauauucaaggcuuggugaaaauaggggauagccacacucucuugagaucuccagggucucccuaguccccagggccuaccuacacacccuaugccagccaaaugaguaugggucauggcuuuugugcaaaaauaaacuugugggggcuggcaggggcacaggguggaggaucugucagaacaucaguggaauuggucucagaacaccaauagaccaggcagauggaggaaccgcaacaaggccuacucagacugcagacacaagcagcuaccagcacaagguaauuggagcuggggcuuggcugagguuucagcugggcaaucaccaggcaggucagggagguucauggaacagccuaggagccaaggccuggggucuccugggacugggcuugaccuggcaggcagggcacagcaggaaagaucaggcugggcaggggcccaagccuuaaggcuccugcaagggucuggucggggagccaaaggccaugcagcgagcugggcucugugccaagaggaccaaggguacagacccugcucaagcugcagaggcuaauggcaggcagcuagugagcggccagcggggcgggcaucauggcagacccgugguuucaugcuggcuugucuucaccuucagcucuugggcugagcuggggugcugcccccugccaggcaccuccucucuguaaucuuguuuucucugccuugaaagugucuuggaacccauguaggcagcuucaggagaagagaggauggugcuggugcuggugguguggugaugcccuuuccagacauggcagcaaagacuucucagcagccuugagaccugaaggacacaggaagcagcaagauggugagagaacugcucaccacuagauccaggagggacaccagguuacccugcucccagcugguaccccuggggccugucaggacuucccggauaacccagaaaucuggagaguggcugggaucugaggcuuggucaggauaggaggcaagacuuucuuaccuggugucauucuccuggcucuguaggcuccagccgcugccucggcugggugugaggacucagccccucggggacccuccgccugccauggcugagucacggagcugagcucugcucuucuucacugguaugaaucacugcuggggugagaaaucacaggguccucggugagcuggcuuagcaaauucccccagaaccgcccccaccucagccccguccuuggaccgugaagugccagugcccacuacaaugacacccacucugaugccacuucacuccacccuugcaacuaauuugcuagggaagccuugaagggcuccuggaaaguggacuugguucugcacgccccccccccccacucuaagauacacggugcagggcucaccugggggccaggaggugccaggaugucaggucugcugcuucagcugcauuuguggcuucagcucaccccugggaggggagcuaugcugcccaagacuggccgguugcccugggcggcagcuaggguaccagcuggaucugcugugucugcaggagugggcugcauccccggaaguugagguucccucagcaucucugcuuuagcaucugcccuaggauguccccuggguuuuggugccuacuuuuuguugccuuucagacacuugguuucuugauuacccaaagagcccuggacacuggagcagaaugaggaagccagaucguguucugugauggucugagaguguagagggugaggccaauggggcugggggccaggaccagggcagacagaugagggguaggcggcaggugggagcccuaugggaaaggggcuucuugauguucaguccauguagcaugguuguguggcaguugugagucaggccaggucagugggugaguagaugucuggcuggacagggcaucccuuugggagucagccccagcucaaguccuaguuggcaaaagccacaggcuggguguggcaggcgggcuggggacccugggcuggccccucuauucaggcuggguccugucacuggcuacugacucgcugguaagagcaggugugagugccuccgucucauccucugugggcaguggggugccagaaggcucagcugccugcuccaggccguccugcacuuccauaccccucuggauaagcugcuccagggucuuggggaguggguggcgcagaaagcgcuugaguuugggcugcagggugcccaccacauacugaaugaucuccuccuccucagcguccacauacagugucugguacaggucccgcuugcgccagaggaacuggucgagugguucacccugcuucugcggcagcuccagcucccgcugaauggcuucacgggagaguguacccucacuguauugcagaaacuccuucuugaacuccacccaguucuucaccgagcccugcuugaacucccaccacuucuuggcuggcccauucaugugguucuggaucugggacagccaauauucuucagagccacccaccugccgcagguacucuuccagguggcucaggaacucccguggguccucgaagaucuguguauccacaccagggcucgguugcccauccucaccuggcccccaagacugauauugcugagccucaacugacuccuguucaggcaguucuccugcggcagguggcggggugauggcauaggggcuaacgguauagucauagccaucagcuuccuggcaguagggcucuggaccccccacaccuacagagacaguguggcgggccggcucgcugcccacuggguauuugccgcccauggacuccaggcggucagcccaccucuccagacgguagaagaccucccuccacacgugcaucucacgcuugacccagcgcuccagguuggcgauggucuccuggcagcggcaaagacaggccuugauggacuucuuccagcgcugugagucgccggugggcacguagccguccaaguuguucuccagcuugcccaccgaccugugcaacccuuucagcucucgcuccaccugcuuggacacuucggucaacagaugccgguggguccuccguacguguuccagcaucucagcucggcacuuaccaaucugcaggaucacauuggguuuggcggccggcccaccccgcggggcaggguaggcguggaggccgccgguggucauaugguccagcuccaucuggucgucggugcugcggcuccgaacaggcuaagaacuccucugaggcagaagccggaagggagcagagccggcggcugcagcggcaguggcaggugugcggugccggaggagcuuagcgaguguggcaggcucgucgccgcugaagcuagagaggcccagagacugcggcugcgggagaacucgcuugagcucugcaccgaaaccg

SEQ ID NO: 7800 - RNA, 3499 nt, Mus musculus
cgguuucggugcagagcucaagcgaguucucccgcagccgcagucucugggccucucuagcuucagcggcgacgagccugccacacucgcuaagcuccuccggcaccgcacaccugccacugccgcugcagccgccggcucugcucccuuccggcuucugccucagaggaguucuuagccuguucggagccgcagcaccgacgaccagauggagcuggaccauaugaccaccggcggccuccacgccuacccugccccgcggggugggccggccgccaaacccaaugugauccugcagauugguaagugccgagcugagaugcuggaacacguacggaggacccaccggcaucuguugaccgaaguguccaagcagguggagcgagagcugaaaggguugcacaggucggugggcaagcuggagaacaacuuggacggcuacgugcccaccggcgacucacagcgcuggaagaaguccaucaaggccugucuuugccgcugccaggagaccaucgccaaccuggagcgcugggucaagcgugagaugcacguguggagggaggucuucuaccgucuggagaggugggcugaccgccuggaguccaugggcggcaaauacccagugggcagcgagccggcccgccacacugucucuguaggugugggggguccagagcccuacugccaggaagcugauggcuaugacuauaccguuagccccuaugccaucaccccgccaccugccgcaggagaacugccugaacaggagucaguugaggcucagcaauaucagucuugggggccaggugaggaugggcaaccgagcccugguguggauacacagaucuucgaggacccacgggaguuccugagccaccuggaagaguaccugcggcagguggguggcucugaagaauauuggcugucccagauccagaaccacaugaaugggccagccaagaaguggugggaguucaagcagggcucggugaagaacuggguggaguucaagaaggaguuucugcaauacagugaggguacacucucccgugaagccauucagcgggagcuggagcugccgcagaagcagggugaaccacucgaccaguuccucuggcgcaagcgggaccuguaccagacacuguauguggacgcugaggaggaggagaucauucaguauguggugggcacccugcagcccaaacucaagcgcuuucugcgccacccacuccccaagacccuggagcagcuuauccagagggguauggaagugcaggacggccuggagcaggcagcugagccuucuggcaccccacugcccacagaggaugagacggaggcacucacaccugcucuuaccagcgagucaguagccagugacaggacccagccugaauagaggggccagcccaggguccccagcccgccugccacacccagccuguggcuuuugccaacuaggacuugagcuggggcugacucccaaagggaugcccuguccagccagacaucuacucacccacugaccuggccugacucacaacugccacacaaccaugcuacauggacugaacaucaagaagccccuuucccauagggcucccaccugccgccuaccccucaucugucugcccugguccuggcccccagccccauuggccucacccucuacacucucagaccaucacagaacacgaucuggcuuccucauucugcuccaguguccagggcucuuuggguaaucaagaaaccaagugucugaaaggcaacaaaaaguaggcaccaaaacccaggggacauccuagggcagaugcuaaagcagagaugcugagggaaccucaacuuccggggaugcagcccacuccugcagacacagcagauccagcugguacccuagcugccgcccagggcaaccggccagucuugggcagcauagcuccccucccaggggugagcugaagccacaaaugcagcugaagcagcagaccugacauccuggcaccuccuggcccccaggugagcccugcaccguguaucuuagaguggggggggggggcgugcagaaccaaguccacuuuccaggagcccuucaaggcuucccuagcaaauuaguugcaaggguggagugaaguggcaucagagugggugucauuguagugggcacuggcacuucacgguccaaggacggggcugaggugggggcgguucugggggaauuugcuaagccagcucaccgaggacccugugauuucucaccccagcagugauucauaccagugaagaagagcagagcucagcuccgugacucagccauggcaggcggaggguccccgaggggcugaguccucacacccagccgaggcagcggcuggagccuacagagccaggagaaugacaccagguaagaaagucuugccuccuauccugaccaagccucagaucccagccacucuccagauuucuggguuauccgggaaguccugacaggccccagggguaccagcugggagcaggguaaccuggugucccuccuggaucuaguggugagcaguucucucaccaucuugcugcuuccuguguccuucaggucucaaggcugcugagaagucuuugcugccaugucuggaaagggcaucaccacaccaccagcaccagcaccauccucucuucuccugaagcugccuacauggguuccaagacacuuucaaggcagagaaaacaagauuacagagaggaggugccuggcagggggcagcaccccagcucagcccaagagcugaaggugaagacaagccagcaugaaaccacgggucugccaugaugcccgccccgcuggccgcucacuagcugccugccauuagccucugcagcuugagcagggucuguacccuugguccucuuggcacagagcccagcucgcugcauggccuuuggcuccccgaccagacccuugcaggagccuuaaggcuugggccccugcccagccugaucuuuccugcugugcccugccugccaggucaagcccagucccaggagaccccaggccuuggcuccuaggcuguuccaugaaccucccugaccugccuggugauugcccagcugaaaccucagccaagccccagcuccaauuaccuugugcugguagcugcuugugucugcagucugaguaggccuuguugcgguuccuccaucugccuggucuauugguguucugagaccaauuccacugauguucugacagauccuccacccugugccccugccagcccccacaaguuuauuuuugcacaaaagccaugacccauacucauuuggcuggcauaggguguguagguaggcccuggggacuagggagacccuggagaucucaagagaguguggcuauccccuauuuucaccaagccuugaauauccagccaggcugucugcccauaccaucuuaccucaaagacagauauauaucuauauaugauuuuguuaauaaaacuaugaaacuuau

SEQ ID NO: 7801 - RNA, 2239 nt, Mus musculus
guucucuccacuuacucagcagguauuuauuacacgacuguuguauccuggagcucuauaaacggagagcaugucccccaccaggcaucaucuccugggacuccuggugccucacacccaccucccagcuccauuucugcucaguccaucccaucucagccucuaccaggccccuccccaagugcugcugugcacacuggcucaggcccuggagaguaggguggcgagggaguccuucagcugaagcaucugagcagaacuugguagggcacagugcugaugggguggggugggccaagcgcuagcuguggaaauagcagcagagaggagaaagggcccugguggaagggguuggggugagggaggccagcccuaugugggaguuaagaguggugguggugguugcuccuguguggggguggggguggaggugcagcucaucccuucacaaucgggcuaugguagggcucucccagagccuacagacggcuggagccccacagcaacaggcugcagagcacggucagcagccccagggugguggguggcuucagggugugggccccguugacauugcacaggucagaguagcagcacgugauguucuucuugcccaaauaguaguucuccgagucauccucacacugugagcugcagcccuuacugauaacugucacgaguccaauggccccugggaagagagagugacacuugggauuaaagccagguccugauagccaccucucugccccuggcucagggccccuuccggaacaugcuaaacuucuggacccacuccacaaagaccagaaaugguuggugaaugggugagcaaagcuuugaugucuggcuggaguggggagggaggccgcccgguggggcagcaggcagugaggaccggggauggggcagcagagcacuggggguggggggcggcagagcacucacggaugcgcgauguaaagcaacugugcugguccaggcugcaguucuguacauucagacagucucuguuguucaucugugcugugcaugaauagcacugcagagcagcaccugugggugaggcaagaggccugaggcucagaggcuggccagcugcaccucaagagagacggaccaggccuucccaucuccaacacagaguggagagagacagcccaguccccuccagacugcugaagcauagaggagacuaaaacccaaaacucucagauacccuuuacggagggcucugugccagccuacuccgcuuuggucacccaaaacccacacuuugcucuguuauucacuguucaggaacuuaaaguaccugugaucccugagagggacaaggggccuagugacaggucacacagggaaaaagccccgccgggcacuaggcuggagggacauacgacuucuucaugcuacuuggcucugagggccaccuguccucugagcccagcuugucucuuaggcuuccuacgccuccacuaugcuguggggccccuggggaaguccugcuccgugccugggacaaguagcuucagaugucagggcaugugggucaccuucucuuuucaaaagcuggcaaagcuguccuuaaagucacaucuguaggaauaggugcuuacaucugacuucaguggcuacaagcuuuguucugcuuaggucuccaggggccuuggggacauucuucuuuuucuuucucugcaacuggaagcugaggcucuaggagucuagugaccuuucuggacuuacuugauaggagggcucagcacacuaguucaucacagacugcccacccccaguggacucucacacuggaggcaaaaguagcuggggauggaccagugagacccuuuccaagacauccugaggacccuguccugcuacguuccucccccucccucugugacacuucucagcuuaagccauuugucuccugggcuucccugacuaaggcccuguagccuugugugucugucccuuggcagccucuccuuccugaagcccuucagucccuccuagccugccucucacaggacccuaguaagaguccacaccgcaaaggggcuuugguguccccagucuucucucuccccuucccucuccuaaucugucuaccccuuggacauuucuccaucacuccuuucugagcccugucccguggcugucugaagcuuaccuggaugcagggcuaaguagguggccagcaggagaaagaagacggucuucaugguugcagugagcaccu

SEQ ID NO: 7802 - RNA, 3184 nt, Mus musculus
aagaguuggugcgcuccaguccucggagcucccaggcuucagggccggccggcagcaggcaaccugcgcagcgggcuccuggacaccaggugcccgcugccaagaugcuggagcuguugguggcgucguuaucccuggcgcucgccuucuuugcgcugcuggacggcugguaccuggugcgcgugccgugugcuguucugcgcgcacgcuugcugcagccgcggguccgcgacuuauuggcggagcagcgguaugccggccgggugcugccaucggaccuggaccugcugcuacacaugaacaacgcgcgcuaccugcgcgaggcggauguggcgcgcgcugcgcaccugacccgcugcggugugcugggggcgcugcgcgaccugaacgcgcacacggugcuggccgccucgugcgcgcgcuaucgccgcucgcugcgccuguuugagccguucgagguacacacgcgacugcaaggcugggacgaccgcgccuucuaccuggaggcgcguuuugucagccuucgcgaugguuucgugugcgccuugcugcguuuccgacagcacgugcugggcaccucgccggaucgaguaguacagcacuugugcaaacggagggugagcagccccaccccgaugccccggcccuguuuggcucucagcccucucccgcgagaaaaaccccuuugaaguucugggacuguuccaaugucggaacacuuuugcacguuuccucuguguccaaggaguugcccuucuugggguccccaucaucuaugaaccaaggcuuuuccguucaggccuagccaguuuugaauuuacucccaagcacagaguuucuccucucucccucucuucuagaacugagaugcucagaguagguaucucagcuaggagucugaguccuaguucuguguguucuacagugcugagucacccucuguggucuuugguuuugaguaugggauaaaaggaugucaguuagaagcaguugcugggaauucuaguggacucgaggcccucuuuggcgcagcuugcagcagagaggacuggggguuggauugaccccaggggaccacaagccuugagucuuuccaagguuggaaggaggagaacccugugccugcugggacacaaggccccuccccaggguccacuccucuagcacgguggcagagcuagcuacugcaguauagcaacugugaccuuggagacagccagaguagugaugguugccaaggcaggcuccugaagaguaccagggcaugccccacccuauuguucccgccugucuuggacaagugccuccucuuagaguauaggaaugaccuuacaucagugcugaggggcuauaucugaagggaaacacgggcucgagaaguccucccagcaauugguggcagagaaggcucucccucgcuuucucucuuuaucuagucaugaguucccaugggcuguuugguacugguugauaaagugccuguaaggggugaggggacuggaggugcagccccagcuagcaguaacagcuuggaggaggcgaacugaagcacccuggcaacucagcucagcuggaggccagggggguuggcugggaguuuccaugguuacuugggucccaggcagaggcagauaugguacaagacaggccaagucugggguaggguucuguaagcugaggaacuguucugaggccaggugccaggauggggugucucugacaguaaagugugcccagauagagccuagacuauaggucagucauuccuggcugccguguagcacuugcugugagaagagagcaccuuaucgagccucuucccucacccucaguccucagaaccuaucugcaaggacuccggggcagcagcuuugucagguagucuccugcaggagcaccuccccacauccugcucuucucuaggcagcuggugguggucagucacccagccaaccucauaggcuuuugccugauucuggggacagacacuugaagcguggucccgcuggugagggccuggcagaaguagaugggcuagaaagagcuaggaaggagaaaauagguuagaagggcuugggagagcacugggucagaugucauuaauuugggugugguuccugcaaggucacagaguaggggaugcgauaaagcaggagguccagaggcagaagggcagcagccuggcugcuugccccuuuucugugccuucugcuuagcgcucacaguggcaccgggcucucugaaaccucaacuuccugucucccugcagguggagcccccugagcugccagaagacuugaaacauuggaucuccuacaaugagaccagcagccagcugcuccgugcugagagcggccucagugacagaaaggaccagugacugccacaucugcauccucccugccccgccugucagccaguccguuccaugggaaugggcugccuggggugggugcacuccuaaccagaauggccucagacaagccuggcuucuuuuacccgcuugacacuccccugugcuugccucauuuuugggcagcuggugggguggauguuguuguccuggcccggcucugccuccuggguccccauagcgagacuguucuagugugcccagaugcacaggguccuggagcacaagggccagcagaacccaaagucagggcugcuuguggccaagcaggccagaguagucauggguguggcuggggccugcagcuuacucagggacagugggccaucuggagggucaccucauagcagggaagcaagaccagaaccaacccaagggcccccgagaacacagaagggcaagugggugcuggucauuggcuaagauucuggugauacccaccacucuuaagaggauauacccuguucuaggcuggucgccaugacgucuggggcuccaugacuaugccuagcaccuguccugucagcucagggagaggccagcugcuugaagcuaggaacggccuccuugcucccucucugggaaccacaccuggagccagagcccaaagcuucagugaugcccugcaccccccccccccgcacccuccucacccccauccccacccccaccuccaccuccacgcugcuaugcuugccuuagugcugucaaggggaaagcugcaacccguuuuauuuaaagaaagcacaagauuaaaagaguucucaaggc

SEQ ID NO: 7803 - RNA, 4575 nt, Mus musculus
uggagcccccugagcugccagaagacuugaaacauuggaucuccuacaaugagaccagcagccagcugcuccgugcugagagcggccucagugacagaaaggaccagugacugccacaucugcauccucccugccccgccugucagccaguccguuccaugggaaugggcugccuggggugggugcacuccuaaccagaauggccucagacaagccuggcuucuuuuacccgcuugacacuccccugugcuugccucauuuuugggcagcuggugggguggauguuguuguccuggcccggcucugccuccuggguccccauagcgagacuguucuagugugcccagaugcacaggguccuggagcacaagggccagcagaacccaaagucagggcugcuuguggccaagcaggccagaguagucauggguguggcuggggccugcagcuuacucagggacagugggccaucuggagggucaccucauagcagggaagcaagaccagaaccaacccaagggcccccgagaacacagaagggcaagugggugcuggucauuggcuaagauucuggugauacccaccacucuuaagaggauauacccuguucuaggcuggucgccaugacgucuggggcuccaugacuaugccuagcaccuguccugucagcucagggagaggccagcugcuugaagcuaggaacggccuccuugcucccucucugggaaccacaccuggagccagagcccaaagcuucagugaugcccugcaccccccccccccgcacccuccucacccccauccccacccccaccuccaccuccacgcugcuaugcuugccuuagugcugucaaggggaaagcugcaacccguuuuauuuaaagaaagcacaagauuaaaagaguucucaaggcgcgugugccggggagguucuccuuuucgcagcccugccaccccggcacagaccgaccagcucccuggaugugucuucuggaggaacauggauugacauagugugcccaggcuugugggcgccucugcacuuagggcuaagccugaugagucaugggauugaggccaagagugagcagcuggcuagagccccagcuggccuuccuaccauggucccccuccuuguccacccgccaccuggagccuaugaaccuugccacccaagucacgugcaccuggccugucuuuucuguugccuuccuuagagucccaggagggcccuaggaaagugggguucaggcaacauggggcucuuuguccccuuuguggccagggagacugaggucccguggacuuggagcagauguuuuaugggggugggggagaucugugcucuacccagcaccaguccauaggucugagggccugggugggggaaggggucagggggugagggcacucagauucggucaaggguggagaaguugcacaguuagccaauagugugcagcugggaagaccugucccauaccucugcccuuccuaccuccuaccuaacccuugcccuaaaccauaggcacauggguagguacucagugucuuacuuucagggccuuuggaaaaggguuuuuccuuuucaggguuuaguagagcagcaggcuagaaaugggcaguauuaaagggccagggguaaucuggaggguggggguccuuaggaggcuuggguggcucauagcagguguugagugcugccagacagucccacugggacuccagauagaaaguggugggagcaagguggagcuucugggucugacugagcaucugccuccagaccuggaggaguacacugccuggacauagaauucccugcuuaauaaucuagauguguacguaaggucaaccacggggcaagggcuuuugcgguucucuguuggcacuggggaccagguagcugagccuugcuuauugcucuuaugggccagccccucaggugccaagccacagcucuccugccuccccauggacucgggccaggcgugacuggguucucacugagucccaccucuuugucucugaagaggccggagacaguaccccagcugcuccacuagggggugauagcuguuuggucucuacagugaaccaguagcccuggccucuugccuccaaauccugaguucaacgaggcucucugaaauucacagugcaggggaauggccccgagaggggaccuuugaguauagaauuggcccuagaugugguccuagcuggugaggcuuagagggccagguuggcagcacaggggguuguggggaagaggugcuucacacaccucucagggauccugagguauccugcaccauccuugucacucccccccuacccuugcagucuguugggcaacccgcuagcaauccugauugccagugggacucagggccauggccuccuaacugggagaauccaggaagugcuccgugauacugcguuagugccuagggccauuaaggccccacagcugccacacaccucacagagggaagaacacuguggaagggacagcggggaaacuacacugggaaagggaaacaguggccaaagggcaaaggcuccuggguccugaaaagcuugagcucccagcuggagagucggccccugagugugcuguucgauccacccucugccuucagcccuggccacuacccugggaagcaguacgaguccagcauggcauugggucuguagauaaggggacguuggccacagucucauuugauuccucagcugucucaggggaaugggcaggccauuguaagaggggcgguguguggcagauuuguagagauggacacccuagggcaccucucuacuaggguagagaggcugcuggacuuuguguaucucccucuguuguauuccuagcaggucuggauggaccacccagucacagaagcaguuggauuuagguuucauggggagaaugcuggggaaggguuuccggggcuuaggaaccugccauggauugagaugggcuagugugcaggaagggugacccagggggccuugcucccucuagguuucugucucuucaucugacauaugaauugaaaaaaacaaaaacuugcaugaaagugagggucaggggccuggaagugccagaauacagccugucuucccugcaggcuagcacuucagguucccagugcccaacaagaacagagaggccccuucgcccuugguuuauuuuauuuuccacaagcuugguggacagugagugaccugaggcucagugagcucugcucauagauccaggcauguagagacgacugcaggcagcaccgggcccugccgggagaguggauagagaaggaacgaggaggcucccuguguggcuagaggccugccacgaagccuggaaacccugaguugcagaggucacggaagcaacagaagacaggaugggcaacgccaaugccaucagggucgguggccagacacgagcuggagcaggagcgggucaccaugggacugugguugaaggggaacgcugcagggugggcagacagcagagccccaagucacugcaguuccuuucugccucugcacacccuucccauggugugcugccuucucaaaccccuccugcaaccugcaucuuaaaucugcccaacccccacccagccacagcacauauucacguuggcaccagccucuguggagcauccacacuaccugguccugagugggggcucuagccuaagccacauuuaacauaccugugcagagccagggucuaagccaacugcugccuucuacccauccccacuccccauagcccugaugccacugucuuagugcagguacuugaggggcuauacaucugugggcaccaucuauaagauaugauaccaucagcaccaccacacgcgcgcacacacacacaccauuccugcccccucugccuucuuggcugagcaaaacagugguggacgaaagggaacauggagggacaagguaagccugacaccagguggaacccccagcccuggccugaacccagccuuaccugcuuccacugucuccaguacagucuuacaggcugugucuuccaucuugcacugagcaauauucuugcaugaguuaauggccgugggcugcucacagguauagcaucggaaggccucaccuagcaaggguuaggggucacagucucaccaccucgcuccaggggucccuauuggagccagguaggugagagagaaagugaccuccugagagucuuccgagacccagauguccaagacaagugacaacaccacauccugcauccguaucuuccucccuggagaacagaucaugaccaagacuucugucccagaagcauguuggaaucuaagacccaggaagcuuaccaaggguccagaggaugccuuggccacaaagauaccucucucccauuaagagaugggauaaaccgaguucuacagcagagcugccccugagagccucacuccaagucacucaccauagcccaugcuccaggcugccaagagcagcagccacauggcccagcgaagggucauucuucagugcucaggagcuaggagcccuggcuggccu

SEQ ID NO: 7804 - RNA, 3926 nt, Mus musculus
gugacccagguaguuuuuauugggagauuuguugacacugaggguaacccgcagauuggaucuuaagcuuguaucacaguggauuuacacaggacuucauucagaaccucccaaagaagugugaguuggggugggggcuuugggauagccaagcuggagugaucuccaaggaccaggccuaaccaaggggcauggcauuguucuguggagccagcugggaguggaggaguguggucagucccuguugcagagauuggacuggcagcaggcgauggauacaugaggaccuaagcccaagcuggagacaucaggacagccacuguagcacaucuucgucaccagaggcagaucuguaaagcugaugggagaaccugggggauaagagagaaaccauggugcuuccugaagaucugagcugcccaaaccucuaucauaucagccauuguacugagggcuaucuccaaggacugaaagacccggccuggucccuauccuaggcagaggcugccagacacauuccuacuguauucuugaucugcugagcucugggcucugccugcccagugagccagcucucuguucaagaaggguguguccagcccaucccucucaucacacucacggguggcaaugaugacacaguggguggagcuccaugggcagcuagacgggcgagagcauccuccaaaucccuugcacagguggcauugcaggcccuguguuacagcuacagacagaagaagacagagacagccggugagcaacuccugcagaggaugccaccugcucugguacccagcgcucagcuucuauccucaagcuggucccauagcucugcagcccggccucccucgaggggccuugcaccucgagagagaccuuggaagaaaggcuaagggaaacccugaugcucagccuaccacugugugagaggcaguaaucauuggagccagcuggucuguguuccagcccagaguaccaagggcuggauggagcagagguggaccuccugcggaagaggagaagagguuccagcuccugaagaccagggauggggaucugggacuuuagccaugcccuccuuuaccuccaaguaccugagaaaaaaguaguucuagcccugggguucucuguucuaugguuuaagauaaugggaccuuuauccaguuagcaaggaaucuggggcaaggccaggcagauggagggugggagccuucugaguuccaccggccauuuuccuggcaaauccuagaucacaggucuugcauccagcccagggacccccagucaggccagugaguggccuaccuugcucucucuugcuuucucuggauucccuuuccugucuccuugccucucccugucuucucugcagccuucucccucucucuuucuuaaguuuucuuccuuggauuccaaagucccaaauuccaugcccagaccuggguauucuccaugaucagucaagcuacugcacacgggcucuguacaaguccugagcugacacaccaaauagggaagcuccuaggggaagucccauccuaccugggccaccaaggagugucugggacaagaagcuggcuccugccuggggcuccuacuacagccacaccucuaccagcccucacauguaaguuugcugguccauucuggcuagucucagagguuuucauccuauguacuauagagcagguggacagauagcaagucccuaccacagcaagguccccacaguuugccuugacuguuuacuaggccuuauaaaacagccauagcugagacccugcaaggggcacaaaaagguagcaacagaagccaagaagucuguagcuguccucuguauguuaaagacacuaaacagacugaacauggguucccugcacagcgaaaagcauagacagcagcugauugaggggcaagugguugggacaccaaaagggacaggcaaggugcuggggagaauuggacuggcaucaacuuccauuucucuuccuucccaugccuccuagcuuugcccaggcucacccuuccaucauccauauggcagaaucaagccccgucucacaggccaucuccucccggggagccucucagcuauggcauagagauccuccuuugauacagccaucacgagcugaccuuguuauguuuguacucaaggcugucucccuacucuuauucacuaggguucugggggugaauggggaucccuucccacuucccaaugccccccaagcauccguuacacuggauccugcuucaccaaugaggcucaagagauguucaaagaauaaaggaucgaaugagcucuaggacagggacaggagcugggucaugaagggaaagaauagcugucccucuuggggucuuugugucaucaaggaagccaggaagguuuagcucucagaaggaaauuggcucugggaacagugguaggaucauaggaacagacccucagguagacacuugccuagagagagaggguuuuggagaagguaagagggacaauagaacaagccucaagacagcagacuccacuggguccaaucccacugcaguguugccaagggauaguugacucucucccuggucuuauuuucucacccugggaucagcuuaggauggaaucuccccuucucaggcuauguugagcccugagucuacggcauuacccauggguggcagaacaggcacacagcaaagauguaggacguggacuacgcagagagagacugacucccucugacguugaaguggccaggcuugaggcuuuugucucgagggguggguaugaaggaagagccugggaggucccuguguagagacuugccucaggcucacagaugcuccugagauacuagagccuuagcucagaugaagauggcaacuggcccauggcugagcccucccucugaaaccucagcccugacagagacaaaugucucuaaaccuugugcucagggccaucaaaguggagauggacuguguugaaggcccugggcagcaauuagguggucagcaguucagacuuccucaggucagagaguccccauuaggcccaguucaagaauagugaaaucgagccagagauguacacauggaccuccuaucccacagcucagguggaccccaaaugcuggagcauucccacccaugauggaaaccaagaguuugcuaggugaggcuucugggagcugaggcuggcugaaucuggagcacccuuugcugauggcaacuguuucuuugcucaggcauugaucgggguuggauauaggaaccacuuggacuccauuaaaggauggcaaggccaggaauaggaaaugauaucuguggcugucccugggaggccaucagcaggcacuggcgucaaggcacccauuacaggagcuagcuagccuggaggguacagaaguucgagggaacugaaugucaacuagaugaaaucgcccugggaagguggaacagacagaaucuaaacaaggagguaagagcgugucaggagagaguuguggcugcagaagacagaccagcuggggcccuggggcuggaggggggcaaaguagcagaggugugccgggcuugugaguguggaagguuguugcuauggagucggggauaccuaggguuggguuucaaacugagaagcaugaagcuugaguguugugggguucagagaagagaguuuagagaucuaugaaagccagcagcagaagacagaggcuuguagauagggaggguuuuggggucuaggauggggagaggaaaaaggaaagagguaccccaaagggucagcaguggcccaggcuggaaggacacagcuaaguaggggcaguagggaaggcauccauauuccugacucaccuagcuccaugcucaagaccacggccagaaggaaccagaagggaagccucauguucuccgcgucg

SEQ ID NO: 7805 - RNA, 5364 nt, Mus musculus
cucggaaccuggaagaagggaaccaagacggagucagagccucugcaggaagugcacuaaaagaccguuggagccugacggguuacagagaagcucagaaccccaaaggaaguacacuaagcgaguuaaaacucugaaggagaggugccaaaggaacacaaaggcaggccccaagauacaguuagaacccugagguagguauaccgagagauaucuuaagagaaagucucaaaagaaacgccagggaaagaaggucggagcccauaggcaagguugaaaaagaagaaugugaaccuugaggguagggagcuaguuaccuugaaggagggguaucaaagagagggauggagccuugaggggggcagcaagagagaucaggggagcacuaaggaagaggcaccaagaaaguuggauccccaagggaggagcuccagaaaagguuuuagguacucaaggggcaucaaaaagaguuggagcccuacaguaagggcuccaaaagagguuuagaggucugagguagggcaggguggggagggagggagaaacagaggggggaagggagagagagagagagagagagagagagagagagagagagagagagagagagagagagagagagagagagagggagaggcagcacuguguucagaggcccgaggaaagggcaccagaaaauggucagagguggucagaaccuaggagcagagguccaauagaagguagccuuacagcagagguaucaagaugaggcccugaggaaggagcaccaagagagugcagggcaugaaggguggcaacaaucuagauugagagcccugcaggaggaaugccuggugagaacuuucaguauugggugaaucacucagagugauggucagagucgugagugaggagaauccuucuccagagcuugaagccugaaggaaggaggguagguagagagaggcccuguaugggggacaaucaucaggauggucuccagaaggaggauguugcccaucuuccucaggaagggccuucuagaacguuccugugaguacagaugagcccaguggggccagcagcugagaggugcuaucagagauugagugacuagccuggaacauuccagaagaguacauuagauuccaguuaagcaaccagguuccagauaugagaucauaagcuccaguccaguagggcagcuccaugaggaacacucaggggagucagggggaugagucaggaucagagaagcaggaaguugagggaagguuucuaacaagggcaugguaagcaaauccaguguuagggaagggaggacagguugggaggggaggauguggacuauguccaugggagcgagaaggucuagaaggggaaagcuggcagggccaucaggacaguuccagcaauggaagcaagaucugcauaugcagcagagcaguaaggaauaggcuaugaccugaagcuccugugguaggagcacguguacuggcugucuaggcagaggccauggccagagaugacuccucaguacauugaugcuggggacauggaccuggagcaaggagccuuaccucacugagggaguauaggucucuucacuuucagguucaacgaucuguuggaaaugaugcuccccuucuucuugucaauucucaugggucucccauggguggauaccucuaucaacaauaccaguggauugguauucgacaacacuacugguggcuuggacaaugccauugagccuagauguaaguaugaucugaagaaucuagugugucagaugaaaggagauuccacguagaguggacuaggguuauaagaaggcuuguuuggaguuaggcucaccaaaaacaagugguaugagucuuguuguguaaacuugggacuccaggauauuccugauuuucagcaggguugagugaaccaaaggcucccacagagaacugcugaccaggagaccugagggaacaucuggccauagcccuucccgggcagggacagcaggugcagagugcauaggagcccuguaggauuguggugucuuaggggagucaccauuccacagacagagagacuucuuugaagacgucagcguuuucacaugugacuguccuuucagaacaaggaaggguccaugaugggccugcugcuauccuuggagcuggccuggcccugccuuagacuaugccagaaugugagcucugcaguuauggcuuguguagagaacuacacuggagagcagccgugaggggaugcgggugagugaguggguguaugauggcgaaagggauucuugggguaaaaguccaacacuauuuucuuuuucugcagggacuccucagaugagaugccauucaugccaggagcauaacaccuucuauuguccacauauccacuauugugacauggauaucagacgcuguuugacaguugccauacguaaguaucuguauuuuggucacuuagagugaauaaaccugcccauacaaucguagugaccaggaucaguauagacauucucucuggacccagauccaccacucuucugguagcuccuggaacugagagccaguuuacaggcccugguuucagcccacugcuuagauagugugccucauggcaccaagagccugugguuggugguaggcugacugucaacacacucuggauguccagggaaugagacuacuguggcccuuucuaggccuuuaucccugagugucucuccaugcauauggacagacauucugguucagcuuuugugaaucuuugcauguguguugauuccuggucuugugcagucacauccugaaguagugacuuuuuuuuuugcccugauuaaacagcaugcccaggacaacuuccaaaauaaggcauuucauugggcuuauguuuucagagggcuagagucuguuaugguggaaggaaggcaugguggcagaaacagcugagagcucacaacuaguuuggcaagcaggagacagagcuaacuuggaaaggugcuaggcuuuugaaaucucaaagccuguucccaagugacaaaccaauaaggccacaccuccuagugcuucccaaacaguucuccccaggguggguaauggggugggguggugugagguggaggaaaccagauauuccaacaauggaagcuauggggaccauucucauucaaaacaccacacaccacagcuagccugguucaagcacugcguggccuugcuuccucagggugacuccuggcuucugagauggcaaagcuguggcuggaucagggcacacacacaggcaaaaucaauauuaauuacaugagcaguggucuuuuuggagguuucaggagggguugcaaugaagauguaacuacuguuaguauauguacaucaaguaacaugcaaugcaaauagucccugggcuggggaauguccacggaaagggccaguauuucuuaaucacagaucaccuggcaguucugaaguucccauuuucaacgccuccugcccguggugucuaggugccacaccacagagucuaaacucauuauggcucuagaucaaggauggaaggaguuugucuggaaaggagcagauagcaucggucuuagugcuugugccucugucugggaggaaguaggccuagauagcauguugcugauuuguccaaggguggucuguuuccagggauagaugauggauuggauuuccuccuccccuggcuuuacuuugcucacaucuggaacagaugaagucugauaccaccauuuacaaauggaaauccccauaugagcccaccaagagagaaaugggcaaaugcacaugcuucccacauguucauggaacugaugguccucauauauggagcuauguggagucauuucugcauggcacuacaacuguacuguaaauuguugugugggaaggaacugucggcucccugucaggagagaaccagucuaggcagcccaguagacaaggaagccacucugggagaaggaaacauuuggaguugggugauuugucaagagaggacuuaucaaagugaguagagagcccagauagcugaaguccaacugucaauaaccacagaguuuaugugugggaggaggcuacuugguuuaugaucacaagacccuucugaggucuggcagcagacacgacucagggcuguggaugguaaaguaguuggguagauuccacaguagacgcacuaaauuauggaugccgucuagaaggggaacaagcaacagcaacagcagcaggagcagcagaagcaggaacagaaacagcagcagcagcuguaacagcagcagcaggaacagcagcaacagcaagaagaacaaggccucaaaccuucagcccagaggucccagcgggguguggucagugugcucaugucagacaacucuaguggacuaaaguuaguggagauguugaucuuguucucuaugaagccuuucuuggaaagggccauauaaucugcuguggaaaaugugucaguuaucagggagccccgugcuuuauacacagguccaaagcuugggaugccagguagagggguugggaaggaguucacucuggaguugugaauauggacacuccugugaagccucuauggagucucuguuucauucuagacuugggcacagagccaaaacucagucagauauuucauuugcauaucuguguuucgugagucuaagaagucaacuggggagggacagugucagaugugaagaagguagcaugcauagaaagaaagcuaaguguauauaaugguacggagcaguugggccaucuugguuaguagcauguuucugucaggcauucuugacagugucugggauggagcuaguugugugguuuacuguaguguuggguuuaugacgaaacucugaaggugcuaauucuccuaauggcuuccuuuguaggugugaaccuucggcugcucuaugucuacaagcacugcaccaaggacugcacauuuauuuauagaaggcaugugccuccagaacucccuagggugcuuaaagaugucaagagcuucuacuuugucuugugcugugggagugucguuugcaaugagggaggacccagaaauauggagagggacuuguuaggugaaacuuccauagaggaagagguaauugcuagagcugugagucuggggugggucaaccuucuccuuugucuugccuugauccucuccagcaucauacugaccugauaaccccccucuggguguacucaucuucccacaguugaaagcaccuauguacuuuguugcuuccuugugaagcagagacagugucaagagcaccuuuugggcccauucaucauuucuuguaggaaagaaauaaaggcaucguuugucaaaaau

SEQ ID NO: 7806 - RNA, 4858 nt, Mus musculus
ugaccuccuucccgaggaauuucuguccugccgccucauccccaaaagagggauggcccagacgggcucagcccagagggaccugacaaccugaagggcgggugaugaggcauccuugguccaggacuuccucagccuuacagcagcagagauucccaugagcguuucaggaugcagucuguccccucacuccuuccggaagcaagcuaagccugcgcacaggucuuaguaucggugauugccagaagcccuggccuuuccacccucccuaggucuguccugaaagguaagguagacaugcuacaccagaagccacgccagggcucugaugccacauugugugcgguggggcacuuagggcggucucagccaggcuucuggguaccaccggggaccgccgccgugggcgcauagcuugggaccccugucguagucucagaggagcaguugugcagccaagccaagggcacagccggaguugccagaggccagcagccagggucguucuccccaccagccagagacccgcccacagcccaugaaacgccccgccugcagcccgcccccgccaucugugcuccgcuccgccugcuugggugcauucagccuuuggugauccuccaggaccuaagguuucgguauuaucuucggggccucuucacccggaggugagucugcugagcccgaccucagguguucacucgucacgcgagggccuggccacggcggggaagcacugggagagagcgggaggccuugaccgcagcguguaggaucuggggucccggcgcucugcucccgggugcagagugguuggagcaugcgaggcccucugcagcgugcucuguuccuaccaucaccccacccccaccccaguccuuccugcacguuucuggagaggcaaaggccccugcugagccuucacuggguaccccuaucucgacuccacuugucugcuugggaucuccaaagggggauacacccucguaaacuagagcaggaggcugggggguggggguagggguagggucugaccaguuagauugaggcuggacccuccccagagugaggagcgggaagcucuuugucuuauccaggauuuugcauaucaaugcugagguucuggugauuaaguagggucccuggcuagcggggguaaccugaacaaccuuccuccgcuggccgcuagccaauagacaccuggcuuccgcggaugagcccuuugaguuuguggagguguuccucagguccccagggcccugccccguugccugcagauguguggacagacaaaacauuggacucguuuuccaaccacuucaccccuuccuucgcuaguccuccgguggacgaugggaugccucauugacuuguuuguggcugugcaugccagagcuuccuagcagacagcucagggcuccaucguuccuaaaucccacuguguaacgaaaaaaaaaaaaacaaaaacaacaacaacaacaacaacaaaaacaaaaccagaaaugaggacaggcccagcugggcuuggcacugaacuuggccaccuggagcuuuggcuacccacuacaagaugucagcaagucucaggauagaagaggccuaaggccaguccuggaagauaccaaaacuucaccuccucuauaccccguuccucuaggagaacuguaagccaccuuugucucugggacgccccucucccacucaacagauggcaccagucaucuuccuccucaagaggccagugguauucaaaauaggauauugaaaccaagcaagcugguccucuccucuacccuaugccaaagacuucugcccaaagggcccagaaaagucccauagccaucuggcuggcuagugugcugacugcuacaggugucaguguccccagcgagcagguaguggaguggaggugucuucuuguggaaauggguccugagccucuaccuuguacagaaaggaauuagugaagcccagaggccuccagcccgugucucugccacaagagagaggggguggggguggggcuguauuugguucccagggcucagggaagguuuucgguucaugcaugcucauuuaucugaccacugucuuaaccccaggacaaccacuuaacuguccacuuccauaucagaguucuugguuccccuuuacuucgucuauggagccccugaguuugggaagggguauuaacugaaagguaccauuagaugaacuuggagaaagauuuguaggugccacgggagauuucagguaaaagcucuuuuaauaauuggcuacaauagcagcaggaggaggccaggaauucugagguagagauuugauuagcagcacguggagcaaaggagacuucugacuccuacagguuucagaaaguggggagaggcucucagaugaauggcuuggacugugagguaaguguuaguguagcacgagacuagcuuaaggcuguacaaauuguccgucugauuggugcauugggccagguagacacuagauaagcaauugggccuuaacucgaguugucuuaauggcuacccccagggcagcagggagucaauacugcucuccugucuggggccugaaugcugaaaccaucuacaaaggggacauaaggcauauuggggagguguagagugggccaggcccagggucugcugguaucuaugccaggauccugaguggugguggcguagccugucuuuuaaccaacugccucucucacaguaggcuucuuuggcuugcgaaccuucagcagaugucugccacuuccaacaugagagucuuccugccugugcuguuggcagcccuucugggcauggagcaagguauggagcucugagauaacccugcagccugguccuccuccugaucucucauucuuucuccugaguagaugcccagggcuccuccugagccagcccuccuaggaacgucuggccuucccaccuccuacucucuagccaacugaccuaguuccccugaugcugugcuggcccagcuacaccuuugucaccucguguugacuuuagccacuccaguaccaaagucugaagucaguugucauuggcuggcuuuuuucccugacccagggcugagcaugcuguugcuucuugucaguggguuggggaucaagggccccacuggaaagucaccuuacccuggaaggcuuccccaggcaauaggcaggugucaccuacagcauugucccuuuugcaguucauucccugaugugcuucucauguaccgaucagaagaacaauauaaacugccuguggccaguuucaugccaggagaaagaccauuacuguaucacguuaucugccgcugcgggcuuuggugaguagcugccuguuucccuagccagggccagggaccugcggggcuuuccccauuuccugcuacccugucugucuguccccucauccucacuuuccaugcagggaaugucaaccuuggcuacacccugaacaagggcugcuccccgaucugccccagugaaaaugucaaucucaaucucgguguggcguccgugaacagcuacugcugccaaagcuccuucugcaacuucagcgcagcuggccucggacuucgugccaguaucccacuacugggccuuggacuccugcuuagcuuguuggcucugcugcagcugagccccugaccaucccccauguguucuccauauccccccagcucaggaaaagcccagcuccuuuuaggucccaggggacccuaggaaccuucagcuccuccugggugugucuaguucccccuccacacucucucaacgucagggcuaaguaccaaacucacccauaccugcucuguugaagugguacuggcuacccuugcuuccagagccaauccuauaaccucccuuggggaaccagcgaaggggugaagaucuccuuggagucucaagaguaccagagucagcgccgaaucuuguggacacacugacaaggaugucuaauccaaauagauguauaucugugugcucaguguaucccugugugaaugaagccacuuggauucuggggugggcaaagaagaccugaaaagauucuacagcagaaggccugugucgccaccaaaaccccucccccugguaucauuguacccaccuuguacucuguucaggaggcugcccauggaggacugccaccccuccagaugaaggcucccacuacccgaugcaguugagucccauccugcccucucugcccacacuggcuuccugcugcuauucuagugccucaaauaaaccguucacacccuuuccugcuauguccugguuguccuuaacccgucuucccccuccgguccaaagggaccuggggauccugcaggcccacagcccugcuuaagcgauucugaaagaccaaccccgauacagugauacauuccuaugaugccaucauagcagaagcagaggucucugggaggccagccuggugcauagcaaaucccaggaaucuaggcccauuuagugagacaggccugagagaaaagagagagagcaaaggcagagagaacuugaaagugugcugucucaggcugaaagcugagaaguacagcuacccauaaaggcaggcccaucaggcuggucacacauucccaagcuuugucugccccagagacuucagaggccugcuguugccacuuguccuucauaaacuacccuguagucuaagccaugggagucuggcccaggcaagugauacuuguccacccuauaacuggcuuugcuuugcuuucugguauuuuaagacggucucgcuauguuaagacuagcugccccaaacccagagcaauccucuuugagugcuggaauuaaaggcaugcaccaccacac

SEQ ID NO: 7807 - RNA, 4858 nt, Mus musculus
gugugguggugcaugccuuuaauuccagcacucaaagaggauugcucuggguuuggggcagcuagucuuaacauagcgagaccgucuuaaaauaccagaaagcaaagcaaagccaguuauaggguggacaaguaucacuugccugggccagacucccauggcuuagacuacaggguaguuuaugaaggacaaguggcaacagcaggccucugaagucucuggggcagacaaagcuugggaaugugugaccagccugaugggccugccuuuauggguagcuguacuucucagcuuucagccugagacagcacacuuucaaguucucucugccuuugcucucucucuuuucucucaggccugucucacuaaaugggccuagauuccugggauuugcuaugcaccaggcuggccucccagagaccucugcuucugcuaugauggcaucauaggaauguaucacuguaucgggguuggucuuucagaaucgcuuaagcagggcugugggccugcaggauccccaggucccuuuggaccggagggggaagacggguuaaggacaaccaggacauagcaggaaagggugugaacgguuuauuugaggcacuagaauagcagcaggaagccagugugggcagagagggcaggaugggacucaacugcaucggguagugggagccuucaucuggagggguggcaguccuccaugggcagccuccugaacagaguacaagguggguacaaugauaccagggggagggguuuugguggcgacacaggccuucugcuguagaaucuuuucaggucuucuuugcccaccccagaauccaaguggcuucauucacacagggauacacugagcacacagauauacaucuauuuggauuagacauccuugucaguguguccacaagauucggcgcugacucugguacucuugagacuccaaggagaucuucaccccuucgcugguuccccaagggagguuauaggauuggcucuggaagcaaggguagccaguaccacuucaacagagcagguaugggugaguuugguacuuagcccugacguugagagaguguggagggggaacuagacacacccaggaggagcugaagguuccuaggguccccugggaccuaaaaggagcugggcuuuuccugagcuggggggauauggagaacacaugggggauggucaggggcucagcugcagcagagccaacaagcuaagcaggaguccaaggcccaguagugggauacuggcacgaaguccgaggccagcugcgcugaaguugcagaaggagcuuuggcagcaguagcuguucacggacgccacaccgagauugagauugacauuuucacuggggcagaucggggagcagcccuuguucaggguguagccaagguugacauucccugcauggaaagugaggaugaggggacagacagacaggguagcaggaaauggggaaagccccgcaggucccuggcccuggcuagggaaacaggcagcuacucaccaaagcccgcagcggcagauaacgugauacaguaauggucuuucuccuggcaugaaacuggccacaggcaguuuauauuguucuucugaucgguacaugagaagcacaucagggaaugaacugcaaaagggacaaugcuguaggugacaccugccuauugccuggggaagccuuccaggguaaggugacuuuccaguggggcccuugauccccaacccacugacaagaagcaacagcaugcucagcccugggucagggaaaaaagccagccaaugacaacugacuucagacuuugguacuggaguggcuaaagucaacacgaggugacaaagguguagcugggccagcacagcaucaggggaacuaggucaguuggcuagagaguaggaggugggaaggccagacguuccuaggagggcuggcucaggaggagcccugggcaucuacucaggagaaagaaugagagaucaggaggaggaccaggcugcaggguuaucucagagcuccauaccuugcuccaugcccagaagggcugccaacagcacaggcaggaagacucucauguuggaaguggcagacaucugcugaagguucgcaagccaaagaagccuacugugagagaggcaguugguuaaaagacaggcuacgccaccaccacucaggauccuggcauagauaccagcagacccugggccuggcccacucuacaccuccccaauaugccuuauguccccuuuguagaugguuucagcauucaggccccagacaggagagcaguauugacucccugcugcccuggggguagccauuaagacaacucgaguuaaggcccaauugcuuaucuagugucuaccuggcccaaugcaccaaucagacggacaauuuguacagccuuaagcuagucucgugcuacacuaacacuuaccucacaguccaagccauucaucugagagccucuccccacuuucugaaaccuguaggagucagaagucuccuuugcuccacgugcugcuaaucaaaucucuaccucagaauuccuggccuccuccugcugcuauuguagccaauuauuaaaagagcuuuuaccugaaaucucccguggcaccuacaaaucuuucuccaaguucaucuaaugguaccuuucaguuaauaccccuucccaaacucaggggcuccauagacgaaguaaaggggaaccaagaacucugauauggaaguggacaguuaagugguuguccugggguuaagacaguggucagauaaaugagcaugcaugaaccgaaaaccuucccugagcccugggaaccaaauacagccccacccccacccccucucucuuguggcagagacacgggcuggaggccucugggcuucacuaauuccuuucuguacaagguagaggcucaggacccauuuccacaagaagacaccuccacuccacuaccugcucgcuggggacacugacaccuguagcagucagcacacuagccagccagauggcuaugggacuuuucugggcccuuugggcagaagucuuuggcauaggguagaggagaggaccagcuugcuugguuucaauauccuauuuugaauaccacuggccucuugaggaggaagaugacuggugccaucuguugagugggagaggggcgucccagagacaaagguggcuuacaguucuccuagaggaacgggguauagaggaggugaaguuuugguaucuuccaggacuggccuuaggccucuucuauccugagacuugcugacaucuuguaguggguagccaaagcuccagguggccaaguucagugccaagcccagcugggccuguccucauuucugguuuuguuuuuguuguuguuguuguuguuguuuuuguuuuuuuuuuuuucguuacacagugggauuuaggaacgauggagcccugagcugucugcuaggaagcucuggcaugcacagccacaaacaagucaaugaggcaucccaucguccaccggaggacuagcgaaggaaggggugaagugguuggaaaacgaguccaauguuuugucuguccacacaucugcaggcaacggggcagggcccuggggaccugaggaacaccuccacaaacucaaagggcucauccgcggaagccaggugucuauuggcuagcggccagcggaggaagguuguucagguuacccccgcuagccagggacccuacuuaaucaccagaaccucagcauugauaugcaaaauccuggauaagacaaagagcuucccgcuccucacucuggggaggguccagccucaaucuaacuggucagacccuaccccuacccccaccccccagccuccugcucuaguuuacgaggguguaucccccuuuggagaucccaagcagacaaguggagucgagauagggguacccagugaaggcucagcaggggccuuugccucuccagaaacgugcaggaaggacugggguggggguggggugaugguaggaacagagcacgcugcagagggccucgcaugcuccaaccacucugcacccgggagcagagcgccgggaccccagauccuacacgcugcggucaaggccucccgcucucucccagugcuuccccgccguggccaggcccucgcgugacgagugaacaccugaggucgggcucagcagacucaccuccgggugaagaggccccgaagauaauaccgaaaccuuagguccuggaggaucaccaaaggcugaaugcacccaagcaggcggagcggagcacagauggcgggggcgggcugcaggcggggcguuucaugggcugugggcgggucucuggcugguggggagaacgacccuggcugcuggccucuggcaacuccggcugugcccuuggcuuggcugcacaacugcuccucugagacuacgacaggggucccaagcuaugcgcccacggcggcgguccccggugguacccagaagccuggcugagaccgcccuaagugccccaccgcacacaauguggcaucagagcccuggcguggcuucugguguagcaugucuaccuuaccuuucaggacagaccuagggaggguggaaaggccagggcuucuggcaaucaccgauacuaagaccugugcgcaggcuuagcuugcuuccggaaggagugaggggacagacugcauccugaaacgcucaugggaaucucugcugcuguaaggcugaggaaguccuggaccaaggaugccucaucacccgcccuucagguugucaggucccucugggcugagcccgucugggccaucccucuuuuggggaugaggcggcaggacagaaauuccucgggaaggagguca

SEQ ID NO: 7808 - RNA, 3899 nt, Mus musculus
ucaggaugccagcugagaggagcuaagagaaaguaaaguacuuauuucaguccacuucugacagaccuuuccacuguaccugcagccaggucugagaggaaguaaggacuggugugaggagggagcugcuaggugacaaagggaagaacccucaggauagggcuguggugggagugagauuaggaaggaagagcugggugggugguggaugagagaaguaggcagacauguauuccucagggaaagcuguguagaggguuggagggagggaauauuggauggcugagccgugugagagcccaggggugugaucaggggucuauuaacuggcuccaacuuccaagguuuuaucugugcagcccuucuccaaggauggacacuucucacgcgauaaaguccugugugcugauccuucuugugacccuacugugugcagaaagagguaagaugcaaaaugagagaggggcagaaggguacaauggcuauggaaaugggccucaggguuguggguacaccugcaccuccauugugugcauggugacugaggugugcuggggucaugggauuggaaauugguuuguggugggugaagccuccugugcugggaugcuuuacugggucuguaauccugccagugccugccuugcaaccaucaccauauaccagaaggacacugggagcucaguaucucuuccacagacccuggccaccagagcagccugcccuuagacucuacacugcuacccuggucucccagacaugacacuggccugugggcacacaaaguggcagaggcuucuuuccugauccagcugccaagucaagggguuugcaauccuuaacucucggcauuugacuuuuucuuaugcccagcccaugccacaugaggccccagugcuagaacuucccuauuuaaagaggucugagcucucagacacaccuauacuucuaguuacaucuguguugugggaaaccacauggagagcuucagcuuugagcuagacucugggaaguucauugcucugucaugugccauuucccagggggucagcucugcagguuuggggugggacaggucagaacaguccuccccaucucguaaccccaguaccuacuuacacacccacucaccgcuucagcagacauuugguauccaugucuucccuauauggugacugccucucuaauaccucuuggggugcaggucucuccugugggacuggcuaguugagacagcaguagcgagcauauucaaacaaugguggcucuugguucacuuuugcuuuugguugaagugacugcuuuuggucaguaauguccuugcucugaccuagcagccagcggcuguguggaaguaaagacauuggagaggaugggucugggcuaggaauugcauguacuagcccucauguguuggcuugucucucagcucagggacuggaguguuaccagugcuauggagucccauuugagacuucuugcccaucauuuaccugccccuacccugauggauucuguguugcucaggaggaagaauuuauugcaaguaaguucccugugaccuauauaaagauggcugagggugacuuuggacaaaaugucauaucuggguauuuguuauugaucaugguugcccucccuccaaauagagcuuuccugggcuuggagugggacuccugcaauguggggaauguuggaguccagggaugugcugggauguggaucauaaagcuuggcuaccauuggcaugcaugguguucaucaucccccucuguugccaguguacucaugugauguuucugcucguacuuuaugucuagggucucacugguucacugacagaccaggauagcaggaaacaucuagugagucuuugcauauaauaaaggaaucuggaguuucagcuaaaggaaugacguaggaauguugauugaaagagaccuuaagacauaucagaucugccaaaauguuagauuccagguauaugcucagauagacaaggcaggagcaguccugcuaugcuguccaguuuccugcucugaccacagccugccugucuccuggaguaggucuccuagauauaacugucuggggaacugcaagugucugagaggcugguugcccuuucugcugugccacugggcaaucuuacacuaugcugugucuuuguguguguguguguguguguguguguguguguguguuucuauaaaugugggugcucauguaugaauuacauaauguaauauagagcucagaggacauccuaauguaccauucuucaggcaaugucuacuuguuuuauacaaauuagucuugauucuccuggaacuggaauuuuguaugguuguaauuaaaucacccugugcgguauggaggccaaacccugggcuucuauaagagcaacaagugcuguuaacugcugagccaugucuccagucccaaccaccuuguuuauugagacaagaucuuucacugggaccuaggauuugccaaguaugcugggaaccaguggagaggagagagguagcagagaguucccaggaccuccugauuccccaccccuccagcacagagaucaugaccaguccucccaugcuuguuuggcucuguacaugguugcuggggauugaacucggguccuuagacuuccauguggccagcacuucacugacugagcugcuuccccagaacacuguguguaagggcaccuguggacacauguguggaugucaugcacuggggagguacaaguguaugggauacagaaguugacggguaucuucugugacaacuguuuuauuuacuggggaagagucucacaugaacaccaggguugcagguugagcugcucuagccugugaacuuaccucagggaucuccaucuuuguguccugagcacagugauacaaguaggccaccaugccuggccauguuuugaugcacucuacugaugggaacugggaacucaugcuugugcacacaagcgcuuuauccaccaagccuccuuaccagcccaccauuuugauuuuugguuuauuuguuauuugagaaagauucuuacucuagccccaggauagcuuagaagccccgaugaagcccauuuggggauuuaacucauaaaaauguuccugccucagucugccaagcucugggauuacaaaucugagcuaccaugucuggcuucaacaugccuuagagacaaggcuggcccaaccagaccugguggcauguggcccagagucugggaagcuguauuguuccugcauaagaagucagucacucccugauaucuugcagacucucaaagaaagaaaguaaagagccguucuugccauccuuucugcccugaugaaauugaaaagaaguuuauccuggauccuaacaccaagaugaauauuuccuguugccaggaagaccucugcaaugcagcaguucccacuggaggcagcuccuggaccacggcaggggugcuucuguucagccugggcucaguccuccugcagacccugaugugaugguccccacccuuguccuuucauccuaaugugcaaccacucuuuccuggaguccucuagugaugaauuaugaguuauagaagcuccaagguggggguaguguguggaacacccuuuuuuaccuuuguagccccugcuggguagguaggugcccuauuccucucuagcguuuucagaucuguacuuccuggaaugccauuuuguuguggcuugcuaaucuugguccuggagucauguggccagcacagggaagaggcagcauuccaagguguuaugccaucaccauccacacauaaguaucugggguccugcaggguucccauguguuccucucgaugucccucugcugaguccaauaaacccuuuguucucccggccaag

SEQ ID NO: 7809 - RNA, 3944 nt, Mus musculus
caaacagaguggcuuguguugagaaucagccccuagcagggcuucucuagcuguguuugacucccggcuacaggugcaggguaacuuauuaguuuuuguuguuguuguuuuguuuuguuuugugaucaaguuaaaacuaaaucaagggguggacagccaguagauaaaguuuuaaccauuauuuuuaaaacaugaaacacgcacagaacaacaaacauuuaaacaacgaaacaaaaacagacauaaauggacagacauggauacaugggugcaccaaggacagacaauagacagagcgagaagaggacuagaugugucacgaaagggacccagauauccugcuuaagagaaccagaaccaaaacuaaggauuuuuccaguaggagccagagaagaggcaggaggucucucgacuuccuccuguccccaggagagcucugaaauagcuuauguucauuuucuuuuucuuuugucaaagugucccgaacaggggacaacuguuuuuuugaaacccaucuucucucucauauuuaaggucuaacucuucaucucuuucuuuuuuggggaauuuugucagagaagggagaggaggcauaguggcagcuacugauaguuguuccccagcgccuuuuuuuuuuuaacuuccccaauuuuucuuuagcuuguauaauuaauuuuuuauuuuauuuuauuuuuuuauuuuuuugagacucauggugaggggcuaaagcaucucugauuaaagcccacaaacaaaaaguaucuaccaggaccuuuucagguuugugaauaguggaaugaucuguuacguguauuucaguuuuuuuguuuuuuucaaguuuguauauuuacugguccuacuucugggaaucaaggacacugugagucuacuugcgcuaagacuuuuuccaauguuuguuuuuaaaaaccuguuccucucaccugaagcagcucuuuuagguuguuaacaaaaguguuuuuuuuuuuuuaauugcucugucccauugugcugcgacuauccuaguugaggugguguuguacaaguacagucucuaauagcucauugacccuaggauauaguuacuuacuguacuuggaauagccuuuuacugauaacuuuguucgguggagcgcuccaaccaaagcagcauuucucagugagucuuccguuuucagggucucuguucaggcgcuaucuguagccggccagcggcuuuacagugagcaggacgucaccugaaaggagggcuggaaaugaggcggaugagaggagaaggagccaagacuguguucugaucaacgcucaaaguuugauauucaguccagcguuuaugaagggaaacccacaaaacccauccccuggacaguaacucgggguagcaacagcacagcagccagucugauaaguuucuauuucuuggcagcucacuauuuccaguacaucaaagcucgcagcugcaaccaaggcaggugucucuguuuaggccgaugaaaccuauuguagcaagcguucaaggucugcuuagccuguccaggcugaggaggucacaggaaacaaaguagaaaaguccccuggucugucacuuaaggagguaagucugucuucuguuugaacauaugggaaaggucggauguggcuguguccaggauccgugugagaugucacuggauuccuccugucuguucaaggguauggaaugugcggccgccacccgauugucuuuauuguguguguuucucuucucuguauguaugugucucuguccgccuuucaauguguuucugccagcuuuguuucccaguauugaccaguggcugugagacacucaccccacccccagcuuaagagcugugccuuuuguuggggacucaaauccuuuuggcucugccagguugcccagagaaaccaaaaaagccuucgccuguccuguucaugcucccuggguggagguggggcgaggucaggacucucauagaggacuccugccauugaagcagaaugcacggggguggggguggggauggggggugggguauuguucccugauguacauucccucugcuucccagucugcuucgcuucuagcaggacaaaggaaggagaaaagaggaagcucugcuccuuucuuccaugauuuaugucuccuuuucagucaagucucuccauucucugaaaaaaaaauaaaaggagaaaaaccaccccuauguugggcaggaggcucacuacuggacaaugcagcccccaacagaaugauuuuuuucccuucuguccaacacugaucaaggaaacuguggugguuugaaucaaacuggcucccacaggcccauagagaguggcacuuuuaggagguguggccuugcuggaauaggugugacuacguuggggugugaggucucagauguucacuuccugcugccuguggaucaagauguagaacucucagcuccuucaccagcaccucgucuuccugcacuccaccauauuucucaccgugaugaugauagacugaaccucuacugaaacuguaagccagccucaauucaauguucuccuuuauaagaguugccuugcucauggugucucuucacagcaguaaaaacccuaaaacagagauuuuaaaauaauuuuugcuaggucuuuuaaagaggaguaaagacagcugcuaaaaagcuuaugaauagaaaagguaaaaauuuuaaaggaauaaauagauuccagcuacuggagguagcucaaaagguguuuaacaacagagagaaccaauugagagacaagaccuuuugcauaaacugaaagccaccaucaccuucucugaugaugagaugcaguuaaacuuauacauaacccacaaaauuuugguguccugcccucagucagaagagcaauuucuagcuaaucaaaauauacaguuguacucucucucacauugacaacaaagauuuccagggauauaggcagaaaccaacccgcuaggacuggcccaauuccaaguuccuauaauuguucaacuaauaguucagccacccgcauccagacucaacaauacccaaugaugcuggaaacacaaagagaaacugcaguccacacuaccugguuuagagagcccagcauccuggggcccugucagucacccuagaacaccccucuccugccugugaagaaaccugggaccuuugcuucucucgagucugauucuuccagaggagcaggugugcucugccuggcaccugacagcugugcucuucagccucccaugggcagaggugagccaacccacuugugcuuucacagugccagggccagagggagguuacagcaggcaacuuaccuggaccagguugccugagagauuuaaaaauucuccaauccugguugaugagacacuacaugcugaccuccugcccuuccaucaaagguguccugggaccauacucuuauacuauauccucuuaccaugccuccuccuagccucuagaacuaaaaagucauaaaggggccacugagggaccgcugcaagaguuacagacccagcuuuguagacccagagguucccuaucuuggcuaccagcuguggggaggcaaaaggagccugucucggaggacugcugccauccuuuguggcaucccuagccuguauaggccaagcagaccuugaacauucgccaggcaggcuggacagaucuuggcuaagcaaaccuugaauauuugccauaacgcacaggauggauauacagaccuugaaagauaggcuucaucggccugaacagagacaccugccuuggcugcagcuucggguuuugauguacuggaaauaaugagcuggcaagaaauggaaacuuaacagauuagcugcugugcuguugcuaccucgaauuacuguccuggggauggguuuugugggguuuccccuuauauaugcugugcugaauauuaaacuuugauca

SEQ ID NO: 7810 - RNA, 21773 nt, Mus musculus
gggcguggccucggaaagcgggcagagcccacgcaugcacgcacacgcaugcugcugcuguggcucagagcccugugccggcguuuccagcauguccccugccgcgucccuuccugucaggugucccgggucgcgaaggcgaacagagccggguaaggcgggugggacggagcucaggcgagacagggcucagugacuugccuaauccugcuccugugccgggccacaccggacacauugggaaaaaucggucacccauguaauugggucugggccuccaggcugccgcguuugguuuggaggaggucccuuuggagugugguucccagauucccugauuggucucaggcccacuccacgauucuuacacucuuugucacguggccuuagcuuucaauaccuaccuuacgucaccagccugccccgagggacuuccuagggguugggauggcuguccaggcugagauuauaugugagauucugauuuuucaaccuuucccucguguacugagguucccggaagcgcccagcucuggguugugggauuguugcucacagcacuuggggagcggggauguccuggucuaaucgcccgagugguggguggguucacagcgaagacagcccuuccagggccagccauuacagcugaccugcugaccugcuuuugauagcucagccccggacuggggcagcuaagcucuuaggcucuagaaauuccaggggaaagacagggcuguccugacucuccaaauggggcugaguuguggccucuaggagaagacacagggcuucacagcaggacaucgggguaacuuccuugauacucuucuccagugggacaaaggaaugucacccacgccacgccacgccacaguaguuguuuauagccccaaucucaguguccuugucugugaaauggggauggccguagacuucgccuagcaguuuggguaaugagcuugccgcucaguguagguucugaggugcuuguccacauuuuaugacaucgaauugggcugaauguuggaggaaagcugccugagucgugucacgaagcacuucugcaugcagccaccgaacuguuccccaccuagacccacaugagaagcggaaugggauuuaaaccccuaucucugggaaccuuuggccaccacuuuucucuuuuucccuccugcaugguucaugggacaccucucaccccucacaccccucaggcauccaaguucuggcuacuuugcaagagcugcucuguuuaugaagcccggcccgcuccuuacuuucugagggcacaccuggaauuguuuacuggcucaggacauggucccuuguccccugaccuccccaccuaugcucacuuucaggcauuguagcuccaccacaccuggucccuucuuugcaggaagagcgagaaaggcccuuuaaaaaacuauuugucucggggcagcggugcugcacgccuuuaaucccagcacugggaggcagaggcaggcagauuucugaguucaaggccagccuggucuacagagugaguuccaggacagccagggcuacacagagaaacccugucucgaaaauuaaaaaaaaaaaaaagucaaaccagacaugauaguuuauacuuauaaucccagcacuuuggaggcugaggcaagagugcgucaaguuugaggucaguuugggcuacacaacaaacaaaaguaacaugcucuuuauuuuccugauccuuucuuuccucaaaccaguaggccucuugccucucacaggauacagaguugagccaacaaggcccaccaggauggcugccuggaagcccagcaugugccuggaaaacccucacccagguuguaggaaggcucaugucugagucuuccuccucccuuccugccugaugcgccccugggauugcucauguguccguucugauagccgaguccuuacugcuaagaaaccacccaugcccuguccagcccucucccaggaucucaguaucccgauuaccuuggugucugcgucccaggcccuggugcagugcuggccuaggacagacucagaugaacaggccaggagaguucauguaguuagguuguggccucaugcugggcugugcccuacuggcuccagagugggccuagccugggagaggaugcccuguguugggaggaucgggagacaaacugcgcggaccuugcagagagccagccaggguaugcuguguuggugccggcagaguuaggucacacccaauggccgucccuucuucaaaagucccugagguguccugccucugucccugcccuugcuuuccuuaccucucugcuucccugugcauuguuagagucaugucuuccaucuccuuguuccucacaggcggggcuaccuauaccagccacucuuaguuaccaggugugauggcuacgccugggaagagauuucagagggaugaagcuagagaucccuugagccucagaaaagggcacuguccccccaccccacccccgcuucuacucagcuggggcccccgaguuuguacccuggcagaugcgcacuggagaauggcagccugacagcuuuuugagccccgcccccuuucaggcauuaucuuccuccuagguaauaggccagaggccugaugugagugccgugcuccacguaggugcucuccugucuuuucaggugggaagaaacgagcaagagcagugugaaguggaggcagcuggagcacaagggcccguacuucaccccagccuacgagccccuuccugacggagugcacuuccucuacgauggugaggaccaggggguguguacucccgugauugggcugccuagugcuuugggcugauuucguucaguacaugguuuguaugcugagaaggcuugcugaccuucccagcauggggugcaaaguccucuucccugccugggguucagaaguuccugacggacuggcggauagcaggggucaacacuggagugccccagaaacucuguguguguguguguguguguguguguguguguguguguagaugaccauuggcaggcugcuacaaggaaggagagacacagauuugugcuucagggacacgaauuguguccagacuugcccagguuugggugagcugcuuuggucucccaggcucuccucuguacacuccuggcaagaggugguagaggagauacaguguaugcguguguguccugguccuguuuguugguuguuuuugguguuuugagacagggucucgcuccauaguccuggcuggccugaaacucuugaugcagaccacacugaccuugaacucauagauauguaccugccucugucuccaagugcugggauuaaagguaugggcuaccagaccuagaccacugucucccucccucccuuccuuuccuuuuaaaauauuuuuaguuuuuauuuuuugagacagggucugccuacauagcccuggcuguccuggaacucauuguguagaccagguuggucucgaacucagauagauuuauuugccuuugccuugcuauuguguacacacaugcugggcccauacguacccaugaugugaccucuggcgcaugugccauggugcacuguggaagucagaggacaucuuugcagagucaguuuucuuuuuuccauuguauuuuacguggguuccacgaucagauccaggcugucaucuggcaaacccuuuacccgcacacgcuuguucugaaauuccuguccuggaacucuucagacauuugguugagagacaucucucaggaguagccuugguauccaccugguguucugucuaggcuccugugcacuaagucacugagcauggaggguuagccuccagugguccacauuucccacacugugauguguaaacuucuauuucgugccuguacuuuucuaugugggaauuuguguuuccaaauuacacauguuagggccaaggguauagcugugguagagugcuuuucuggugugcacgaggcccuguguucauccccagaacugcaauaagaugaaaaaaaaauuuaaauguggguuuuguuuuuuuggaccauugguaugguuccacgaggaaaaccucagccuggugaccgaguuugaucccugggacccacauaaagaugaaagguacaauaauaaugugcuacguguguugcuuuuucacauaauacaaacuugguagcaagaauggacgugaugaaggagucaguggcuggcacuguuacaaaccccagagugguguuccugggaucguguggcccuuaccucgcccaggggcuggucauuuuuaacucaggaguauaccguauacuaaagcgggagguuguguccccuggaugggaccugaggccaucccucagccacucgugugugcuaucuacaggcaaaccgcugaagcugagcuuggcagcggaggaggucgcuaccuucuaugggaaaaugcugcaucuugaguguacgagcaaggaagucuuucggaggaacuucuucagugacuggcggaagguguguuucucagcggccccagcagcagcccuugcgguggccagcguuugcccagcauggcugcauccaagauaguagccuggggugaccuucucccugagggcuccacuaacaguauccagcgcucagagugggaggcuggagcaguccggaggguauuuucugccccaugaaaauaagcacgugguauggaggugagaguauuguguaagguuucucucuuuccuuuguuuuuaaaaacaugguuugugugagccuggucugaucuucacaucuugaucuagcaacuacaagccuauagaaaugcuauacauagcauuucuccagugacugacagaauugagcaucuuuuccuauacuguuugucauuggaauuuuccuuccuuccuuccuuccuuccuuccuuccuuccuuccuuccuuccuuccuuccuuccuuccuuccucccucccucccucccucccucccucccucccucccucccucucucucuuucuuucuccccccccccacaagguuucucuuuguagcuccgucuauucuagaacucccuuuguagaccaggcuggccuugaacucagcgauccaccugccucugccuccugaaugcugggauuaaaggcaugcccccaccuccuggcuuguuucuuucuuuuaaugaauaugauugcauaaaagagacuuccucauugugugguuugaccaagagcuagcccacauuugaauucuccacuucucucccuaugucuucugccugucuauaguuugugguauguaaccuguuuguugugccugugucugucccuuagcaaauauaguacuuuguucuauauugauugaacaguuacagacaaaacacauuauuguaggucgagggcaugucagaguacauagcuuacgauuaaagguauacauuaucuuggguuauaaaagcugaagguaggguaagguauucuuuuaaaggcagguuaaacaaacagaccgagcacacaguaacagcagguuaaguacuuagacuuuuaaaaaaauguauauggcuauuuugccugcaugcacagauaugugcaccaugcacaugccuagugcgauggaucccccagaacuggaguugcagacagugguagacugccgugugggugcugggaauugaacccaggucccuagggaagcagccagugcucuuacccacugagccaucucuccagccccgaguacauaguuuuaaaugauuccagagcauguuauuaacuugguugcacauucuggcaaaaguucaaaccuucgaaggcaagagagaucuucagaaaauaacauuaucacguaugauuguuucccugccuguguguacgugcaccgugugugugucugcugucugaagaggccagaugagggcucuggauacccugaaguuggagguacaggcuuuugugagccaccugccauggguguggggcacucagauccucugcaggagcagugccagcgacccucuuagcugcuggaacaccucuuucguccuguuuauuuauugagacaaggguggacucugacuuguuacauagcugagacuaaccaugagcuuccacccucuuccacugccucccaagugcuaagacuauaaggaugcacaucaccucuuucucccuauuacaauuuuaaucagaaauaugacuugcuaaaauuuuggcuucuauuuuaauuuuuuuuuaaaaaucuauuuuuauuuuaugcauauguguguuuugccugcgugugugugugugugugugugugugugccacauccaugccuggugccuggggauucccuggaauuggaguuacagaugguuugugagcucucuguaggugcugggaguugaacuuggguccucugcaaguacagccagugcucuuaaccauugagccaucccgccagcuuccauuuuuauuuucguuagugugcuugggaguuugcgcucugaugugaaagcuggcacuuucuugguaaugguagugccauugcuguuaugugucugagaagucuuugacucaccgacggucacaaaggcauucuccuuuguguuuuccuaggacauucacaguuguugguuuuauguuuagcaugugcgugcauuuagguauagcaucaggggccuuacagcuugugguuuaagcugaagcugacuagacauucucacucauggaucccuggcuguccagcaccagcuguggggacaguguggucugucccccaugcaagacucugucccugauccugccucucacugugacucucaccaacugcugccuugaaaagcauccaggcacacggguggagccagccagccagugcguguuccuucccgucuggcguuccuuaguuauuaguacagaggggaaaagugggcuguucuguucucagugucuccaagcgggcagggaaggggcccaacccagaggauggccaacagacugcagcuguggcugugcaggcuggguccugucucccgaugaucuccucugaucucugcugugcaggaaaaagguggcccuguauugguccccauauguccucacgcgcuuugcagaugacugggagccaggaccuguugcagggcuguggcuucuguagugaggaaauggagguugaaaaccagcugccgagcccccccccccccccgccacucuccaugucugcauccaugucuuucacuuugauuuuugcacugucaugaccagcgugcaaacaaguaauauuagcauuuuacuguguguguguuucuccauauugcaauggaaucaucaaauucugaucugcugugauuucaaccauucucuccaaaacucuuccccgggguguaaugacuuuugcaucaguaguuaaaggugguacugggggagggggggguagagagauggcucaguguauagcuuccgggaguuacgauccuagcguccaccuguaacuccagcuccagggggucugauguuucuggauucugcaggcacgugcguguacgugugcacacacacccaucuccuaaccccaguucaaaauaaauauaaaucuucacaaaccauguggaaccuccuggagguauccaggcccuggcgggggggggggggcugccugugaggaggggccccugcccuguguuugugggaggggaucagccaggcccuguuaccucgcugucuccucccucuauggaagcagagaaaggacccucugcagagaucaagugaaaugccgccuucuagcuuccaggagugagaaaugacgcagccucggguuauuuuguuggagaagcauuuauaggcuucuaauuuaauuuuuagcauuccguugagugaauuugcuguaaucuauccagugccuuaccgcuuucuucuuuaauugucccuggaguguaaucgucaucagaccaacguggauaaguugcguaggacgggauccugaauuggagcuagugggucaggaauuuuuaccucuuuccuuacugaaauguuaaauuauauuuaggaagagguauccuuggcucuccugcaccacccccaucuggguucauacuaauagagucuauuacuguuggcuggagacuggggcuagugugguucuguuacugggagccugccugggagcagccgcucugucaguggacucuuuggguuuggggacaugggaggccuugcuuuaggggaaggauguggauuuaggggcucacuuggggauuucauuuggucauuuucugacagaguaaggcucaaggugugaguuagggccacaagccugaagcugagacgacacaugcucuccucucagcugucccuguccaucccgggucucccuugucaucuguucaugcuuucccauguggccaggagagagcuguuuccagcugaggccacauggcuuauucccagggcuccuccacuguacacaugggcccccgguacauugguuguuagaggccgaggggcuaguggaauggccuuagcccucuuggcagagugcaggcagucccguguuugugguaugucacggugauccugugcuguggccccacgcgugggcuccccgugccguggggcggacacucagcacguguugcugguuuugggacaggagaugacaccugaggagaggaggcucaucacacaccuugacaaaugugacuucacggagauccauaagcacuuccuggaaagagcugaggcccgcaggacccugcccagggagcagaagcagguuggcagcggguucugggaaacugggagguagcaggugggugcaagcugcagggcaccccucauagagccuuccucuccgaguggccuuaguagguggaccagguucugggugccgucacggcaggugcugagugauuucaaguaacaccccccuccauuaaagugugucugggauauaauuccauuuuccugggacaccuuugaaaguauacuaccauuugaaaggucaggaguggcagagaacccaagggcaggaaugugggggugaucuggaucuacugugaaucuuuucacgucuccccucuacuuaaugggagccugcuacauaguucuuucucaauugacugguucuuggucaucucuuugcaggggguuugaggcgauuccagaaccugccucauuuccuccuaccuugaaggcuaccuuacauggcaaagggagcccugugcggugcgcuccccacaccugcuggaaaggugggggcuugaggccuccagcagcagcaggagggacccauggucagcacaggaaugggguucacuuuagcuucuucucuccuaaugcccacauauuguuuugacucagaagcuaaaggaagaggccgagaaacugcagcaggaguuuggcuauugcguuuuagauggccacagagaaaaaauaggcaauuucaagacggaaccacccggcuuguuccguggccgaggugaccaucccaagauggggauguugaagaggagggucaugccagaggauguggucauuaacugcagcagguaugugggagucagccugccaggcucucgugggugagcauuggacccuggcugggucuagcccaggcuaccuacuggacccuggcugggucuagcccccgcuaccuacugggugacuuuuguccuuagcucuuuuggggugagacccuuuccuggaugggugcccgaagacacugggcucuguuuccaugucucucgggucuugucagagcucugggucagcugggcuggugucucuccacuugggagaacuacuugucuugcucagcagggcugagguucccucaaugggagguguccucuacguuuucagcauuuggcuuucugagugcuggcacguugggugugggcuuugcuguaugcugcuguguugcuguuaccucugguccguccugugucaccucccuacuucagugaccccgagugacagcugugcagcagccaccggguaugugagcugaggcugcagagcucucugucuagagcgugcugaaaguccccccuguuuuaccgcagggauuccaagaucccugagcccccagccggucaccaguggaaagagguacgcucagauaacacagucauguggcuggcugccuggguggagcacauccagaacuccuucaaguaugucauacugaaccccagcuccaagccgaaggugagagcagggccuuccagggaagcucugugccccagagcgcaggugucaggcccuccccucuguguuguuccaggguggcaggcaugggagacuccucagcccuucaguucagccuucagagauuagccaggaucagcuagccagaguugagaguagcuggguccggugguugcagucuaacaggaaucuaagugggguuaaucgucacugugaugguuucaauaugcuuggcccagggaguggcacuauuagaugguguggccuuguuggaguaggugugucacugugggugugggcuuuaagacccucauccuagcugccuggaagucaguauucugcuagcagccuucagaugaagauguagaacucucagcuccuccugcaccaugccugccuggaugcugccauguucccgccuugaugauaauugacucaaccuguaagccagccccaauuaaauguccuuauaagaguuggcuuggucaugguuucuguucacagcaguaaaacccuaagacagucacuucacauuuuucugaggccaggcucugcugcccccgucccucauccaguuaaaccugccugggaugccugagguggggaaauguccagucaccugcucugcacuuugugggaacauuuguugucuuuacuuagggggagauggauuggcagaaguaugagguagcgcgacgcuugaaggggguuguggacaagauccgugcccaguaucaggcugacuggaagucaccagaaaugaagaagagacagcuggcugucgcccuuuauuuuauugauaagguauagcaugggaccuugagaguuggggcagccaggacaaugguggcuucucccuggagcuggagccuccaucagauaaguaugugugugcuuugugugguugugugauuuugugauugugugugugugugugugugccacugaguauauaugaguuuuaugagugugcucguaugccacagaccacagccaugaccagugucuaccccgaucuagcuggcacugcggacaggcaaugagaaggaagagggcgagacggccgacaccgugggcugcugcucgcuccguguggagcacauccgacugcacgcgcccgcagguggccaggagcacguuguagagcuggacuucuugggaaaggauuccauccgcuauaagaaccacgugacgguggagaagcucgugagugcccucaccucagggaccguguguucacaguggggucucugucagagcauaacagagccacagugauaugcgguggccugguguaccucccugugucuccuguggcugugugaggaggcgugacagccaggggcuuacacauacagucacacacacacacacacacacacacacacacacacacacacacaccccugugauaaauguuuugguuuaggaggcaugaaguccaggguuuggaugcugaucccauggaacaugggaagaauccguuucucgccugucccugcuuccacugguuccucgcaugcccuggcuuugacucccccuagugagaccucuuccccgcuggccuggcuucugccccaugagaccugaugcagcugcuccuuacgcccugcuuccgcugaacacagcugcuuccgcgaggucugucuuacacagugucaaccugaggccgcugugcucugugugaccccaucuugacagcuccaccuguguguggcugcucuguuccuacagaaggucacauuauaagguuccaaaggggaugugaugccaccuuggcacccuuggcaggaugggcaagcuaaaacccaggagaggccaguguaaucugggccuggccaggaggaacuuaaggccuucuuccuaaagugggcaggggagagagauuguuuuccugaggcucugugauguuagguguguccgauuuggucacaaauacagcgcccugggucaccuggguggacgucaguguugcugauagaagagggaaccaggagucuguggccugcuagcaucacugaguggcucuguagaggcacaaacggccagcuucagcuuucaccacauggucauggaugaguuagcagugagugaccacgugcaggauaguggugugagcauaaagguuccagaggguaggccuggcacugugcuggcaccaccucuuccuaggaccugguguauguaucucucuguagcccucuguugaugugcacggugugaugagacauccuuuccugcucagcucauuucugcuccagggggucuccguguggcugcgaguuuugcucuucuccauggcagguguuccagaaccuucagcacuucauggaagacaaggacccuagggaugaccucuuugaugcacugaccguaagcaugcauauaguuuucaaagcagugauggggucuuaaagguuucuauugccguaaagagacacuauggccgcagcaacucuuauagaggacgacguuuaauugagccuggcuuauaguugagcgguuuguuucguuuguuaucauccuggugggaaacauggcagcgugcaggcagacagugcuggagaaggagcugagugcucugggucuggacccacaggcgacaggaagccacugagcuuagacuugagcuucugagaccuugaagcccacccucuagugacucacuuccuccaacaaggccaugccuacuccagcaaggccacaccuccuaaaugugccauucccugugggccuaugggggccauuuuuauuccaaccaccacagaugggcacuagggggucuagucuagcuugucuuuguacccaguguguucucuguucugacccagcagcuaaagcagcuuuccuuaugcucuuccggaagcugaggcuagcccaugcaacucaugucuccaugacuccuuucuucucucuguacccagacuuccagccugaacaagcacuugcaggacuugauggaagggcugacagccaagguguuccggaccuacaaugccucugucacucugcaggagcagcugcgggugcugacccguggugaguaggucuuugucccugagggcuagacccgcaugggagcugcccaagggcugcacguuggugggcccuaggcaugagccgagcuaggacuggacacagcagccuauugauggaagaaugcuugaggucaaccccagaguggggguggccucacucgccccccagcaggaagguguccugcuuccugcuccaccccuuguagcugcugacccuggucuacagucuguucuuccccuuccuccuuuagguagggccuugccucucuuccucagucacuuuggagguuccuaacagaccucugcgccccuacacuccugaccucgucuguacccccaaauccucucagcuuuagcuuucauuccuuuacugccauccagggaccuuggucucccuccacaccugcuucucugagcccagaaaggcaugaaggccagugcccaccaccuaugcccacacugcucccuaagcaggguuuccucaaggagauacugcggcucaugggcucaggaacucucuggucagggcagggugaagacucggugucauuaagugcugaauccgggcuauuccccuaccaagcccagguagccagucugccugaccuggagccagugagcuguguggcccugaagacaucucucaugcauuaggggcaggagugcagggaggaacccuuuuaaaggagcuugccauaggaagccagaagcaggggcuacuaguagagcauccuucaggcccagcccuggaaaaaacgaacaaacaaacaaacaaacaaacacccucaggauccuguuuccaggugugguuuuguaaaucuuguaugaauggccaccuggccuuagaauucuuugggugggagcuaguccaugcagauggguggcucgggaaccugaaccuggauucagucucucagggauguaguuggugagaaccuugcucaguaaagcuggguguacagaacacagggccucaggguugauagucaugaggucuuaaaaggauccugggcuaaacaaguccagacaacacuaccuugccuuuccuugggccuuagagcuuccagcuuacacuguuccagaaggaaauggcugggccugggauggcuuuggggcuccugucucugccccaauaggacauaguucagcucccacaagaaagugaggauuccgugcugccauuacuguggcuaaacccaguugucccuggcuugugggacaucuuaggucacugacuucuuccuugggauuuuguguccaagaagggacauuuauaacauguccagagaguccuuuuagggccaagguuguaguccagcguacaacacuugcuuagcgugccaaggcccuggccuccauugccagugccaccaaagaauaggagggggguggggaggaucagagcugguugcagcagagugacagcuguccuugucuuugcucagcggaagacagcguaaccugcaaagucuuagcuuacaaccgggcgaaccgggcuguggcaguccucuguaaccaucagagagcaguucccaagaccuucgagaagucgaugcagacacuucaaaaaaagguuaguuggagccuguggugagugucccccccauaccggcugguucccucccuucucuucuggggcauuucauggagggcagggauguggacuggguauagugcuguaggaggcuggggccggggacuuggaaucacacagggccauguccuggacagccaugggaggaaccagcuucuggcugccucucauuucccugcuaggacacagccaguauucuaguuuaugaaagaggucggggcagugggaaugcuggaucaaucuguggcuggcacggguggcaccauugggcucuagaggucucuugucuccacucugcuccuggucagccccauguggcuucauggggccuucuucuaggcugcugugucaucugaguuguuucagaauguaaggccaggacacggguggcauaguucaccuagccuuugugaggcucuggaguccaucugcuauaaccucccacacccccaggaauguugggcuaacagcuaugguuggaaguccucaggacaagucuggguggggauggaagcaguccugaaagcguuugcuuuuucacagauugagacaaagaaggcacagguggcugaggcacagguagagcugcagaaagcagagacugaccugagaaugagaggggacagcaaacccaaaagguauguguggggcugcugcccugaaagccgugacccuggggccagggccgagcucuggucagccuugaccuugagauucucuguugcgaucuuugaaaacuucauuccucauacacagaaguaauaugauuacagagcuguguaagguguggccguagccucugacgccggcugcacacugcagggucaccgcuugcagggcucccaggcuccuacggcucuuccuggauuuuguuuugagcaguugguggagcuaauuuucacggcacacaguuuacccuuucaaagugcccaguucugcuggauacagugacaugcuuuaagcauucauggaggcagaaacaggcagaucucugaguucagauccagucuagucuacauaguagguuccaggccagcuaaaaaaagaaaaagaugaucaaaaccaagcaaacaacaaaacaaagcaagauacacaguccugagagauguguggccaguuucauagagagauccuguacccaucggcauccccucccaucgccccagcuuuccucaggcuucucugcagcuaugcugggcuuaugggcauggcugccuugcccggugagcccacugggucuuguuucucuucugucauuucuggcuguguugugccuaacccuuucucuggccccacaguagucuucgguucaucuugaguuuacuuuuaucuggggucugaggguuuagccucacuccugggacuaccagauucucuggcacugugggccacgcaaccauuucuguccuuaccaagugcaccuggccccuguguuggaaaucgguuguuugcagguguggguuucauuuauggccuuugcuuuuguucuguucaucuguguccuggguccaccccaggccauccugguggcugaguguggggaucaggaggaaugagacugccaacuuuuuucuuuucuucuuugagacaaagucucaucguguacccuaggcuggucucgaacucaugguccugccucgcccuccugaggacugagauuauaggcauguaccaccucugucuaacaccuaacucugucuuucucucuaaagacuguuguggcuacgugccgacacuugaaaucuaccucccccgugcacugaggggugguguugugcuugcugguuauuuugaaagcgccacaccauguaguaccaagucucaauacagucuguaagcaccuggaaccccagcccucgggguauaucaggaggcucagaagccuggaucacucucagcuacauagcaaacucagggccauccuggguuacaugagggcucauguuuaaaaaaaaaaaaucaauauaauuuaaacuaagucuuccuuaaccucucagcaaacauuuguaguuuuucaaggaaaagcuaaggguuguguucccaggcaggugugaacaggcuuuuuagcucauauuuggguuguucauggccaccuuuguuagggguuccccagucuaccuuggguccagcgauaacaguucuugggcucagugcacacugugcucauugcugagauugaccacggcagagcagagcgggcagagcaccugggcuguguccaggauucugugggagccccucucugaggcugccaugguaccuugagguugucacucagugcugucccuucugcauuucacagcugucacccauuguccuuuccucccccuuuugccccccgacacacaccuugauacaggauccacauucacguucaguaaacacagccuugcagaugugcccuuucccaucuagaggccacaucuggacaggaacguuuucacagauggggcuuuaaacucacaugcaggcuguguccuggggaagagggcucaugugcccuguccaggaguuccuccugcucacuuaggcaguagccagccccauuuggagcagacugugucugacagccacacugccuccccaggggaaggcaggauguaaucaggcucuuugucagaggcugcaaacugcucgugcaggaggcugacaucagcaucgaguccuccagggcugagucccaucuggugggccuugugcugaggcagcaguuacaggauccaugggcuaggaauggacacaggcugccacuccugauuucccaugguggccaguguuaggcucccagcagacaggcagcagaggcgcucagcuuaggacuccagagugcccaaaguugguagagcugcuguggcaggcaaugccagguuuaggucaggaccaggaccaacugggagaucugugaacucaggaccccagagagguggucuggagcugaguccaguccugagccuuugcaccucaacauguuagagucagaaaagggguaucaguccagaguccccggccuuugggugccagguggcccagccccagagcucacuagcaaccugacucuaccucugagcucugagcggauccuccucuagucuguuuccucccaaggcuuccaggaggcaaaaccguggucaggauacuuaggaagacuuuucaaaccuuaacacucaggguuucaguuccaacacucccaccggcuacagaaacaucuguggccuuuaacacugccccagccccaucccugcaccuuuuauggcgcugagcccucugugcuuaugacggugaagacuaaguguuacacagugcaccaguuucacucgugugcuuagauguagagucuuucaucucuccuuuuauuuguugguuuuuuauuuugggcgggggcuuugaacucacagagaucugaugccucugccucuugagugcuggcgugaaagguaugugccaccacaccuagucccuuccugcccccaggugauuuugacaucuuacccuaucauuuuuaaaaauuauauauuuauuuuuaugcguauggaaguuuugauugcauguaugcauguguacagaaugcccaaggggaccagcagggggcaucagcuccucggggacuggagucacagaugguugugagcugccuuguguugucuggaaucaagucugagucucuggaagagcagcccgugcucaucuucucugcugcuuccuuaccacugagauguugcuuugaguccaggcuccaggggcacagaggaguguuggccaccacgcucugaccuuucuuuugcuauaggacuuccauuguguuucagagucaccccuguguauccccaggggcacaucuggguugaugcccgaggguguagcauaugcugggagcugagcaugcagcaaaggaggcaggaucagugaagggaaauuuucacaagggaagaaaacaucuguguacucaggcuccuucuugauuugcucccuuuauucuuggcaccacaaacgggaugacauucgagggaccacauaugcaagacacccgucuaucuggaaaguuucugagcccuuucccaugagccaagacccagacuuuaagaaggaaauccaggcucagcaugaacuauguugucugucuguggaacauauugagccuaaugagcaagaauagcaggaacccucgugaaauacuaauuccaggcaccacccauaggccagccuguccugugggcuguccuguggguagcuagccaagccuagcucuggugacuugccccacccugggugaccaccuaacuuacggcaaugcagcugcugguggucuguuggccucguuuccugcucucaaugguugcuucugccacagugugugcagguggauagucacaccacccgugcacauggaguugcucaguuauucuuguuuggcauggggaucuuccgcuuccuuuuuuugacuuggcuagaccagagcagcguuaacagucuguggugucacugugucuugcauccaaccugagagacagagcuuuuggucucagucgucagcaugguggucacugugugcuugcauggauacuucucccgggauuugcaggguugugugugcacacgugugaccaugaugggugcuggggacugucagguguccuuucugagaugacggugggguuuguccgccuguuccaguugcaugcccauggcugugaucucugcccuuuaucucaugcagaauugggcuuccguuccuuugcagcuucucuucuguuuccagagggugggaugccuuugucugguuugaucagaguaaugcuggcuccagaaaaugaguugggacguguuucccuccucuauuggagaccuggugcugguggcucuguaggcauuugguggagggcuccgcggugcccuuacgggggcuuugcuuugggagcagcuuuuagugaucaguuuggacucugcuugacaucgaucugucuagguuucguauuccuucuugagucagugaguucuguuguuuuucgggaacagucggugauaaggcuuuguguccagcuguccaugacacccccacuccuuugugcuucuggaauguccuugagcauuucugaccgacugacuauaguuccuaagggcugaaguuuucuccuugugacaagcuuccugaggugcggagcucugccuucucacaguggcgugcugcagaugucaguuaguccagggggcauucagugaggcgugcagcugucacagcacagcugcuacgaaaugucccaugugucgccugaagugcucugcggggcacgaggcuccuuccugccuccuucccugcauacgguggcccacgggucacacuuggccuccuggccuuucugcuugugcucuugacagcgacucugccauugcuggagcguggcugucacugagcagguggcugcuguggcuccugcugcccagccuuuugcagcucauucccaugccuguccacucuuccacauuugugucugcagcacuggucccuaggguugggaucagaguaccacgugguggcgggaucaguagcagguugccaugggcggguaaggagaaggguggaagggggaccucguuuuaaaauguauuuucuuuaaugagucuuuuuuuaaaaaucuauuuaucauuuuauuucuaugggucuuuuaccugcuuguaugucugugcaccaugcaugugccuggugcccgaggaggccaaaggagggcauugaauccccugauacuggaguuacagacgguucugaauugccaugugggugcuagacauugaacucagguugucuggaagagcagccagugcucuuaacugcugagcuaacucucuagccccauuaauuucuuuaagaagacaggaauaagggcuggacagcuucucgagucauagaggcaucuguuccugugccuguucuuagccuugcccgcccccuuguuggcauugcacgguucccuccauccauggagccagcagccucccuggguguggugcggguuggccucagcuuugaccccucuggacuucucucccuuuaugccuggagaaggcuaacgaggccauuugcaggagggacgugaagguggggcagaggaggugguggugacgcgggucugcucucggcagccgguacagggauccccucuuccaacaguuuccuucagaagcagcgacgauuguuaaagcuggaagaacagcuggcccgauugugcgcgaaggccacagacaaggaggagaauaagcagguggcccugggcaccgccaagcucaacuaucuggaccccaggaucagcaucgccuggugugugaucuggggccacuguccccgugugugaccugagggcuuuaggaggccccagcacagucccauaggugccccgcccuguaucuggcccugugcuaggcacaacuucuugugacagggaccaccuaacuggauggcccugaugacucuguuccugaguccaaguccugucuuuagaccucuuuccucugagcuuuggggugguugggacugccaggacccugcgagcacuaaaucacaugagugcuuggucugcccacuggggguugggccuugcucaguggcuagcuaggccauaccagggaugucaugauacguggggaaggaauacaauuggguugugaugccccggagagcaggucuagguggcacuggguaucuuggucacccagaugugcggaggccacuaccucuuuccacaccuuggccgcagggcaggacucagaacugauguuguuaccuccagguguaagagauuuggagugccuguggagaagaucuacaacaagacccagagagagagguuugccugggccuucaaccaggcaggugaagacuuugaauucuaagcagccucuuugccgcugaaauguucuuucucacugugaagcaguauugugguuuuucuagaauaaaaugucgggggaag

SEQ ID NO: 7811 - RNA, 897 nt, Mus musculus
uggaagucggcugccgcgaccacucgcugguaagaccaccgugcuaucaucuccugacagccccuuggaggcccggcccgcucccucgccccgaagccuggcgggucugucacgcgagggccgaacccgacucggccgcuccgaugcccacccaugacgaccaucgggagaccgcaaccgacagcacucgcuucggagagggucuacggcgaucacaagaaacaagggaacacacggcccgaccgcagccagcucacccugcaggaggcguaucugccgccgcagcugcuccuuuuccuccaucuccggaguccgcgacgccuagccagacccccucgacgucaucgccgcgcgacugguccccgcaggcggggaggagagaacgccgaacuucacuaugcguggacacgggguuggaaggcaccgucgccccggcaacccuggaaggacgcaugcgcagaacgagaaaaauccgucaucuugaagcgcccggaaguggcccgcaaucuggcuucugcaccaauuccugcgcaucauuuccaccgcuggggguuccucggaagacuuggaggagauagguugcuaacaguuuccccuagacccaggaauuccuuuuaucaauuuauuuguuugagacaggauguauuucuggcuggagagaaacauaacuggggaacucgcuauguagacuaggcuggccucgaacuuacggaaguucucuuuccucugccuccggaccuggaaucaaagggaugccauuuuaacgccuuugcugccgcagcagcacgagaacagcgaaaaggaaucggaggcaauuuuuuuuuucggaugauuacagguguuaagaaaauucuugagggcauuuaguaggaaaggcugcaaccucuagaaaauacu

SEQ ID NO: 7812 - RNA, 1447 nt, Mus musculus
ucaguguccuugcuggguugggugguccaggguuucuuacuccuuggaggccauguaggccauaagguccaccacccuguugcuguagccguauucauugucauauccggaaaugagccugacaaaguugucauugagagcaaugccagccccagcauugaagguggaagagugggaguugcuguugaagucgcaggagacaaccugauccucaguauagcccaggaugcccuucagugggcccucagauaccugcuucaccaccuucuugaugucgucauacuuggcagguuucuccaggcggcaugucagauccacgauggacacauuggggguagaaacagggaaggucaugccagugagcuuccuguucagcucugggaugaccuugcccacagccuuggcagcaccaguggaugcagggauaauguucugggcagccccacggccaucaugccacagcuuuccaaagggaccauccacagucuucugaguggcagugauggcaugaaccauggucaugagcccuuccacgaugccaaagucgucauggaugacuuuggccaggggggcugucuuagucaggguuucuauuccugcacaaacuucaugaccaagaagcaaguuggggaggaaaggguuuauucagcuuacacuuccauacugcuguucaucaccaaggaagucaggccuggaacucaagcagggcaggaagcaggagcugaugcagaggccauggagggauguuucuugcuggcuuacuuccccuggcuugcucagccugcuuucuuauagaacccaagacuaucagcccagagaugguccuacccacuaggggaccuccccgcuuggucacuaauugagaaaaugccuuacagcuggaucuuguggaagcauuuccccaacugaagcuccuuccucugugauaacuccagccugugucaaguuaacacaaaacuagccaguacaggagcuaagcaguugguggugcaggaugcauugcugacaguguugagugaguugucauauuucucgugguucacacccaucacaaacaugggggcauuggcagaaggggcagagaugcugacccuuuuggcuccacccuucaagugggccccagccuucuccgugguggugaaaaacgccagcaaaaugcacgacauacucagcacuggcaucaccccauuugauguuagcggggucucgcuccuggaagauggugaugggcuuccccuugaugacaaguuucccauucuuggccuugacuguguccuugaauuugcuauggguggagucguacuggaacauguagaccaugcaguuaaggucaaugaaggggucauugauggcaacaaucuccacuuugccacguggagagcagauggcagcccugauaaccaggcacccaauacggccaaauccguucauaccgaccuucaccauu

SEQ ID NO: 7813 - RNA, 1259 nt, Mus musculus
uagcaacccugcaccaggauuuauuaaauuaucaauacuacacuuuucauggccacugugccucaaguuccagaucaaaaucccugcgucuucuggucucaagaucuggaucacagcugcgcccucuguucuggauuguagcucauuccagauuaaaaguccaaaugaaaacaauccagguaauuccagauuaaaaguccaagugaaaacaauccagguaauuccagauuaaaaguccaagugaaaacaauccagguaauuccagauuaaaaguccaagugaaaacaauccagguaauuccagauuaaaaguccaaaugaaaacaauccagguaauuccagauuaaaaguccaagugaaaacaauccagguaauagcaccuaacacgacccggguuugcuguuaugaagagugucuuaaugaaaaggagcaagcugagaaaggaaaaauacaaaauguaucguucaaguaauaaagaugcagcaggaagugaaauagaacugaauccugggcugggcaggggggggcacacaccuuuaaucccagcacucgggaggcagaggcaggcggauuucugaguucgaggccagucuggucuacagaguucaggacagccagggcuacacagagaaacccugucucgaaaaaccaaaagagaaaagaaagaggaaaaagaaaaagaaaaacaacaaaaaaagagugaacauuaguaaccaugaaacagauuuuauaccaggcuguuuugagacuuucaucgucaaugcaauuauuuaaaaccucuucaccucagccucaggcagacucuucagacaauggcaagaacugccacauucuuuaucaaaauaucucaaaaacaauuucucagccacauacuaacauucuucuccacuaaaaucuaucgggccaggucugcacaguuaaaucauucucagcaccaacaucuuccauauuucuccgaggaugguccauuaaacccugcuuuaagcauuccacuauuucccaaaccaaaauccuuauuucuccaaacaaaaccguggucgggccuaucacagcaauggucccuggugccaacuucugucugaggguuuuacugccaugaagagacaccaugaccaggaacucuuauaaaggacaacauuuaauugagguugucuuacagguucugagguucaguccauuaucaucaaggcaggaagcauggcaguguccaggcaggcauggcgcuggaggagcugagaguucuacaucuucauccaaaga

SEQ ID NO: 7814 - RNA, 968 nt, Mus musculus
gggcugcccuccggggucuccccucugccaggcuagggaccugugccagcagcccacgcaccagaccguggaccuggguaaaaggaacaaacgucaguaguuagagccccaggaccucaaaaggaaacucuugccagcaccgcaccucccuacacucagagcagccuuuagggggaguguggucgagguugaagggaggcuugcaggauucucuggauggggaugcuaaccugguccuccagccgcugcccccgggcuuccagggcugaggacagagugagcgcuguugccugggucccggcauagccagccuccuccagacaggcagcuguauacaacgcaaggucugcaaggguuccuuccucccaggaauacugggaagccuaugauggaagaaugaaacguggaguuucugaaguccccaagccgaucucaacuauccucccuaguccuccagucuucccaucccucagauggcgacaaaccuuccucccguaugaucuuuuccauccguuuacccucaggacuccucaaugccccccccccccccguacuucuugucuuucuagugcccaagugaacagccaaacuuugcaucauccagcaucugcccucuuacucaccugguacggucucucgggggcuggcuccugggcauuguguggggaauagaucucacuaccagcugugggggcaaccacuucauucccaggcugggccucaaaggcaggggugaguguuugaauauagggcucaggcucgggcccaagcuccuggggaucagacugagggccuguagaagagggucccacaggcugccccuggcuagcccggauuccuuccgcuagagcugucagaguuagggagcccacagggccgucccggccgucccggccccgaccccacacacccccagccauaguguuccuaccagcggcaccugccaccacucuuccagugaaguugug

SEQ ID NO: 7815 - RNA, 5118 nt, Mus musculus
cucuguccucccaaacccgcccagucgcuucugucggucaaagcaguucuagugggcgggacccgcugccgcaaggacgagagaaggccagcucagagcaggauggcggcgacaaugucugaaccucggcgugugggcuucgugggugcaggccgcauggcggaggccauugcccgaggccucauccaagcaggugggaggcgaggccuggcugggggagcuuucguucuaaugggaggaguucguaagccuuggcgggaggggcgcacgugguacaccaagggccaguagggugaauucgcugguuuccugggugagaaucauacaucaggacucuauuaaggccuccaggaucgcuggaugaguccgcagucccuucccaggccggugagugggcauguuaggcgaggugugggggaaaaaaaccaaaaaaaaccaguucauuuauuuaacauugauuguauuggugaauauuccuuuaaauguauugcauuaaagaauauuacgauugacuucacgugugacuucuuuguaguggaguuugcuuguuucuuuucuuuucucuucuucucuucucuucucuucucuucuuuucuuuucuuuucuuuucuuuucuuuucuuuucuuuucuuuucuuuucuuuucuuuucuuuucuuuucgagacaggguucauuuggccuggaacucccagguagaccaggcugauccugaacucagggauccaccuuuuucugccucccagaguguuggaauuaaaagugugagccacucgcugacucgcuuuuaacuuuuuaucuccuuaauguggcugcgaguuucuaguuccauauguggcucaaaucgugccuuagauugaaccgacuuaaugccaaguuaaaugucugacguccuggccucuuccuccucagccucuggcuuaaccaaaggcuacccauuccucagcccccacucucagaggugggcagcugugaggacacucgggaggaagaggauuggcccugugcucugaagagugccugcuaucgcugguuugucauuucuuuauggcaacaauaccuugaauuugaagacugacguuucuccaccaguuccaaaugucugcuaccuggagcuugagggguaugguggggagagaggcaaacucuuccgggcugaggacugcugguguauauaacugauguuuuacuggcccagcacggcuguacaguauuuagaaaacuuuaugaacagauugcggguagaggaaguuggugaccuuuggcucucugcuuucaguuguauuucaaaguccagaggcccaugaucaugggaggagggcuuccuacaagccuuagcaguuuacacgucgaaccuggcaguucaccugccucuugcugcuacacacacugucacugacaucauuagcucccuggggaagguuuuagcaugcacuucugucuggcccaggcuuucuaccccuauauccuccaaaaccaggugguguccaccagaggggccacuucguuuccccaggacacaccagcucacuugccuguuaggucuuuaucagacuggcuuuguuuguuuuuguuuuaagacaagguuucucuaugcaacccccuggcuguccuagaacucacucuguagaccaggcuggccuggaacucagauucaccugucucuuccuagaugcugggauuaaagucauauaccaccaucaccaggcuaagaucagcuuuuuuaaaaauuauauguuugaguguuuuaucuguuuaggcacugugugugugucuaugugugugcuugcaugcuuacacacuccgugucuucagaagccagaagagggcaccgguuccacuggagguagacuuaucaaugguugucagcugcccaaguggguuguaggaaccuaucccaggucaucuucaagagcagcaaauacucucagcugcuaagcugucucuccagaccuuuauuacuaacucucuugcuauccaccaugcaacccuagcucuggcguuccuucagagguuuugcauuuuggccaaaagaccuaaauguuccagucagcugccccuucccugaaagcggagacccuugggcuuuguuucuuguuaagaucaggcggguuccuggucccaguguccaacagaaacggcagugcuauuuaaguacgaugaauugacuugaucagccccaaggacaagcaacccuaaggagccuuaggcucacacugggcugggcaagcuguguccuaucuucccaguccuuaccagcucucguccuucuguccaggcaaaguagaagcuaaacaagugcuggccagugcaccaacggacaacaaccucugccacuucagggugagugggaccuagagggccuugucuuucugaagcauuuaucaggggcagguauggcagacgguuugagaugguuuggucuguccaggggaacuaggcgucagaggccaggaagaaaguucuggaaggacuagcauagaugcagugugugucuuauguaggguggguguggacacucauuaggagggaagguucuagaaggcacaacuuaagaguuugaggagcagggccuguuggguuugucguaggcguuggagaguacagcaaguacagacauuggugacccacgggauacggaauggucgauggcacgcaggucagccuguguaggaugcugccucacacagccucauuucuggcccuugugucucuuuaggcucuggguugccagacuacucacuccaaccaugaggugcugcaaaacugcccacuugucaucuuugccaccaaaccccaaguccugccaacuguccuggcggaaguggcccccauagucaccacugagcacaucaucguaucuguggcugcugggaucucucugagcacaauggagggggugaguggccccuuggugugaguaaggccuugacucugaaacaggaucuguggcccauacuugggaaggagauagcaucccaaccaagcaccagaaguuagccaguuggcucaccaggguucaguggcugggauaauguucugccaagguaccugggcaguggggauagaggcugcauuugccugacgcugaauucucuccuauccagcuguuacccccgaacacacgaguauugcgagucucucccaaucuacccugcguuguccaggagggggccauggugauggcccggggccaccaugcugggaacgaugacgcagagcuccuacagaacuugcuggaagccugugggcagugcauagagguucccgaguccuacguagauauccacaccggucucaguggcagugguguggccuuugugaguauugucucagagucaagccuugggggcuucaaaugaucccccugugagcucugcugucccucagaacaucauguuuuauuggaccaucgaggcuggcuccuuuaccaaacucuuggguauaggccuuauagucuagguaucugugaccauguuuagggccguguuucuugugauucugagcuagugguucucaaccuuccuaacgcugugacccuuuaauacaguuccucaugguguggugacccccccccccaagcaaaaaaauuauuuuuguugcuacuucacaacuguaauuuugcuaccauuauaaauuauaauguaaauaucuguguuuucugauggucucaggccaccccuguaaaaggauuguucaacucccaaagggguugauaggcauuuucucucccuuggugacacacaggccagauuagaccagauuaaaaugaaauaaaggcagauuuauuaggaggcagcucuccaggugaguuagucaaucucacagguagaggucaguaaagucacacauccaggcuaaucaagcaagaggguuuuacagagcuuaggcgaagcacgaugacaugccagcuaggagcugggcuuguguccauagcauccgaggucaaaaacugagcccuugggugggcacucguggguggguugccagaaguggagagacaaggaguaaugacauguuuccggaugaaggaguuuucugugugggugggauuggaggaaggagaacacagacaugcgauuucccagcuugcacgggugggcaagcagggguuccagccuaacggagucacgagccacagguugagaaccgcuauucugagcauucucuagcugugaacugugucuagcaaaaggucaacuuugacaugaccccuccccacucccaaugcuguugcuacagguguguacauuuucagaggcccuggcugaaggugccaucaaaaugggcaugcccaguggccuggcccaccgcauugcugcucagacccugcuggugagugaagccuuuccucgggagaaugucgggaagguuugagugugagcugucuccagcgaacuggaagacgagccuguggaguccagacaggcugggaaaaugugcagcugccuccccucuuuuuucucucacugcccuuaacucuccuccuuaggggacagccaagaugcugcagcaggaagggaagcacccagcccagcuucggacagaugugcucacaccagcuggaaccaccauccauggguugcaugcccuagagcggggcgguuuucgagcggcuaccaugagugcgguggaagcagcuaccugccgggcuaaggagcucagcaagaaguaaggcaggccucagaugagacuacgggcuccuugcccagcugcagccucuguggugagaauagcccuggacgggagauguagugggcaguccucuaaguggaauggcuaauuuauccaagaagcggugacuacuuguaagaugcuaucaagacgggguugccuugacugugacauucagucaaggaagaaucgcuugccccuuaccugagauuccagauccucccuucugcaccuccuggccaguugcaguuguguccucauggucacaggagcugguagaauaugucuccuguggaggugguagacaucauccuccaugcuggcgugagacgucuuugguuguggcugcuuugggaucacccacacuccguaagcagcgccccguccauauucucuaagcccaauaaacucauugguucucuaaguuggacuuuaguagaguuguac

SEQ ID NO: 7816 - RNA, 8463 nt, Mus musculus
auuacacagacuugggauuuuuguuuuguuuauugucaugugcgagacacuagggacauaggagccaaugauacauccuuaguguccucggggaaacagcaaaacaggaaagagaagguucaugauugugguauuuaauagcaaguacaguagcaguggugaacacugagcgacagaagcacaagacacaaacccagcucaguaccagggaagcacuuuuggccaugacgccugagaaaugauacacaaugaccaggagcgacugggagacacugggacaggagugggagcagccuggaggaugcgguggcaaucgcaucaacugcauuaccaggcaucaaacaguugaggaagcaaaggccagagaugagucccagacaacagggaaccgacuugcaguuuugcaugagaaaagccccuuucucuaaccuuucagacagggaaccauuucucaaguaacaauacaguucuucuuugaaaguacuugagaguguguuguaacuucaaauaaaaucuagaaaauucucuagagguucucccucagugaacagcucaagaucagcugucuaguccuuuggcuugccugccuuggugacagacaacagaccaguaacagccuaucaaugacuugaaaaacugugacaauccgcaucuucuaagccauauauguacuaaggaugccuguuuagaagcaccauccgacucagagugacugucuuauaaauuauuuccacaacacucccgaucuguagaccucucuccuaaaugaacggaggucucacucagggaaagauccuccugguggacaagaucugggggugggguaagaucuuucccaaguuggcuauacguguagcgcuucucuuccgugugcaucuucuggugcugaaggaaguuggaucucugaauaaagccuuucccgcaguaacugcacacauagggcuucuccccgguaugaacaaucugaugcagcaauagcuuagaacucuggaugaaggcuuucccacagucuuugcacucaaagggucugucuccaguguggaucuucugaugcucagugaggugggccuucugcaggaaagccuucccacacuccuuacacucauacacccguucaccaguguggaucuucuggugucguaugagguaugagcucagaaagaacgccuucccacauucguuacacucauagaguuuuucuccacuguggauucgcuggugcugggugaaguuggaugucugacugaaacgcuucccacacucguugcacacguaaggccgcucucccgugugaauccgcuggugcugaaugaguuucgagcuccgaauaaaggccuucccacacuccugacacucgaagggccgcucuccagugugaauccucuggugcucgaugagguccgagcggugucggaaggcuuugccgcagucucugcacucauacuguuuaacuucuguguggaucugguaauggcggauaaggcuugaacuccgaaugaaggauuucccacacucguuacacucauagggccuuucuccugugugaauucuuugguggcgaaugaguaaggagcucugacugaaacccuucccacacucuuugcauucaaaaggccucucccugguaugaacccucuggugucgaagcaggucugaacugugacaaaaugcuuuuccacacugugcacacuugaacggcuuuuccccaguauggacaugcugaugcucccucaggcuugcguagugaacgaagucuuucccgcacacguggcacacacagagucuguccccaguguggacucucugguguucagugaggagggaggucugacugaagccuuucccacaaugaucacauuuguaaggcuucucccccgugugcgagaucugaugcggaacuacaucugaauuaaaugggaagccuuugccaccaccaccacaggaacgggccuccgcaucuaugaguucucucugaaguauaagaagguuugaauugagaaugggguuucuuccugacuuacugcacguuugggcugugucuccuguuugaaucuuccagugggucacugucaucugagugaagcccccguccugagaggagggacucuccaagcucugcuugucuggguuccccaacagcugcgccaaucugucuucaugaaauucccgagacucagaggcagagggcuccagcacugugaguucgucugacaucaucuuaugugaauuuucauccccagaaauucaggcuuccggauccccuucuugccacuggcucccuacaggagaaucugaaaugagaaaagaagcuggucuuuccccuuugguaacgagaacgggccgaagguguggaguuaaacuaccauccgacagagaggaagcaccuccucugcccacacuucugaccuucacuguuaccagccccaaucagccacccacaugggaaggcuuccugcggcccgaccugugauauggccaaccuuaggacaaauaggcugugcuacacagcacucuucuaacuuguguccugugugggugacagagggauagggauauagucaggacucuacuuaaaaaccaagacauguaauuccaagaucacucaaauaaacucuaucacuccgacugcccaccacccucauucacauucugcaucgugugaucuuuaucuugucccuacccagaaugcaucucccuuuaggcuauuuguagcauucagggccucagugcuagcagcauuucugaccuauagugacugagccugaagccaagaacccaguuagaaucuccacacuucuaaccucucccucuuucaguggccuuauaaucugguucccucugugaaaucccuuaaugauuggagugaugcgggcaguuccuguccuagccucacuggcacaauguucucacuuuauaucuacuuagcccccauaaaugguugggcucuauacccaaaaguuagcccaccucagauaagaaauuaacaaaaucaagcaaacacacacacacacaaaaccccuacauuuguaccaaacaugaacgugucccuuuuucggggaagggccauuauuccuugaaaacaacauacuuaccuacuugucacaauguauuaggugugauaaguaacgagaugauuuaaaggacagaaagcuguaaguagauagagagcauacaaacauuacacauuuucuccuuaaggcagggucucacucuguggcacuggcuggcuuagaacacacaauauggaccaagcuggucucaaacucacgaagauccaccuacuucugccuccccagugcugagauuaaaggugugugccaucacucuggcaacuacaacauucugagaaacucaagcauucuuugauuucaguaccugcagugaggaacugguauagaauccuuuccugcauggacuggugagaugacucagcgguuaagagcacugacugcuuuuccaaagguccugaguucaaaucccagcucaaaaccaucuguaaggagaucugacacccucuucuggagugucugaagacagcuacaguguacuuacuaaauaaauaaauaaauaaauaaacaaacaaaucuuuaaaaaaaaaaaaaagaauccuuuccugcaccuuaccugcccuuuucuucccaucaccugugugagaccagcucuggcuagaucccaccuguuuuggaucugucugaacucuugcucucuacacugacagcucugacacccuaagggugugucagccauguucuauacucacccaacucuucuuuuuaauccaucacuagagcucuagagacagcucagagguugaggguacuugcuguucucauagaggacccagguucccagcccacaaaccgaugggagcucacaacugucugugacuccaggggaucugaugccacauucugaccucugugggcaccaggaccacaugugguacacacacacacacacacagacacacacgaacacacacagacacacagagguaaaacacucauaugcauaaaauaagcauuuaaaauaucuaauguuuuuuccuaccccuuaacccuuacuucagugagaggaaaggcagggagacaggaauggccacuuccaccacugaccugcguucccaucagccuuccucccucugguuucaggaaucaagcuguacuuaaccugaagaagguccucaccuccacuugcucuaggccuucucccaucccaucucaucaagccaccgcgcccucccucuugagauaaaaaccucucugcuccucuagccugccauuccaagucagcacacaguaaugcgaguucuuccacuaacuggggaaagcaagcuggaagugacacaguagggaacaagaggccuuugacauccuguagguggagcaucagcaucucacuuuaaaaaacuaaauggggggcuggagagauggggcggguaagagcacugacugcucuuccaaagguccugaguucaaaucccagcaaccacacgguggcucauaaccaucuguaaugggaucugaugcccucuucugguaagucugaagacagcuacaguguacauagauauaauaauaaauaaaucuuaaaaaagaaaaacaaacaacuaaaugguacacuuaucuagucucaagcacucuggggaacgucccaauuuccuaucucaaagaacaugaauaccaagcuaacuucccaaguucuaguuccucuccaguuacugucucuccucuccacaaugacacucaauggucacugaguuuaucuuacaucuccucuccucuguuacuuuuuuuuuaaaaaaaagauauuauuuauuauguauuauguauuauuaugcgcucucugaccuguaggccaggccauuauccugcacccugcuccugucucagaaccucaaugcucccucuacuggugucucucaaggcaccagggugacagucuucuaaccugucuucacacucuccuccuccacggccuuucuacaaagccagcaggcugacccuuucaaagcauaaaugaaauggugacuuucuauuuuaaaaccuucaaggcucuccaauccccuccuaccaccauucuuccccaaguauguaggugaauuagcaggaacacuugagucacuuacuagacaguuguggugaauaugcuuggccagggaguggcacuauuaggagguguguguggccuuguggaggaagugugucaccgugggggugggcuuuaagagacccuuguucuagcugccuggaagauaguacucuucuccuauuugccuuugggacaagacagaaaacucucagcuccugcauaccugccuagaugcucccacccugaugauaaugggcugaaccuuugaaccuguaagccagccccaguuaaauauugucccuuacaaaaguuaccuuggucauggugucuguucacagugugaaacccuaaccaagacaacacuugagcucaaccuuucccaucaccccuucuaagagcuggcuguucucaggggccagugcucugcucugcuccaugcaagccugaagcuucagaaccccuaaagcuacagcaaggcagugcugccagcccguggcaccagagucucacuggcauucaguauaaggaaguucaaggcaacccagccagccacaggguuuggcaaggaccugcauacgcucacguuuuagaaaccaccgauaccuucugacuuuuauuauuuuauggagugcuaaggauggaacucgggauauuaugcaugcuaagcaagugcucuaccagugagcugcaccucagccccuuauaucagacuuagaaugacuacgcuaccuggacacaagccugcagcuguuuacaagaagagcuuagaaucaugugugccucucggugacucuuacaacucggcagcuagagauggcugagcaguuaaaagcacugacuacucuuccagagcacccggguucaaguuccccagaaccccauagccgcucacaacucuguaacgcaaauucuaggggauacaacgcccucuucuggcuucugaggguaccagguacacacaugauggacagacuaacaagcaggcaaaacacccaugcugcaagauaggaucacacagugaacaccaagauacuguuagcucagcccuuagcacacaccuuuaauccuucuggcuggacuacagacacacccuuaguucacacuuuuaaucccaaacaaugaaggcaaagauaguuuguacaaggaagcacccauguuuggaagugaugucugauugagaggcggacaaggugacaaaucaagaaagauuugacagaacaggauauaccaacucuuacuagaagagaaaagaaagggaagccacuuaaggggcccgcagucuagagaaagaagagaggcaguuuuacagacaguuugaggagagaacgagccagaagauuagaacagaguaccagacuuaguuggaggccaagcagagcaauucagaagccagacugagugagucagcugggagacaaguuugauacagaacagcugaguuaaaccagccagaagauuccagaaagaaccagaagggaugagcuuauucagcagcaagucucaggggcugaaaacaaguuuaggccuagauuagauuggacagaggcuagaagcuuccaggacuagcaagcuaggagauggaggcaguaaaccuuagagacaacaauuccaucaggagaauaaaaaccaacauuagacacccauacacauaaagaaaaacaggagcaggaaagcuugcaucucugcagccuugggaauaaccaggcgggcgggccucgacauggugucccugacaaccuguggaugugccacugcagcuguggagguagcugggugcugugugugcaaggcaugcuauuugaggucaaaaagaauagagcgagugacuggcugcucucuuaggacuccuauuccaaccucuaccucuagccccuacauacaaggauccugcugacacaaacagucuucuuuuccuaacaagcccagggccuuuuagcagccauuuuccauaagccaacagagcagucagagggcucugugauuuacuucagagacaccacuuuguucuagcccacugcuucucuggcaucccguccacuuccagaucagaccauaagucuuguaggggaguggggguacuuucccaggucuacccucucucuauaucauccuccaacgcauuccagaaccagaaauccacccccaaggcuccaggaguguccauagcugcauguguuggcuugugagguuucucuauaccucccauaugaaaaaagaaugccaucauuaugccaaguauuaaaacagauacaaugccacauccgugacaggaacaaaggucugcucucugccuuaaaacuugauguguauauguuuguuugugugugugugugugugugugugugugugugugugcgcgcgcgcgcgcgaggggcauggggagucugauuucuucgugaucagaagacauuuguuucuuucauuguaaugggucucaaaggaacgaugucuagaagagcacagggcgauugugaauaucagcucuccaccuggaaaacuacuugaguuuagaacuguucuucugcuaauaucccgggaaaccucuagcauagcacucaagcccuggggacuccuggaccacgguggggccgggugcaaagaggacuaaaugucccuggcauuaucacagagaugucauagacguugacucagacacuucauggaauagaacagcuuguaugacaccucaccccaccuaagaauccuccuucaugacauacggagcugauucuguccaacacacauauuaucuucaaccccugaagcacuggggugccugcacugcauccccucggacagaggccgaaaggacugagggaaggcagaaggcaggagggcaagguccaagccgaagagcagcguggcgcgcaccugcauuccaucaccugagcggcuuagccuucaagcagccauccgggggcccgaccugcaggcgccgaggccgagugugcaacccucgagggccucgaugucugcggacgaucgguccaugcaucuaccgcccgcagcucggcgaggagacgcaaggcuccggcccgaaccaagcgaggagcuacggacagaggccaaagcgaagugcagccggcccgggacaccaaccaacucgcugagccccgccggucacgagcccgcccacccgcgcgagccgcuccgccucacucacccggagcucggcggcgagaggacggcgcggaaccaagccgagcagcauccaggcggguaaccccgggcggccacaaagcccgcaccgcugccgcacgccccggccggaaacugcccgaggcuccgcccggaggacauccguaggcacucuaggauaagaaugggggccggggccgucucccugucacagacuuccgggccagauuccug

SEQ ID NO: 7817 - RNA, 2335 nt, Mus musculus
caacaacaaaagagauuuuguuaacaaaaaccaaacagacaagaccaaucuuauuucuaccuuuugcuuuuuuccuuuuagaucuucccucuguauuuuucuuuucuuuucuuuucuuuucuuuucuuuucuucucuucucuucucuucucuucuuuucuccuuucuuucuuucuuucuuucuuucucucuuucuuuuguguuguuuguguguuauuuauuuuggaggagguugcaagggcaaaggucggauaugaggggaugagugggauggggcuacaugaugucaaacaagaaaucaauaaaaagaaaaaauaguagaggucacauuuucauggccaaaauauaagaauaaacauagauagcuaguaguaagauaaugagcuaggaaauuaauucuuucuaguauuguuuugaaaauauaccccauaggcuauuaaaagaaauuccaacucuuucccaaggcauuguuuaacuuggagucuucagucaucaucuacaguuggcuuaauggucacuccucuucuuaucugaccccaaccaauuaaacgccaguguuucucaacucuucuguuaagggcaauuuuuucuccuuucuucuguacacacaggacuggucaaaacaauuuugcccaaaucagccuuaacagcacuaacucuuccuccugucaacagggauccuauguugaccauaagcacuucauucuuagacagcuuuuggaccuuggcugcuuucuugucuccuucaguacguacacccagaagacguuuaagcaggaaauaggagauuuccaguucugugaauauuucagguaacgcuccaacugcaccaagcacuugucccaccauucuaccagcucagcacacaguggggccgaucuuuguuccaacuccagugagaccaccuggggcagcauacugaagaucauuauguuucccccaaaaaagugacacaauauuggaaaagguugguuuacacaugaguuuuccuucccuaucuuuggagacaauacggggucugacuucuaucuccuggcauaccuuuaacacuccuuuuagaauacuaccaccagcuauaccucccuuaaggucaucgacuucacagccagguuuguugacaucagauggacugauaacaaugagauggggcucugaaguaaagucucuuggggccacugguauuuucuucacuauauacucacagacaacuucaauauuauacuucaguugagcagaaauuggaauaauuggugccccuuucugcuaucguuccuugcacaaaugcgagauuuugcucauauuguuccuuagccugacuuucuuuuaccagaucaauuuuauucuguaagaucaaaauaugcuugaguuucgugauuucuacagcagucagguguucgggccaagggcaugauucauuacuagcuaucaacagaagagcugcauccaucucuacugcacuguucagcaucguagccaucaaaauaucauggccaggacagucaacaaaggaaacaugucugacuaauuugaaguucccuuuggcccccagaauguauguaggaaacuuaucugguguacugcuuccacaugaucuggucuaggacaacuugagucaucaaaguuuauaagucuuagcaugagcauguccaagcuugaugguaauguuucuuucuagcucauuuuugaaucugacagugugaacuccagaaauaaccuucaccacgguggacuucccaugagcuccaugaccaguuguaacaauauuaauuguagcuugucugcugauaacuucacgugaaaguggugucaacuugguaacaucccccagccaucuugcucagaggggaaaggacguaucuuccuuuccaucugcucagcuaucuuauggugggacgaaggcugccuaaacuagaauuagaauuacaaauaaguuugcaucuuucaaauuaaauuuggcaucacaguggccuaaggguccagugaccccaaugaacaaaguaggaaauccugacccaugccacuaacaugaagcaaacuggcaaacaucaguuuagacagccauaggacaaauuccaaacaaagaauguugaugguucuggcugcuugagaacuggagauagguucucuggggcauggacauuucugauuugaagccaacauggucuacaaagagaguuccagaauagccagggcaacacagugaaaccuugucccccaagcccaucaaaacaaacaccuccuuccagugggcucaggaacacacgaaaaaaaacccacagaccacccauaucaacggaagggcugggccccugggggcgggcucgcgcacacuuccg

SEQ ID NO: 7818 - RNA, 3189 nt, Mus musculus
ucaaagcuggauagaggagggagcgucggugagaguccccuuaugcuguggggccugaagcgcagcuaguggagugaaagcaagagcacuaagacccgggugaguggaggcugggcacuuggaaguuaguucagugucuugaagcugaaguucugccugaccugcgacacuguaacugaagaaucaugcaaggauauaagaaaccuuagggaaugaaugauugagucaagccguugccagagcaacagaaugggaugaggucgaggcacugcaaccaaguucugucuccauagagguuguucaagcuggacaucaacauuccuagagcuacgcaccaggaugcgaaagcuguggucuggagggaacgcuuauauacagauuggccacggugcucucugauccuuaauccugccugcucugaaccucauaaucagaagacacacccuugaaccuagggugcaguucuccagaauuuucggguuaagaagggagaguaacugagcugggggagcggguggagcacagcgcucucaugaguccaguuggcuugggccucaagccauggcgcccaagaagaagcgcggacaaaacgcggggcgcaagcaggaaacuacagagcaaccgcucucggagcgcgcgcaguaccuacagcgcgaguacgcguugcucucagaaagccugguggccugugagcagcggaucgacgaggugcugcaggacaacgaguuccugaacagagaggcgcagcgccugcgcgaagagaaccggcuuuaugucgguuacgugagcgcgcacgcucugcgcugcgccaacgccgucgugcgcgucgaagaccagaaccgcauggaucuggcgcagauccgguggcagcgagcggagcuagcguccuucuaccacggccgugaggacggggugcgcgcucagcugcaggaaaugaagaagcgcgcggaaaacaugacgcagcgggugcaggagcuccagcccuacaaggccagugcgcgcgccccccgaggaccgggcgggcuccagagggaugggcgcgcucccuaccggugcgcugaucggcgcccccugcuccccaacccucaccccaccccauguaggagcugcagcuggagcagcuggcgcgaauccggacccuggagcgcgagcugcugcacaugcgcguggagcacacgcagcuccuccacggggugaagcgacgcuuccuagaugagaagacggcuuucgagcgggaggcgcggcugcaagugcagucccugacgcgccgcuccgagcgggaggccgcacguucccucauuucccacgcacaggcccucaaggcggacaacggguaucuccgacaagaacucaugagacuucuccagaggacccaguuacugcaggacaugcgacagcagcugcuagagcagcgggagcagcugcgccgggagcauguggacuugaagaaccuggagcaaaugcacggcugguugcaaaggggccccggggggccaccgcucuggcagccaccccaaagccuccaacccagcuugcgcaucgggucaaccagucacguuuuaaaagcccaggcuacgccccagucaguuccaaccucccggggccaauccauggaucugucacaccgacccuccaagacuccaucuauauuguccagugagucucuuccgggccuaucucagaaggcugggucagugauugcucuccggaguccaucacauccaggaucucgagucucaucucugacuccaucacgcaaggacucgcgugucucauccgcgaccccgucacgcaagggcuccaggguuccauccaugaccucugguaccuugcggucgcgcgagggcucucggaucucuccacagcccuccuugcgugaggucucuccagaaauugacacaccugcaaaguccaguuccaagcuucccacagcccuguuggaagaucaggccccucucagcccacaguuggaggaggcagaaaacgcugaagacgacacagaaacugucuuggagcaagccugaacccacacgaggaggcaggccaguagggcauaggguggaggacaaaccuuggaagauuucuuggugcauagauauguuaauaaaaguguuaaauaagcucugugacgcucugacacuugccugggucgaugcccuuguauuucaagugagcagaggccugcuauucgagcuacagcagagcugguuguauccuuggcugcuggaauucgauguucuuccaccaacagccagcaaggcaggcaggcuuagggaaaguuggguaguguaauuucagcagcagagggcagauucuguucucagcacagggagaaguuacugggcuuuuccaaugcuuuauauaauacgcacacacacauauguauguagguauguauauguauauauguauauacauuccaauuuagggaacacugcaagaauuauuaggaauucccauugccacccaucuagaugaacagggaugcauguuauauauuugguacuuucagccauccgggauucuguuggagacaguuaugccccuuaauuuuaaauauaucccuguguuuacugaauaggacuuugaccuguuuucuuccggugcuggguguugaacccagggcuaccuccugagcuacagcccaagcccugucccaacuuucuucaagacaugauuaaaauuaggaaaugcaccuuggagaaaauacuguaaacuaaaucauacuggccaaauugucccuguggugucuguagcuagcuauggaucuuaccugggucacaucuuacauuccauugugcuggucuguccuuuccuuuauagaaagggucuguauaggucaggcuggccuugaauccaagagauccuccugccucugucucuucagugcugagauuaaaggcauccaccaccaccucagccccguugucuugucuuuuuuuuuuuaaacuucuuuuuaaagauuuauguauaugagugcacuguaacugucuucagacacaccagaagaggguguugggucccauuacagaugguugcgagccaccacguggucaccagggauugaacucaggaccacuggaagagcagucagugcucuuaaccgcugauccaucucuccagcccucuuugucuuaauguacaagaccagucguuagagcacuccuuaacugaguuuuggagucuguu

SEQ ID NO: 7819 - RNA, 14088 nt, Mus musculus
caccuggagcgacuccucgaaacaggaggccugggaaggaagccucagaugagaguuggucuuggacccucagcuccaccccugggacuaacaggugggccacgugagggucccuuaggccuugcuuuaauuuaaagggggugcuggacucccaaucauggcaguagucaggucccacaccccaucccaggagccaagcuagacucuucuuuaucuagacuuuugaaggcucagugucuucaccagcccacgguguggcccaagugcuucaugcugggccuagggugggccuucaucucuggcaaacuccugucuggcaggguucguccggguaggccuggggcuccaguggucagcuggguugggaugaccuauggccagugagggucugggcaguuagggcuggcuggugcauuugggaugcagcucuuggcucuguggccaguuugaguuucccgcgaccagagacugagggugggguaaagggggggggcuuggugacacccaggcaggaccaggcaaguccucaagcagcaguuuagcuacugagagccgcccccaguuucucagucucccucccagucuggccagugaagucuguggccuguaaagucucgcacccugugucagcguguuagucagccuccucggcuagggugagccacugugccgccaaagucucuauaaacucucugguguggcccagugccacagagugggaccuguggggccuauaggcagagccagggcccugggcucugcuaccggggugcggagaucagccaagggguagcacagccacuugggacagcggggagcagagggcugaaccuggcugagagcaagcaaccucuuguggccucugggauguccucugagcucccuaaccaggccaguugaugagccaggccccuggggagcagacaucuggagaaagaggcacuggauucagggccaugucugggaaacgagggcgagcucgaaagccccgaggcaagagggugggcagggcccagcgggcagcugggcagcagggcccugaggcugagcccccgccccccaacacagggggcccucaggaccagguggggguggccccgacagagcacgugaccagcacucagccggcuccucagggacacuccagggccaccaggccagagcagcuacaggcagccuggaggccaguucaggacauugcuuugggauccgagcuggugcuggccccugagcacauggagggcuguggagcuggggcccccaugccagcccugggcccugaauugcugagacuccacgaaguccagcugugccuagcccaggagcagcugcugcuggaggaucggaggcggcagguccagcugcagaugcagcuguggcaggaggagcagcuguggcugcagcagcugcaggaggagcagcuguggcugcagcagcugcaggaggagcaggccugggugcacauggaggggcugcagcuggcuguggcccuggagcagcuccggagugagggccucgaggcacugcaaacucaaggccagguaaggccuagagggguauggggcaggggcucgggcagugacaguacaguggacacucaagcaucuuauaggugugugaaggaugggaagccagguuggcuguagaacgucugugggccuguccaccaagaggggcuagugcucacuacauaggauguugccugggugaaggacagcaagccugcccagaccacccaaugcuugguaggcaaggucauugagggagggaacuugcuuggggauggaggugucaggggaccaggauaaguagcuacaggagugguccagggcgguaggguguguguugggggggagggccgggugcacagcugauagacaacaucagaaccaagaaacagucccuaccccaagcauccuggacaacuucuccgucugguccacccgcccugccccguguuuacugcagcuuggugcccagggcuugagaucacagaggcagaacgcaaugcugguacccauuauccucauuccaggaggaagacuggccucagacgcagcuggggcuauuuugggcaacuaggaucucaccucagcguaguguggagucaccacugccugucagccccagggaaucuaagauguggggcugcgugugggucugggguggguccccugacagcggguacagacuccaggcaagcucggugcaagagacagucugggaagauguucacagcuguggcagaaugaaugggacucagagcagaggggcgauaaaggcugcaggaggguaggcacaggggcgagggagaccuuuuucugaugcucugcaggagccagcccaggcuggcuguaacccuucauccuuccuggaggugcuuacagacaaacagucugaaggggaaggcaggacugugggauggugaauagacaaccacuuagcaugaagauucccaacucagaaucaaggccugcuuuuucucaauauugcuuuguugcuguuguugucguuuccagacaggguuucucuguguaacccuggcuguccuggaacucacucuguagaccaggcuggccucagacucagagauccgccugccucugccuccugagugcugguggcagugugcgucaccaacgaccugcuucgauauuuuuuuuaagcuaucugccccuccaaucuccuccuuacccuaacacuguacccuccugagcacuguacccacaccccuucuccagcucuagaaguucggggugcaguggacaucugagcuuugagucacaaaucuaucauuccacgcccaacugaaagaucucuuggaaaccacuuggagagaaaggguuucugugugccuaguggucucguggucaguguugggguagugcccuggaggucagagggggcacucaccagcaguagcucgaagcuuggacccagggaggagcgccugccccuucccugaugcagcuuugggcccccccuucuuagugcucauucuccugggggugggaaggaaaaguccagggaugguacauucaggagggcagcgaacaaggcagugggaauacugccccggcccuggaugaacaugcagcaggagcauagaccuccagcaugucccccagccagcuucuugguccaccugcccgccccugguggucuaaggaugugcccaguagcucgaggaaggauaccuagcaagaggaugugucccuuuaugcugguacccccguccucuacaauucuggaucugccuguccuucuguguucuaacaccauccucuaaaucgcugggcuagaagcucaacagccugagcucugcggacuugcuuucaacuacugccaacgugggucugcugaacacagccccuccccacccgcaaacccucuuccuucuuggccuugggaaucucugcugucugguucuggaagcaaugcccuucucccuaguauacaaggcaggccccccauucacuccucuuggaagaacuuuccgcuccuguuuuaguagggucuuccagugcccuagaaccccucacagggccaaugaauaggaaagcggguagugcaaucgcugacuccauacacuuauguacccacuaggcuggggccgcagggcuccagagugcauuuggggauggaguuaaugaaauguuauccuaaaaguaggaccagaaagugacugaaaguaagcugucuuacggacaauguucaggcagguggcagacacugagaaucuaggacaggagaagugguagguaggaagcuggcuuggacaugugacugaguucagggcacggcaugcguagaggaguggguuggagggagggcuggguagauuagggcucuaggaggaacuaaguccuuagguguacgggugauguguuggggucgauacaaccaugagguucccugucuguagaggauccaguacuugcagcaucuugggugcagccucuuuuaaugugcauguauuaagacgggaccuuugugucuucaguugguuugcacaggaaaggaucagugggugccaggaccgacacuguuggagcaguuuagagagugauccucaugugagauggggacuugggggguacgauugguuugcgggauucuguguggcagaggggcuucugcuggcggaucacuccagauucccuugugccugaggggucccauggguacgggugagugcgcaggaaccuuuaugguugggcaaaugaguggggagguccguggaguuccuaugcugucggucucaugcgcgaagaugagccugcggggaguggacuggggaaacuagaggugugucugcgaacgguagggcggucacuugagugagauggguacccaaacaccccccccccccccccccgucugagaccucaccugccucaccugccucucgcaacacagaggccagaagcuccgccccucgcgucgagcuggccaguuuccuagcgacuaagccggaacuuccgaguuaccccaacuuccggggcgagggucaggggucggcaguaggggcuuugagcgaucgguuuucaaauagguucaaggggcuucaguguccggaaagacgaggcucuagaaauccggagcggcgcuggccaggguccggagcgcagcucuggggcuccaccagagcgcucaggggucgggguuggggugugggcugggggcgccagugaagccacacugggaacccgggaucgcggccgggguccggggcgcggagggcgcaggaaugcgggcgcgucgggguggggccgccccgcccaggugcugcccggacaggcaggaggcagagcgcgggcggggcgggggcgggcgcgugaaucaggccgaacgggcgggcgggccgcggcggggaguggcugucggacggacgggaccgcgaggccgcugggcggcggugggcuccugcugccccugugccgaaaccccgcucaccuggccagguagggcucccgccccggagcgggccgggcacagcacggcggggcgaggcacacgggacgggaggcucgggccuccgcgcggugccaccugggucuggucucuggaccugggccgggcggugcagugagcgcgugcuuugggacugggugggagacagggagacugcgcuccggggcacugggugagggauuuuccagggucacgcuggcaaguaggagacugaacagugcgauucgcucuggcggccuagguauugucaggacaugaccuguaccuuucccggagccucuccccgagccgccaugaaccggggugucuagggcuggguccuuguguggaaggcagggaaaacuggacucuccuaacuccugaucucauaucccuggacuggaucggcagauaagauaccuggccuggguagccgcuaacuuccugggguacaguaacaccuuugggccuugcagugccuaaccugaaagcuguauaauucaucgacuuccggucuuccuagguucuucuugucccccacaaccccaauccuucuugaucacaaucauccugucauccucuuuguguaguagccuaagguccucaaccauggaucccccuuccagacccaggaacacuacuaccuccugccagacaggagaggaaagggucauuuucuugcccuacuuguggugaagggccuggggcuagcuucagguaggaggucaggaacaaaaaauuccugcugagucacugguuugggugggauaggcuccuuccuuaagcagggccccacuuggauaggcagaugucagugagcaggcuguuggauucaucgcugauaggaguggucaccgccccgucuaucgucaaggggcgauguguaccagugaaugauuguaagggcauuuaaggucgugugugacuucugugaggucagguaccacaguggccgcucaggacuaaggccacuucccaacccaugugucucugaggguucucaccacuggcuagacaguaucaguucucagucuuauacaaggaaguguccccucagcgugagcaugcuaggauccccagguagugugggaaugcugccuaggagagcuggcuccagucugagaccuguccaagcagacaggcccgcaucagaccccaggugcucugcuuccaucuccccagaacagugugccacgccucacauugcagacaggaaggaaaagcaacagccuuaggucagggcaaugccccagagggaagucggagcacucuucuuagggccaguagacauaggaguguccccaccuccaaucucugucacacuuggacuugcuaauguguuacgccaugccccuagggguggcagacacuguagcucccugggucauacacagcagagucccgcuggacccccaacgucauugaacaaguauccccuaauaccagagcugccauccugucagcaucgcuggcccacuccucaaggcacuccuccuccugggcagaaauacuucccuaguuuggacuaucauccaggaaccugugugcuaggcagggcaagagucccaagccauuucaaaccuguggagcaguggggaaugguaugagccugcccuaaggcaacuuccaggccagaggccaccagguuugcaggcguuugguugucacuucuaaugccuucuucaaccacaagcuucugcuacucgcacucauggcccagggaccuccugauguggacaugaacgguuucucgggcacauacuugccagugaacucagaccaggcuggaccugggcuagcccgugacaucuggcuuccaaggcacaggagucaugcucucucaugagcgcacaugcacgcacgugugugugcacacacacacacacaccagccacuagagaacagugauccugaggcaccugugaugggggacgcugacagagaacuugggacgaggcuuguagcaaagucuuccuucauucuuaguguauuagggagaggguggagauccggggccuuggguauuggcaauggcucuguugccaucaggaugggugagugagucugggaggguauaaagaagagacccuacagggaacugugaguucccaaggaacuguggcccagggagguuuuagcugaggugagacggaagcaagggugaagauuuucagagaggucgaagguugaggagucaggacagggagaucagugaagggacugugggcagaugcagguguggacugaggaaagagguguggguggggcuuaaggccaucaucccuggaugagucaaucugcacuccacugugcucaccuugggccagguaugaugucuugccaccccucccagcucugugcagugaaggacacaggcuagagcaaaagggggggggggggaaggaauaaucucuuuaacuggccugcauuuguaucuuaaccaaaacuuaucuuuacaggaaaagggaaccacagaguaaaugggccgugaauguauugacucugaaguaaggggaggugggaccucuuaccuguauugggguggggacaaacauuggcagucacugagacugauagaaacaaggugucagccccaggaaggggauuaagggcugaguaccacuggcccaugucuuaccagcuaggcacaugcuacggccuguggugcugcuucagagucugucuucacuggggcucagaaaaacucccgggcauaagcuaaacccaagauccagcagccacaucagccguguguguccacuuguggcaugagguaaguggguccuacugccccuaguuaaugcauuuuccugccccuccaggccccuggccccaacauggcccgucgcucccagagcagcucgcagggggacaacccacuggcaccuggguaccugccaccucacuacaaagaauauuaccgccuagcgguggaugcauugacugagggugggccagaagccuacaaccgcuucuuggcaucugagggggcaccugacuuccugugcccugaggaacuggaacacgugagccgccaccugcagcccccacaguauguggcccgggaacccccugaaggcaccccaucugauguggacauggacggguccucaggcaccuacuggccagugaacucagaccaggcugugccugagcuggaccugggcuggccccucacauuuggcuuccaaggcacagaggucaccacacugguacagccgccgccaccugacagccccagcaucaaagaugaagcucggaggaugauccgcucugcccagcaggugcauucucacgggcuugaaggauggugaaaggcagcccaagccggguuuugaagcaugaauaggagggugugggagauauaaaagcauuccuggugcuuaggaugccagggcuggccagccagaccucggcaguaggguugcccuguagagucugcucauuaucaccugggucuuggguagcggguucuguagacauuccaguaucuaggaucauggccuguacccagaaacucagggucuugcccagcugagagcaccccaccccaggcagcugguaaacugaaaaaccaaguguuuaagccaggaagacuggcucaugccuguaauccuagcgcccagggagguggaggccagccugggcuacacgguaacagaccaguccucauuaagaaacaggaacacuccuacaaaacccaggaauauuaaagagagguagcaaggccagaugguaaaggccuagcuucugccccuguuccaggaaguugacaaaccgcaccuugaccacuuggggucugaacacacggagcugcagauaaucccccucugaaugaagcacccuaaaaguauagccccugcuucugcuucaagcucccucaagggcuaccaagugucaauuuugugugugugugugagaccuucugcugggucccuucuuccccccaccucccaauucaugaccagucucuccuggggcaggcuaauggucauuuuuaucgugcuugugggugaaaauguggccagagaugggcaggaugaccaggcccuucccuccccgcugaccugauacccaccucccaggugguagcuguggugauggacauguuuaccgacguggaucugcucagugaggugcuagaggccgcugcaaggcgagucccggucuacauucugcuggaugaaaugaacgcccagcacuuccuagacauggccgacaagugucgcgucaaccugcaucauguggacgugagugaccaagccaggggaguggagggaaaauaucuuuggugaagaccugacuccccucucuuccaguuccugcgugugcgcacaguggcagguccuacuuacuacugccgcacugggaagucuuucaagggccaucuaaaggagaaguucuugcuuguggacugugccguagugaugagcggcaguuauagguaugcccaguggguugcccuuagcccuggcccuucccaccuaguccuccguggucccacuuccuucccauaaagcuguccuugccccagcccaccagcccaaccccuuucagaucccugauuauccaccuagugccuuuagccucuguggcccuauuuccucucccugacuccugccauccuguccacagcuucaugugguccuucgagaaaauccaccgcagccuggcucauguguuccagggagaguuggucuccagcuucgacgaagaguuccgcauccucuucgcacagucggagccacuggugcccucagccggggcgcuagcccgcauggaugccuaugcgcuagcuccauacucuggggcugggccccuggugggcguccccgggguuggagcaccaacaccuuuuucuuucccuaaacgggcgcaccuccuauucccaccgcccagggaagaaggccugggcuuccccucuuuccuagacccugaccgccacuuccugucggcuuuccgccgagaggagcugcagagaaugccugggggugcuuuggagccucacacagggcuccggccacuggcgcgcccaacugaggcugggccguucggagagcucgcgggcccccggggcuucuuccagucaaggcaccuggaaauggaugccuucaagcggcauagcuacgcaacacccgauggagcuggagcaguggagaacuuugcagcggcacggcaggugucacgacaaacauuccucagucacggugaugacuuccguuuccagaccagccacuuccaacgggaccagcucuaucagcagcauuaccagugggacccacaguuugcuccugcgcgcccacagggccucuucgagaagcuucgugcaggccgaccuggcuuugcggacccugaugacuuugccuuaggugcuggucaccgcuucccagaacucggugcugaugugcaccaacggcuggaauacgugccauccagcgcaucucgggagguacgccacggcucggauccggccuuuggacccagcccccguggucuagagcccaguggagccucgcgucccaaucugggccagcguuuuccaugccaagcaaccuugagacaaggccuggacaccgcuucggaggcagaaccugagcgcaggggcggacccgagggccgggccgggcugcgucacuggcgccuugccuccuaccugagcggcugccacggugacgguggggaggagggucuaccaauggaggcugaggcuugugaagacgaggugcuggcucccggaggccgggaccugcuccccuccgccuuccgcacuccugcagccuucccagcuaagggaccaaagccgggcucaggaagcggugguggugacagcuccgagcgagagggcccagaagagacaagccuggcuaagcaggacuccuuccgcucucgcuugaacccgcucauccagcgcagcuccagguugcgcucaucacucaucuuugcgucccaggcugagggugcuguugggaccgcagcagccaccacugaaaaaguacagcugaugcacaaagaacaaacagucagugaaacucugggucccagcggagaggcuguucguuccagcgccucggccaaaguggcggagcuccuggagaaauacaagggcccugcccgggacccuggcggugcaggaggugccgucacuuccuccagccacagcaaggcuguagugucccaggccuggcgggaggaggugguagcaccaggaggagcgggaacugaacgccgcagccuugagaguugcuugcuugaccugcgcgauuccuuugcccagcaguugcaccaggaggcagagcgacacccaggagccgcuucgcucacugcugcgcaacugcucgacacccugggcggcacugaccgccugccaucacgcuuccucuccgcccagggccgcuccuugucuccacaaggucgagauagcccuccgccagaagggcuugggacacaccagcugccuuauucugagccaaagggaaaccccaccccagcuuacccugagcgcaaggggagcccuaccccagcuuacccugagcgcaaggggagcccuaccccagcuuacccugagcgcaaggggagcccuaccccagcuuacccugagcgcaaggggaguccuacccaagccuacccugagcgcaaggggagccccacgucuggauuucccaaucggaggggcagcccaaccacaggauugauggagcagaagggaagucccacuucaaccuacccagaccgcaggggcaguccggugcccccagugccugagcgcagggguaguccaguacccccugugcccgagcgcagaggcagucucacuuucgcuggggagucuucgaagacugggccuacagaggaggugucuaguggccccauggaaguccugcgaaaggguucucuccgccucaggcagcugcugagccccaagaaugagaggcguggggaggaugagggcagcuucccaacuccgcaggaaaaugggcagcccgagagcccccggcggcccucgcugagucggggugacagcacagaggcugcugcagaggagagaggcucgaggguccgccuagcuucagcuacagccaaugcucuguacagcagcaaucugcgagaugacacuaaggccauucuggagcaaauuagugcccacggccagaagcaccgcggggucccugcuccagguccagcccacagcaguccugacguaggucguccaacaacugcaggagacuuggccccagacauguccgacaaggacaaauguucagcuaucuuccgcucagacagccuagggacacaaggccggcucagccgcacccugccuggcagugcagaggagcgagaccggcuccuucgccgcauggagagcaugcgcaaagagaagcgugucuacagucgcuucgaagucuucugcaaaaaggacgaagcuggcaguaguggggcaggagacaacuuggcagaugaggacaccagggacaguaaaaugggcaaauuuguccccaagauccugggcacauucaaaagcaaaaaaugaucuccuggucucggaggccaggacucugcaucacugccauacugaaccuacaauacccaucuggagugguggcugucagguuagugucaaagcaguuugggaccuagcugacaaccaccugaacugagcuccacuugaauucgccucgcagccgcacugccucucacucuuggcuuuuccaugaggggcuuagccccuccaccuggugccuuuccucaucaccuacccccaccccagccuccaccaucuccugggcucaggucuacuuugggucauuauuucaccucagggauccaucucucugccuuaugcuccaguuuuucaagaacucuaucacuuugugccucaguucccucuuaaggccuuuuaucucagggcuuuuucucaggguuuccaucucauggcuccugguccucucccucuggugacagccuccucccauccucucaucucuaucucucucgggaacacaccuugccugcucccacucugacuccucacugccucauagcacuuucuuggcaucugcccucuuacuguguggauggcagaguuggccucgggcaguuuaagggaagagagggaugcuggcuaggacagacuguuggaaaguaauugcuaaacaccuagggcuccccacccuccccgccucaggccaugccugcccucuccagcaaguuucuggguagcacuugaagaggagccaagauuggggagcacugggcuuugcaguacaauaaaggaaucgggacagacguucugugaucccaagccucaguaaauuccuaagccaaagucuggacagaggcaugucuauagugugcccucagcaaaaggcagaaggucccugguuacuuuuuucuuaccacuaaggauuaauuuugaucuggaaugacauaaacacauggagagcccccacacacacagagagagagagagagagaagcacugagaaauaugugucugcuaucuacuauuuuuuccaaauaguuuauaccugugucuauggaaucccaagggggcaaagacaugagaacaaagccacuauaaguauuucugacuccagcagcuggagaagggaggguacugggacuuggacagugacccaauuugcccuguaacauaucacucaaaaauccccaaguuccuggccaggugcacacgguccccugggaacuaggugagccggagugcuuccuagucuuaacaugcucacugcuuggcucgucuuagggcacucgguggucugguguccugugcgucacugcucaugcucagaccuguugaacuuugcaauggaaaguggaggcuggcaguccuuccugggucccucugagcccccugacugugccuuuccuggagcccucugagccugcuggcugugcccuucacaccuuucugagaaggacauuuccugaagcacggugccccguguucugacauuaaugauaaacacaacacacaaauuccaacauagcccagugugggaggcagacgggagcuggucucuacauucuggggcagccuggaacugcaaguuccagaccacccagggcuacacauugagauccuaugcaaaaauaaaaggcaaaaaaaaaaaaaaaaaa

SEQ ID NO: 7820 - RNA, 22629 nt, Mus musculus
gagcagagagggcgggccuaggcuucccggcgggcugcgcggcugggcgguugucgcgggcagcggcggcgguuccggcugcggugcugcgggcggaugagcugcuaggugagcaggccgggcgggaugcggagccgccgccgcgcccccagcgccuaagaaagcgcugccgggucaggccgugcugccagcugugugccgccgucggagccuacagcucguauugaacgcgggccgagccgagcgccgaccccggccacaguccgggacccggcugcccgccccacccccgcgcgcgccgcuccgcccgcgcucggcgcucaugcgggccgagccccgccccccggcccgagcccgccgagcgccucccgagcccgcgcucacugcccgcccgcaucaugcugaagugcaucccgcucuggcguuguaaccggcacguggagucgguggauaagcggcacugcucgcugcagguugugccagaggagauuuaccgcuacagucguagccucgaggagcugcuccucgacgccaaccagcugcgcgagcuaccuaaggugagcggccgccgcaccugcugccccgcgcucaguucucggggugguguaugacuucuggggcagccggcuggagcgagaucucagcaggcgcugcccgagcugggcaccgcaaccuccagccggcccugcagguuccuacuggucagagccccgccccagccagccccacccuccuccagccgccgguguuggcaccugguggcaaccugucuggggacuaaguagauacugaaccuaaaaggggagccaacagagaagcccaugagagcacaggaggaggauggguccagggugcgagaccgacccggguuagcaacuguuaaagcuaguugggcuacuuuaaggguaggaaguugguuuucuugcacuguguucugccuucguuuugggaggagagguuugcagugcugagugggacucuccuaagauacuugcagugucagaucuauucugucaucgcucagcggagagcccaccuuucacugucuguguuccuuccugucggguuuguuugggguuuuuuuuguuguuguuguucugaggccacacuagaaggaaggccaaaggaggcagguuauguaggacuuacuuuucugagauaggggacucaguggucugauauucuugccggcugguggcguugcggguguucuucauagaccuuuaugguauccgugugugaaucuuggacauuuugcacuuguguuucucucuggugccuguuguuguuauugcuuuuuuuuuuuuguucuguuucuugagacaggguuuccccuucguaacccugguuauccuggaauucauucuggcuguccuagaacucagagauccaccugccucuguggguacuaaagaugugcaccacccacaacccaccccagugcucucugguguuuuuauuguuguucucucuuuguuaagcucuugcuguucauuguugggguuccugaagagcuccaaacuccuuuagaagagguaguuuggauaguagguaggauacugagagugacugacccauagggcagagggcaggggcuauccauuugggagcugcugaugucuugccuggggcauguuaucugggugacaucuggguaauagugagaggugggcuuuccaccgagaaaugagagcguaggucugacaguaucuuaggagagucccccucagcaguugcagaguaucauugcagaacagcagugguacaugugacaaaugacacaagggagaccaggcaucaggugggcagggguguguuuugcaggcuucuuugucugguuuuucagcacacuggguaucauggcuagagccgcagaaccuugugugaccugggauacaaagagguccaggacccuguggccaugauccuccugguuuggaaacucucccauacccauagggcuuuggcuauagagccuguuccccugaucacaucuucugcccacagcccuucuuccgacuguugaacuugagaaaguugggccucagugacaacgagauccagcggcugccuccugaaguggccaacuucaugcagcugguggagcuagaugugucccggaacgguagggggggagggcggguggcacuccgugaacauaggggggagcauaggggcuccugggagcuccugaggcgugccauccucacggcacccucuccaaacacagauauuccugagauaccugagagcauaaaguucuguaaggcucuggagauugcagacuucagugggaacccccugucuagguaaguguuagcccacagugcggguuggcucuuggccacggcagggucuagagcucuuccaugcguaucugaggccuguguugcuuuguuucuccagacuuccggauggcuucacacagcuacgcagccuggcucaccuggcccugaaugacgugucccugcaggcacugccuggagaugugggcaagugagugccccuugaugaguggaucuggguauaggcagugcuugucuugguucugccuuccucagcccugguccuuggucucuuucagccuggccaaucuggugacccuggaacuccgggagaaccugcuuaaaucucucccugcguaaguuuggggccuccacccagcagagguagagcuacccuggggcguggccugaguggccacaugcagauguugucuucuguacaggucccugucuuuccuggugaagcuggaacagcuggaucugggaggcaacgaccuggaagugcuggugcagugagggcugccuggggaagcaagggugugcuguggggcagcugcugcuccugggugucacacugcuuucuccugucuuuguccauucuugcagccugacacccugggggcucugccuaaccuucgggagcuaugguuagaccgaaaccaacugucagcgcugcccccgguaagugagggugggacuggcuuuauccccuaccugcugcccuuugaccuuuugucugucugcaggagcuaggcaaucugcggcggcuggugugccuggaugugucagagaacaggcuggaggagcugccuguggaguugggugggcuggcacugcucacggaucugcugcuuucccagaacuugcuucagcggcugccagagggcaucggucagugugccaaucaucagugaccuugugaggugccaaagaggggcuugggcuaggaucugacuuaacccagguuagagguguccaaagagggcaggugcaguaagcgaaggccaagaucagauacccauucauccaguuagcacucaggcgucagggcaguuuguuaugaaagaauugggauguagguuuccaagggucagggguggggaagagucucggaagcugagucugcaguaagaaggguggggccggguauggggagcauaagaaaucuuggagacccagagaagcccacugucacugaaaugugggaccaggcuauggccguucggaggaccuacaugcucaagugccuuugaccugauuucggucuagucaccaugucuccuugaugccaggucagcugaagcagcugucuauccugaagguggaccagaaccggcugugugaggucacugaggccauaggggacugugagaaccucucggagcugauccucacggagaaccuguuaacgguagggcagccccgaggcaccgagccucucagggugugaugagcgcggucagugcaccugaugggaguggcaugugcugcugguggcuuaucccaagggaggugcuugcuagggcacucuuggcauaugagauugccucggauccacuggacccuguagggguuaaagagcccguguguuguuucggacaugcagucugggcuuaagacuggaaagaagacaaaggcaaauuggacagaagcacgugugcuucauacaaauagggugagcagagugcuagggccagacuagagaugucugugcuagugugagucucaggcugagagacaguagcgagcaacuuuccugucugugggguacucacagucaugguagugagagaagagggugaugaggaaacgagcagcaggugugaguagcagguaccgugaguaguggaggaggcacagaaacguggccuugguagauugagcuggguggcuaugggugagggccagagagaacagucuagggugucagggagccuggcaggauguaugcuguccuuaagggggagagguggaggagggugccaacugguucuaugucuagauccccuaaccauaguuccuuugggcuguggggaacccugauagcuauggaguuuaccuuaagggagaccuuuacuuucccaaggccucccuuuuccuccuaauaaucagggguuucucucagccugagacccuuccuuugcccggcaggccuuaccccacucgcugggcaagcugaccaagcugacuaaccucaauguggaccggaaccaucuugaggugcugccuccugaaaucggaggcuguguggcccuuaguguccucucuuugagagacaaucgccuggcuguccucccuccugagcuugcccauaccgcugagcugcacgugcuugauguggcugggaaccggugagugucugugugaccccuggggcccagguggcauccugcugugugcugacugugcccuccuggccuccaggcugcggagucugccguuugcgcucacccaccucaaccucaaggcacuguggcuggccgagaaccaggcacagcccaugcuccgcuuccagacugaggaugaugcccagacgggugaaaaggugcucaccugcuaccugcugccccagcagccccugccaagucucgguagguugcuguuggcugggcccugaauggugggcggugaaacagagagcuuagcaugggucucugacucugccucccacagaagacgcuggacagcagagcagucccucagagagcuguagugaugccccucugagccgugucagugucauccaguucgaggacacccuggaaggugaagaggaugcugaggaagcugcggccgagaagcggguaugaagggguggggacugugggcuguguacuucugucccaccccugccugaccccuucccggccucuguuccucaucccuguccccauggcagggccuacagcguagggccacaccucaucccagugagcucaaggugaugaagaggggcauugaagagcgccggaaugaggccuucgucugcaagccugaccccagcccacccucgccuucagaggagguaggcgagacaggaucaggagcccuggguguccaucccuccuggcagugggagcuaugagggcagaggcuucgugagggaggggccugcagaugagcuggugaauggaucugggacugcacgggcaggcggcugcugaggguugugcuggacaaagggugcagguggguggcucucauguagucccucccuguggagucagaggaagguguagccuggugagggugucccagggccaagugcuaggcacgccaugguggcagagguugggcugagggaaggcuuuauucccuucauucucccaccugaaccugggaaggaguuaggugcuagaacagggcaggucauuugcuucuuguggagcuucugucauuggggcuggggcaugcuucuaggaaucuagacaguggcuagacgcacggggcgugcguguaccgacugugcauggcuacuucccaacuuagggcaagaacucacuugagguugauguccucccaggaucuuaguauuuauucuccugagucugggagaaagcauugccaaggucugagccauagaagcgugagcaugcaagacugcauucagacugggagugauuguaagaagugagccugcuggggcuguuagggcccgggcagcaggaagccuaggagaucugccacacgggguagccucuggguaacaaacuucugugcagccugacaucaccacuugcuguaggagaagaggcugagugcagagucugccuugaguggaggcucugucccgucagcaagcacagccucggaaggugagccugagauccugccggcugagguacaagggcuaggccagcaugaggccaugccugcacaggaggaguauacagaagacgacuauaacgagguaagagcagacaggaagaaagcccgcagggcagaagggcgucugggggucaaugcugcucauccuaucugugugucuuccagaggcagcugugugauuggggccacaccaguuaugggcugagcaauaaugagauauuaaagggcuuccucaggcaguuuugcagagugcaguacagggcagugguccugaggguuccugggaagcggguuccaggguagggcaaauuucacuucucagccaggcucaguacugucagauuuaguaccugugggcuuucccuaaacacugucccccacuucacugcccuggguauagugcuccccugcuaggucuuuaucuguuguuaaguuuccguuugcauuuccaugugugucugggaagagcagcaucuucugaucuuagcagcugaguucucuguaucucucuacacguacaguggggacuggucagucucaggcuguuaccugucggccccaaaccugggcccugagaggauugagccagggccaggcugccacccucaucuuucuucccacuuagcccacagugcacuuugcagaggacacacugaucccuagggaagacggugaaagugaagagggacagccugaggcugccuggccgcugccuaguggccggcagaggcucauccgcaaagacacgccccacuacaagaagcacuucaagaucuccaagcucccacagccugaagcugucguggcccugcugcaaggggugcagaccgacagggagggccccacugcagguuggcacaauggcccacacacaccuugggcuccucgagcccaugaggaggaagaggaggaggaggaggagaacagggaugaggaggaaggcgaggccaccacggaagaagaugacaaagaagaggcuguggcuucugcucccucugucaagguuugucauucacaccccuaucugacccaggcucugcuggcuuguuagcaggcugcuuuggaaccugguggguagcagcauggaggacaucagcccuaaacugacaggcacagucaggcccuuguccagccuccuuggcugucagaagaaggguaaugaauguguuugcugugauuggccucgcuuaccauuucgucccaggauuaccugccauugaucuucgaaguucccggcagcucccugggccuaccugguugggugggaggccaagggcacuuggaagcugagggucccucugugucccgugcguuuggagggagucuuggacaaggucccccucaggagcugcuggcucucucaggauccuuccuaccucagccagccuagaggccuugcugcuggcccauggcucauccuguggcucuugugccuugagaagucuuuuugggauugcggcaaaucuguagaacaguggcaucucuuauccuuguguuugauuuugaugucucaaaaagagcuuacccacucauuggggacuccucgaggccagagaaagccccagcuauuaaaaguccaacccuuucccugagaguauaagcuguuaguauaugaucucugggaaaauuuugggcuuaagucagagacagccaggaauagagccuucaucuaagccacacuauauauguggucugcagaaaugcuaaugauuuuacacacuugggaguucuaggggguaagguccugacucagaucacaggggcuugauggguguuccucuguccugucuacucauggugagggcuggggaaggugguggcacuucccagcgguggcuaaccugcaugccucgcugcuccuguccuaacagggggugucguuugaccaggccaauaaccugcugauagagccugcucgcauugaggaggaagaggucuguacugcucgcugcugcucuaugcucugggcccggggcuacugcugaccuuugcuuccugggcugcgggcucucacuucuucccaucuccaugacccccaacucacacccucucccagaagaguuccugacagcugccacagaacugggguucugguuccacuucccuagggccuccugguccccacaguggggcaaccugcccuguaagggaugaauggagguauugggccguuuucauauccucugugagcugugagguaacuuuacauacaggagcaaggccgggcuucacucucuggaggacagcuagcuuuguacuacaggagcuagcucacagaaguugugccugcccuugaauggcaggagccucccugcuucuuucugcuacccaagugagcacagauacccagggaugagcugauuguagugucuacagccagcccuucugcugcugcaagaccagggcaucacgggucuuuucaugcaucuguguccacucuuguuuccaguuaacacucacgaucgugcggcagacggggggccugggcaucaguaucgcagggggaaaaggcucuacccccuacaaaggagaugacgaggugagcagccgccauccaguaaccagucuccagucuccagucuccuugagcccucuccugcgcacaccugccacucuugucucaggagauggccugcuuauuaguauccuuuagaaugugcugugugggucaccccagggugacaggucagcggguggucaucaagcaggauguuaggcgucugagaacaacuaacagggcaacugagcuguuuccucuacagacagcucuggggucagaaaaguuucucguaagcuugacuuguguguucuagcuucaugagcgagagccuucccagcacugagaacagcccuucuggccucgaagccugcuguucuuuacuguauuuggggucuuggcauccucuccagaggguaggccagggcugucuuuguacuguccaguggccucugcaccucucaccccauaaggagacggguuccugccucugccugugcucuuguggacugguccccacuuuuccuccagggcauuuucaucucucgagugucugaagagggcccugcagcccgugcuggaguccgaguuggugacaaacuucuugagguaaguagugaccccuugccuugcagcaagggacagcuguucccucuaagguccguagagucuugaguacugagacacuugggugucuccaucuuccccagaagucuagggcccaaugauaacugggucaggcuauugugcucuuucuuaaucaguaggcuuagaaguccucugucaaguucccucuccaucuggaucuagguuagugguagaucucugacuuacuaugcaugauacuguggguuuaaucuccauuucuacagaggaugggauguuuaaaaaaaaaaaaaaaacagcagcccucgggcuaggcaagaggcuccaggcagauucugaguagccugguggggucagaccucuguggaagcccuggagguuucuaucuggccccuuggccauuggagagcucuuaggauagcuuugaccuugcuguggagacaaggaugagugaggcagaggagggcucugggacucccaaggggaagcugcuguuccucgugcuuuccuacucagcucuaaucccagguccaccuaggagcgagcgacuggggcuggcagcuuaauaccuuccguguucucugccaggcagaugacagguccugagaaggaggcaccaguauagagugguuagccuggaccauguuacggaaacaaacacggaaagagcacacacacacacacacacagucugauguuaggccggcugugccuggaacuggaagcugauugugccauggcuguggccuuuugucgcccacaggugaaugguguagccuugcaggacgcagagcaccacgaggccguggaagcacuucggggggcaggugcugcugugcagaugcgaguguggagggaaagaaugguggagccggagaacgcagucacuauuacccccuuacgcccugaagaugacuauaguccccgagaguggcggggagguggccugcgccuuccccugcuccagccugagacuccuguaucccuccgucagcgucaugcugccugucucgugcgcagugaaaaggggcugggcuucagcauugcugguggaaagggcuccacaccuuaccgggcuggugauggggugagauaguggugugugggguauagagggggcuaucccugaugggcagaggcaugucaggucuccaguaucauggcuuuaguguggcuucuccauccuuacagggcaucuuuauaucccgcauugcagagggaggggcugcucaccgggcaggcacucuacagguuggcgaccguguccucucggugaguggggccggguguggccugacuaaugcuguuuguuuguccugcuuccuaucucugaugugagugucccugcagaucaauggaguggacaugacugaggccaggcacgaccaugcugucucccugcugacugcugcuuccccuaccaucucccugcuucuggagagggagacuggagggacuuacccaccuagcccucccccccauuccuccccaaccccugcugcuacuguugcugcuaccgugagcacugcuguccccggagaaccucugcuaccuaggcuguccccuagccucuuggccacugccuuggaaggaccauacccuguggagguaagacacccacccauguccuucucagucccagggcccucugucagaagugguguggucacucuaggcagaacgaaguacacagccuuucuuuuuaauuucaggguuuuuucuuauuuauucuuuucauauauuacaucccaaguguaguucccucuccucccagucccuccccugccucuuccuaucuccccuccuuccacuccucuuccucuucccuuccgaaaagagcaggccucccaugguucgcaucugaguauacauggcauaucaaguugcagugaaacuagauucaucccuucaauuaaggcuugaggaggcaauucaggagaggauggggucccaaaagcaggcaagagucaaacucagcccccacuccuauugucaggaguccuacaaaaacacuaagauacacaacuacagcauccgcagagguccuagcucaggcccacagaggcucccugggagcccuucugagcccugguugguagauucugggggcuguuugcuugugguguccuugaccccucaguacacagccuuucugcacaagcccgagaagcuagggcauccagucagccuccgugaugguuuccauuguacugcccaagcauaauccucuaucagcagccugcuguuacaugcugcuguccggaaggacgugucgauguugggcugugugcauaucuggguagcagacugccccacagauagggagaugggcagcauaggcccauccuuucuguccuugcagagcccauggccaguauguuggucccuuuaacccuugcccuguucugacugagguccacccaauguccccaggaaaucugccugcccagggcugguggcccauuggggcuuagcauuguaggagguucugaucacuccagccacccguuugguguccaagauccugguguauucaucuccaagguaaguaggccuggcaggcaacucugcaggaagcagcccgcccaggcacucagggauucugaguggauucucucuccuacccugcaggugcuuccucggggccuagcugcucgcuguggccuucggguuggggaccgcauccuagcagugaaugggcaggauguucgggaggccacacaucaagaggcagucagugcccugcucaggcccugccuggagcugugucugcuugugcggagggacccaccacccccgggcaugcgggaacucugcauccagaaagccccuggggagaagcuggguaucagcauccgcggaggugccaagggucacgcggggaaccccugugacccuacagaugagggcaucuuuaucuccaaggugagggcucuuucuucgugggaccguagauagguagcugcugcuggucucacacuguucucccuacaggugagccccacaggagcugccgggcgugaugggcggcugcguguggggcugcggcugcuagaagugaaccaacagagccugcugggccuuacccaugcggaagcagugcagcugcugcgcagcguaggcgacacccuuaccgugcuugucugugaugguuuugacaccagcaccaccacagcccuggagguuaguugucuacgcuggggacuagugcuggcugccauugaccuuuagagucugcacaguacugagcuuugugucagugauggguacugugucuaguaggcccuuugcuggucauuguacuggaggcuguggucugggcagguaggcagugcagagguggguuugucugucugugugaucagguccugagagaaggucucugagaaggcaguacuugagagcauguggcagcuggcugaaaggacaaggagcccugcccagucccccugaaucugaccucccaaagcaaaggcagcccccuagcccugcuggcccuuagggcaccccucuggcagucccuugguagagcuuacucccacuuucuggucacuggcuuuguuuuuguaugccacagggcaugggcacaggguagagagagcgucuaccgcucucuugcucccuggagcagaacaagaauagccagccaucagcacuaggccuaggcccaagaggcaagcgcccucuggacaggccucccucuaggcucuccaggugcaugcuucgucauuguccugcuuucucccugcaguccucgggaccccuccacaucuucaccuguagguccaaguaggucuugaaaggaccuucaugugcacuggcugccugcuguucccagacauccuugugagccauucuggucucuaguguguuggcggcuguauuaccacuccgucgguuuuaucgcuucaaccuuagggacguguagccacccuggguugguuggucuucuuguagugaaucuuuggauuagugacuuccugucagaugcuggcagaaagauacccucuggccacacacccugcacuuugucccggacgagcuugugaguaucacuuggaugggacacaaguuacuuuguccucccaucuagauggauacugggcuagauggagccugugugaggugcuacucccuugggcugaaggcugcccuugucccacuucuccccaggggacuccuguguccuggggaaguaucucggaugacuucacccuagagaagaugagcuuuuauuuccuuacauuagcacgcguauuuaaaagugcugcuucaugcaggcuucaguuuuugaguucggaacgacgcucucuggaaagagugaggaccucaguguuggagcugcuguggucccggguccccuuggcuaugcaugcgucuggucccugcugcuguaaccuaggcugcuccuacaguacauaggaggcucaugaguguagggaagcagcuguauagcuacgugugcugaguccugccaaggccugucuuggcuggaucuucgucugaauccugucugaagagcaaggcuagugagaagcuaugggcccaggagagcugaccaagagccuuugaggagcccuuuccugcccacgcagugucugcuguaaccaccgucccuucccucugucucaagaugccuuggcugcucuuuuguugcaagugcacaccuucacaucuucugcugccuaggcccaccugacagggggaguucacccugggccuugcauagagcuccgcuggcagcagccugcccuucgacccuucuugggcuucccagcaugaaguugagcuuuuguuuuccugaugcuucuggcuccaggguuuguuugaaacaggucucccuguguagccgagguuggccauccccuaagcccucucagguggcagucacauuugugugccaccguauccagcugugguucugccucccuuugaaaauggggugcuuugguugccaacauuuacagaauuuaugaauuaaggcuuuuccuuuagagcuguguauggguucugauuuuauuuuuguucugauuuuuaaaaagucaggaucucauauguagcucuggcuguccuggaacucauuaaguagacuagagugaccuugaacgcaccaagaccuaccuaccugccucuaccucccucccaaaugcugggauuaaaaguauucacuaccacgcccagcuguucuuucguccguccauccguccuuccuuccuuccuuccuuccuugcuuucucucuuucucuuuuucucuuuacuuucuuuuucaguaauuuuuuuuauucacuuuauauccagaucacagcccuccccucccaggcccacccuuacaagucccucucccuauuguccccccaccccuuggguaccaccccauccugggacaucagguuccagcaggacuaggcacauccucucccagagaggcacaacuaggcagugcagguaggugaacgggauccaguggcagggaacagucugagucagccuccacucccauuguuaggggccacauaaagaccaagcugcacaccagcuagaaguguguagggggcauaggucuagccccugcgugcgugcucuuugguugguggcucagucucugugagccuccauaggcccagguugguugaccccucugcuucguccaguucucagcugguuuuuccuaggagcuuuuccuuggaaaggcugggagaguaacacacccugccuuuucuacucauuugauuuuuuuuuucugccuuccccuuaaguuuuuuaagacaggguuucuuuuauguagccauggcugucccagaacuuaacucuauagaccaggccggccuggaacucacagagaugcgcccaccucugccucuugagugcugggauuaaaggggugcacugcugucgccugacauuuucccagcuuucuucuagacuguugguggucaaccgacuguacguuaacagugaagccgguggcuuacucggaauuacagugucucugaacugaccauuuucaugucccaagucaaguuaggccauagaagagauaagaguuuguccuuucagggacauuugugggaguugcuucuccccacccugucaauccuagggagugaacucaggucgucggccuugguagcaguugccuuucuccccccacccccagccccagccaucuacuggcuucucucuucucaaaauacccacuugagucauccgggccuguuugaccuguggaaucaguucgccagcuguuuaguagcuugucccuguaccuuucugccucccucaggcuuuugggugcuggcucuaccuugccugcccuacgcuaaggacugguucucucagggcuccugcaagguaccuagauguaggcucucgcuuguugucagaccugaggcuguuggacuucccaggcuccccacagcggcuggggggcccugaaaggggugccacggguuagcucaagcucaccccaucucaggaccgcccgagaggaccuacuucaugugguuucucaacggaaacuugauuuugcguucccauguguuugguguaaagagaauauuuucugcucuuacuccuucgcugagggucauguguucaucucucucaucacacuggccugucuuuccaaucagagagugcuugacuugcagugcuggcacucagggcuuugugacagugugacagugguugcagcaguguuauccacuguagaaacugcuucaccagcccugccccagcuagagcuaccuugaagaacaccugccucuccuguccucacccuccagucagucugaacgcugugcaugagugaguccucacaucuugcucuugugccugucccugagcaucuguccuaaggacuggcuccauccuggugguguccugcucccgucuuccugccugucacccagacuugccuaccacagguggacuguguacuugucaccauuuuguuucauuuaagaucugucauccugugugcaugaauguauguucacaguaugcgugcaugagcccauggaaauccgagagggcuuaggauucccccaaaaguggaguuuuggacaggcgugagccuccauguaggugcugggaacugaacccagggccucugcaguugguguccugcugaaccgucccuucagccccagucacaguuguuuaguuguuuauuuaguggucugauuguugcaguguugucuuaggggcggggcuucgccugaucccaucucugcuccagcacuuccugaccuucagacuugucccacaccuggcccagcugugggguuggccacuucuccgggagugcugaguucuucuagcgaacagaaaugucuagaagccaaggagaauauuacuagugcagugcuccugggguauuguggccagagguagggacaguguaugaauaguuacugugguuauuucuggggccauaggaagccucaggucacuucagggcauuguccaucuuuccagucaacaccacacgucagccuucuuacuggaguggccuuuucugaugugggaaaccuggcucccucacccuugcucuuuuuaccuucugcucagucucugugugacuguccuucccacuccacugagccugcuucucuugggccuccccagugucuuuuugacuaaauuauuccagaaauuaagaagggggcaccucguuuauuguuugaccuagugguuuugucagagucugagagagccaaauucaucucccaccgugaguguucugaccccguguauuuauuucuggugacccugcucucuguuaggcuccuuguguguucgguguuuacagugauuggucaguggacuucuguagacgcauuugcugcuguuugugucccugcuugucacucucagccucucgcucuauccucccagcugugagcagccgcucagugcuuucaguuggcucccuuggucucucuuuucagugcucucugcgcaggcagccagcuuugugucugagaccgcauagcauaguaggaccgcucguggcagccaugugcuguccucuugccuuuggcucuccugucuccuauuccugugcuccuggugagagaggacugagcuaguccuugugcucugugggcuagaaggcaggcagugccacacacuucugccaccuguguuuauccuucaucucagcacaguuaggccaggcccugugcucucggguaccugcucccugccgagccucauucacagcagacacucaacgugcagauccucuuuccuucccacaguuccagucccagggccaggcuaggugacucuccccuuacaguguuugugaagucucacuuaguacccagacuccaucuucuagaugcaaacuacccaucugggagugacauucugcugccaagccuuugugauggccaugcuuccuuugucuccagagugaccauacucagcuuguuuuauccccauaccaagcaguguggcugagcauagcugcuuuacauuccugucaugugcagacaugaccaacacccacagugauaccaugaaccuaggaccacaaauccucuuugucccuggaaggcuggggacagguacacaagggucauggguggaccaacagguuguugagagugugaggucuuggguccaggccucagccugccucagaagugggaccucgcuagcaggucucuucucucagccuacuucuuuccuuucagguguccccaggugucauugccaacccauuugcagcaggccuuggccacaggaacagucuggaaagcauuucguccauugaccgggaacugaguccugaaggcccaggcaaggucaggaucaaaguggcuggcaaccugggacuggcccugagcuacuaguuccugaccaugucugcucugccaacaggagaaagaguuggccagucaagcccuacccugggagucugagucugcagagaccacggugagucccacacgggccuagcucagagcccaggguagacucuacugacaggacauugcaguggugaacacaucccagagguggcaggcagccacaucccuggaauguaaaucucuuagcagugugguccacucuguucuccagggucggaaucuagagccccugaagcuggacuaccgugcccuggccgcccugcccagugcugggaguuuacagagaguaaguggugcaugccggguguuacaccauggccugucccuaaccuguugucugccuaucaggcucuuccuugucugagggagcuacugcugcugccugugucccaaggccaccacgaagagagcuuuugucuuagaucaggcauggcuuguagcuaucagagcuguaaugcugccucccaguuaggcagcauuugaggguuuuguuguucuuguuuggcaguggggauacaagauggagccucuuggaugcaauagucaggcaaccaccacugaccuccauguccagcccuugucugucgggcuucucacuuuguggcauaggugcagaggauggccuuugaaagccccuaaccucuucccuaguaucuacccccaaagaguuggccuggcagagcuuaaccugcuacaggcaggcugccgggaagaagaggcagcugucauuccucacagccauccuggaggggucucaugaguggucaccauggagcgggugggcugaagcagcagcugcagccuguggaaggagagcucaugggugggggagacugagcagugcugacagcuggucugggaguggccacucgggccucaggagggauguggccuucaaggcaguugugggccugaggacaggcagaaaggacauuugguccccauuguucuccgggagguuugcaaaacuaucauucccagaagauguugggagaccauugccagaaugugagugcucaaggggugggcuuggccaggacauugagcagcagggggauagggaaagaucaggaagggccuggaugaggaaguaacacauuuggauuucugggugcucucucuucccuccccagccgcucuagcagagaagccagcaugguuugagaaaggggagcagcgggucuaggcugagaugcuucucagggucagguaccaguggugggugugcuuuugggucccagcuaucuaguuucaaucuguucaucuguucccagaucuccuuggagagcuuagggcugcacccuuggcaguaacgcacugcugugagcaggcaccuaacuguccagccuaggcccuggggagagcagaggaggcuagggccuuggagaaggaaaguccuuuacggaggccuccuggucauccaggccuaacuggugacaucccuggacuguggucagguuaggacacacaggagcugucucugugcugccaggauaaaugcucagacccguuccuucccugguagacugcuagccuaggugacucuccuuuccaaccacugccuucuuccucaagggaccaucugcgaccaccggagggaagacgacugaggcucccuguuccccuggcagucagcaagugagcaucccaguuacaggugccccacuggggcagcagauggguacugguaugcaggguccuuuggggugguggugucauacuuuuuuguccagggauaccuuucugguuaaaccugaccuugaugaaggcagggacacugcuggaguucaggcauccaaaagacgagcauaagaucauuucuguacaguugcccucuaugggucacgccugcucccaacauccccacuucauggagcagcauuccugacggugcauuauagggugggggugggcacagggccauucccgccuagcuccuagccucaacccugccaagauagauauuuggaugaguguguccuuguagccugcuugucuccagcgugcucucugucuuucucucucuccuccuccucuuccucuuccucuuccucccucccuccuccuccucccccccccuuucccugcuuucacuccuggaccucugauccugcucuccucugccacuguucccuucaccuuuacagacaaaaccgggggugauccagccauuggcucaggccuggccaaggaacuccccggcccccaggggcagagguggucccuguucugugaguguccuguuccguagugggugaggguggaacaguugcuuccagagcaggauggggaugugggucaguggugguuggaggauauggaggugggucugggcaguggcugcacugggaaagcugcccagccucacucguggguguuuccccagccacccuccccugaugaacugccagccaaugugaagcaggcguauagggccuuugcagcugugcccaccgugcauccuccugagaacagugcuacccagguaugugcaguggugcccugcugcuacugugugcucuauagagugggcacccaaggugagggccccaagagaaacagcagccaagucugagggcccacucccccucuagccuccaacaccuggucccgcagccuccccagagcagcuguccuuccgugaacgacaaaaguacuucgagcuggagguacgggugccucaagcagagggucccccaaagcgugugucccuggugggugcugaugacuugcggaagaugcaagaggaggaaggugaggagccuaacuugaggagaggccuggguggagcaaugaccuagccuugucugauaugucuuccuguccacagcucgcaagcugcagcagaagagggcacagaugcuucgggaagaagcaguaaccucagggccugacauggggcucgccucagacagggaguccccagaugaucagcaggaggcugagcagcccugggcugugccaagccaugcaggggggugaguacaggaggccaaaccccauuaccuggcuugucugcuucauccccuuucccacaaugagcccugucugcugcuccagcucuagcccaucaucacccccaccccugggaggcaacgccccugugaggacagccaaagcugagcgacgccaucaggaacgguuacgcaugcagagccccgagcuuccugccccggaacgggcccugucuccugcagagcgacgggcucuagaggcagagaagcgagcucuguggagggcagccaggugagugccucccuaccaccuaccagaucacccacacacacaagguccagucagcagcauccucuuugguucuacagaaugaagucucuggagcaggaugcucuccgugcacagaugguccuuagcaagucccaggaaggccguggcaagagaggacccuuggaacggcuggcugaggccccuucaccugcccccaccccaucacccacaccauuggaagguauguuuccaggggccagcggggcuccaccugcugggagaacuccuaacucuauucuuguucccuuagacuucggccuccagaccagugccuccccuggacgcuugguaaggagccuauaucuaagacccuucccccauacuguggccugaggcagcagggcucuagacucccccagccucaccucccuugcacucugccuuucccucaugcugucuuuucaagccuuugucuggaaagaaguuugacuacagggccuucgcagcccugcccucuuccagaccuguguaugacauccagguacuggaggccgcuuggcccaucugcacgcuccucccagcccauccuugccuguccccugccuguccaguccuuucugugcuuccuacuguuuccuguauguggggccucccuacccaccuuguuuucagcccaguguacucugaccaaugaccuaggcucugugagccuagccccagacagccacgccugcauggguaaguucaggcaggucugggaccugcccugaccagccugucuccccaucagucaccagauuucguggaggagcugaggacuuuggaagcaucucccaguccuggugaguaggcgccugucuggguugagugcccuccacccagaguucuggccgcccuuggcucacagccuacccugcucaaccaggcucccaggaagaagauggagaaguggccuuggugcuccuuggcaggcccucaccuggcgcugugggcccugaagacaugacgcugugcagcagccgucggucugugcggccgggacgccggggccugggcccugugcccuccuagggccaggugccuccccagacuuagggugggagccugccagcuucaucaccucccuuaucccaagucuguuagccuugguguuagcauuuuaaagagaccccucaggaguucuggcuucugauuaacugccccguagccgggaucucguggcgagacuguaacuagugauguuuguacaaccaaagacucuauuuugugguuuaagaagaauaaaguuaccuacguuuuaccuucu

SEQ ID NO: 7821 - RNA, 3893 nt, Mus musculus
ccaucuuugggucucugcugcuccuucugggcuccucuguaaagccgugcucuguggcuaauacaccuucccugcccacaggugguccagaugcagugcaaccuggaaagaagcgaggacaaggcucgguggcacgugagcaaggggccugguugagacuagggaagauggggaccaaucaacucuggcgccgcucugaccacgcccuuccgucugcagcuuacucugcucuuggugcuugaggaccggcuacaucggcagcugaccuaugaucugcucccaaguaggcugguaguggggucagguggugggcugaggcucaggcacuggcuagugccaugacucauuuguccuguguucucucuucagcggacagugcccaggaccucgcugcugaacuagugcauuauggcuuccugcacgaggugggcgggugcgcuuuggguguggaaaggugcagggucugccgagcugcccgguacuaccaugcuucccuacucauccacugcaggaugacaggacaaagcuagcagccuuucuggagaccacuuuucucaaguaccgagggacgcaagcgugaccuucccaguccugacggcccagcagagauacaggggcucaggguuguccacuuggcaaagagcccccacacugcucaaagcugccuucugccuguguucccuggaacugaacacaggcccugcuagugaagacacccccaccccccagcuuucugcagcagugugggacccugggguggugauggagcccugagccuggacgagaguggauacaggucaguuaggggaaccgcuccaucugguacuagacaacagccaugccuucagguggcauagaaaccuagggaaggagccugaacucaggugucacagugcugggcaucaggcagaccagaccugaccugauuggagaacuguagacuagauagcuuggaguugaacccauggccagggaauuccuugguccugcucagaccaguccugaucccuugcagaccugccuugagcccucuuucugaucuuccacacucuugagaccaggaccuguguccuccccaaagcccuugggaaggaucuuucuauucaucaucccucuggccuaggggcucaggggucaggcauccuccacauucccucccuggggaaguuguguguuugaguugaggauguggguuccuggcucccucuuucuccccagcccaacuugucucuuucuuacugguuucaaaguccugaugaacgcuuccccucagagccacccugguuuccuugguucuugaacugccucucucccaacuucaaaccaggucuuaaacguuuuuuaaaugcauauauaaauguaaugcagucacgguccuuuuuaaacacuuuguguaugaaaccaggaaagcucacuauuguauuaggaauaguuccacauugcugcuguuaacagauaucauaaacccagugguuugagacgacacacacacacacacacacacacacacacagagagagagagaguucuguacaucaagugugauccaggcucucacuagauuaauacccaggcuaaguuccuuucuggaagcugggacuuaccuccugcuccuucaagcuauuggcagaacucacuucccugcaaugguaaggcagaaaucccuauuuucucaacagcugccaacuaagaaccccucucagcuucuagaggccaccaacuuuucuuaguucuucuuucuccccccucaagaccagcagcgucaaguugaaucuuuguccugggcuagcugacuggcuugccacugcugggaagaguuggggccuuuugugaguagguuggacccaccaggauaaccgaggaugauccccuucucagggucuauagaugaaccacaccugcgcaguuccuucugcugucauccugggcuuuggugcuuggagaacagccgugggcgguggguguuguuacugugguaccuaccaugccaucuuaaccgaaaccaagaccuaaaauaaaacagauuugucaugggacaucuaauaaauuaaaugaacucugauuaugcauggucugacauaguuuauuuuuaaaauccacaacagacuguacagguaauuaaacugaauuugaaaacaucagugauguacuuuuuugguuuguuuuuuuuuuauuuuuuuuuuauuuuuuucuuuucugccucuguguagcccuggcuguccuggaacucacuuuggaaacaaggcugaccucaaacgcagacaucugccugccucugccucccaagugcugggauuaaagccaugcgucaccaucuggcuguucagcuuaucuuucgagauacaguuuugcuauucaguucugcuugccuagaauucaguauccauagcaggcuggugcugugauuauaggugugaaccaucaugccuuacagcaaacauacuguuuuaaaaguuggcuugccaggcagggucaauagugaauagcaaaugcaaucuacccugauuuuacaaaaauucaaaucucuuagccucagccuauguauuagucaggguucucuagagucacagaacuuacugaaugucucuauacaguaagggaauuuauuguaaugaguuauagccuguagccccaacuaacccaacaauggucagcugugaaugggaaauccaaaaaucuaguaguugcucagacccacaagaaggcuacuaguuucagcuagucuuugguauaaacuggaguccugaaaaaguaggcucuaacagaugugcuggccuuacuuugucccaggcuggccuugaacucagagaucugcuugucucagucuccuaggauuaaaggcuaccuuaccuggaccuaagcuuuccauggucacuaugccucaacuugcaugucaggguccagucggaagccuguauuuuccagccucaagaucuggaucacagguguacccuccuuuucuggauuggaguucauuccaagcugacaaccaggaauagucaucacagccagaaacucacuacauagaccaggcuugcuucacuuucacaugaugcuggaauuaaaggcaugugccaccgugcccccacaagcgcgcuuuuaguccuguuuacugguuuuuccauggugcccccacauggcagucuguagggcuaaucaccugcccacucucugccccagcaucaccccacuuugaugggcaucggugaugaguauuacaguuccaucagcguagguuuuagcagaggacaacguguccuacacuauauuuuccguauugcacaauuuuuuguuuucucugaaguuaauaauuuuccuuuuuaguucuuuuaaauggggugugugugugugugugugugugugugugugugugugugguggugguuguggugugugccauagcuuacaaggaggucauacagcaaccuguaccuguaggaguuaguuuuuuuuuuuuucuucccaccauuugggcucaagggguugaacucagauuaucaggcuugguggcaagucccccuuaacugcugagccacuccccagcucugcuccuuacuuucuguuugccauuaauucaucugugggcuccucucaauauuuaggaccaagcccaacugacuacccuucucuugcuggaucuccacugagugagccugcugccucuuccuguguugugguucaguccucagugugggcugcccugcaccaggaucuguccgcaugccucucucuccucuccgggacccaugcauuccucuucacuuacccccacuugaagcuucccagagaagaauggaugagaaauuauggaaucuuugccuguuuauccuuauucgaaucuuagacgugugaaacugugagaaguuuguuuagcugaaagcauucucuccuca

SEQ ID NO: 7822 - RNA, 6688 nt, Mus musculus
cugauguuuucaaauucaguuuaauuaccuguacagucuguuguggauuuuaaaaauaaacuaugucagaccaugcauaaucagaguucauuuaauuuauuagaugucccaugacaaaucuguuuuauuuuaggucuugguuucgguuaagauggcaugguagguaccacaguaacaacacccaccgcccacggcuguucuccaagcaccaaagcccaggaugacagcagaaggaacugcgcaggugugguucaucuauagacccugagaaggggaucauccucgguuauccugguggguccaaccuacucacaaaaggccccaacucuucccagcaguggcaagccagucagcuagcccaggacaaagauucaacuugacgcugcuggucuugaggggggagaaagaagaacuaagaaaaguugguggccucuagaagcugagagggguucuuaguuggcagcuguugagaaaauagggauuucugccuuaccauugcagggaagugaguucugccaauagcuugaaggagcaggagguaagucccagcuuccagaaaggaacuuagccuggguauuaaucuagugagagccuggaucacacuugauguacagaacucucucucucucugugugugugugugugugugugugugugugucgucucaaaccacuggguuuaugauaucuguuaacagcagcaauguggaacuauuccuaauacaauagugagcuuuccugguuucauacacaaaguguuuaaaaaggaccgugacugcauuacauuuauauaugcauuuaaaaaacguuuaagaccugguuugaaguugggagagaggcaguucaagaaccaaggaaaccaggguggcucugaggggaagcguucaucaggacuuugaaaccaguaagaaagagacaaguugggcuggggagaaagagggagccaggaacccacauccucaacucaaacacacaacuuccccagggagggaauguggaggaugccugaccccugagccccuaggccagagggaugaugaauagaaagauccuucccaagggcuuuggggaggacacagguccuggucucaagaguguggaagaucagaaagagggcucaaggcaggucugcaagggaucaggacuggucugagcaggaccaaggaauucccuggccauggguucaacuccaagcuaucuagucuacaguucuccaaucaggucaggucuggucugccugaugcccagcacugugacaccugaguucaggcuccuucccuagguuucuaugccaccugaaggcauggcuguugucuaguaccagauggagcgguuccccuaacugaccuguauccacucucguccaggcucagggcuccaucaccaccccagggucccacacugcugcagaaagcuggggggugggggugucuucacuagcagggccuguguucaguuccagggaacacaggcagaaggcagcuuugagcagugugggggcucuuugccaaguggacaacccugagccccuguaucucugcugggccgucaggacugggaaggucacgcuugcgucccucgguacuugagaaaaguggucuccagaaaggcugcuagcuuuguccugucauccugcaguggaugaguagggaagcaugguaguaccgggcagcucggcagacccugcaccuuuccacacccaaagcgcacccgcccaccucgugcaggaagccauaaugcacuaguucagcagcgagguccugggcacuguccgcugaagagagaacacaggacaaaugagucauggcacuagccagugccugagccucagcccaccaccugaccccacuaccagccuacuugggagcagaucauaggucagcugccgauguagccgguccucaagcaccaagagcagaguaagcugcagacggaagggcguggucagagcggcgccagaguugauugguccccaucuucccuagucucaaccaggccccuugcucacgugccaccgagccuuguccucgcuucuuuccagguugcacugcaucuggaccaccugugggcagggaagguguauuagccacagagcacggcuuuacagaggagcccagaaggagcagcagagacccaaagaugguaaauggucuccaagggaagucggaaaagcacgucuuacugcaccagcccugaguauuagggaagcuuccaagacagccuucgguuuggguccugaaugaugaauacaaugccagagaggggaugggggaggcagagagacagaaacagaaagagaaccguggaaagcaaagaaacgcugugccccgcagggugugacuguacagaaaaccaaggugccaccaggaggaggacaggaggcuggggcuuaggcugauuuccacuaguucucugggcaggccauguagacuacuggcaauugaauuuaggguguauugaggaacgaaggaagcuaugagaagggagaccggagcaauggcucuggauccagacggggaacagacguagccaaagccucuggaagagagcaugcaaccggaugggggaaggacuguaaaagcaagaagccucuggggaaaugauugugucgguccgguuccagcuuccacaaaggggucagcuuggauuuggucucuggcagccugggggagaacggggauggggagaggcggguccccagagaaaggcauccauuuccauucccugauuguggucaacuccuagagacagcacaguacagcaggaggugggacucaccuuccuggucuccgagucaaaggguucuggcguuggaguuuuggccuuuugggcuuccucuggggguggggccaacacacggggaagccccaagggccgagcagccgcaaaguucaucaguggauagaucccguuccuggggauagacaaggggguggguagcuaggugggggcucaggccugauagugcuuuuucuucagucucaugccagcucucaccugacauccucuaggaauuuguccagcuccaagaaggagaccucugaguaccuagaaugguguggaagguacaugagagaugucagggcaaagccuagccaagcagcuaggaagggaggcuccguuuggccacuacucaccgccacugcauuggggguccauggggcugcggcaucucagccaaaacugcauggagguccauggccuuggucuuuuccucuaccacauucucaggcaugaggucugugaacgacacaagugcucauggggauggacccaaccuaaggguccugcaaagacccuuccacuaccugaccccaggauccugacccaccccggcccuucugccccucacacuggugcuggaugaagcagugagcugccagcagcuucagcgagugcaccucaaagagcacucgguggaagaggagguugugggcugagggucggcgggcagggucccgggccaggcaggagaggaugaauuccuagguuguaaacaagaaagacaggugauagcuggaaaaguccucgcucuagaggagguccuucaagacucuagaccccaccgguccaaucaccacauccucccaccucagggaugcugaaagagccuuccuguaugaaugagcagagaagucaucccauuagcagcucaagaucugauucuggacacuugaggacaggcaagccuugggcuccaaacacguaugccuacuuccauucacccuuguggagucugugagcuucuggaagagucuuccuuucaggugggccuuaguccuccugcuacacucucagauguacugaccaggcugccccucucagauuuaccgaccaggcugccccucuggccugccuagagcacuucaaggguaagcugaagcaccugcagccagccccagaggggcaagguaagcugcucacccgcauguuggggucacucagugagugccuggcucgagcgauggccucuucugugacucugguauccccguuggcuuggaucucgaguacagccaucugggugcagggacaaauuggaauuggugggauggcguagacccuggagcaggggcuaugaggagaguggacaguaccuccagugcacacaucccgaaggagaagauguccacagcagucccaucauugacuucugaaaugggagaagcaagacagcguuggucaguucugaugugcuagcccgucagaugccugagagcagcucagggacucaccgccauacucuggugggaaaaagugcagguuucggaguucuucccguucagcucgaauagggcuccggagaucaucaggaagugcugaggaaaaggguggagcuaaacagacaaguuucuccaugguccccacacccccagagaccccacacaccauuggagaagaugcgguaccacacugcaacagccaacgcagagagaaagacaggaugucaguugggcggggagacugggcagucucuguccagggcucccgcagguuccccaccccugcccccugcccccugccccgccucgccagcaccggagccgaucuugaugaggccauugugcugaaugaagauggugucgcucgucagguucccguggaugauggggggacugcaggcgugcaaaaaacugcaagcauagaggaugagaggcaggaagaaccgggucagagagcagcggaaaggugcagagcagggggcaagcgcgugggcaaggccaggcucucaccugagugcagacaggaucugcguacaccagcgcuuccaggccuggcagcggacgcacgacuccgucgggugggcaccaaaaggcugcugagccugcggagcccgcccgcuaccccacuccugaaccgagguuuuucggagucccccgccccacuacugucccuaaguucugcuggacucccuccaguccccagcccacuccccauacccgggcguucauggccuugugguucuucuuggucuuuuugaggaacugcuugaggcugccagacgacacguauucugugaugaagaugaccugcgggcaggcgggcuccgccguugcgggugggucuccaugcugccccacccagccuguggcuucacuccgcccuucacccgccccuagcucacccucgcgcgggccucagaggcguccagccaauacuugugcagcuugacgauguugggaugguccaccagcgccagcugcucaaacauggucuggaucuucuccuggggaaagaggaugguuguggggccaaucaacgguauggggcaaagcggguauagacaggccucaccucaugggccgcaaaggccuuccuauccccgaagugaaguucguuccacaccacuucuacacccuccuccguguccauggccagaaaggugcucuggaucccgggcauguucccuugguucaccuaggugggaagaauguguguccugauacgaauagacccaggguguggacguggucuccgccacaaccuucccccagccgugaaugugcugcuagccuugcccagcucagugggagggcugaggagguaaggcugggaaucaagaacccagggggagaagggugguguccaggggcugggccagaagguacgcagguuuuagagguuggggagauccccagagcgguaguagggauccaagaggcacguggagguggucccaguaugacaccgguguucaaggaauggggguuucucaccagggcuuggggccaaagggauccgagggccuccagaggccagggcguccggggagacccucauacuggcucggccccacggaucccauggcuucuauccuuaggcuacgggacggcggcgucacccgcacccgugcccaccugcucccgccgcuucugccagcggccacacgggcucuccuccaggaugucgcucucguccucgcucucguccucccgcucgcgcucccggccucuccucggcgccggcuccggggccgccauggcucggcgagcccaggccgccgcccuccgcgcaagcccucgccccgcucccgcccgcccuggcccagcgcccagcagcccaaccuggagcccagcggagcggccgccgcgagcccuccucggcuccgggaauugggaggcgcgggcucgcagcggacccgagggaggagccgccccgccccuccggagccgccucugcaggccggugcuggacuguagcucgauccagggcggcagaaccccgccccaggcacgccucguccucccagaccacuccugcuucccccaaagcuccgccucaaagagacgcgccccucaaaggcaccacccauuccugcggaggccucuccaagguuucccaggcagcugugguucucccagcagacugugccuggccucuucgggaaccacuuuugcccaacucuugaagccaguucuuccagcaccgcaucccgauccugcucccaugacaaguguccugaacucggcccgauguagagagucugaauggggcaucaagggucaagggcaucugggggcaggcacuucagugguaagaaaccauauggucucagaaaugggaccaguucccuccucagguagccaaggaacgcaucacuaaagaugcaccgcagcagagacugaugggauacucuuuaaauccugacugccugucucuuccuggaccagaauuccgugcaaacccac

SEQ ID NO: 7823 - RNA, 6688 nt, Mus musculus
guggguuugcacggaauucugguccaggaagagacaggcagucaggauuuaaagaguaucccaucagucucugcugcggugcaucuuuagugaugcguuccuuggcuaccugaggagggaacuggucccauuucugagaccauaugguuucuuaccacugaagugccugcccccagaugcccuugacccuugaugccccauucagacucucuacaucgggccgaguucaggacacuugucaugggagcaggaucgggaugcggugcuggaagaacuggcuucaagaguugggcaaaagugguucccgaagaggccaggcacagucugcugggagaaccacagcugccugggaaaccuuggagaggccuccgcaggaauggguggugccuuugaggggcgcgucucuuugaggcggagcuuugggggaagcaggaguggucugggaggacgaggcgugccuggggcgggguucugccgcccuggaucgagcuacaguccagcaccggccugcagaggcggcuccggaggggcggggcggcuccucccucggguccgcugcgagcccgcgccucccaauucccggagccgaggagggcucgcggcggccgcuccgcugggcuccagguugggcugcugggcgcugggccagggcgggcgggagcggggcgagggcuugcgcggagggcggcggccugggcucgccgagccauggcggccccggagccggcgccgaggagaggccgggagcgcgagcgggaggacgagagcgaggacgagagcgacauccuggaggagagcccguguggccgcuggcagaagcggcgggagcaggugggcacgggugcgggugacgccgccgucccguagccuaaggauagaagccaugggauccguggggccgagccaguaugagggucuccccggacgcccuggccucuggaggcccucggaucccuuuggccccaagcccuggugagaaacccccauuccuugaacaccggugucauacugggaccaccuccacgugccucuuggaucccuacuaccgcucuggggaucuccccaaccucuaaaaccugcguaccuucuggcccagccccuggacaccacccuucucccccuggguucuugauucccagccuuaccuccucagcccucccacugagcugggcaaggcuagcagcacauucacggcugggggaagguuguggcggagaccacguccacacccugggucuauucguaucaggacacacauucuucccaccuaggugaaccaagggaacaugcccgggauccagagcaccuuucuggccauggacacggaggaggguguagaagugguguggaacgaacuucacuucggggauaggaaggccuuugcggcccaugaggugaggccugucuauacccgcuuugccccauaccguugauuggccccacaaccauccucuuuccccaggagaagauccagaccauguuugagcagcuggcgcugguggaccaucccaacaucgucaagcugcacaaguauuggcuggacgccucugaggcccgcgcgagggugagcuaggggcgggugaagggcggagugaagccacaggcuggguggggcagcauggagacccacccgcaacggcggagcccgccugcccgcaggucaucuucaucacagaauacgugucgucuggcagccucaagcaguuccucaaaaagaccaagaagaaccacaaggccaugaacgcccggguauggggagugggcuggggacuggagggaguccagcagaacuuagggacaguaguggggcgggggacuccgaaaaaccucgguucaggagugggguagcgggcgggcuccgcaggcucagcagccuuuuggugcccacccgacggagucgugcguccgcugccaggccuggaagcgcugguguacgcagauccugucugcacucaggugagagccuggccuugcccacgcgcuugcccccugcucugcaccuuuccgcugcucucugacccgguucuuccugccucucauccucuaugcuugcaguuuuuugcacgccugcaguccccccaucauccacgggaaccugacgagcgacaccaucuucauucagcacaauggccucaucaagaucggcuccggugcuggcgaggcggggcagggggcagggggcagggguggggaaccugcgggagcccuggacagagacugcccagucuccccgcccaacugacauccugucuuucucucugcguuggcuguugcagugugguaccgcaucuucuccaaugguguguggggucucuggggguguggggaccauggagaaacuugucuguuuagcuccacccuuuuccucagcacuuccugaugaucuccggagcccuauucgagcugaacgggaagaacuccgaaaccugcacuuuuucccaccagaguauggcggugagucccugagcugcucucaggcaucugacgggcuagcacaucagaacugaccaacgcugucuugcuucucccauuucagaagucaaugaugggacugcuguggacaucuucuccuucgggaugugugcacuggagguacuguccacucuccucauagccccugcuccagggucuacgccaucccaccaauuccaauuugucccugcacccagauggcuguacucgagauccaagccaacggggauaccagagucacagaagaggccaucgcucgagccaggcacucacugagugaccccaacaugcgggugagcagcuuaccuugccccucuggggcuggcugcaggugcuucagcuuacccuugaagugcucuaggcaggccagaggggcagccuggucgguaaaucugagaggggcagccuggucaguacaucugagaguguagcaggaggacuaaggcccaccugaaaggaagacucuuccagaagcucacagacuccacaagggugaauggaaguaggcauacguguuuggagcccaaggcuugccuguccucaaguguccagaaucagaucuugagcugcuaaugggaugacuucucugcucauucauacaggaaggcucuuucagcaucccugaggugggaggauguggugauuggaccgguggggucuagagucuugaaggaccuccucuagagcgaggacuuuuccagcuaucaccugucuuucuuguuuacaaccuaggaauucauccucuccugccuggcccgggacccugcccgccgacccucagcccacaaccuccucuuccaccgagugcucuuugaggugcacucgcugaagcugcuggcagcucacugcuucauccagcaccagugugaggggcagaagggccggggugggucaggauccuggggucagguaguggaagggucuuugcaggacccuuagguuggguccauccccaugagcacuugugucguucacagaccucaugccugagaaugugguagaggaaaagaccaaggccauggaccuccaugcaguuuuggcugagaugccgcagccccauggacccccaaugcaguggcggugaguaguggccaaacggagccucccuuccuagcugcuuggcuaggcuuugcccugacaucucucauguaccuuccacaccauucuagguacucagaggucuccuucuuggagcuggacaaauuccuagaggaugucaggugagagcuggcaugagacugaagaaaaagcacuaucaggccugagcccccaccuagcuacccacccccuugucuauccccaggaacgggaucuauccacugaugaacuuugcggcugcucggcccuuggggcuuccccguguguuggccccacccccagaggaagcccaaaaggccaaaacuccaacgccagaacccuuugacucggagaccaggaaggugagucccaccuccugcuguacugugcugucucuaggaguugaccacaaucagggaauggaaauggaugccuuucucuggggacccgccucuccccauccccguucucccccaggcugccagagaccaaauccaagcugaccccuuuguggaagcuggaaccggaccgacacaaucauuuccccagaggcuucuugcuuuuacaguccuucccccauccgguugcaugcucucuuccagaggcuuuggcuacgucuguuccccgucuggauccagagccauugcuccggucucccuucucauagcuuccuucguuccucaauacacccuaaauucaauugccaguagucuacauggccugcccagagaacuaguggaaaucagccuaagccccagccuccuguccuccuccugguggcaccuugguuuucuguacagucacacccugcggggcacagcguuucuuugcuuuccacgguucucuuucuguuucugucucucugccucccccauccccucucuggcauuguauucaucauucaggacccaaaccgaaggcugucuuggaagcuucccuaauacucagggcuggugcaguaagacgugcuuuuccgacuucccuuggagaccauuuaccaucuuugggucucugcugcuccuucugggcuccucuguaaagccgugcucuguggcuaauacaccuucccugcccacaggugguccagaugcagugcaaccuggaaagaagcgaggacaaggcucgguggcacgugagcaaggggccugguugagacuagggaagauggggaccaaucaacucuggcgccgcucugaccacgcccuuccgucugcagcuuacucugcucuuggugcuugaggaccggcuacaucggcagcugaccuaugaucugcucccaaguaggcugguaguggggucagguggugggcugaggcucaggcacuggcuagugccaugacucauuuguccuguguucucucuucagcggacagugcccaggaccucgcugcugaacuagugcauuauggcuuccugcacgaggugggcgggugcgcuuuggguguggaaaggugcagggucugccgagcugcccgguacuaccaugcuucccuacucauccacugcaggaugacaggacaaagcuagcagccuuucuggagaccacuuuucucaaguaccgagggacgcaagcgugaccuucccaguccugacggcccagcagagauacaggggcucaggguuguccacuuggcaaagagcccccacacugcucaaagcugccuucugccuguguucccuggaacugaacacaggcccugcuagugaagacacccccaccccccagcuuucugcagcagugugggacccugggguggugauggagcccugagccuggacgagaguggauacaggucaguuaggggaaccgcuccaucugguacuagacaacagccaugccuucagguggcauagaaaccuagggaaggagccugaacucaggugucacagugcugggcaucaggcagaccagaccugaccugauuggagaacuguagacuagauagcuuggaguugaacccauggccagggaauuccuugguccugcucagaccaguccugaucccuugcagaccugccuugagcccucuuucugaucuuccacacucuugagaccaggaccuguguccuccccaaagcccuugggaaggaucuuucuauucaucaucccucuggccuaggggcucaggggucaggcauccuccacauucccucccuggggaaguuguguguuugaguugaggauguggguuccuggcucccucuuucuccccagcccaacuugucucuuucuuacugguuucaaaguccugaugaacgcuuccccucagagccacccugguuuccuugguucuugaacugccucucucccaacuucaaaccaggucuuaaacguuuuuuaaaugcauauauaaauguaaugcagucacgguccuuuuuaaacacuuuguguaugaaaccaggaaagcucacuauuguauuaggaauaguuccacauugcugcuguuaacagauaucauaaacccagugguuugagacgacacacacacacacacacacacacacacacagagagagagagaguucuguacaucaagugugauccaggcucucacuagauuaauacccaggcuaaguuccuuucuggaagcugggacuuaccuccugcuccuucaagcuauuggcagaacucacuucccugcaaugguaaggcagaaaucccuauuuucucaacagcugccaacuaagaaccccucucagcuucuagaggccaccaacuuuucuuaguucuucuuucuccccccucaagaccagcagcgucaaguugaaucuuuguccugggcuagcugacuggcuugccacugcugggaagaguuggggccuuuugugaguagguuggacccaccaggauaaccgaggaugauccccuucucagggucuauagaugaaccacaccugcgcaguuccuucugcugucauccugggcuuuggugcuuggagaacagccgugggcgguggguguuguuacugugguaccuaccaugccaucuuaaccgaaaccaagaccuaaaauaaaacagauuugucaugggacaucuaauaaauuaaaugaacucugauuaugcauggucugacauaguuuauuuuuaaaauccacaacagacuguacagguaauuaaacugaauuugaaaacaucag

SEQ ID NO: 7824 - RNA, 2465 nt, Mus musculus
uaagcuaugguuuucugcuaggugccagggccaugucuuucccaauguccuuggcacuucaugguucucuccaucuggugcuaauggccuccagcucagggacacgucuuccacuuuguucccagcugcaccaccuucuuaggaagcagagcuuaguccccgccugcuucauguucuugccuguccucucaugguugcucucucucaucucuuagcucuguucucagcaccgguuucuuagauccaucuagaguaccgcauagucgaaucuguagcuuuaaccacuucauuaucugguccaugaacagaauuagcucagcaauccuuuccuucuccuccuccucugcuauuucuucuucucuuccucucuccuauucccccucccuuucaucugucugucugucugucugucugucuaucuaucuauuguuuuuuagacaggauuucucuguguagaucuaucuaucuaucuaucuaucuaucuauuggguuuuuuugagacaggauuucucuguauagcccuggcuguuccggaacucccucuguagaccaggcuggccucaaacucaagagauuugccugcgucugccuccggagugcugagauuaaaggugugagccaccacccgguguuucucuuuccuuuuuuacccuggggauccauuccacuugcuaagcaagcgcucuguccuccccacuguaucuccagccuagaaaucucauccuaaauguccuguuucugauguccagauuuuuucauagcagguaguuuuguuuuauggaugugguaaucaucugccuccuaaaaggccaguuagcauuucuuuaaaagcucuguuugaaagccugaguuuuuuuuuuuuuccuucaggaacagggguugguuggcugaggucuucucugcugucugagccuucuagugcugagaggcaauacaggcuccuggcuuggcuuuuuacuguugaagccugauuguugguccuaaauuuaggugagugggguggggguggggucuacccaccugcagggcucccuggaggaguuaggccuuccuggaagcuagcccucccgugucacucgucccauggagacagucacuguauuucucuagacagagcagcauggugagcuuucaaguuuucauguaaauccuaaauucuuccuuccaccagagugcugaguucagcuuucuccuggcuguuguagggauagauuccaaauaacuucaccucaacuaccauguacuuggcagguagaacgcgugucacacccauugcugcagcaacaguaccagcugcaccgggagcguuuaaugcagagcugccagcaacgcccaguggagcagguccucuaccauggcacuucagagucugcagugcucgacaucugugcgcacggcuucaaucgcaguuucuguggccgaaacgguaaggccugugccgggcagggaggugggccagccaugcuaaccccgaagacccucaccuuggugauugacucaccuguccugcccuguaggcacacucuacggacagggcguguacuucgccaagcgugccucucugucgguacuggaucgcuacucgccucccaacgcagaaggcuacaaggcaguguuuguggcacaggugcugacgggugacuauggacaggguucccgcggucugaaggcaccuccuuugagggucuccggucaggugcuucgcuacgacagcgcuguggacugccuucagcagcccagaaucuuugucaucuuucacgauacccaagcuuuaccgacucaucuaaucaccugcaagaacauacucccggguacccccugauaacucucuuggucucuuggaucucuuuccuggacauuugaccuaagaggccagcuucugguucccugcucuacaaaguccuuaagugucagagcugcccacgggagcacuccugucuuuggcuggauagacaggaugacuguggacuggggagggccagaccuaaugguuccuuggccugcucgaccgccaggggucagcagaacacggcaggagggagcaccgccagacacacccgucuugguuggaccgcgcccuagagggguucucugucuuugaauaaaccuguacuugaaaccaguuagaaggaccggcuggaacucagaauccgaccuguuuggggagugggggccacccacguggcuagggacgggucagcuguucacggagggugggggcggcggugggcaguggauccaggcgucuggacgcggugcacuccuacgaccucacgaucgccagcagcaucucuugucuccucacucaccgcccaccaaggugugcgcacucggugagugccgccugaucuagucauaucuucggcuccgguucugcaaccuccggguccaguacucuuggcacguagcccggucacgcgugaauccuuugcucguuuucggaggcgcccgggcagcgcagcucu

SEQ ID NO: 7825 - RNA, 24841 nt, Mus musculus
ugaccagagucugugggaaacuuuaauggccaugcacaauggccuacagggugaagugagccugggccagccgggcaccggguguuaccagaugaacauagguuugccgucaucgugggacagcugauggaggcaggagagcagcaggagggcguccgugagcuugcuggggugcacgguuuccaauagcacacgcugcaagaaguccaccguguagcagccaccuucagaugccgccagcucaggccgcucgcgcaggaugccguacucauugaccagcuguucugucagugccgggugcacccgcccguuguagccuaagcucugcagcuuguucaugaugcucacguaacgcugugugagcgucuggcacagguccucauccaacuugugauuacugggguuuagggaggccuguuggggagaguggccaucagggaccccccacacacacacaccccacccuggcucacaggcaggcgggaagagcaggggcaagggaggccgggggaaaggaaauugugaaguauugcuaugaggaugccaagagaggagaagccauggucccugaaagguccagagggcugggccugaggucaaggcacccaaaaacccaacucaggcaggcccagaggcuccccaaagcugcuagagacaugcaucccacuguuuuuuuguuuuguuuguuuuuuccuuccaccagcuaugugggacuauguggcuuccaguaugggggcacagggaguucuucauacucucagguugccagaccccagaguuugcaugcuuucccaagagcuaauagaaagcacuuaaccuggaauaacagacaccguucuaacagggcaggaaggucuuccugaacaucaccuuucccgaggcccccguggagucaagguacugacauuucuaccaagcacgcccaugcugacaggcugaugggacuuccaugugggaagacguauuuccacauagaagguggcaggucucuggggggcaccauggguauagcacuggcucuucagggacaguuguacucaacuggggacacccaccugaucucucugcuguguugggacuggugccccugguauauucacugggaaagucccuugguguguugacauuuuucugggcaguacggcaaacgcgauuuugugucuuuccuggagcuggggacccuauuauauuaaaucccuaucuguguacaucaguugcugucugcagccaagcacacuggaugauuugucuaagaaggcaaaucugucaggcagggaggagcacaaugagaaggccagugcgcuccucggauagaugcagggaagguggccuguggcauuuguugcuuuguauauuuuugcaaaaagaaguagccagugugaucuguggugaggaaagaauuaaggccugguagaaugcugaccuuuucacaagggccuggaucaccaagcaccagaagaagaaggaggaggaggaagaagaggaggaggaagaagaagaaagaagaggaacaggaggaagggggaagaaggggagggggagggggagacuacagagcuccagccuaagccuucucuagaagaccccacugugcucccagacaaccucugccaagcuaaggacuuugaucugaugagcuaagcuggaguucccauucaccuggcuccaggcucaucagaugaaaguccuuagcuuagguguggccuuuguuggaguaggugugguguggccuuguuggaggaagugagucacuguggggguggacuuuaagacccuccuccuagcagaagccagucuucuguuugccuucggaauaaauuguaggacucucagcuccccuuccugcaccaugcccgccuagaagcugccgugcuccugccuugaugaaaauggacugaacuucugaaucuguuaagccaaccccaauuaaauguuguccugauuaagaguugccuugggggggggggcgucccauaaucagucaccaaacacagacacuauugcauacgccagcaagauuuugcuacaguacccugauauagcugucucuugugaggccaugacagugccuggcaaauacagaaguggaugcucccuguggaggcccccaauggaggagcuagagaaaguacccaaggggcugaaggggucugcaacccuauaaguggaacaacaauaugaacuaaccaguacccccggagcucgugucucuagcugcauauguagcagaagauggccuagucagccaucauugggaagagaagccccuuggucuugcaaacuuuauaugccucaguacaggggaacgacagggccaagaaaugggaguggguggguaggggagcagggcagaggggaggguauaggggacuuuugggauagcauuugaaauguaaaugaagaaaauaucuaauaaaaaaaaaguugccuuggucauggugucuguucacagcaguaaaacuguguguguucugggauugaaggcauguagcaccacaucugguuuauguaguaucgcuaggcaagcauuucuaucagcugagcuacauggaagcacuaaguuuaaugcuuuguuucguuuuuuuuggggggggggaguucaagacaggguuucucuguguagcccuggcugucccggaauucacuuuguagaccaggcuggccucgaacucagaaauccaccugccuugccucccgagugcugggauuaaaggugugugccaccccugcccggcugaguugaaugguuuuuguaucaguuccauauaucaauuuuuaugaaguauauuuaauuucuugguucaacauuaauaaaaacauguauauauauuuuaaauuuuauguaugugucagucccugaguauguacacacaaaugcagggucccacacaggcagggguuuggaaaccuuuagaguuggaguugugagucaccagauauggaaucugggaauugaacuuggguccucuggaagagcaguacacgugcuuaaccauagagcccucucuccagcccaguauuuuaaagauuaaaagaauaugugggcaugguggcuaaugccuauacauauggaacuagagaccgagacagguacauuaacucagguucaaggcuagccugggcuacauaguaucccuacauaguaacuagggauacacacucauuaaggcuuugucucaacgaauaaguaaaucauucauucauucucugagcacaauggugcauguuugucaccccaccucucuggaggaagagggagggggaccacagcaagauuugggacuagucugaguuccaagccagcuacgcugcuuacucaacaggaucuugccucaacaaucaaaauauguaaaaaugaaaggacauagagggugggcacccucaggaggcugaggcaggaggaccauaggucugaggcuugaaacauuuuuaucaaaaggguagauaaaauauaacugccuagagaaacauuaugauuguucccaagaaaaauuaaauugauauacagguucuuagaaugccuaagagggcuuggauacguaagguagcuuggauaccaaagcaguauguagaagugaagucauucucaggagcccauaagcgguggucaaggcgcccuucgccacacaacauggcccuagucacucucacauggacacggacacggcgggacucaaggccccuaggauuaggaugcuaagagaaaagacacuccaaauaucuuccacaaaguucuucacaacuggguaggaagaaugagaacagagagagcuguggcccacuucuccuuggguuuaaaugacagcauaacugggcuggagagauggcucagccauuaaaagcauguacuguucucgcugaggaccaaaguuuaacucccagagcacgucgugcagugguucacaacuaccuguaacuccaucaaauaccucuggccucuucaggcacuuaaacugacacacacacauauaccaccaccacuagcgccccauagacaaaaauacagaugaaacuuaggaaaaaaaaaaaaaagacacagugguaccagugguaaucuauguaauuaggaggcagaagggucacuauaaguguuaggacaaccugggcuacguagcaagcccugggcaagccaggguuacacaguaagaaaaacaaaaacaagcauaacaaacaaaaacccaaacaagccaaaaaaucaacaaugaugaaaccaacucaagccaaaagaaaguguaacuguacaaucuaauuaaaaagacagccagauuuaguggaaagucaggguccuuaucaaaaauaucuauuaaauuucaacccacuaaaccuauacagcguuggagagugaguggcuuguagggacaauauuggcuuugacuaguguuagcaggucuggguagaauuuagggauuacaaccacugacccuggggguggggggagauggaaaagaagauacacugaaagggggaaauaaaauuugggugaacuggaaucaggugcaggugagacucaaccaaaggcccagccagguggguggggacccuugaagccaggggguaaauuuaugauuuccaaaugugaccacaggaguuggccuggaagacuccauagagggauauggcuagguaucagccuagcuccaggaggccacuuuguuuccgggaggguuucaguggagcuguccggaagaggaaggagagucucugggucacugcugacagaaguaaaacgagaugacucaggcucuugggcggaaugacaagcaugcugaggcaagagguccagcuucucacaacgccagguuagguggaacgccucuaaucccagcagaggagguagaggcaggagggccagaaguuuaaggucauccuugcuaggugacuauaaugccaacugccccuugguaucuuguggucacuguugcuacaccacgggacccucuuugauugaguugguggcuaaugauucuccacagaaaacccaggaacauggcugucuuguuauauagacuaaaugggaaggaacucuggccagccaaauauggcucuggcaggccuugcccuucuccauucccucugccuuacucaaaaccaucaaauuacauuccuaaagcuagcuaccaagguaucuugccuuauuuuggccacuuccuccuccugaagcugacaaccaaggucuagauauuaaaguguugaaguccagcaaucaaaaaaccccuuugguucacucgauucacaugcccaaccaacacaccacuucauccuagcccaucauaacacacacccucuccuccuccuccuccuccuccuccuccuccuccuccuccuccuccuccuccuccuccuccuccuccucuuccuccuccuccuccucuuacagucuccuccaaaauggacaaggagagcuggacccagacaaaggagcccucauagaugcaagucuaagagggaugcuggcaagcacugggcaucuucuuugcucuggcagcucugagcucucagaggcuguaccaacugaccaaagggaacuccuuugagaucuccauagacaggcugggccccucaaaagaaaagcacucauuuucugcuaccaucauguccacacaguccucugucuccuugucauuuuucucuugacccucagucccaggggcugccccuuuagcccuagagucauccugaugcagagugcacucugugucuugguggucucuggaguuagucagguguuuuugagcuggagagaagacacaucuuagcuuauaacuucuagcuugacugcugauaggagagucaaagacucaagaccaaacaaaaacccuugaggggcugcugagaagguucagcugguaagagcacuugccgcuuuuccuggggaccagaaucugguucccagcacccacaccaggcagcucacaaccgaggagaccuggccucucuggacaacccucccauacacauaauaaaagaaaaauaaaucuguaagaagauuuucuuaaaaacucaaacuuuugggcuggagagauggcucagcgguuaagaguacucuuaaccugcucuuucaaagguccugaguucaauucccagcaaccacauggugacucacaaccaucuguaaugggaucugaugcccucuucaggugugucugaagacagcgacaguauacucacauacauaaaauaaauaaaucuuuaagaaagaaagaaagaaagaaagagagagagagagagagagagagagagagagagagagagagagagagagaagaaagaacucaaacuuuaaacccuuaggagaaaauguugacuaaggaauacaaaauaguuucaggaguuucugcuaggggaagauuucuuucuuuuucuuuucuuucuuucuuucuuucuuucuuucuuucuuucuuucuuucuuuucuuuucuuuucuuuuuuuuuuuuucuuuuccugagacaggaauucucugugcagcuccucucugcccuggauugcacauuguagaccacccagcuaggggagaguuucuuaauugagacaauacaaauaacgugaggaaagacugacauuucugaacacauucaaauuaauuaucuaaacuaagcacaguggagccugccuuuaaucccagcacuugggaggcagaggcaggaggauuucugaguuugaggcuagccuggucuacagagugaguuccaggacagccagggcuauacagaggaacccugucucaaaaaacaaacaaacaaacaaacaaacaaacaaacagacaaacaaaaaauuguaucuagugaaaggacacuuuagccaagaaaaggcaagcuaagaaucagccuguggagcuggugagauaacucagugguuaagagcacugacugcucuuccagaggucaugagcucaauucccagcaaucacaugguggcuuacgaccaucuauagggggauaugaugcccccuucaggcagguggauguauaugcagcagagcacucauacauuaaacaaaauuuaaaaaacagccugugcaaucagaagucauuacaacauaauuuguacacaaagauggccuaagagaauaagcagcuggaaagccauuuucccgcugagaaaagcucaaauguauacagggauaggcccugcauggucucauauggcagggguauccagccaagugcagacccauauccccaguccuuacccccuugccaguucccugugguguucucagugagcacuggggaugcuggaggcagcgggcuauagaauucuuuagguuuguugauucagaccccagggguuggugcugcucagccaaagaccaacuaggagguggaagaggagugcucccuccucccuggaggaaaucccaucccucucucuucuagagucuguagcccacagcuaugggcucccuccaucucagagucccuccccauaaaugccugguccuucaguaccgacugagcuuacugccccauccgugaaggccgugaaggcuccucuggcaaugugggagacggauagccacacaccuggaugaucuucucugggauguuggagacagugaagccguagagacguacgcgcucugggaagaugcuggacaggauucuucggucuagcuggaaggcgauuucccccacuagccucucacagacuagcuguuuugugucugagaaugacagagggucucagcagggugggacuguggugagcaguccagaguauguaaugagggaaacggcaccacacucaugucgaucccuuguaguguuacugaccucggggauugucagguaacuuguuagacuuucgguggggcgucuuccgcuccaucuccacgacauucuuccgagacuguuccaucacgcgugaaccccggguaucauugacugaagccgaagaggaugaggugcggggcggggaugggagguuguguggaggagaauggggauugggcacaggucggguaggggauuggugcacccuggagggggaguuggaguggguguuucuugaaggggaaccguuuucagcagcuuggggggcaggagcuggggcagagcuggggauugugcaaggaggagagccuguuggggagcuuuggacaaaagugagggacauuugucccugggaaacacuagucugaguucgauuauccaaggugccauaaacauuuguugugagacuggauguggccaugguacgcauagaggggauguucuggaggggcgcgcccacaaacaugucaaggggcucuggguccugucucggcugggggugcucacuggugauugggauguggaggaguggaaaugagaggagggguuagagugaggcagacuggaagcaggaaucggcccacccagggcacccaauuaccuuuggaggugggagcugguccugcauaggcugagguuccagaaaaguuuccucggguaggcucugccagccgcacccuuggcgucucuggcugcccuauguuguuuaugggguugggcacuacguucugagcaacaccuagagggguagcuguggaggagagcaggggacuacucagagagacugccacugugccugccaggggagccaugauggggcugcucugagauacagccagagggcccaccagccggcugcuuguuguuagggaaccaguugaggucaggcccagugagcuggccagaguggucccuggggguacagucaugggacuagucauuugacuguucagggguccaguagagggcaaacccagagaacuggccaaggugacuccuggggaaacuguaguaggauuggucaguugguugcucauggagcauggcacaagauuggcaaacugguuguucugcaacaaggguauuuggccagacagcaguggguuaagaguagcagccaggggguucacaagggagccugcugcaggacugagcugugggguauucaacaugucagccagaggugccagugcuaccauccccaagucuucugagcagggcuccuuugcugcugcugaagcugggggcaggaauacaccuguggauacagaaagaacacaaagacccacucaugucuggucaagguaucugucugcugagcuggcuggcuugaccugcccucucugagcaucauuccuuagguggguuggaugagggcaucuguggaguagccagaggcauucagcacagagagcauucugugccacuuuagaggguucuggauguuggucugucccucucugccgccaaccccacaccagaagagcggcuccuaguggucguacucaaagacagcuaaccuggcucucuacuuuuggcugggaggagugagccgggccuuaacauuguagagagacuuguacccacugguaggaccuccaagggucagaguaggagagccucaugcugccuagggccgcacauagucuaccagacucggggugcagguucuugacagcuaguuuggacacagccaucacucagagaggcccagaaugguugcuggcgaucuuuggacuccuauagaggaauggggcagagaucuuauucuuuuuuacuucugaagcagaauucccuuaaugguuuuugggagggaaauuccuuggagacaugauugcugcaagggcagaguucaggagaguuuuuguaacuguacaauaauaauugaaaaagcaacuuuguuggguggugguggcgaaugccuuuaaucccagcauuugggaggcagaggcagguggauuucugaguuccaggacagccuggucuacagagugaguuccaggacagccaggacuacacagagaaacccugucucaaaaaaccagaagaagaaggaggaggaggaggaggaggaggaggaggaggaggaggaggaggaggaagaagaagaagaagaagaagaagaagaagaagaagaagaagaagaagaagaagaagaagaagaagaagaagaaaagaaagaaagaaagaaagaaagaaagaaagaaagaaagaaagaaagaaagaaaggaagaaacuuugauuuugcugagcugcagagauggcucagugguuaagugcacuggcugcucuucuagagaaccccaguuugauuccuaauacuuucucagcaggccacaacugucuguauuuccaggggauccaaugaucccuucuggauucugugggacuguauguaugugguacacaaacauauauucaggcaaaacauucauauaccuagagaaaaaaaucuuuaaaacaaaacaacucauuuaaaaaacuacuucggaaucuacccuuuuaaaaagauuuucacagcugggcuuaguggcacaugcuuuuaauuccagcacugggaggcaggggcggguguucaacagccuggucuacagagcaaguuccaggacaguuagaacuauacagagaaaucuugucucaaaaaaauauuuuuauuuggugugugugugugugugugugugugugugugugugugugugguggaugugcacacacagguucccauggauaucagaggcuucugaucuacugcagcugauguuacaggugauugggaguugcgaggcaugggugcugggaaccaaauuuagguucuagucagcauagucugugaucuuaaccucuaagccaucucucuagcccugaauaugcccuuaauuugugugugugugugugugugugugugugugugugugugugauacuagugauugaacccacccauuaagcaugugugguaagcauucuauuauugcgcuguucacugguuguuauuaauauuacuauuacuauaaaacaguaaaugauuacuauagggaaagaauggggaugcagaaaaaauacgagcugcuaauaacccaucucgugguuugaaaaucucaucaccuuggagaccgucucugcccauguguuucacacaagucaugggcugcuagguuggcaagaacuuccugaaaugggacaagccaccuggcuucugcagugacuacucaagcuaucauucuagugugaaaguagccaaaaaaaaaaaaaaaaaaaaccaaaccaaaccaaaacaaaacaaaaaaaaccacuagaagccagacagucucuguggccaaacaggagauaucagcaugaggcagccccacugggccagaaggguugucaaguggcagagauggguguguggaguguguggaaaaagagccugagcagaagauguauggccuccccagaacugcugcuccugcagaaaugguacuccccagggcaccugguguuaaugguacugaacugaguaccuguuguuacugguacugaacugaguaccuguuguuacugguacugaacugaguacccgcuguacuacgucaggguuaugcucaccuugugaggcuuguguaagaccuuggugccucuaugaaggauauuuaaaaggccuuguggagguuugaaugagaucagcccccaaaggcuuguauguuugaacaguugguuccuuguugguggagauuuugggaaggguuaaguguguggccuuguuggaggaggugugucacuugggacagacuuucagguuucaaaagacuugcaucauuucuccguguggcguucucucugccuacugcuuacuguuugagaugugagcucucagaggcuccugauucuguguguuccaccaucauggacucuaaccugaccucuaaacccaauuaaacaguuucuuucgcuuucuuuucuucuuucuuucuuccccucuucuuucucuuucuccuccucuucucucuccuccuccuccuccuccucuugguuguuaauuucaagacaaagucuuucuauguagccuuggcuguccuggaacucacucuguagaccaggcuguccucaaacucacagagauccacuugcuaagcucugggacuaaaagugugcauuaauccccucuccucucaccugcuaaaaucaagggcucuuugaaaaucacauucuguguagacuuucuaaaagagcugacagaaagcaaaagaagguaucaaauaucuauacaaauaagggucaguccugaaggaggcaauggauauaauaaaaucaaauauaauaaaaucaaauagugacuaagucuggucuuugauuaaauaagugaauuagcaguauuuauuauugggcuuuguguguguguuuucacuauuuucaauaugcaaauugugacuuuucuucucccuccccaccaugacuauugcagacuggcaagauagaucagccaguaaaggugccugcugccuagcuggguaaccuuaguucaaucccuggggcccaugaggugagagggagagagccaacuccuuguaaguuguccucugaccuccacaagcaugccaugguauguaugcauucuccuaaacaaacagaaauaaguauauagguaauaauguauuacacauauauaguagugcauuaaucuaauauaaaaauguauauaaaaugaauacuuuguaaaaaaaagaaaggaauauaacaaacaguauugggauuaaaauuauaauaacaauaauuugucuauuugcauuuaaauaagaaugauaagaaaaagguuaauuaagguguaaaaaaaaaaucccuugccaggcaugguggcacacaccuuuuucccagcacuugggaggcagaggcaggcagauuucugaguucgaggccagccuggucuacaaagugaguuccaggacagccagggcuauacagagaaaccuugucuagaaaagccaaaaaaaaaaaaaaaucccuuuggaaauauaauggcugacaugcccaucugaguuccaaaaaauaaagucucagggcuggagagauguggcucagugguuaggagcagucuccacucuuuguagcuuucaagcauccacaugguggcucacagugaucuggaugcuccaaaguccuccucagacuucugaggucaucaggcaggcuugcggucauuacacacaccacagccacacaaguaaauaaguaaacaacgccuuuaaaaaacagucucaagaggaccccagagcaaaagaaacuacacaaagcgccuggagauacuuguuagcuuuauuuuaaaaugccaaccagagaaaucuauuuugggcggcagaaagauagcucaaagaguuaaacgcgcuuacagccaagcauccggaucugaguucaaucccugggagggugggacugacucucacagucuguucuuugacugccacgugucuaccgucaaguaaauaagugugagauaaaaauaaaaagauagagagaagucugucuugaaaugcauuuuuuuuuuucuugguucuguuucuuuugucucgugaguagaucgagcaaaaacaaaacaaagcagcaugccuacacaaauaugcuugcacacagggccggggcauugcuugccuauugugcuugagaccguggagccucuaccaccaaaaauccccagcuuguacacagaugcuuguaguagcauaauucauaaaagcuuaaaauaaaaauaaauaaauaaauaaauaaaaaagaaagaaacucaaaucuaaaugucugcagacuggcgaauaaacaaaauguuuuucagucauaaaccccacaacaaaccuugaaaacguuacugaguggaaggaugcaguaaaugaucccguuuauacagacggucuagaaccggugaacgcaucagccauuucugaaagcucagggaacgcaggaaggcagugugcccucacucucgcuaaaggaccgaccucucuaaagaaccgaaguuucuuuuuagggacaagaguguucuaaaggugugcugauguuuauauacauaaaugaauauauuuaaaguuauuaaguuguauacuuuaaacauuuggacuggaggcuggagagauggcucagugggucucugguccugaguucaauucccagcaaucacaugguggcucgcaaccacagcuacaguguauuuauuauauacauaaaauaguuauuuuuaaaaaguuugaacugggugauauguaaacuaaucuuuauacaauuauuauagaaaaggauacaucaaggucacaggcauuuaagggaacauuuuuuaaaaaaagauuuauuuauuuauuauauguaaguacacuguagcugucuucagacacuccagaagagggagucagaucucguuacagaugguugugagccaccaugugguugcugggauuugagcuccagaccuucggaagagcagucaggugcucuuaccuacugagccaucucaccagccccuuaagggaacauuuauggcucagacaauuaagugcccauaguauagcccuccaggcucugcaggagcagacccuacucacauugaaaggcccggcacaaacauagcaaccauaggguuugaccuuagucagagccacugaaaccagcagcagccucaggagagagaagcuugaguuugggggacucuaguaagagggcaucacuuggggaaggaguucuccacuaaauagaaauguaccgccuuacccaccucuaagacacuucaguccuacacuuuugauucuaauuaaaaaaaaauggacgagccuuugaugcuucagcccuuuguuagaguuugaacagagccgauuagggaugauaaauucgaaagcuuaucuuuuuaaaaaguuuuauuuauuuauacaacugcccuauuuauauguaugccugcaugacagaagaaggcaucagaucccauuauggaugguugugagccaccaucaccugggaauugaacucaggacaucuggaagagcagccacugcuuuuaaccacugagccaucucuccagccccugguacacuauuauuuuaaucaucuagaauuagaagagauaaguuuguuacaucagacaaugggcuuaaaaagaaaagcacaccucugaggguuuaugaaggcagcuugccuugucuaacucuuugaucacuguggccuccccugaccacaugcuccaggucuccccgccugccuaccuugcuccucugcucuuucucacacucaccccugccugguagcuccaucucugggucuagaaaccaccaccccucuacuuuucagugccgcuccccaccccagaccggccaagccacggcugugcccagagugccugccaagucuuagagggacacccagggaucauggugcugggugggugggugggggguccugacauguggagucugaggcugagaggaaagaguauugggaaggagcgggagguaagacuuagcuaagacuuuccaauuggguuuucuacagagguggagggauguggagagagcaagggaagaugaaggaggauggcugagaagaagcuccucagagaagggagacauaaggggagguagauccugaggggagagacuugggaaaagagagaccugaagaggaagauaucccuagaaaagaauccugagauagaagguaaugagguacaguccugaggggcugggagaggggucccggucuugaaggagagccuugaggacagaagggucucuagagcagcauccuagguuagggaucugguaugggacaguguuuugugggaagucugagaguagacucaggaggguuagguuugggaucgugagucucgggguagagacagguccugugaguagguuaaaguucugagaugaggaaggaaguaggugggagguggcaccaggugggcauuaggguucuuuccuggaaaaaaaaagugggggugggggauggaguggaaggcugccccuggcuggagggagcauccacuggagcaggcagguaccacacagguaagguuagaaagcccagaagccuagcacuugggaggcagaggcagguggacuucugaguucgaggccagucuggucuacagagugaguuccaggacagccagggcuacacagagaaaaccugucucaaaaaaacccaacaaacaaacaaacaaacaaacaaacaaaagaaagccuagaaggaaaaggauggagaguuaggugacaguaauaaaauggcucagacuucuuagucauuuuaccucuguggucugucccaugucuguccuuguuagccugggccacuuggaccagcugucaccuauuuucauccuugugucucuuugaaugaaggccuugcuguguagcauagucuggccaagcauuuguaauccuccugccgcuauaucuuuucuuaaaaaauuauuuuuuauuuuuugagacaggguuucucuuuauaauccuggcuguccuggaacucacucuguagaccaggcuggccuugaacucagaaauacucuugcuucugccucugcauccugagugcugcuugugccaccaacugcccggccugccauauuuuuuguauugggguauugucagcuaccagccaccacuacccagcccaccauaucuuuuguacugggaguauuggcagcuaccauggugccugaacucuguggugacuucuguguggagaagcuagucugaucgcugggaagaggggccaguugucggcuacuguuuuguagucuuaagcacuuagcucucacuuuugcucucuuccgcuguucuaacguuccugcgugcauuuguccugccucacagagacagccuggggugggcaucugagcaaggccuggaggucucgggagcgagaagucugagcuuguucugcucuaauucuauucuuuaugugugugcuaaggucugaaagcugugucucucugggaagguuuuuccuuuggacagcccuccccaucuucccuuccgcucagccaguacagccuaucgcuagccuacauucuugcuaaaccaucaaagucuacuacaugccugccucggguuacuacuacaggaaaagacauaaggugcuggcuuaggccuuuggaaaucuuacaaaugacugguacugauuuagcuuuagcucacuauguaaccaaacaagugcuuccagguucucuucucaguuccuacgcucaucuuuauuucagaccuccuccuucuccacccuuauucuuguuuucuguuugauuuuuaaauuucuauuuuccugguguucugccugcacgcuugucugccugaggcuaugggaacagcuggcacuggaguuagagacaguugugaguagcugugugggugcugggaguugaaccuggguccccgggaagagaaaccagaaaccagugcuuuaaacugcugagccacccccuccagcccugaugguuuucgaaacagacgcucacggugucaucuugacuggccuggaacucacugugcagaccaggauagccucaaguuuacagagaucugccugucucuaccuccagagugcuuggaugaaggugucugucacuaugccuggcucuacucuugcucucagaaaaauuauuacggagaaaauugagucagugaaccugaaguucccauagcucccucccucccucagccuucauguguagucuuccuuuugcucuuuccuucaguccacaacacuucccccaaagcucccuuuagccgucuccgcuagcuccuuccaaauacaaauucaggccucugccauccugaaaagaaacucuggacuccuuuccucuuccuagcuaccgcucugucucccaaccgcccugugaaguuaacuucuguagucaacuugcuuggauuuagaaacacccagagcauucuagagcaugugguuucucacaucuguaauccuaguacuggggaaguggaggcagggugucaggagcucacagucaauucucagcuacauggcacauuugacaccagcuugaaccacaagagugaccggcucaauaugaaaaccaaccaaccaaaagucaaccuuuuaguuugucugugagggcuuucaaaaguggauuaacugaguggguaaaccugaauuggcucuggguugagcuaucuuguggccugggacccuagacugaauaaaaaggagagagcuaguugaguacuaguguuuaugucucucugcagacacaagugacucauauccuuaccacaaugggcaguauaaccucaaacugcaagauaaaauaagcccuuuuaccuuaggccaaucuugccauagcaaugagagaaguaauaaaauuuuaaagccaaacuuccuguacuaaaaagucacagccaucuucucagcacuggagaggcagaggcaggaggaacucugugcucugcagagugaguuccagcuacacagagauacucugucucaaaaaaaaaaguauuuuuacaccugugacugugcacaugcacacauucauaucacagcauguauguggaagucagaggaugacuuguggaaaucuggucucgcuuagcacaguguggagucuaggaacugaauaucaggcuaggcagcaagcccucuuucccauagagccagcccacugccccuguucuuucugccuccuuacuucaccucacucuggucaaugagguugaaaucacacuucuauugaagucauggauaccaaggcauuguucaagaaaggcuguggaaauauugugcacuucucuggcucagcugguugagcaacccuucggccuggcugacgccauuucuuuugaaauugucucuuggccuccaagacaacaaacuccugucauuuccugugugucuugucacguccuuugccagcuuguuucuaccugaucucacuaguacuugccagucucuuaccacuguauacuaucuuccaagguguccuuucuaguuuuuuuuuucuuuuauguucauugguguuuugcuugaauucaugucugucugagggugucagaucuccugaaacuggaguuauaaacagcugugagcugccacgugaaugcugggaauugaaucccgguccucuggaagagcagccaguacucuuagccucugagccacuguuccaggaguguugauuuuguuuguuuuagcuguuugguuuuucgacauaggguuucucuguguguagcuccauucuggaacucauccuguggaccaggcuggccucaaacuuaaagaucugccugcuucugcuucccuggugcugggauuaaggcuuguaccaccaccaccuggcuuugcuacguguucuuaaccccucugguggcuucaaucaccaccaacuuuugaauuuuuuuucuaucucugugugugcuuucaggguucuuguugcccacugucuccaaaacucucucuguggaugucuuacgcugaaggacgacauccuccaaaauuguacuuccuuuucuccagccucaccucuaacacugucaagagccgugggcaggaauucaaauggaagcccacauacugugugucagagagguuggaaguuauuauucaagcuaacacuuagacaauguucuucuuucuuacucugauaaauaggccucuguaaugaccuagaauaguaugcuuaaauuuaggauuauuguacuuucuggagugucgggcuaggaugugaucccuuaggaagaacucaugaucccuugguccagaggccccauccaccacccguuuuucccaucgucugggccuguaucacagagggccugguauccaugauuuugaguaccuacaacccauguauuuaagaucuguuccuaucuccccagcuguauuuuucccuguguuccuccugaguugagaugcaucagaacucugcuuaaagaaacaagguggucuuagaaagagaaaucaaggggcuugagagauggcucagugguuaagaauacugucugcucuuccagagguccugaguucaauucccaggcaaccgcauuguguguggcucacaaccauguauaaugggauucgauacccucuucuggaaugucugaagacagcaaugacauauagauaaaauaaauaaaacugaaaaagauccacgagaagaaucugaccuccugauaaaacccauccagggaagcaggcugugggagccaggcggguggggcggcccuguuaucccagcaccugacagguagaggcagggauaucaggaguucaaaauuagcuugggcuacaugcaacucuguaucaaaggccaaaaauaauugaaaaaaaagaaaagaaaaaaaucgguuguaacaagaaaguugagagagcauagugggagccugggacuaagagccaccgugugucuugggacaugccaccaucagucagcccuaguccuuccagucagacauacucugcacucuguauuuaucacccgucucucucuuauuuuauuuuauuuuaaaacaggguuucucugcagccccggcuauccuggaacucacucuauagaccaggcugggcuccaucucagagaucugccagccucuaccuccugagugcugggacuaaaggugugagacaccaacacccagcuaucuauccccuuuuacauccaacaguuaggauuuguuuuucuuacuacgcuguccacucgcaguucgugcuauggucgcccaccugaaugacuagaagcuucucuggaacucaucuccccaccccugacaguuguguuuccucccagcagauggagugaucuuucugggcacaaauguggcuacuuccaguaagaacucacgagccuuggcuuaucgcuuuuaggagcaaauccuuagcaugucauuuaauauucacagucgugaccugaccccugcugaccucuccagcugaugguucaccucucacugaccucuaucacgaacauucgagaacaguacuauacauacaggaacaaccuacacuaucagauauaaauacaagccccuacaccaugugcauucaugcguuaacacagcagcucgaacauuuucuuaacagccauaugggaauauuaacucacauacauauuuacagcauacccuccuccaagaguacaugcuguguucucacaaacuuauguguauguucuccacacauauucacacacauaugugcucacaugcacaucauguacuuuaguugcauacaccaacacuauguacccacauccucucaucauuucggacacuugggugcccacauguacucuuaugcuuuugucuaguucuggcucccgcaacacuagggucagaucuuugucuauaccacacuuucuccuuagaauguugcuuucugccuucauugccagcugucugaacuccucuauaaagaucugaaauaguccaaggcuugcuuucuuucuucucucucucuuucuuucucucucuuucuuucuuucuuuagcucuggcuguccuggaacucacuuuguagaccaggcuggccucgaacucagaacuccaccugccucugccucccaagugcugggauuaaaggcgucacuaccaucacccugcuuuucuuauuuauuuuauguguaugaguauuuugucugcaaguaugucuaugcaugacaugugccugguaccuaaggauuccagaaaauagugucagggauuggaguuacagaugguuguaagcugccaugugggugcuggaaaucaaacccagguccucugcaagagcacaaggcucuuaacuacugaaccauuucuccaggcccaagaauuuaaaaaauaaaccuaaaagccagauaugguugcaugcagucuguacucuggaggcugacauagagagauacccacuuagaggccaacuugggcuacauauugauuucaagaccaggcuaggcuauauaguaagauccuguuucaaaaucacaagggcgagggagauggcucaacgcacagaaacacuuaaugcaagcauggagaccugauuugagucauggaaaccuauguaaaagccagacgugguggcaugugucuaucaaaagcagaaccuagggcaucccccauaagccacagacuggguagccuagaguauacagugcaguggcagaaacaagagcaacccugacucuaacaagaugaagacaaggcccagcacauguaucugacugacacauguaucauggcaugcacaugcccucaauacaaauucauacacaaauacauacuuacaugaugaauuaaaaaggaguaaaaucuaaggccugaaguaggaagcugauaucuagcuuguuagccuaucgaacuucuuaaauguuauaccucuucaaugcauauuauuuuugucacccugacuggugguuguugguggugguggugugugguggugguggugguguuuuuuuuguuguuguuguuuuguuuuguuuuuuugaggggaggaguggggaugacaagguuucuuuguguagcccuggcugucccagagcuccuccguagaccaagguggccuugaacucagagaucuucuguugggauuaaaggcaugugucaccaccaccccacuuuuuuuguugguucuuguuuucauccugccuguuaucgcaguuauuaaugacacgacauuuaaaaauggaguugcaccggugcuuaugagcauugcuagggcuguguagcaugcccgcuacagccaggcguacugguaggaaauccagccagagaggagcaggcgaggaauggauacugcccggaaggacuucaaccucuuaguacaaggguucaaguucucaaccagaaguuagucuaguuagggauuaacugcugucuuuucuuuucuuuuugagacagugucuuguguaaucaggccggucuucacaucacuguguagugagaaugacuuugcauaucugaucgucuugcuucuggcuugugcaauugcgcccaguuuuacgguuagagaucaaacccagggcuccauucgugcuaagcaagcaacccuaccaacugcgcuccauccccaaccccuggugagacuauuuccagggauuaauuaggucuucaggauccuuagaagcuauuuucacucagagugcucucucgcacucacucugagggcugcaguagguggauugcccgaggguggaggggcagggcuugaagccugaagccugagcccaggaguugcagugauugcugugagucaggauguaaauaaccaacuuggcuuugggagcucaggaagagagagacucagggaggguuauuauucccaaaugccgcgcagagguggagaaggcacuuaggaugguauucauaaccuuuccagaacagcuuuguugggggguccacugccagauuguagaaggucuaaacaggcagagcaaaguccuccucuuagauaagagagaugucauggcuccucgggaacagagggagaagggcaggccgggaggguaagauggucugugacugagggcgggucgcuguagggguggauaggcaguaagcacucacggaaaaucauggacaggaaagaacacagccucuaggacaggaaggcuuguauagggagggacauggauauuauuacuacuacuaguguuuccucuucuggguacacguagaaucuguaucagcuguagcaucuacagucacgcccugggagcuugcuacucucagaagcucucccccuggaccacucuuugcacccagcuuccugccuuuucagcacucccuuccuauugcuauacucagccuuguagccucugucaucccuuggugucugaaugccaccucccucuaaccccaucccuaucccugggcucagugagggucaacaguucaacugcauucccgugaacgcuugcaaccccgcuggauucucuucucucauccugcucuggauagcucuagccccagggcuucuaucacacgcuaacaaacccuacaucucaacuuuagauccuggcuucucccccucagcuuccuucuggcugucacaaaauggagagaaugagccugugcugauggugggaacuggaaaaggcggaagacaagggaagacagggauguggagacugggaguaggugggugggguggggguugguagccuauuggacuuggcggggagaagauuuggauuccagagcugggcagguuuuagaugcugaugcugcuuggaaguuagguugaagggaauguagguaggaagcuccuauggggagauauuauggggccuagguuggccuuucauccaaugguccuauguucucauccugccucugucuguugaggccaauguccucuguuuguuuguuacuaucuaagcccuuucuccacaauuucuucagaccccagcauccuggcucuuccuuccucugugcagcuccuccauccuucccuccccgcuguccuuauacccaggccucuuauaguuacccugauguuggggagggccugccgcugccucaccaagcccuccggugaacccgcugaugcagaggccaccugccugagucuugaucgcagacuugagcuccugauucucccgaaugagccguaccagcuucuucaguuccucauuuucccgcaccagccucucuaucugaugccgaagccccucguaacuuguaaguagagacaugccccagggaaggggagagggugcagcccaagagagggcacugcaccuggaggcugcccagggcccggggccuugcccgggcuggaaaaggccaccagagucugcaagccuggucuaguaggcucuggguauugugaggucagagccuaugcccuccucuuugcccucugcucuaacaggcucugcucucugggccucuaggcccauguguugccuuaccucagccugcaaugucuugacaaggucuggccaauuauaauuucacgguugccucuucggcuguugucuuuacccuacuucaagcuaguugcugccccuggacuuucccuucagauaaauccuauaccacaucacuugccuuugucuguacaauuggcccccucaucggcuuuccacaggauguucagugaguguaggugucuucccuccagacua

SEQ ID NO: 7826 - RNA, 865 nt, Mus musculus
cauauaucaccgggcccagauuugguaccaagacacgcacaagacgacgagcugcgcggaggucgaacacuuccugcagacacacgaaguccaagcccauagguaauguggccuucagcucaccaccaggcacccuaggcggcggcugacugcauucggaaacccuauacugugacgauugaaggcuaucuagcagugcggccccuacagccucggcgcgcugcaggcugugcgacagguuguuaaaaugagccagcccguggggcaauaggcacagauuagcagugagaaagacaaagcagcgccggcgcucagcaggcggaugccagggcuguggccacacccagcaugccggagggggcugauagcagaaggggcggcgccagaccuggaggggcagccagagcgcaaggccgaccaacgcuaaggguaggccgaccaccaccagugguagcaacaccccacuuccugccaggacuuugaaccaccccaagcuuuuggaucggacgcuuggugcccagcagcccagcaacugguccagggaccaguaagucgggaaaagcagcacgcgggauaaacuguagagggcuugcagcacuggguucgggaaaggugaaggccucagggcguugggugucaggggccaguccucuuggggcacugggcuccuucgccgcgaaaugucagggagacucauugguuuccagcggcggcggaggucaagaccagguggcacaaccugugcgcgccgcuaguaaugcccggacgucccgcgagccugagugcuggccacuggccccacccacucagaacuucuguggcgguuggaaacgaacaacaauuuaaaaaaaaaaaaaaacccgua

SEQ ID NO: 7827 - RNA, 2632 nt, Mus musculus
gugaauagggauacaaaaauuuaauuuggcucccaaacggaaauagggugguugagugauugugucuuaacugggacagggacgcaaccuguguuaaaacuugcucuucuucucaggacgcguucugccuccacacgccugggggugggggcuauggagacccggaggacccagcaccaccaccaggcucgcccccgcuauauccagccuucccagagcgaggcaguguguaugaguaccgccgcgcccaggaagcaguaugagugcccccacaauaaagauccuuugagucgcaugguuauuggguuauugggcuccgcuccccccaugguggucuuucucgacauucauccccuugucugggcaccagcgucaggagcauaccacuugaagcuucaggcccauagccaagugguccgugaguccagcaaaggcaguacugaaugucaccugcuccgccuccugccgggcaggugucaaguugagagguguuuucaguuaaagcaagcccagcagcccugaggugaggcacuuacugggcucaggcgacucccggguacucugcgguaggugauguaguccagacgccggcccuuccaggacugagcuggguaacucccaugaaggggcccugacagguacaggcggcgccccuuuuccugucucagggcccuaggagagggacagcauuccugaggcuagggacguuucucucagcuggccuaguagugccuggggcucaaggaguccacucaccuccgaagcaucucuggggagcaggcaauggaguggcguagcauggaggaauucaagauugucccuguggaguccagggaagagcagacucagcagcaggccaccuugcugacagacaucccacagacuuguucucccaccuacccagcagcaguaccuaaggcccagggcuguuccuggcaaacgccuagccggcagggguccugaaagcagcugaagaguuuauggcccugcuccuuggcaugaucuguggagaaaagccguuucucagugggcagagcugggucucuuggcuccaccucaccccagcuucuuaccuugggagcaguugucaaaguuuagaucucccaggaggacgcugaaggcuacagccucaucacucugccgguucucagccucgaacucuuccacccauuccagcagcagcguuagcuguuugcagcgaauauguccauccucugagaggagagaugaaguuggcuuagcccagaguagggaucuaagaccucacccuguggguccugaucuguaaaccacccaaggcauuucuugggaugucuggggcagagaacauugggauguggggacagacguguugguaagguuaagggaccuacugccuucgaaggagagaagaggggcuaccuacccacauuucaaacccuccugcagggcucaccaacgggugcaugcaaauguguacaaugaagguaucccacgauggggugcccguccacgaugccuagcugcgccugcaacaccacccacaguuccaggucuucuugcucuccugguuaaaucuauugcuuacgcucuccccgcuagggcucacugcagccuggguuaguaccuggacugauaguagaccuuuggaggccauggcguccucgcgacgagcguuaggaaagcaacggaagguggcacgcagcaacggguagcgcgaggccaguagaagcccacugcccaguaccuugauguacggcccagccauuaagccaaaugugcccacaucauauaucaccgggcccagauuugguaccaagacacgcacaagacgacgagcugcgcggaggucgaacacuuccugcagacacacgaaguccaagcccauagguaauguggccuucagcucaccaccaggcacccuaggcggcggcugacugcauucggaaacccuauacugugacgauugaaggcuaucuagcagugcggccccuacagccucggcgcgcugcaggcugugcgacagguuguuaaaaugagccagcccguggggcaauaggcacagauuagcagugagaaagacaaagcagcgccggcgcucagcaggcggaugccagggcuguggccacacccagcaugccggagggggcugauagcagaaggggcggcgccagaccuggaggggcagccagagcgcaaggccgaccaacgcuaaggguaggccgaccaccaccagugguagcaacaccccacuuccugccaggacuuugaaccaccccaagcuuuuggaucggacgcuuggugcccagcagcccagcaacugguccagggaccaguaagucgggaaaagcagcacgcgggauaaacuguagagggcuugcagcacuggguucgggaaaggugaaggccucagggcguugggugucaggggccaguccucuuggggcacugggcuccuucgccgcgaaaugucagggagacucauugguuuccagcggcggcggaggucaagaccagguggcacaaccugugcgcgccgcuaguaaugcccggacgucccgcgagccugagugcuggccacuggccccacccacucagaacuucuguggcgguuggaaacgaacaacaauuuaaaaaaaaaaaaaaacccgua

SEQ ID NO: 7828 - RNA, 2783 nt, Mus musculus
cacuguguugcucucgcguggucugagcucucgucggcccgcaggggccgacgggaacggcggccgcacuaaagggggccgacauggcggcggcggcggcuucgcuucgccggacgguacugggcccgcggggcguggggcuuccaggugcaagugcuccgggucugcugggcggcgcgcggucccggcagcuuccauugcggacaccgcaggugaguccuggcgcgggccccgaccaucgcgcgccccucagcccugaaggucacggcggggaggcuccgggcgcgcgccggcaucggucuccugcguuccuccuacaacucgacgggguccccgccgccgggccggcacacccagaaagccggucugggugcccacgccuuggaguggcagggcauuguugcucugagcccagggucccacugugauggggucgggacgggagauugcagcgaagggcucgcccggagcgacugccgaagccggcuguccggaccuggcggauacccugcagugaccccagccugaccucagcggccugcaggugaccuugguccgcugcaguacucugggucacuuaggcuugucuccuggguuaaguuccacgagcauucuccauuugcccuccagagccgagccguggccgaggaguuggcugcaguaagggauccagcaggcauugggcacggugugugccuugggcgcucugcgugcggugguggccagugcgggguggagguggagcggaagacaugggcguucauucagauccccaggugggcugcuggggucuuggcaggugcugagcggggcucuugcaggcaguguccuuguccucgaagucuggcccuucucgaggccgaaaggugaugcugucagcguugggcaugcuggccgcggggggugcagggcuagcuguggcccuucauucugccgugagugccagugaccuggagcugcacccccccagcuacccauggucucaucguggccuccucuccuccuuggaccacaccagguggguguguugcggcggggcuggggguggaaguucccgggugaauucgaaucuucaguuccucuaauucuuuaucucuuuagcauucggagggguuuccagguauacaagcaggugugcucuuccugccacagcauggauuauguggcguaccgccaccuggugggagugugcuacacggaggaagaagccaaggcgcuggcugaggagguucggagggugggggggugggcacgaaagaagguggaggauacagggauugugguuucaacugugagggacuaaaagguugugaugggguucuugguggcagguggagguccaggauggcccuaaugaugauggggagauguucaugcggccagggaaguugucugacuauuuuccaaaaccauacccuaacccugaggcugcaagagcugcuaacaauggagcuuuacccccugaccucagcuacaucguucgagcuagguacuugggcugcccagaguauggggcuagaaagggagggaagccagcuucuguuagagacuaagcccugggucugguucuaggcaugguggugaggacuacguauuuucccugcucacuggcuacugugagccccccacuggggugucauugcgagaaggccucuauuucaacccuuacuuucccggccaggccauuggcauggcuccucccaucuacacagaagucuuggaguaugaugauggugaguguccuuugccauggguucucuccuacuccuagcaugcuucccugauauuucugagucuggagguccaucucccuucucaccuggagugcuuauugacugcauacuuaaagaggcuuuggggauagcuuucuuaguccuguaagguuccuauccaugugaagucauggauauggcuaaucccugccucugugcaccgaggguuacccuugauuggcccaagcccccaacaguagccucgcuauuuguucuuggcccaggcaccccagcuaccaugucacaaguagcuaaggaugucgccaccuuccuucgcugggcaucagaaccagagcaugaccaucgaaaacgcaugggucucaagguaaacgguugggcaagggucacagugggcaguugggggucuuuccugugucuuuucugagcucucuuuguucccagauguuguugaugaugggccugcugcugccccugaccuaugccaugaagcggcauaaguggucaguccugaagagucgaaagcuggcuuaucggccacccaagugacccuguucaguaucugcuugucaucuugccagaacaagcucucagcagcccaggaacaguccauggccuucucaggccuggcccuuuucaucagauacaagggccaggagaccagacucuugcuucugaucuuccuucagcccucagugugggaauaaauuaaguuucucaacauacacauuuuagcuggucaaugacuaaaacauuuuuucaguggaacccuggaacccauauuucuccacauuauuguuuccuguacugcccaguaucugggaguuauugauaugcaccagaaugcaaaaccuggcagcacuguuugcaugggagagauggcucagugguuaagagcacuggcugcuuuuccagaggaccuggguucaguucccagcacucaacaugguggcucaaaaccaucugucuccagucgcaagggcucuaacacccucuuuuggccuucaaggcacugcaugaauguaauacaaagcuguccguguagguaaagca

SEQ ID NO: 7829 - RNA, 2783 nt, Mus musculus
ugcuuuaccuacacggacagcuuuguauuacauucaugcagugccuugaaggccaaaagaggguguuagagcccuugcgacuggagacagaugguuuugagccaccauguugagugcugggaacugaacccagguccucuggaaaagcagccagugcucuuaaccacugagccaucucucccaugcaaacagugcugccagguuuugcauucuggugcauaucaauaacucccagauacugggcaguacaggaaacaauaauguggagaaauauggguuccaggguuccacugaaaaaauguuuuagucauugaccagcuaaaauguguauguugagaaacuuaauuuauucccacacugagggcugaaggaagaucagaagcaagagucuggucuccuggcccuuguaucugaugaaaagggccaggccugagaaggccauggacuguuccugggcugcugagagcuuguucuggcaagaugacaagcagauacugaacagggucacuuggguggccgauaagccagcuuucgacucuucaggacugaccacuuaugccgcuucauggcauaggucaggggcagcagcaggcccaucaucaacaacaucugggaacaaagagagcucagaaaagacacaggaaagacccccaacugcccacugugacccuugcccaaccguuuaccuugagacccaugcguuuucgauggucaugcucugguucugaugcccagcgaaggaagguggcgacauccuuagcuacuugugacaugguagcuggggugccugggccaagaacaaauagcgaggcuacuguugggggcuugggccaaucaaggguaacccucggugcacagaggcagggauuagccauauccaugacuucacauggauaggaaccuuacaggacuaagaaagcuauccccaaagccucuuuaaguaugcagucaauaagcacuccaggugagaagggagauggaccuccagacucagaaauaucagggaagcaugcuaggaguaggagagaacccauggcaaaggacacucaccaucaucauacuccaagacuucuguguagaugggaggagccaugccaauggccuggccgggaaaguaaggguugaaauagaggccuucucgcaaugacaccccaguggggggcucacaguagccagugagcagggaaaauacguaguccucaccaccaugccuagaaccagacccagggcuuagucucuaacagaagcuggcuucccucccuuucuagccccauacucugggcagcccaaguaccuagcucgaacgauguagcugaggucaggggguaaagcuccauuguuagcagcucuugcagccucaggguuaggguaugguuuuggaaaauagucagacaacuucccuggccgcaugaacaucuccccaucaucauuagggccauccuggaccuccaccugccaccaagaaccccaucacaaccuuuuagucccucacaguugaaaccacaaucccuguauccuccaccuucuuucgugcccacccccccacccuccgaaccuccucagccagcgccuuggcuucuuccuccguguagcacacucccaccagguggcgguacgccacauaauccaugcuguggcaggaagagcacaccugcuuguauaccuggaaaccccuccgaaugcuaaagagauaaagaauuagaggaacugaagauucgaauucacccgggaacuuccacccccagccccgccgcaacacacccaccuggugugguccaaggaggagaggaggccacgaugagaccauggguagcugggggggugcagcuccaggucacuggcacucacggcagaaugaagggccacagcuagcccugcaccccccgcggccagcaugcccaacgcugacagcaucaccuuucggccucgagaagggccagacuucgaggacaaggacacugccugcaagagccccgcucagcaccugccaagaccccagcagcccaccuggggaucugaaugaacgcccaugucuuccgcuccaccuccaccccgcacuggccaccaccgcacgcagagcgcccaaggcacacaccgugcccaaugccugcuggaucccuuacugcagccaacuccucggccacggcucggcucuggagggcaaauggagaaugcucguggaacuuaacccaggagacaagccuaagugacccagaguacugcagcggaccaaggucaccugcaggccgcugaggucaggcuggggucacugcaggguauccgccagguccggacagccggcuucggcagucgcuccgggcgagcccuucgcugcaaucucccgucccgaccccaucacagugggacccugggcucagagcaacaaugcccugccacuccaaggcgugggcacccagaccggcuuucugggugugccggcccggcggcggggaccccgucgaguuguaggaggaacgcaggagaccgaugccggcgcgcgcccggagccuccccgccgugaccuucagggcugaggggcgcgcgauggucggggcccgcgccaggacucaccugcgguguccgcaauggaagcugccgggaccgcgcgccgcccagcagacccggagcacuugcaccuggaagccccacgccccgcgggcccaguaccguccggcgaagcgaagccgccgccgccgccaugucggcccccuuuagugcggccgccguucccgucggccccugcgggccgacgagagcucagaccacgcgagagcaacacagug

SEQ ID NO: 7830 - RNA, 4084 nt, Mus musculus
caggagccaacccucuuccuagagugguccacgguuacgaagagccucugcugugcuuauguguguuugugugcauuggugccugguuccuuccgggaacugguauugucuuguguagggcagcagcugucguucguucgaaccuuuaagaaaaguucauccuugccuucuuuuugugaccggugaccggucugugacacugucucggguccugcugaaaggugacuagcuuggccggaccgugccuggagaucugggaccauuccuaucgcuuagcgagccaucaggcucugguagugcgcagcaucggguccuucuuguucuccaagcucuggggcauccggaaccgaggcucacaguccgaguuucuggccggcggaaguacucgacaguucucuaucacggaagcacucucggagagucaggacuccgccggaucagaaaugucgccgcccgccggcggugcggcaguggcugcagacccugccucaccuguggugcuccuggcagugcacgcggcggucaggccccugggcgcuggacaggaugccgaagcgcagccgcggaagcugcaauugauagcggacccugagcggccuggacgcuuccggcuaggacuguuaggcaccgagccuggggcggugagugugggcccgauucuggaaucaacuuucuuucgauuaccuugacgacaguccuuaagcaguuauuuuucuugauugccuguaaaagugggaauaaugcugauaccuaauuuacaaaucuugugaggaauugguaagauaacaggcgagaaaaguucagagccguaaagauuaccucguuccuuuuccuuucacauucguguggguaacgaagaggaaccaccgaccgaguacucuucccuguucaggucaguuuagaauggcccuuggaggcuauuuguuacaccguccgugggccuaaccaacacgagcugcagccucccccuggagguccuggaaccuucagcgugcacuuccucgaccccgaggaagcacagcagugggcagcacuggugcgagaugccaccgcagaaggacaaaauggucaguguugugaaauaaaugcuuauuugaauauguccgggccaccuggucgagguuggggguagugauggaaaagcugggcaccuaggaaggcuuccaagaggaaggaaguggagaaauaagagguucaagagcugaccccaguaccagacaaguaagaaaaagaagagcaagcauugcugcaggacuaagaguuuaaggaaaaugggauuguauucaguggaaaaacaacagagacuuaaagauagaaacuccacaguguagacaaggcuaaaggaggccagaggaucuuaggagauggaauugauaggucuugugguuguucaaauggaagaguuagugauuaugacugagcuagaagaaccacuuaguaugaggcuuauauccagugccugcuuggaaaagcauggacauggcugggacucuggagagguaaagacugggaguuggagaagucacccaaagucaccaggagaagcauagagaaaagagggccuuggauguagaccagugguucacaaccuuccuaaugcuucaaccuuuuaauauaguuuuaauacaguauggcccccagccauacauuuauuuucauugcuacuuuaauaacuguaauuuugccgcuguuauaaauuguaauguguaaguauguuuuccaguggucuuaggugaccccugugaaagggucauuccacucccaaagcauugaaacccacaaguugagaaccacugauguagauagugcccugguaagagguaggaaagcccacaaacaccggaggaagcccugagccugacaugagaccuggguaccuuagcauugaaagagagacuuucucuugucguucauuugccagauguguguacccaacccuuaauacuguucuuugugacaaggucucaaugugaauuccagguugaucucaaauucacuguguagcucaaguugguuuugaacugucagugacccucuuaccuguucucccggaguguugguguuauagauguguaccauccaacuggggacuacuuuuuuucuuuuuuccugugugugugcacacacgugagugugugucugucuguauuuguggugcgcauguauuuguauagaggcauacauguacauagcacauaaagaagucagagagcaauccugggacaaccucgagugucaguccucauuuuccaccuuguuggggaguuucauuucucuugccucuacccccaacucacucaccauaugaacacugggauuacagaucuauacuuccaugcuuggcuuuauaugguuuggggaauuugaacucucaggucuaugucuguaugaaaagcacuuuaagccaggcagugguggugcaugcuuuuaaucccugcaacucaggaggcagggaucuuugaguucgaggccagccuggucuacagugaguuccagaacacccaugcuacacaaaaaagcccuauuucucuccaacugagaguuguuuuuguuuugagggccaaggcugggagaggaagauuagccugaauuauggccuaaggauaguaggaugaggcagagaaggccaagguucuaaaaaccugagauuggauaccacuagccuaauccacaucuuuccucuuaggcaguggcagcccagccccagccccagccccagcaaugugccccauuucuccaccauguucuucuauggcucaaauaccuaaagcaacccaaccugagguggaucuuccucaaaguucuggaaacuucaaaaaagguaagacagauuggaaggaguuggggguuuguggcuggugucuaguugugauagcugucuuuucucccuuuagaagagcuggcuacacgccugucccaggccauugcagguggggaugagaaagcagcggcccaaguggcagcaguccuggcgcagcaucauguggcucucaauguccagcucauggaggccugguucccaccaggucccauaagguaaggccuggucuugcuuacucugccuuccugacccucccaaguuaacuguccaacacccuaaucuauauucugacccaggcuacaagucacaguugaagacgccacaucgguuuuguccucuucaucgucugcccaugucucacugaagauccacccacauugcuccauugcagcccuucaggaucaggugagcaugggcgucgggaaacgugcagcagggauucugggugagugacgcugccuagcccucauguucugaccucagguguucucagaguucgguuucccaccagcugugcagcgcugggucauugggcggugccuguguaugccugaacgaagccuugcuuccuauggggucucucaagauggagacccugcuuuucuuuacuugcucucggcccccagagaaguuucagguuaguacuuaaugggguaagaaaggugggguguagucuugagauggcccugagccuucucuauuauaggacaaagccuucaaaacuccaagauggaccggaaauuaggcuuguuuccucagucacuggggcugccucaugaccuccagccguccaguuccagucucccaagucccucucaggugggcaaauaaccagucugggugugggccagauaugggcagcugugggcauuggaagaacuagaaagcaucaacagucuucccauccuccuagccuggcuggucuugcccuuccugcacuuucaucaaugccucaaaccgcccuggcugugagauguguagcacccaaaggcccugugcuugggauccucuugcugcagcuuccaccuagaagccaccaaagguacaagagucugggggggggggugaggggguacaguguagaauaaacaggaguaaccuaucuuuuuccucagguuacagagaauauggcccuccugucacaggcccaaccaccaccacuugaacuuugcaggggacugaugcuuguuggggacagagaugccaguguuaaacaacaggggcuacauacaagcuaguaauuaaagacacauacgagccagc

SEQ ID NO: 7831 - RNA, 3087 nt, Mus musculus
cauucagaggagugggguugggcccgucggacgcuuguuguugucgggucgggggaggcggaggucgcuguuucguucucuggcugguacgaucucggcgguccgcggcagguuggucgcgaaagcgggcguugcaggggggcgaggcuaugucgcggcugcagcccguaugggccggcagggccuggaguaacgggacgucgccgcgaagcuucuucccccggauacagugcggcccgaguggaggccgcggcgccgcccuccaguccugaggaacccgcgcugcgcaaagcccgcgccgccgucaccucggcaccgacacuaaacaacccgucuacccuggcuugaucuagcccaauucuggcagguggguguccgccuugugcgccaagcgguccgggcuugcgggaaccacaguccccggcgggccucgcgcugcugcagugccucaugggacuuguaguucuuaugcugcuuggggcuggagcgccucucuuggugcacugccuccuggggcuuguaguuucccgcuacgaaucugcugguaccucuaggcuugcagggcagcaaugccaggagaccacuggccugcgccagcagagguggugugucugcccauccuacacacuucgacguacgaaguacgaauuaggcauacuugcaaauagaauugaagaauucauggguuuccuccucuugacaggaagcagugaagcaacccauagaacccgggaggagcacccauacaggugacccucaaggcuugaaaccccagaugccccguuccgaaccggauagcagguucuuauugaggaccuuacaacagucugaggaugccugcagaaugucaauggaguaggaaugucgagaguggguggggcccccagccagccccaguauauaguacuugagauugagguagaaccuggacaugccaugcucaugcauaggaucaucucccugucagccagugcugaguucucaggggcagguaaggugaggaagaugagcuccaugguggacucaagguuagcucgagcugcaaacaguacucugcuaguggguggaaaggcugaaaguggagcccuuuggagcuagguagccaugcuggcuucccacauucccagguagugcugcccuaaucccacuggcacaagaaucucccuucccaaaggacaugaagcuauuggagaacuccagcuuugaggccaucaacucacaguugacaguggagacuggagaugcccauauuauuggcaggugaggcuggaggcucuggggaucaaucugucagagaucacuaucgugggccucgggguuagcaugcuucaugacucugccugcguucuuuaggauugaaagcuacucguguaagauggcgggagaugauaaacauauguucaagcaguucugccaggagggccagccccauguguuggaggcacuguccccaccccaaacuucaggccucagucccagcagguaagcugagguggagacuaccuucugggguaugugggacagugggcaaggcugacauuuuucucuguucagacugagcaagagccaggguggugaggaugagaguccucugagcgacaagugcagccgcaagacccucuucuaucugauugccacccucaaugaguccuuccggccagacuaugacuucagcacagccagaagucaugaauucagccgagagccaagccuccgcuggguaaggaugaacagaagggccccaagccaugugguccuucucauugccauccccacuugguguggguucuugggcucucccugcugcccuggacccuugucaccccugacugucaccuccuguaggugguaaaugcagucaacugcagccuguuuucagcuguucgugaagacuucaaggcccugaagccacagcuguggaaugcaguggaugaggagaucugcuuagcugagugugacaucuacaggugggcucacgucuuugcagcugggcgugcacauguguauggcaguggagaccucaucccucugcuguuuucucuuuucagcuauaacccagaucuagacuccgaccccuuuggggaagauggaagccucuggucauucaacuauuucuuuuacaauaagagacugaagcgaauugucuucuuuagcugccgcuccaucagguugguacuuugccaccucaccuucuccaguucccucuucaacucagaucauuccuuaacugggucuacucucccuggggcagccugggaaaggagauccuaaguccgcugucucucccauccaguggcuccacguacacacccucagaggcaggcaaugcacuggacuuggaacugggggcagaggaggcugaugaagagaguggagguggaggcggugagggcagggcagaggagaccagcaccauggaggaagacagguguggugguggcuguggccauggacuauccucgggagccuggaaugggugggacagaucaggguuccuucugucuggucugggugcuaucuccuaaaggccuacugugugccaacuucugccuaggguuccagugaucuguaugugaugagaagaagcagaggucucagcgucauccagcucugaccaaucccuggaccugucuaccugaggagcuccagagcuuccccagaugcuggcuaugccuuggcacugacaccguccuggcgcugcccaaggcuauaccuguguagcccuuuggauucagccuguggauguccacucaucccugcaggcuccuacugcccaugcuguggcuggauuaaacagcacggggucugauagaaaacgggacugcucugcaccaacagccugucacagacaggacagcuggaccacagaguuuauuuuuguauuucuuauugggccuguacacuccagcucuaagggccaguaguuugaagcccuauaaguggugcccaguguucauggggucuggucuuugaccggccucuggugcccacuuuugucucccacuuuaccaggugggccacaugcacugagugucacuuugcugcagcucauuuguuuccaauaaaaguuucugugacuuagaugga

SEQ ID NO: 7832 - RNA, 3087 nt, Mus musculus
uccaucuaagucacagaaacuuuuauuggaaacaaaugagcugcagcaaagugacacucagugcauguggcccaccugguaaagugggagacaaaagugggcaccagaggccggucaaagaccagaccccaugaacacugggcaccacuuauagggcuucaaacuacuggcccuuagagcuggaguguacaggcccaauaagaaauacaaaaauaaacucugugguccagcuguccugucugugacaggcuguuggugcagagcagucccguuuucuaucagaccccgugcuguuuaauccagccacagcaugggcaguaggagccugcagggaugaguggacauccacaggcugaauccaaagggcuacacagguauagccuugggcagcgccaggacggugucagugccaaggcauagccagcaucuggggaagcucuggagcuccucagguagacagguccagggauuggucagagcuggaugacgcugagaccucugcuucuucucaucacauacagaucacuggaacccuaggcagaaguuggcacacaguaggccuuuaggagauagcacccagaccagacagaaggaacccugaucugucccacccauuccaggcucccgaggauaguccauggccacagccaccaccacaccugucuuccuccauggugcuggucuccucugcccugcccucaccgccuccaccuccacucucuucaucagccuccucugcccccaguuccaaguccagugcauugccugccucugaggguguguacguggagccacuggaugggagagacagcggacuuaggaucuccuuucccaggcugccccagggagaguagacccaguuaaggaaugaucugaguugaagagggaacuggagaaggugagguggcaaaguaccaaccugauggagcggcagcuaaagaagacaauucgcuucagucucuuauuguaaaagaaauaguugaaugaccagaggcuuccaucuuccccaaaggggucggagucuagaucuggguuauagcugaaaagagaaaacagcagagggaugaggucuccacugccauacacaugugcacgcccagcugcaaagacgugagcccaccuguagaugucacacucagcuaagcagaucuccucauccacugcauuccacagcuguggcuucagggccuugaagucuucacgaacagcugaaaacaggcugcaguugacugcauuuaccaccuacaggaggugacagucaggggugacaaggguccagggcagcagggagagcccaagaacccacaccaaguggggauggcaaugagaaggaccacauggcuuggggcccuucuguucauccuuacccagcggaggcuuggcucucggcugaauucaugacuucuggcugugcugaagucauagucuggccggaaggacucauugaggguggcaaucagauagaagagggucuugcggcugcacuugucgcucagaggacucucauccucaccacccuggcucuugcucagucugaacagagaaaaaugucagccuugcccacugucccacauaccccagaagguagucuccaccucagcuuaccugcugggacugaggccugaaguuugggguggggacagugccuccaacacauggggcuggcccuccuggcagaacugcuugaacauauguuuaucaucucccgccaucuuacacgaguagcuuucaauccuaaagaacgcaggcagagucaugaagcaugcuaaccccgaggcccacgauagugaucucugacagauugauccccagagccuccagccucaccugccaauaauaugggcaucuccagucuccacugucaacugugaguugauggccucaaagcuggaguucuccaauagcuucauguccuuugggaagggagauucuugugccagugggauuagggcagcacuaccugggaaugugggaagccagcauggcuaccuagcuccaaagggcuccacuuucagccuuuccacccacuagcagaguacuguuugcagcucgagcuaaccuugaguccaccauggagcucaucuuccucaccuuaccugccccugagaacucagcacuggcugacagggagaugauccuaugcaugagcauggcauguccagguucuaccucaaucucaaguacuauauacuggggcuggcugggggccccacccacucucgacauuccuacuccauugacauucugcaggcauccucagacuguuguaagguccucaauaagaaccugcuauccgguucggaacggggcaucugggguuucaagccuugagggucaccuguaugggugcuccucccggguucuauggguugcuucacugcuuccugucaagaggaggaaacccaugaauucuucaauucuauuugcaaguaugccuaauucguacuucguacgucgaaguguguaggaugggcagacacaccaccucugcuggcgcaggccaguggucuccuggcauugcugcccugcaagccuagagguaccagcagauucguagcgggaaacuacaagccccaggaggcagugcaccaagagaggcgcuccagccccaagcagcauaagaacuacaagucccaugaggcacugcagcagcgcgaggcccgccggggacugugguucccgcaagcccggaccgcuuggcgcacaaggcggacacccaccugccagaauugggcuagaucaagccaggguagacggguuguuuagugucggugccgaggugacggcggcgcgggcuuugcgcagcgcggguuccucaggacuggagggcggcgccgcggccuccacucgggccgcacuguauccgggggaagaagcuucgcggcgacgucccguuacuccaggcccugccggcccauacgggcugcagccgcgacauagccucgccccccugcaacgcccgcuuucgcgaccaaccugccgcggaccgccgagaucguaccagccagagaacgaaacagcgaccuccgccucccccgacccgacaacaacaagcguccgacgggcccaaccccacuccucugaaug

SEQ ID NO: 7833 - RNA, 2559 nt, Mus musculus
cgacuuccgcuuuuccggcgguggccccggcacgagaagugacugagacugcuggcggcaugcggggaccgggaguagguucgggguucucuggugagcgaggguugcuagagcaggaggcuggcgcggacacggaggcgguggaacugcugcccuuccuggugcucggagcgcgagccgaccugcaggcggccgcggcgcagcacgugcuggcgcugacuggugcgggcucgggccgcacgcuguuggccggacagccagaguuguugcgggccuuggucgaccuugcgguggccccggccccagcuccuucccgcgaugccucccgcgcgcucgugaacuuggcugcugaucccaaugugcacuggcagcugcuggcggcugacccggagcugcccgcccgccugcugcgcugcguguuggacccucaguggcccugggcugaagaggcggcugcagugcuggccaaccugagucgcgagccggcuccgugugcugcguuaauggagaagcugauggccgcugagccggagcgguugggucuggagcgacuugucaacgcgcugugcacgccgagcuacaacgcggccgcaccccugcauuaccuggggccgcugcucuccaaccuuagccagcaggcggaggugcgugcuuuucuccuggacccagacaggugaaacccagucgccugcgcgggcgggaagguggggaaguggaagugaacaaggacagcagugaauaucuucuuucaacaggugcgugguccaacggcugcugccucuuacccaguacacagauucuucggugcgcaggggcgggguggugggaacacuucggaauugcuguuuugagcaucgugagugacaaggaggggguggugccauugccaagguggggauuggacccuagggaacccaacggaccauuauucugaucuccuuccuuguccgcaccuccaggacaucacaagugguuacuuggggcccaagucgacauucuccccuuuuugcuacugcccuuggcugggccugaagaguuuuccgaggaagaaauggaccgugagugacuugggugguugccucagggcugucuggugcuagagggaagacuacaagagggagauggagaggugugcaggucuggagucccucaguccggcagccuuuaaggagggggucguuacagacacacacaaggcucacccaggcagagcagggcuuggguguucagcacagggaccaauagucucccacccucacuccuagagcugccuguugaccugcaguacuugucaccagacaagcaacgggagccggacgcugacauccggaagaugcucaucgaagccgucaugcuggugagcaggggccugggguguuagugccucuccacaaguccguauuggcauccgaguaaccuuuuuccaucuuccuagcugacagccacggcaccuggucggaagcagguacgggaccagggugccuacuugauccuucgagagcugcacagcugggagccagagcccgaugugcggauggcuugcgaaaaacuuauccaggugagugcggggggucagaaaggcuaggcaagugccaauggcuuaugagcccgcucaccugccuccucuucuugcaggugcuuauuggugaugagccagaggcuggcauggaaaaccugcuggaggugcagguaccugaagacguggaacaacagcuccaggagcucgaccagcaagagcaacaggagcucgcucaagagcuaagaggcaacggugccccacacaccugaagccccuuuggccugaaugccagcuucagacccaccuuugccaguguuggcgcaggguucuagggucaaugcccaguaaauggugagaagcccaagggugcugcccaauccugugcccuguugcaaccggcaauaaugcacauaguucagagcugcacuacugagcuggagcuggcuggguucugucacagcugccuacagaugaggcaggaugccgguggucacuggagcuaugaagagccuauucccagcuggugauaggacuggacugaaaauacugcaagcccugggaagccaacuagguuuucauuccugaaggcacugaggggucuggacguggguaggcuuagagauguaaacagcgccgugagccccaaccuucggagucuucuugcuuuccuugcccaagaccuuaaaagacagacuacacuuggauccucgucccuuccuagaaugcucugccauccgagccugugagccugucucuggaugacuugcuggguuucccauuugcugccuccguuucucuguuucaccugucagccuccuuauucccagguugaauugggacuuagccauucagcuagauagaaccugcuccuugguuagcuuuuucaagucucgguugccuuucaaggcggauuucugaguuugaggccagccuggucuacagagugaguuccaggauagccagggcuacacagaaaaaccuugucucgaaaaaaccaaaaaaaaaaaaaaaaaaaaaagacauccagacucuccugcaag

SEQ ID NO: 7834 - RNA, 1808 nt, Mus musculus
ucuuaacuucauauuuauauuuauuuuuguauguaugugcaugccacagaaccgaggacacaggacuaguuuuggaagcugguucuuuccuucugaugugugagucccagggauugaacucggaccguggggccugguggcagauccccuuauucacuacgccauucugcagacaucagcucucuuagagucgcuauuuguaguuuccuauuucuaauagaagucagaaguuugucauacauuucugcagaauacaugggcauacuugccucccaguguguugggcacugccaugagugcuauccugccaccuguugugccugagugcucuccucaugccucuuccuuguguccuugguccucugacugugugcugucccugucccugggauugaugcuuccuuuggaaucuuuacuuccggcagcuccuuaaagaccuaugcucccugccuuagguuuucugugcacagcccggcagguuuccuucugcuucuauugccagcuguuuccaaacccuggggucagaggaaugggcaaguucagaucugacuucagggcaccaucucccucccagcaagaugacucuggcaugucugaaccuugcagaacuggggacaacugcagcacaaggugguggugagcaggguguugcagccagcaauggcucacgaugcauuuucuugcuguuguagccacaccugcgcccuguggcgggcacuggcaguggagcccggccucacggcucaggucuuagaguuacuucuggagaagaugagcaaagaugucccauucaaggagagccgugccuuccuccugggcagcacugcagacagaguagcgacgcugcuuccccuugcggugaguagggacucggggggcuaccuuacaugcugccccugcccccacaugaggccuggguaccccaaaggcaccuggcagcugugcuggggcucauaaagaccagcagguguuagcucccaagggagcacacuucacauuuuauccuguggaaaaaaaaauaaacccagcccagccacacuuuaagcaauaaagcagcugugagaauuuccucuccuuucuaaggaaccaagaacagauggucugaaguuuguccccacgaaggccacacuguuccucucuccugccuaaugcccagaggacugagcuacacaggguccuaccaacucaguggcuuccuggguuccuccuaccucucccuagagacucaaaacuucaacuguauaugggguucauacaaggcuuggaccccuuugaguccuggaguagggguacaggaguugcuguggucucaagggagauaugacuuguaguggcucugccccaggccaccugugcacuguaugaaguccugucugccccaucaucuggaaccgugguccuagagcucuacccucagcuguucgcagcacuccuccuacgaguuagcuguacugugggugugcagcugccccggaaccugcaagccaaggagcggagaagcaccagcccggccagagcagccaggaaucuugaucccugcagguaaugggguucucaccugucauccccugcuugugugccugugugugcgugcgugcgcuagugugugaugucagcugccuggccuugaaggagacauaaaagaccuugucugaagaacggugggcuugggaguggcuuuccuucccaggaccaaaaucucucucuggugcagguugggacggucauuuguguuucaggcuuccaggguuucuucucaccccugcagguagcuucagacuaguauaguaaaguaucacauggcugug

SEQ ID NO: 7835 - RNA, 24528 nt, Mus musculus
auugggguuacauggcugcuguuuauucuacaaucucauggacuguguggacaaagcuguucagcugcagaacaagacacagguggcagcagcaacuugcaggggugcagcaauaucauugaaugcucaggaaagcucagcgaguucuuauccuacccugcuaauucaugcaggaccacuacgaauguaaauccccacuuuuagagguggagccauccaugagaggacaucugcacacugacugccuggggcccaggaauuauacacauuguacagcucuaacaguagagagagcucugaacagagggauacuuugcccccaaguucuaguagcugccaaauuagacagaagcuuuuacauaggagucuuuuugacaauccacaguccucauccuugacuuggugagguuugugcuugucaacugcuagagucugcuaggcuacagacccuaaccugcaguuagaugguuaucuggugcaaggcaaggugaacaguacagucagcugcucagaacacaagguaugcaccacagccugcccuaggccaccugugaggccauucacaccugcuuuuccccagucuaagacgguaggaacaaauucagaaccaguccaguaccugauagauaugggggccuugcucugccaauauguccagcaugaccauugcagaacacucuugcugauaacauggggcagauuguccuuucugguccccuaaagaaaaagcugugagcaaggacuaguucugugacaaggggagccuugcaaguaucuuccaaggagauguagugaggucugagcucugccuacauuccaccgucggggucccgcagggcagggggaaacauacagguggucacaguagagccuguuuaucaucugaccaucucugugugcauauauuauauacauauauauauauauauguauguauguauguauguauguauauauauauuuauuugugaaggguuaaaggggacucucauguaaaaauccaaaauacaauuuuaugaacaaccugcagggucaguccaaguguggcugugaagcugugaccagagaguagaccuggggcugggguaaaggcagcagguaugcagcccucaggaucuuccuccugauccaagguacugcccaggaccaaguuccaucugugcuccacugggguuguggugacuugaccuaggguccccuggacuacccaacuguuuugucucccuaggaccagccauguccuagggauagguugggggccaggcacaagccagccugacaacuccugagagcucuaggagacagugggguccuuggcuuuaugggguucagugccugucagaagagagauggugggaucauccguguagucaucccccucagagaaguaggagcucucccccagcucaaagagcacaggcagcucacugcucccuguguccacagcaucaggauccagcaggaacagaggcugagccguguagugcaccagcugcuuuccuguggggaaugggguuuggaugguggggugggcaaucuggaagugagggcuggggguagcaaagaagcuuagcucucaccugagucgggguuacuguucucugccucaauaggccugggaggcucuuguggagacagaagcuccugaaucugugggacagggaacacagugaggguuguugauggcccccucugccccccacccugcccgccuacgcacgcuggccaggcugcuguccaggucaggcaggcucaugucgggcauggucaccgaggggcugaacagcugcaggaggagggagggaagucagggcuggcuugugggcaggauggagcaggguggguagggaugaccagacucacguccagcagggcacugguguccacacugaagccguggcuugucagcauggucugcagguuguccagguuggaguccauggcauccaggugaucacuuagcucguuccuggcccagggcaagugggcaggugaacuagugccccaggcucccacccagccacacuccugcuggagaagggcuccccuuugguugcagucccccaagcaagguccuucugcauagccaguaugggcuggggggacuguguguaucucugggaagaugccgaaaggacaaguaguaagcuugcccuccauggcugcugagggugggauacagcauggcccaggggcaggacauccuaggaggcuuuaguaguuacuaaggcugggccaagagggagguggagaaaaaagacaagggacauuggucugcaaauggauaggcggccagauuuuucagguuugacagucuugcaagugcaccaggaagagaguaaggagaggaagcaggacuguacuuggcauggggagaccagaaggccguaggccauggacacaccugagccugggcaaggcaguuaaaauggcucuguaggugccauagggccuacccuacucugacaagaagcucauuguagcagccuguacugguagcuggggcaggcaggacacuugucccuauuacagccauuggcuugugcaaaggguagucaguggagaugcagagccugugagaccauccccuggugcucuucgccagacagggcaaguacuaugcccagguugggaacugguccauggcugugggagggggccuggcggaguccuccucccucccaaguggggcagcgcuaacccuggcuggacucggccaugcagaaaggaagaggggcaggggaagaggcgggcgaccccagacaucuguggagcgcgagccaaacugcaagauacaaagacaagagcccccccauugcaggcgggggacgggggggaucugugcccaccguccucacucacucagcuuuugggaugugccugaggggugguggucaaggcugggccuuggcucauuuccugugucaggacuagggagaaugacagauccaaagaucuuggggcuugccauaagagagggugauggcagaaguaaggguggcccaggaggcaggggcauaucccauuucuagugaugugguuggucucccuccccaacuucaaccucacucaggucuuggggagcaacagauucaacccaucacccccagcaaacugcagggauuaugccucacuaagacacagauacccuguguacagccugaggaaaucccaugcuguugggguucagaggcuauagggaggcaggguggacacugcacucacuugucuaggcaggcuacgcugaggcacuucucagggguggagggggucgggagugcgggggcuugggcuccgguuguguccauaggggcuguguuugaggcagcagggguaggcucgcucucucgaaggauggagucaaugaaggcaguuggggacaaagggguauccauggaggaugggcgcccagggcucgccuccaguacccgagggcugugaggugggcuggggggcucuugcuugacacggaccagagugcugcuggacagaggccugaacauauuagacaaugacagacauguuagaaggagccuaaguuaguuccacccauuuucagcucugcccaaggucauaaaggcugacccacuaaggugauaggagggauaaagguccugcagccccaccucucaucuaugcuccugccuggggaggccaaagggcuggugggagccagcucagugauaucggagauuauggguccagagcuggugacagcaucagaggaguaaaggcuagagcugcuguaggcuggagauggagccugcaauuagagacaaaggccacaugcaaggcauaccugugguagccugggccacccagcacccacugcacacuuacuggcagucccauggagcuuggugcuuacugaguaugggccaggaccauggacaugcuccagggaguacugucgaccauacuugggcacagagugugcugaguugcugucacucaacaucagagggcugcagggaagagacaggucaacugccuacacagaccuugguggugcccaggauauacagcaagcagaggacaccaaagcgcagggucagaguggacaguguagacauucccagagccucacaucuuucucuucacccccaggauccgguucgacugcaccagugagaucaggaacugaaugagcuguggggcagaaaggauacugucacccuggcccagucauggaggggacccaccuaccaccagcccugcccaccuuguugacaacuuuuugcugcugggcaugcuucugccgaaggcuggccaccucccgccacagggccucguucucgcugcaacacauugcugggucaauugggccacauuagaagagccagagaaucaggcuguugauggacagggcuggaccagaugagggcucacugcacaacugauucccuaacuccacucuacuuacagggcaggauucaaacgucagccagggcugagggagggcauggauagaaucugaugguaccuuaggauccuagcugcaauggggcacuuguuacauacuggcuaggcacacaggacaggucucugggaaagauccuaaacuacagauuacccucaguuuugggguagaaggcagcugugaacugugcugagugagugauaaagggcgaguugagucauugugacuagagaacaguagagaggucuggcccaaggacuguuguggucagcuccugucaggccugguuuuuagggaggcaccuggaaaugggcuuugugugcucaaauccugaaaaugugaauuccagcaggggagugagaagugggugcaguaggagaccuccaaccccacucugugucuggagauguacaagacaggguuuccauagaaacaaugaaggcaggcugggagggggaaggaggcuugaauggcucugcaggaucggguaggagacccaaagcaaccuggccacccuccugagccuugggaccuacugcuucauggccaggagcuuggaguccauacacuccuguuuccccuucaucagcugcacaucugucaacagccgggugacacuguccuggcguauuuuuauguccucacucuucaggguggacaccuaagggguggggcauacaagagucgaaaguggcucuggagugugguaggcuccugugcuucaccuaggcauccagggaaugaggagggccugggaaacacugggaagggggagggggucagagacagagagcacaggcuaugcuuuuaggcuaguccugcagcaccaccuagauacugcucccagcccauagccugcaggaauauuuagggcagggaggggcuguacucagggcuggugacucacgcuggucacuuuccucuugauguucucaaggagcuguuccuguccacgcaagaaacaaggaugcuggaacucggugucaucucucucaggcuugaccaggccacccugcucaauguggacuacuuuucggaagccaucuguguauaugggggugggggaaguucuguuugagggccagggaccagaccuucaacagccuagccauggccuagggcaggcaaggggccuccuagaaaacuguacgagagucugacugguguccauuuaccauacauagcaaguuauucuugguuggaaaagacuuuguccccgaacagcuucccuuuuuguaaauggaaguguggccauuagguuagggccucauauccuacacucuucccuggagaauucaggcucaaacucaugaggacccuucuucagccaacccaggccuccaucucuuagaaauaggcuggggucuauuucuccacacccagugaagcaagcauagcauccugaaagagguacuuacacauguugagcugccgcacgaagcuagccauguuguugugcuugaaguacuugggcagcaccuccuuggcaaacuggcccuggucaaacacguggaagcuguucccacucugucaggagacacaugggcaggucauauauagcagacaccaucauaguuucacuguggccugaugucucucucuccaugugugguggauuugcacacucucccuccauaguaguagcaggaggugaguguagcuguaggacucuauggcugguauccgggccauggaaccuaggucugagcagugaggcccauguaaccagagacaggaucuuaacuuccugacaguuuuuaguugcuagguuuagacucauaaaucacccacagcauucuggucaucucuagggacugacuagaauuuaguuuuaaucagcaauuuuucuuuuuuuuuauuucuuuuauuuagcaacuuuuuuuuaauuagguauuuucuucauuuacauuucaaaugcuauccuaaaagucccccauacccucccccaccccccuaccacucacucccacuucuuggcccugguguuccccuguacugaggcauauaaaguuugcacgaccaaugggcuucucuuuccacugauggccgacuaggccaucuucugauucauaugcagcuagagacacgagggggggggguacugguuaguucauaacguuguuccaccuauaggauugcagaucccuucagcuccuuggguacuuucucuagcuccuccacugggggcccuguguuccauccaauagcugacugugagcauccacuucuguguuugccaggccccggcauagccucacaagagacagcuauaucaagguccuuucagcaaaaucuugcuggcgugugcaauggugucagcauuuggaggcugauuaugggauggaucccugggugugucagucuguagaugguccauccuuucgucucagcuccagcaauuuuuucuuuaagaauagcuggagacauaguuccaagugcuuacuauucuuauagagaaccuggguuuguuucccagcacucauaugucaacccacaacugcuaguaauuccaaguuuuacgugaccugauguccuuuuuuguccuucauggccucuggcauacauguggcacucacauauaugcucaaggacacacacacacacagcuccaaauuguggcagucaaaacaggaaugaaguuguugaugcucuggaagacaguccugaucagaaauaccaccuuauucuuuuucaaacucagaugaaaacuguuaaauacuggggccgugcuucugugcuggugcuuuccugagcacagucagaaccacuaggaggggcugaagggccauggcaacucagaggccuuugauacuggaguggggagguccuacaguggguagggacaguauucucgugggugugcaagaccaaucagcugaggaaccagucucuuugcuggggugggagaacuauaauacagacagaaucaaccaaaaggauccuaagguauuggauuagcaccauggcuuuuuucaacacgcagagcagugaaacaggcuuaaacagaaacaguggagcaaguggacacaggaggaagaggauccuaaguagcagggaaagugcagguaggaagugugguaucagugagagaaagaggcucugcucuuuacacuaauuguuuaguccccauucuucccccucaguugugagaccaguggaaacaauagcaguaagaacaugggugagagcucgaucaaggucuuggugcuagguggauuucugaguucaaggccagccuggucuacaaagugaguuucaggacagucagggcuacacagagaaaccaaaaaaaaaaaaggucuuggugcuugaggacucucaaaguaaggcugccugugcuagaccugaggcugucccaguacagagacauaaagaagcacauagaggaagacugcucucagcugcauaauauauagcaaaggcagcuaggaaccuugaaaggcugugaaugagggaucauuauggacucugaaauauucuugggaauucaaaggcuauguacacauuagagcugugagcaugcucaggaagaccuaugaaggccauaagcuugcucucccucuggcaugaaggagaagcaggauagaaaguuggguugucacuugcaggcuaaauguuaaagauaggagucagcauauacagagaggccccaggaaagacuggcuccaguuuuuaaaggaaauuuccgcucgacuuuauuaagucagaaggacaaagugcaauggccaccaagaacacaauuaggacauaauuagucuagggaagucacaagaaccaacaaugacacaaugacaaaagugagagaugaggggacaaugcgcuuucccacugagucaaaaacaacaaggcauuuaagcaaagcuucggcugggacuggugugauggcucagcaggcaaccacugccaagcccgacagccuggguucaaucccugguacccacacaggagaaggagggacccgacuucacaaguuguccucuaacuucuauacacauguaugugcacacuuaaacugauauggauaugacuuugcugccugcaagggccuucccuggucuugaguuuacaguuggauuaugaauuaaccauuaugaaucccauuuauuuuagauaaauuuaauuaaaaagaaaagcuacagcuuauaauaggaaagaaaagagcaaccaauaaacuccguauguuggacucaugagaauacagauucuaacuuuuaguauggccaaagaucugaagaacuguacuugaaggacgagguauaaggaugauguccuacuaauggagagucucaguaaagcaauaagaagcgaaaaggaaacaccaaguugauauucuggauuuguaaagcacaaaucagguaaaaaauucaccuggggacucaagaggguaaaaacagaagagccgacugagguuauagacugaagauagccauugggaguaggcuuucaaguuuaaaaagccuauuccagacccagacacucagucugucugucuguuucugcaccaggacacagcuuucaauuacucuaguaccaugcaugccaccaugcucccugccuugaugaugacagacuaacucucuaaaacuguaagcaagcccccaaugaaauguuuuuuccucucuuuuuaaagauuuauuuauucauuuuaugcauaugagcacaucaccauugcucucuucagacacaccagaagaaggcaccagaccccccauuacagaugguugugaggcaccaugugguugcugggaauugaacucaggaccucuggaagagcagucagugcucuuaaccacugagccaucucuccagccugaaauguucuuucuuucaagagaugcugugguccuggagucucuccacagcaacagaacagugacuaagugaauacaaugaacagagcugagaaagaccuguaaggcaucaucaauccuucaaugcuuaaugggugucucagaagaugagacuggacacaugacgauaguuaggaaaacugaucaauaacacaccaaauuugaugaaaaacauccaagaaacgaaaucaacuucaaacaggaaaaaacuaacagggauucauacacagucacuccauaaucgaccugccaaacuccggaccagggaggaagggacucgccagcagccaacucaccgccacaucagcacagaugguggaugaccacugaugagcugcaggaugaagaccgucuaaucaggaaucaggaauucauagcccugaagauguaaggaaggccucacuggacugggacuguggagcucugggacagugcuuccucuccaguaacacauacaaagcuuguuuacaucaguuaaugucccugaaauuguuccacaugcaucaagcaagcaagagcgaccaaugaaaccacuagaacccauuggaucagugagugucguucacaaacuacagucuacugucccuggcacuaacacccguaucacaugcugcacccuggaagguguggauaaauuguagggaucccucuccuuaguuuugucaagguuuaaggaaagucuggaaggauguuuuuucucuaucuguagguuaaaaacaucacauuacugcuugaacaggucauccaccccacuguguaagagacccuaguaccaggggcagagaagaccagguccaaccacccucaccuuagucgggaggaaggacagagcaugcacaguguucagcugagaaguacagcagcuacaauccaugaggaagguggucuagcucacuugagguccaacaguauugggaagcucaagccuagugcgcgccaacacuauauaugagcugagcuccaggccagccugccuagaugggaaaaguaagcugaaaagagcccuuugggauuagaauguaagacuaacucaaaucugcuuuugcucaaugaacucacugaaauaccccaagaaaagcagccugaccaccucacuaaugcuuacaaauuuaaccagaucugacugcccaauaacccagaguauuacauaaaauagcagcaaguucaggcaguaauugcuggugcuucaaugccgaaugcaacaacuucgaggccgugaaugucaucaaggagaagcagucuuucugaagcagccuggccaagucacaagcaguaagcaagcaagaugauuuagccaccauugaguuccauaauacacuagugacagaaaaugcaagaccaacagaaacugagaugugacucacauaugguggacaaggaggaacagcagcgacugcucaggaaggacaagacaauaaacuuaacaaagauacaauguugcuguaaacaaagaugcucaguaguuagagcagcugcuacucugcagaggacaagguucccuccucuauagagcaccuaaagagcaccuauagagcagucucucucuccaguuccaggggaucuggcacccucuucuggccuccaugggcaccaggcaugaaugcagugcacuuucauauaggcagguaaaacagacacguaaaacaauaaauaugcucagagaaacaaggaaauaauguuugaagcagcaaaagaagaagcauuaagcagagcauuacuaacgguaacugucccaagggagagucugccgcaaacccaccguggaaugcucaccagugagcacaacaguacauucgagugcaaggauaaaaaaauaaggaaacuuuuucuaaaaaaaaaaaaaaaaagauuuauuuauuuauuuauuauaugugaguacacuguagcuaucuucagacaccagaagagggcauuggacucccauuacaaaugguugugaaccaucauguaguuaucucuggaagagcagucagugcucuuaacugcugagccaucucuccagacuacuauuuuuuuuuuaauagaugaaagaaaauagggaaacaggagauaaagauaugacuggaaauuacuuuugaaaaaaauucccuaccucugguuucuaccaacaggcaacuuaagguacuaaaggaacugucucagcacuucacacggacaggcgugguuuugccauuagcaacuauccaaaucaucacaaaguauccacauagcauuuaugucacaguaguuacuauaaaccauccaggaauaguguaaacuacauggggagauguguguagcuuccaugaaaacacuacucuagaauaccaauggaggcuguauuuaguauuuaauucacuugagcaacuauaaaaggaguuauuuuuguuuuguuuuguuggccaggggguggggagcagaaggguuuaagacaggguuucucuguguagcccuggcuguccuggaacucucuguagaccaggcuagaccugaccucauagagacccaccuaugcugggauuaaagguguauaccacaacccagcuagaaggauguauuucaaguuuucaagucaguccagacugcucuauccagcaacccuauguggcacagaggaagaagaaacaaaacugugcaaaggagcucacagucagugacagcuacagaacacacuucaaggagucccucaagggaaaggaggccauccgugaggccaaaggaaggaauaccccacagcagacuagaagagcaguuaagacagaaaggaaaaaacccaaauaccacaaaaccaacaaaaugucaggcauuaguauacaccucaaauaaguaacuuaaugauacauuuuagagccccagaaaaaaaaaaagccaaaccucaaauguuuauuuaaucuuaguuuagaaauuagugaaauggagaaaaaaaucugaaaggccaaacaaaaccaaaaaaguugaauauauagaaugaaaaaaaaaaaaaaaaaagagggggucuuugaaaggauaaggaggacaaacccacugcuaggcaugguggcacauacuuuuaaucccaguacuugggugggaggcagaggcagguggaugucugucaguucaaggccagccuagucuauauugugaauuucaaggaugccaggguuauguagaaagacucugucuaagcaaaauaaaacaaagcaaauaaaaagcuugacaagggcuagagagguugcuuagacguuaagagcacugacugcuccuccaaaggucccgaguucaauuccuagcaaccacaagguggcucacaaccaucuguaaugggaucugaugcccucuuuuggugugucugaagacagcuacaguguacucauauaaauaaaauaaacuugacaaaccucugaccaacuagcuaaaaugaaaagauggaucaucauucugagacacauaucacccaccugaauuaaaucaagauaaguaaucuagaucuauaacaaaaagugaaauucaagcaguaauuaaaaaacuuccaaaagacauagaauauccaguaugguggguuuauugguacauuuuaccagauuuacaaagaacugacaccaaagcuuuucagacuauucuagaagacaucaaaggaaggagcaccacccaaguacacuuuccucuuaugaugcagaucugucugagugcgugcacaugagugaaggugcucacggaggccagagagacuggaucccucuggagcuggaguuauaggcaguuaugagcugugugaugcgggugcugggaacagaacuuggacccccuguaagaggaguacacacucuuugccacugagcuguuucuccagcccuaaccaaacucuuguuaguaaaguauuacccucauacccaaagcagauaaaagcacagauaaagccaagugucuauuuaauuucagaaccugagcagcagaggcagccaaucucugugaguuccagacagggcuaacugacaaauccugcuuugaaacaaacaaacaaacaaacaaacaaacaaacaaacaaucuaccuucagcaaaaaagcuggauacaagauuaccuaaaaaaccaaccaaccaaccaaccaaccaaccaaacaaaaaccuguagcccucuuauauacaaaugacaaacagacuaagaaagaagucaggaaaacaacacccuucucaagagucacaaaaauuacaaaauaucgugggauaacccuaaccaacgaaaugaaagacuuguauaacaaaaaaaucaagucuuuaaagaaagaaauuggaggaaauaucauggaaagaucuucucauggaucaguagaauuaacacaguaaaaauggccauccuacugaaagcaauuuacacauuuaauacaauccccaucaaaauuccaacacacuucuucacaggccuugaaaggacaauucucaauuucauauagaaaaacaaacaaacaaacaaaaaaaccccaggauagcugaaacaauccugaacaauaaaagagucauccaucccugaccucaagcuguaccacagaauaguaauaaacacugcauacuauugauauaggaacagacauguugaucaauggaaucgaaucaaagacucugaaauaaacccacacaucuauggacuguugauuuuugacaaaagaagguaaaaccauacaauggaaaaaaaaucaucuccaacaaauggugcuggucuaccuggaugccuacaugcagaauacugcaaauagauccuuaucuaucacccugcacaaaacgcagguccaaguagaucaagaaccucaacauaaaaccagacacaguaaaucuaauagagaagaaaguggggaagagccuugaacucacugguacaggagacaacuuccugaacagaacacuaguggcucgggcucucagaucaacaauugauacaugggaccucaugaaacugaaaagcuucuguaaggcaaaggacaaaacggcagccugcagacugggaaaggaucuucaccaacccuacaucuagcccuacaaagagcuaauauccaaaauuuauaaagaacucaagaagguagacaccaacaacacaaauaacccuauuaaaaaaauggguuacagagcuaaacagaauucucaacaaaggaaucucaaauaaccgagaagcacuuaaagaaauguucaaaguccucaguucaucagggaaaugcaaaucaaaacaauuccaucuucuacuggucagaauggcuaagaucaaaaacucaaaugauagcacaugcuguuaaggauggggaguaaagggaacacgccuccauugcugaugggaguacaaacuuguauaaccacuuuggaaaucaacuuaguguuuucucagaaaacugggaauaguucuucuucaagacccaguuauaccacuccugggcacauacccaaaagaugcuccaccauccuacaaggacacuugcuacuaugcucauagcagcuuuauuuguaauagccagaaucugcaaacaaccuagaugucucucaacugaagaauggauaaagaaugugugguguauuuauauaauggaguauuaugcagcuguuagaaaaaaaaugacaccaucaaauuugcaggcaauagauaaaacuagaaaaaaaagaucacccugaacaaagcaauccagacccagaaagauucacuuauaaguagauauuagcuguuaaggauaaucacaauagaauccagagacccagagagacuaaguaauuaggagggcucaaggggcacagcugagucuccaugggaaguggaaauagauuuguggguggaguggaggagugugugcaugagaagaggagucagguuggggaaggaggaucagaagaagagacgacuggacuaggggauguuuaggggguguuguggaaacagagcagugaaaacuuaugauggugacccuaacaaggacuccuagcaaugggggauauggagccugaccuagccauguccuguaaccagagguggugguuugaauaugcuugguauauucagggaguggcauuauuagaaggugugaccuugucagaggaagugugucacugaggggauaggcuuugagacccuaccuccuagcugccuggaagccagucuucuagauagcuucaggacaagagguagaaguuucagcuccuccagcgccaugccugccuggaugcugccaugcuuccugccaugaugauaaugaacugaaccucugaaccuguaagccagcccuaauuaaguguuguccuucauaagaguugccuuggucaugguguuucaucacagcacugaaacccuaaaacaccagguaaggcugccaguggugguacggugacaccuguucugccugcaaagcaugugggaguagccaaccaaugacugaucaaacuugaggcccaaaccaugaaaggaagcccaugcccgacauugccaggauggccaugacuuaccaaaaaaaaaaaaaaaaaaggcaaugaacugauugcuaaugauauccugcucaaucaucaucagaggcuuucuccagcaguugauagaugcagaugcagagacccacacauccaaacauggaacuugaggaaguccuuggaagaggaggaggaaggacucuaggagucacagaggucaaggacaccaggaggacacagcccacagaaucaacuaagaaggacccaaaggggcucacacagacugagaggcagucacagagccuucgugggucugcacuaggucuccugcaaacacgcuguggcuucuaauagugggagugggagugucugucucuugccuuccuaggacccuuuuccuccugcugggcugccucacugcaccucgauguggggguuugugccuagucuuacugggaccauguuaugcuguguucagauccuauuacugggaugcuugcucuuuucugaaaggaaaugaaggaauaguagaucucggagagaaggggggaguggaggcaggggaggcucagacugaaauuauuguguaagaauagguaaaaagaaaaaaaaauuagagccaggcaguguggugcaugccuuuagucccagcacuucaaggccagccuggucuacagagcgugucccaggacauccaggguugaugcacagagauacccugggccuaagggagacaucuggaccacucuacuccacaccaaggcucagggaacugaugaaagagcugaaagaauguacaaacgggcagaugggacaugacuuggccguggcauugaugaacgcauggcagcuguugcugccuguaaucaggagacugcuaacauuccagcacagacaggcaaggggcacaggaagcacugccaaggcugaggagccacuacugcuugguaguggcugcuggggguggaggagagggcagagccauuguucuuaagggguguacaauggugaguuaccuauaauccaauaaugccucacaccugugcauguacaaacaagacuaauugaauucagggguuauaacggaaaaauaaaugaaagaaaagaaaagaucugugcaaugguacaauagugggaagaaggguugcagaaggggugggggagaggaauaaggggucuaaaaaauggggggcucucuuguuccucucuugccucucucucuagccucuugcucccuugcucccccucucuccuccuucccuucccccucucuccacguggucauggcuggccucuacuuugcuauuccuucucucugccuuucucugccucugcuacccucuacugccccuccccaugcccugaauaaacgcuauucuauuuaaaaaaaaaaaaaaaaaaaaaaaaagggagagagauacauucaagcccuaaccuccauaccucagaaugcagcuauuugugaacaggcuugcugcagaugugauaucauauuagaaaucaguggauccuuaauuugaauggacuaauguucuuacaagaagacagccaaauaaaaauaaaguuagucacucagggggaaugccaagcaaugacagacagacuggaaccaugcagcuaaaccagggauuaaccauggaauagcagcaaccacagugggaauggcaaggaagaguguccuccugcagacucuggaggacucagggccuugugaacggcucuugacuagaacagcagugcacucuggguggcuuucaccaucuacgcucaggacucagaacacagcuauuuccaccucaggauggagcccuugccugcucacaagggcugcccaagacuugcuguguuuucugauccuacuaaaaauauuucaccaagagaaaaaaagugcauguguacacgccugaagaggccaggcgagggucucagaucccuggguaugggaacuggguccucuguaagaucaggaagcacuuacgugcugagccuucucuucaguccugccacaguucaauaauaauucauuguucauauggagauguagaauucacuucuguguacugaccuuggaucuugugagcucacaaccuguuguguagguucuuuaggauuuucuacauaaauuauccugcuaucuuugaacagccagucuuacuucuuccuaauuuguauuuuauuaagguuuaauguggacuugccucaguuuuuaucuacuuucuaaugccagagagcugcucaauguuuuguuuuguuuuuuacuccuaaauagcuauuaugauuuucuagggcuagcuggugaaguugugaugaagccaauauuuaucucuguaacucaguggcuuacggguccucuuuugcugaccaugagcaguuuuagaaagggguguuauaacuuguuguauacaguggaaaucugucagugggaugaagggagccgugaccaggcagaagugguugucuaaccuggcuaguaaccugacauacagcugucaguaaacagagacuuauuuccagucugucaucuuacuuucuacagaccaacaacuugaaauacauauaaaauucugucugaauagauuuuauacagagccaaccugaaacuauacauauuuucucaaagguuccaugauuccagaagcuuaacagccaugguguuccaugaagugugucaccugcucuuugagugacugacagucacaguccuugccauuuuacuuucucucuaucuccacagaugaggcugaugauguauuugccccucucuugagcuuagcugccuggccauuuccuggguccuagaagcgagggcuuuaggagcagcaagcuagagaacugaaacaagugucagggucggcacauuccuuuucaucucagccaccugcaacuccaaccuccgcugccaccacacacggcccagucaacucuguuuaccaugcagugugcaagguuggaaucaagagccuggcaggacuuguaggcaccaaguucaggggcugaguaccucugcucuaacagucugugaggcuagccuccuucuccuguuacaacuugaagaaauucagcugccagaggcaggcccgagccucgucacugugauccaaagagagcuguuucuucccucuagagugguacauccauaccccgaaacucuggcuuucccugucuacauaccuacucuuuccuaagugaucuaacccuaggcuggauaugcuuucagugaagaacuauguucuagcaugucuacaguccucuguucuuccaaggagaccugcagugaccucuggcuccuggaucucucugaaucccuaccuccuccuccuaccuggcaggaagaagcauacaggucagaucacagaguccaucagcgcacagaucucugcggguuccuuucucuguggagagguaaggagggacccucagguacagaucccaaaugacauucugacuaugagccugcuggucacagcaaaagugucugggggaucauacugagaaagcaagagaccagggaagacugagggaacaggccugaaauccuagcuacuucucgagagacugagacaggaagaucacaaauucaaugucaguugggucaauuaguaagacccugcuuuaaaaagguaaaaggagggcuggugagauggcucuaugcacaaaggcacuugccaccaagccugaagagcucaguuugaucucugaaacccacauggcagugggagagaacugauuuccuaaagaugucauuugacaucuaccuguacacugccacaggggacacacacacacacacacacacacacaccccauaauaaaugcugaagagauaguuagcucaguaaggaaaguacucacguaacuccagcacccauucagcagucaagggcacuuguuuuugcagaagaccuaaguucaggcccagauauucuugguggccaacaacugucuguauuccagcuccauagagccugauaaccucuucuggccuccauaguuacugugugcuagcaaaauauccauacacauaaaauaauaugggggggggcaggguccuuuuuguguagcccuggcuauccuggaacucauuauguagaccaggcuguucucaaacucacagagaucuaccugccuccugaauacugggacuaaaggcaugaaccaccauguccagcaagaaaucuugaaaugaaagacaggggccagaaauggcacacaucuuuaaucccagcagcugggaggcagagguaggaggagcucuuucagucugaggucagcuuggucuaccugaguuccaggacagggcuacacagauggacccuguuucaaaaacaaaaccaaaaucaaaucagaaaaagaauuagcacacacacaaaugccggcacaguggugagcacacacagucccagcacugaagaggcagacgcaagcggagcgcuggagcccuggcuagccagucuauuacaucagugagcucucuuggccagugaaaaacccugccucagaaaacaugguagaggggcuggagagcagacuaccuuacugggggcuuuuccagaggaccuggguuugauugcuagcacccacauggcagcucacaaucaccuguaacccaaguaccaggggcuaugacaccuucuucuggccucuacagagaccagauuuauacgugguauauagaaguacacuuaagcaaaacacauauuuacauaaaacaaauauauauauauauauauguguguguguguguguguguguguauauauauauauauauauauauauauauauauacauaaacacauauacacacacacacacacacacacacacacacacacaaacccaagguggagagugacuauugaugauacuugacaugcacacuagacagacagacagacagacagacagacagacagaguaccugacagagacagguagugagcaauagcuggcugagucugaguuuggauuuucagcucuaagccaagcuucuucaccuuaguuuucaucuguaguacaagcggcuggacgaaggcuguugugcaacacugccugacuguuacugcuggaaguaccggagccuccggaaccugcagcacacaucacaacucaccucugguauacaugaccucugacauucugagucggcugccagguauggaagggaggggccgcugggccuguuaguuccucuugagcaucugagaaugagcucaccuggcugucagagcccggauaacgggaguggcccugcuuguccuaggaguucuggauaucagccauggcugagccucugcuuuaacacgcuucaugugaucccaugaagaacacugaggcggaugggugcccugcuccuguaucacugcacagacugcuuggucuccaacagccuaccccgggacccagcucuuccacuguggcuguccaagcgagcacugguauucaagaacccuugcuaagugguuccaguuucuucaaugacaggguccccccagaggcucaacccagccauugcuguucucagagaagagaaccgcaucacugggcuggauuagggugagaccagagaggcaccuagcaacaaaauucacgaagauccugcacuggaaaggcuaccaaagagcaggggauaucuuaaaaaugagacuucauuccuuuuuuucuuuucuuuuuuuaccucccugacuauuuaaggcuucagucucucccagccccagcacuuguuuggcacaaaucauguggccgucuuccugguucucaagccccucagguagcuccuggggcuagcagaccaaagccaggacaaagggcaaguggggccuggucuccaucucuuugcaccuaguagaacgacacugcuuggguuggguaguagguuaaacacgcucaggagauggagagaugguuaaguaggaagcauucgagucugaauuuggauucccuaguacccaugcaaagcuggguguggcugugcgugucugcaggcccagcaccguguggagucgaaaggauuguugggguuugcugaccagccagucaagcugacuaaaggcaaguuccaaguucagugacacgcacacacacacaccacacaaaaccacaccacacacaaaaacauucaccuucuaaaaacuagaagaaaauuaaaacacacacacacacacacaaacuaccaccaucuguacucuuuugaguuagacaaacuuauuucucauguuucuuuuuaauauuucuaaaacggguggggcaaaaugaucuuacaaaauuuggauaaagcuagauacagguucuaagcuuuggcuuuuuuauuugggcuucauuccccauuucaaaaugcaccgagguggcucuccaacaaugcuagcaagugucugaccgaggggacacaggaagcacagagagaaagccaggauugagaaaugacccuauggauucacuguuuagcccgaccuacuuguugucccgaccuacuuguugcaucucugggcacggaaucuggaggcaccuuugguacaggguaaaaagagaagccuacugagagaggaccauccacacccacguucacgcgccugcagggaucuuacugggauccuaaaucuggucaagggugugcugucccgugggaccugacugaggaacccucuggauggccugagguucuuguggagcaccuguaacugaaggcgggccggggacggggaguggaaccauggaacuggagaaagguagagaucuguucugucuccuguagcaggaaugaggagccgaaccgagcaaagcucaaagacuuuuggggcuagacaggcucccuggccccucaaggaggaggauaugccugagaaggguaagacaauuuuuaucugcaaguuugaguaagaauguggaccucaaacuuccugaucagugggcccgcagggaaugcuguuaagaggcuaccaagacaauguacaugccccacaggccacgggucaggagcaugaauuccuaccugugaacagacagccagauccaagaagcucugcugucccuggauggccuagacaaggguuuucuuuuuucuacuucuacgucagagcuuguuuuuuguacucagggucaugccagcucccacugaccaccgucucuuauaccagcuccacugcuuacagcgugucuuauagcaguccacugcugcucaguacagacuacuugcccaugacucccagcacgcuaacaaggcucacagaugaguugcagcuguguggauggaaggaggugacagggcagaucagcuccauccucacacugagaggcccucaucagaacacccuguccuggaagaaccuacacugacaccucgcccacauuuguaccaaucuauaagcagaaacagcagacaggauggaucuuccuaauaggauuaagcucagacuauuccagaggcuaccugguaguccuacuggaccuagguaagaaagcuccccuucagucaaagaaaacagagggggguaaauuggggaaagauagaaagguaagaucauacucucugcccagguguaugaaauccaggacaggcugugaacugaauauggcauucaggaaaacaacgcggcccacggauagcccaugggauaaucacaaagaccgucucgugaaaagugaaguuccgugcuuucuagucuucucuuuauucccaaaacacccuuuaggcagagcagaguuuaaacaaacaggcaacugagagccagaagccuuggccuccaucugccacccaggccuuuucuccauucuugccagcuuaagaaacuugugcgagggggcagugcuccgcagagaccgagagacccgccagauuuggcuugcagaaggucaaggugguggcaccuagccgccuccaucccuccaaagguucccauugaaucaggguggccugucuucaggccaccaccaucggcuagcucugcgcgcucuggcccucagaauccacaugugaacagcagauucuacuuuccaacuuaacacaaacacggaacgaccucugcaagccagccagagaugcagggccagcagggugugcgguguacacaguccgcugccaggcaacagaacaggguucgacacggcccuuggagggccgggcaaaacugcucuggcgucuggagacuaucggggcugagcuuaggcuccacauccuccuauucucgcucuucucucaugcauuccuuaggccuuccacuuauucugaaugauugccuaaaaagcagaaacgcagacggacucugggaacuauuucucugugagcaaagacccuguacuggaagccccguccuuauuguccgggugaaauguaggaugauuuggggucucggccuacucuccgugaguggcucugggggcggggcgcacuuccuccccagacagcggcguccucccucuaggaugccaggauggcugaacccgggcgagcccgacuaacucgcaggccgcuuucuccgaagcagguccccucccgccacaggacccucccucgaaggccgcuccggcccaugccagcuccuaccgggcuccagcagaugagcgcgucuguguccgggucgcucacgaggguccacagcuugguuaggaaggccgggacguugcugggccccgcugcaccggggcccacggccagauccaucucggacgaaagcaggcagaggcugggguggccuuuuagaagaguggcugaaggcugagcuagugucgucgcugccccugccguccgggccgcuccgccgcccgcugcgcacacacagcaaggccucgcauggccgcagccaucuugcgaccggcgcgcucucgcuagggccagaccuguagccucugugcgcaggcgccgugaucuccccu

SEQ ID NO: 7836 - RNA, 382 nt, Mus musculus
agaagguuuuagacagcacuuuauugauacccucagccccuggacaacacagacucccagcacuggcucauaccagugcugagauucaaaugccauccccaagagcaggaguaggccccauaggggcagagaggccucccagacuaggaggagugugcaggcagccaggaaccccuccagaacuccaggcccagguuagggagggcuggccuuuggcaguagcucagacccccacuggggcaucguaguugagcacguaguagucguggacauacaugagcacagccaccgguugcccaaugaugagugucacccacacagcugcauugccauaguucccuuggaagaaucggcccacaauccaggccagugggaccugaga

SEQ ID NO: 7837 - RNA, 6375 nt, Mus musculus
cuccaaauucuaucaagaguggcauuuauucuccucguggaggugcggcgcuccgaggagcuggugcuauugugcuuaggaaggaggucuguccguccguccgucuguccggccggcccggccccaaacgggggcggaagagggacacggcccgaguaaaaaucccggccuguugcgggccaggaguauguacaagguggcggggcgcaggcgggggugggggcggggcgggccggcagccacagcccccacccgagggccccccgcaccucgggcccuacuuguagaaucaguacaaaauaggugcuaccuaaacguuccuucuaccugaauucgcuaagucgguuauugugcugcuuaguuaugggggcgggagggggcccauggcuuuccacggcggcagggugugggcgaagcgggagauccuggcgggcccacagcccuuccagccuucuccauagguagguagacaggaguagagaguggggcggggugggcgccucugugugcgugugcaugcggcacaggcuggcaggcccaggcuaggaacugugggcauuuugccagguggaguaaggggguuagauaugggcacuguuaugcuaggccugcggguccgcaccaggaggguuagccaagcuuggugcuggguugagacuggccauaucauauacuccagcauguugcaccuuagcggcacagagacagcagagccucguaucucagggaaucagaaaauggguaccuguauggguggcccuggugaagcugggccccagagacccugggaccuguccaauuugagcugggaacauaaggcccaagucaaaggcagagccugacuacacccagcguauucuaggacugagguggguaggagaggccauaggggcccagggauucagcccucugcaucugccuuccacccuggccuaccuaugcguauugggcccugucacugaugggcaccuccagaagguugccacaucucugacggauucaggaaugggccuggcauaucguagguacccaaugaugggucggugagugaugaaggacugacaagagaggacuugggugauaccauuccaucccagccucuggaaccaugacgccugccgggcucugcccugggguaggguauggggaaagaaagucugcguggccggccccgcgcagcaucccugaucuaggggccuaugggauggguagggcaggggauaccugauucucaguaacucuagaggcugcggcagcuucacaugcagugcgcauuauugcucuauagucugcaucggacuaacuaagaggaaggggagcgggcagccccgggaaggguugggaagaagggugggacugcaugcagugaugucacaaaggcggcggccaauggagcggggcccuugggauagggucaccgccgaggcuuuggcauagacgggugaaaguuggcaaccgagugggaguggggccugggccuccaggaaagggccggccucgggggcagaggaagugguccuggacagccuaagccccgggcgucggcgggaaggaugaggguucggcgcccccucccugacccgagugcaauccguucauaaauaaaacguauaaauacagaaagaaagaaacccgacgcguccgcaacccccccccccagggggcuuuacccgcaaagcaaauacagagguguguagagggcaguggcacgccagccugccggcccgggcauccguccuccaacacccgaagccuggggagcgagggagggggcccggggcagggcgggaucggggucugaguaggucggauaaguucaugcgauuccgauaugcgucauuauuauucguuauggaggacagagccccggaagccgggcuggaagaauuaggauuuggcagaggaugcgaggcguggguuggagggaggcucggacugaggcccuagaaagaacccgaggaagaggguugccgccguccgcgccccuccccauccccaaaucgucuagcacucccgggagguuugcaaagccugcggaacagaacgccucuguggcccgccugauauccugcuccuccuccggccagcugcccgaguggagcugacucccuggacgccggacugaaggcuuggccuggaaggcuugggaagggguggggaagaccugagucucugcaacgcgauccaggggcgcagaggagggaggagggcgcuccuuaccucaccucacccccugucuucagagacccaacuaagagaugagguucgguucugggucuggucgacccuauugcugggagaaagccuggggcacccuggaggagaggggaggguuuucggggugggucuccccucaggacccuauugcuugaaggggcuggcaaggcuccuggcgagcggggcgggguggggccggcucccugccccuauugcugugaggaggggcccgcccuccagccccuccgcccggacgccagcggagauuucccugggggcccguauugcugagagccgaccuggcuggcggaggccccgcugcccuaggcuugaaccgggcugagcugcggcggcgcagggguugcggggccgcuagcgccgcccuugaagcaggcugacucguagugcuuguugagauaagacuugagcgcgaagcucuucuugcagcgcuugcacuggaagugcuugaaggcggagugcgucugcaugugcgcgcgcagguuggagcggucugcaaaggccuugccgcagugcgcacagccgaaggguuucucgcccgugugcgagcgcauauggcccugcagcagccagggccgggagaaggcuuugccgcacacgccgcacuuguggcgcagaucgugcgugagcaggugcauagccauggccggcauggacacguacaccuugccacacguugggcaacgccuugccagcuggcuguccaagcugcggugcguuugcuuguggcggcucagguucgacgacguggcguaaguuuugccacacucuccgcacgcgugccggccaccagcgcccguggcucccgaccccgcacgcgccucggugcccgcccccacgcgcgugccgccccgacuagcggacccugauccagagccucgcgugcccggcccgcccccaccuccagcgucgcugucgggggcugccaccgaggcugucgagggggccgcggcagcguuggcauuagcagccuuacggcgugagcgcccgucagugaugaagaaggcgucggccgcguagccuucgcugaccgccgcgucgccguugauguagccgccagcagcaguagccagcucugggcgaggggugggcggcggugcugagccagaggccgcgggacccagcucuccccgcacagccgcagcauacauaggcuccggggauggcccuuugagcaacgccgccucagcgucgccaucguagaccgacgcaggccccacguagucacugagguauccugagggcggaggcggacagacagacagcgggaagggaacggagcagcgggcaagacacacgcaaagcgggcggcgggagaucgaggagacacagcgggagacgucgggguccgaaaggaaggcaaacagggauuaggacaaaggagaaggagcaggggaccacagggcagaggauggagaccguggggaggggaagagaggagagaagagagacagcagaggaugagacagagccaggcagggcuccucccccgccgcccaagcgccccgcccccgcgcagggaggagagagaugcaucuucgggcgcggcugccccccuucagcgagccucaaggucaggggggaggggcggcgcuccucucuuccuccucccccuuccccucccccucggguucuccccacuucagcaguuuucccugauuaugcaacauacugcagacccgccgcgcacaaagccagggccuccagcccagagaccccgacgguccugccucuuugggauccccgaggccuucuuuaggccccagaaucugcuuccagacuuggugcugccccucuuguucuuuagaugugccaacaaaacccuagcaacuccuaccuagucagcaucucuggccaucaccuggacuccaucuuccaucucucuaaccacucacuggacuugcggcucgaacucacauaccucucuacccacuacuuuccauuauccuggguccuacuuuguuccacguucuuguuuucuccccaugucccaacccuacugggggccuucucaagucaccaacaggggacuaggaagacugccagggcacccacuaggggacaccuuaacagaaacaagcugcagguggacaucguucaugccaguagcugcaguuguucccaagguacaaaauggaucucauaaucucagucaugaaugcauacccuucaggaggcagacucugccucguucaggguuacacuugggcucucagcaaccauugggccugguggcaucucgcaggguaugcuguacccugacccuaguacugaaacccaacuccuacacuggcagggucacauaugcaaucauccagacacacgcucagucacauggugcacagcggccucagagucacguggucucauguaguggcacacagacaggcacacacacagggucacacacaagcgcacaaagucacauggccacacgcagucacaugggcccacacaggcuuaugcucuugcaggucauacuugcucugccaccccacacugcuggcacuccugucccccuugccugcaugcuaacaguuguccuugaacuugggcauccuuacacaaagagccuccccucacuccagugccuuggcuucccuugcucaccucuuccucccuaauccugaguccagggaagauacugcuguugcaucuucugguaccuaggcccugacagguggguggcccugacagaccccaagccuauucccuagaguucccagcauucccuagcuggcccuagcaaggggcuuugaaggugcagccaaaaaaagugaaacagauccagauuccgggguauggguuugcaugugcccauuuaacuggguccuguugugucagcaggugucugugcagcuguguaugucucaacagaagucugugugugggucagugugugccuuuaguguuuccuguuccugagcccucuuuccuaccucuccucuacccauacucuguccuaccuaucuuggaagcugucuggccuuacucucugcuccccuuuccucagccuuccuucucuguuccagccucaggcuguuuccguuggaucuacauccccuccuaccuugccacuccacccccacacuuuggccacccaccccuuccugcaaagcccugggcccugccccagcugcaguccagagcgcaccuuuaucuugcagucgcacuccgagaucgcugcgggcgcgcccguaggagcugucgaggucugccgaagagaaugugucaaguuugaccuucuuaaccaggaaggaccugggcaugauuccugcagggcuccggcagugagggccugcagagccggggcucagggggacugcguccgcggcgaggccccgucaccauccgaggagcgguggaagcagcacuguccccugucuggccuguggaugcugcugggcgagugugguccucucucuucuuucugcccugcgucuuuucuucuuccucuccggaucccuccucucuuucucucuccuuccuuccuuccuucuuuccuuccuuccuccucuucucuucuuuucucuucuuuccuuccuuccuuccuucccuccucuggucccggcuucccagcccgcagugccgccccuggacaggcgggggaggaggcugggggggcggagagggggggagcggcuccgucccgggcccggaggcugcgaaugggugcagggcuggcccggccccacggcccccuuccccucccccccccgccgcggcggcggagccucagucagcggcgccccaugcccccgggggcggcagcgccgggccaagagaacacgacaguagcagcggcaggagcaccagcagcuucagcaccgcggccagcgcuggcuagggcagcaccgcggccagcgcccgggcgcgcucagcuggcguugccggagaggggcgggccaccugggccuggucgcggggcggggguccucggcgggggucucuaggaggcuggcuuuauuguucugcagucagagcgggcggcggcggcagcggcgggcggggguccucagggggaggggugcucagggagggcgggccgagagagggaaggagagagggagggacggggguccgggggcggggcuccgcucucggacagcucuggggcaggccuucugagcccgcaagccu

SEQ ID NO: 7838 - RNA, 2868 nt, Mus musculus
gggccucacaauggcagcgcgcgggugcauauguccccaauuagggcugggcgccgccauugucccuucuucgcccccuccucgcguuggggucucugagcugagcuuuccccacgcagccugcuccggcuaucgacgauggucgcggagcggcaagcagagacugcagcguggugaccuuauacggacuggcccggcgggcgcaagugccagggcgccacagcggugcugagcucagcuccuuuccuccugcugcaugcugggcugcuaccggcauccacugccucgcguucggccacgguggguguaagcuaccugcccuacacugagcguggagaccacucuccugcuuuauguuagcgacuucgcuccucggcggcgggacauucaucuugcguggcaggcgcucccgaggggcaggacgggugcggccucccccuuaucgcugaacagcagccggcgaagcucgccguaggggguggggggcgaggguucccuaccagccacaccgcuaguccgggcuccuucccagaggggaacggcugaggcgcagccggaggcgucaggccaauuagcauuuugauugcuggacugaggugggggguucaucuggaacaaggucuaauuaccagacggacccucagggcucaggcaggcucgauucccacccccucuccguuugcucccuucuccuggacauuguccccucuucuaacccuauacucccacuucuagguccccucacaggcccagucauucugucuagcucugucccauacuuugccccucgggucccuucuuucuuaguagugguccuuugcccagccagucuuuccugggucuguucugagucccauuccucugcugcucuguccucggcccucuuuucuccaccucuucuuacaaucucuguccuuauguuguguauacaucccuuccuccuuuuuguccaucucccaucuccuuuggccccuaacccuccuugauggaagagaccaugugcggacacauaugagcuugggucucagggccaggcaguaucaaaugaaccauucaaacgggccuugcucuggcugugauggaucucucaggacuccuccccccacggaggguagaggggcacacagcuaggaggggcagcuggguccaggccauggccaucaguccccaccagcccagguacaugaugcacauggggccugugcaauuacucgggcuuuccacaugggcuccuugugaaccugacucccuguccccacguccccuuucacaucuaaagguuucccagacccuuggccaagccagagagauugagaaacuguugaacacucauuuugacaaguuguaggcaccuuuacccaaggccccauugagucucugagagucucaacgacucuucugagaaucaaagucagcccccagcgaguggauaacuacaggcccuauuaggcugccuuucuagcaacucccacaucuccugcuauucuggcccaauuugcucugcccuuaucccuuuccuaugaauguguagucuauacaggauugcucuaugaaugucuuagucugcuuuuguuguuuccacgcugccuaggucccaucuuacagaaagguuuagggguugguguugccacugauguguucaggcccuguggucugucacuucuccauacaccuagggaaacagcggacagccuuacuggaggcuccaccaacuucugcugggcugagaggugauuggcaaagaauguaaaauuggcuugcaauugcugguggggacagcuucuguggugacugggguggaugaggucauuaucgagaaggggucaaggaugugguagggaaauggaggugaauccuugagaguacuuaauucagccacagugguaguggcagccgggcuaugcagcucaugacaggucugagguaggaauccugggagagagugaaacggggcucugcuaauuccguaaggggcaucugucgugagccuuuuuggaggcugccgaguuaggggguagcacaaagggaagcuauguguccugacuggagacgaguugaagguccagggaaggucuacuuccaaaggccuaaagggcaaacagacuugcuccucacugaggcggaaccauuggaagccauguuagcuacugcaccacuguaacggguggcaaggagaagaaauguuuauuuuuaggucacgguuuucgaggucccaacacccguuuccucuuuuguuucugggcccuucucaggaagagcaucaugauagaaaaaccuagcagaacacaguuacucacuaacagcaaccaggaagcagagagggaugcaggagagugcuggacaagguauuuauuuccagaucacaaccucaguauucgcuuuccuccggcuaggccuaccuaccaguuucugccacugucuggaaaaugcuauaaucugguuucacugauggauuagugaggccugguaaccaaucaguuucuaaaugucccaccucugaacuuggcugcaucgggaaccaggccuuuaacaugcaacccuuuuggaggaauacuuuauauuuaaacaaugacaaaagccaagguuacagggggaagccaugagucugaaucauagcacaaccacaacuguauccaugaaaaaauaagaaaagcacaagaccccgaguucaagccccaggggcccacagaaaaaagccagacacaguggcauggacuguaaucccagcacugggagaauaagagccaggcagaucccuaaagcucacuggccaguccaccuagccugcuuggugaguucuuggccaaugagaaaccuugucucaaaaaauaaaaaaaugaaaauaaauaaauaaauaaauaaaauuua

SEQ ID NO: 7839 - RNA, 3026 nt, Mus musculus
cuuuuuuuaaaaaaaaaccuuuauuguaacaaaaccuccaacauuucaaagugaaaaugagcaggguaaaccuggcugcccucuaagugggcucuuuggcagagggcgggcugguaaguagcugcucuagacaccacuggacuuccuccaggccccgguagacgcgcuucagaccucgggggaggcaacgacaggacuccagguuaagauacagcagccccgggcaaccacuaaucacagaacugugaacaggcaagccgugggaaagugagcuguuggccagagagccccgucugcccucacauauaccaggccuaccaccccaagccacccaagcccaaaucuaguacucucgguguccccaaggaguuggacgagugacucgugucuauaccccuccuggacccuggcaaugaggagucagggagcacuccucuggucccuaagugagacacggcagcaagugguucaagauccacagaauuagugaacggugcacugaccugaccgugcuugggguaacucggguaccccucagguugagggagcacaaggcuggguguaagcccccaggggugcccgagaaaacagccagggccuguuccaaguccuucucgcugaagccuuggccacugaaguccagcucccucagggugugauaccacuuccgggucaacagggggcugccauccuuagccagggucaagccaucagauaugccauacaggcccagguagaguugcuccagcucugagaugggagaacucggugugacuauuagggcacucagugaccacccccaccccaccccgacccccccacaccuucccaagcaaagccagcuagcugaccuugacauggcagaugacacagaccgcuaggagugacccuagcgcagccucgaagguccagcaugcgcaguuucggggagcgauggagcaaucggcccagaaccucauugcucacaaaguugcagguggagccagccaaacagagcuccucaagacuggggaagccuggucccuggggcacgccucggccacacggcuugggaagccaaaucagauucagcagccgcagcaccuaggaagagggaagaagaaggagggaggagggacaggcugcagauauggcaagggguggcaggugggagacaguaggguauaaauaccugcagcugggggcagccuuucugcagggcuuccacaggcagcugcagggguguguuguugcaguucaugccagugcugaccuggaggacuuggagcugugggcagcaguuguccuggaauggugggauaaacacugcuaggucaaaggccugggcugguccccacugagcccuuuuccugaccauccccagccuaccagcagugcgcccaagauggccgucgucugggaacuguaggucagccacaguuuacgcauucgggacccggccuccuccaagaagcucaccacagcuguggacuccaccuggggauccagcccaaaggugcagcucaugcaugucacaagggcccaggcgauuucagggucccccacccacccacggcaaaggacucaccauggaaugauguagguccaggcuguggagcuggcagcaggcucucgcuaacaugaccagaguuucagcagucacaguguggcagucugaaagcuugaggaaggugagccgagggcagaacuugcuaaccagcuguagcaagagauagagagagagagagagaccauccaggguuguggagggcagguaaaggucuaucuacagggacacugguagucaugacaagccuauccuauagucccagcuaugacuccauucuguccacgccaggccuacauggaaauugcugucuccuccagcaauuuccuaagaugucagcaagacgaaacugagcaggcaggcagacaacucugugguacaccaccagggcacccuccccauaguagaccacucaaacgugacagcuugugugcagggcagucuccagcucuuaccuccaacacagaguguacuugagacuuccaguggaugagggucaagcucuggagcugagagaaccugggcgacagcaaggcccggcuguaguugugcucuuguccuuacgcugcccccuucuggacagaauccuccccuacucaacgcggaugcagggaagacaacagacaguaagaugacaaggagcccucaccgauuggguacgagccacuccaggcaagcaaggagcuucuucucucccuuaagguugcccuugccagcccggccaaccagcgagggugacagggucacaguaugccagagugaaggaugggagguggcuucgugccagugacggcaaacgcgugcagcccuaggagaagaaaaaguuugcugagagugcguggccuuuugcggguaaugccuacaauggaguguuuuaggagcagcgcagcggucuuaaagccugccgucgcccguucucagugcuaggcuuugagcucuaagugaagacaggugccggagcacuuguguucgcccgaugugaugccugcucugcccucugcucugcagcacccgcucagugcgccagucucuaccgcggcaggcgcuguugguguaccugccaagaaacggcaugggcccaugagccgcaaccaacaacccgaaaauaugcaccaggacuucuaagggaauacggucuccccaaccagaguccaggcccugaucgagcgacggcuccggucgggguuugguccugggcuuggcgacagccguggggccacgagccagugaccucggagcgcggcgacgggcgcgccggugcgcacgagcgcggggaggcuccagguccggcagcacgagcaacaugcuguccgcuugcagcaggugguacccagagccgcgaggugccaggcggucccaccaccaguccuccgccgagcggccccgcgcaucgggccgcuuggagcuucgaacucgacgucuaacucgccuagaggccacgggagccauagcccccgggagcugaacuaaaagcggaagg

SEQ ID NO: 7840 - RNA, 3026 nt, Mus musculus
ccuuccgcuuuuaguucagcucccgggggcuauggcucccguggccucuaggcgaguuagacgucgaguucgaagcuccaagcggcccgaugcgcggggccgcucggcggaggacugguggugggaccgccuggcaccucgcggcucuggguaccaccugcugcaagcggacagcauguugcucgugcugccggaccuggagccuccccgcgcucgugcgcaccggcgcgcccgucgccgcgcuccgaggucacuggcucguggccccacggcugucgccaagcccaggaccaaaccccgaccggagccgucgcucgaucagggccuggacucugguuggggagaccguauucccuuagaaguccuggugcauauuuucggguuguugguugcggcucaugggcccaugccguuucuuggcagguacaccaacagcgccugccgcgguagagacuggcgcacugagcgggugcugcagagcagagggcagagcaggcaucacaucgggcgaacacaagugcuccggcaccugucuucacuuagagcucaaagccuagcacugagaacgggcgacggcaggcuuuaagaccgcugcgcugcuccuaaaacacuccauuguaggcauuacccgcaaaaggccacgcacucucagcaaacuuuuucuucuccuagggcugcacgcguuugccgucacuggcacgaagccaccucccauccuucacucuggcauacugugacccugucacccucgcugguuggccgggcuggcaagggcaaccuuaagggagagaagaagcuccuugcuugccuggaguggcucguacccaaucggugagggcuccuugucaucuuacugucuguugucuucccugcauccgcguugaguaggggaggauucuguccagaagggggcagcguaaggacaagagcacaacuacagccgggccuugcugucgcccagguucucucagcuccagagcuugacccucauccacuggaagucucaaguacacucuguguuggagguaagagcuggagacugcccugcacacaagcugucacguuugaguggucuacuauggggagggugcccuggugguguaccacagaguugucugccugccugcucaguuucgucuugcugacaucuuaggaaauugcuggaggagacagcaauuuccauguaggccuggcguggacagaauggagucauagcugggacuauaggauaggcuugucaugacuaccagugucccuguagauagaccuuuaccugcccuccacaacccuggauggucucucucucucucucuaucucuugcuacagcugguuagcaaguucugcccucggcucaccuuccucaagcuuucagacugccacacugugacugcugaaacucuggucauguuagcgagagccugcugccagcuccacagccuggaccuacaucauuccauggugaguccuuugccgugggugggugggggacccugaaaucgccugggcccuugugacaugcaugagcugcaccuuugggcuggauccccagguggaguccacagcuguggugagcuucuuggaggaggccgggucccgaaugcguaaacuguggcugaccuacaguucccagacgacggccaucuugggcgcacugcugguaggcuggggauggucaggaaaagggcucaguggggaccagcccaggccuuugaccuagcaguguuuaucccaccauuccaggacaacugcugcccacagcuccaaguccuccaggucagcacuggcaugaacugcaacaacacaccccugcagcugccuguggaagcccugcagaaaggcugcccccagcugcagguauuuauacccuacugucucccaccugccaccccuugccauaucugcagccugucccuccucccuccuucuucuucccucuuccuaggugcugcggcugcugaaucugauuuggcuucccaagccguguggccgaggcgugccccagggaccaggcuuccccagucuugaggagcucuguuuggcuggcuccaccugcaacuuugugagcaaugagguucugggccgauugcuccaucgcuccccgaaacugcgcaugcuggaccuucgaggcugcgcuagggucacuccuagcggucugugucaucugccaugucaaggucagcuagcuggcuuugcuugggaaggugugggggggucggggugggguggggguggucacugagugcccuaauagucacaccgaguucucccaucucagagcuggagcaacucuaccugggccuguauggcauaucugauggcuugacccuggcuaaggauggcagcccccuguugacccggaagugguaucacacccugagggagcuggacuucaguggccaaggcuucagcgagaaggacuuggaacaggcccuggcuguuuucucgggcaccccugggggcuuacacccagccuugugcucccucaaccugagggguacccgaguuaccccaagcacggucaggucagugcaccguucacuaauucuguggaucuugaaccacuugcugccgugucucacuuagggaccagaggagugcucccugacuccucauugccaggguccaggagggguauagacacgagucacucguccaacuccuuggggacaccgagaguacuagauuugggcuuggguggcuuggggugguaggccugguauaugugagggcagacggggcucucuggccaacagcucacuuucccacggcuugccuguucacaguucugugauuagugguugcccggggcugcuguaucuuaaccuggaguccugucguugccucccccgaggucugaagcgcgucuaccggggccuggaggaaguccaguggugucuagagcagcuacuuaccagcccgcccucugccaaagagcccacuuagagggcagccagguuuacccugcucauuuucacuuugaaauguuggagguuuuguuacaauaaagguuuuuuuuuaaaaaaag

SEQ ID NO: 7841 - RNA, 714 nt, Mus musculus
agcaagcaccaaccgacucuugaaaauugcuccauaacauucacauacaauaaacaaaggaaaacacuugguaaagacucaucacuuggugucucccaugaggcuaugccccgggcgaccucaaggggccgcugcacgccgaggcggucacgucacguuuugggggcguggcccuuccacucuacccaggucuguguggcgcgugugggccggugcgcaagcgcauugccuacucuuucgcggggucgucugggcaccagggacgucugcggcgaaaccgggaagagagcacugccggggacauguggcggccggugaggaccccgcccccgcacgcccuggucccugacucugcgcuccgcaucccugcguugggaucucucucuguacccggagguucuggauccaguccaggcccgggcccugcccaucgaccccaaagcuuuggagaacucugauucccgcuuccucuuuuuuuccccagagccuuugggaagacucagcauuauuuaaccucaccccaggguccucuuccuucugccucuguccucagcgcaucccucgggucuccccgggaagcugcucuguccucucuaucagcuucuggaagggagacaaccccaugauucccgcuggguuagcaugcccucacucccuuagccccuuguucuggcccuggggguguccuugccuauucccugcccuuggaguaug

SEQ ID NO: 7842 - RNA, 5005 nt, Mus musculus
caugacgcagcaaguacccugcagaaaucucccauuguagcccauauuggacccagcggccuuagcucaggagccaagagcagcacccccacccucacccaggcuacaagauuuggaauuugucuaagcugcuugggcugagaggcagcuggugaaggguggagggaagccuaagagcucuccugaaaaugucaaauagaacgcccauguuugacuugauaacaucuacgcgcucaaaccuuuaaucccccuagcuucugguccaguggcaagguaacaggcgagggugaucugggcucuucagggaacagaggaagcccugacuggcaguucagggugugacagguucaagccgcccaccuaaggacagggacccaccuuuagcuccagccccaggaggcaccagcucuuucuccccaggcuuucggggaggaucugccacuggaauggcuaacccagcagccaaucacagagcccuguaggaaauaucugggagaggucuuggagcuagggccaaggcaaguugaacccagcuccagucuggccccggacagucccagcugucuccagcuagcccagaagucagcaccucuacaaggaacgcuuuugggggccugaggcgugaugcucccaaagucggucacacagggacuuguguuggcucugcuggugggcacaguggcaguggcccggcccaggaaccugcucagccugcucgccuugggccagggugcucuggaucgccuggaacuggacggccuguuaaauacgcugguggcccgugugcacugcaccgacgggccgugugaaaagguaacacccccacccgaugggucccccagccccggccccuuccugcccgcuccacccuguggcaggcacuaaagagaucugggcaaacuccaggaggcgggucuggaggcuggugucugcaccugcuggcaggcuggagccucccuuccguuucuggggggcuuauacaggccugggccuccauccugggacacacagcuccauucccccaggcuaucaaauuuguggugacucacagugaccacucucaccuucaggaugggggaguaauugcuggggaccccuuuguguaggcuccuagucaagcuaacuacaaggggcagaacaugacauaagauagcugauagaauccaugccuguaggcuaugccugguaggcuuagucuagcucagauccugucuguuugcccacagugucugucuguggagaaugucuuggcucuaggcaaaccugacaagccacagccugccccagaaucaguccuggaguccagacacauuauuuaccuuagugcugcugcugcccucuaccuuaacaacccagagaaaacaugcaaggacauccaagcuggccucuuggccucccauguggacgauuaccuggccacacuggagaguccagaggccaugacccugggucugagccagcuacugcagaagauugaggcccaugcugccagccaacccaccggggagaaggugagggcccagacagcuuuugggggauaaugacaaggaccuuagugccauggaagggaggcugccccaacaagggagaugucccacgugcagccucauuggagguacuuaggugggaaucagucuugugcacaguugguagaacggggucugcgggagucugggggaacccuuugggggaaaugacagucaggagagcucuggggccaaggucauaggccacagugaagggugugacuagcuggggcagccuagguuuaugguauagguagcugguuuagggacauaggcugaugucuucugugaaaucugggaaguaacuugaggagguuggagccgggcagugguggaacacgccuuuaaucccagcacuggggaggcagaggcagauggauuucugaguucaaggccagccuggucuacaaagugaguucaggacagccagggcuauacagagaaacccugucucgaaagaaagaaagaaagagagagagagagagagagagagagagagagagagagagagagagagagaaugaacuugaggagguugggaguugaugggagacccaggcagugagguggacuccugaagccaauacugagggcagaguugaagacaaucucuuuuacagaccuguguagaucuuccccaacugcuggaggaggcugaggcagcagggguuuccaaaagcgccggccuggucuugacugccuugcuggaucaugucauuaauggguccugcuuccaaggccugccuagcccucaguacuuuguggacuuuguguucaggcuacacaguagugacccucccaauaucacgcugcauggugaggccuaggcuacgaucgucagccgcuacucuuggggaauggggggacaaggcuggagcugagcgcacugacugcacuguuuuuguuuuuguuuuuuuguuuuuugcuuuuuguuuuuucuugcuagaacuggagaauuugaugcaucaccuugggguggguggagaggaccacagugaccaugaugaccacggugaucaugcugaccacagucauccggacaggaaagccagccaccaagacucugagcuccauacuccccacaacagcaacucuaguguaugggacacgguacgccacucaugccauucuggagaaagaagacaaccuuccaugggucuguucagacaccugacuccuguccuguucucuuugccuccagcugugccugagugccaaagauauaauggcuguguaugggcuaucugaagaggcuggggugagcccucaggccugggcccaacugaccccugccuugguccagcagcagcuaaguggagccugcagccccuaccccacuauccguauucaggaccagcucagucaaacagagagugagucccccgcccugggugcuagccucagguuauugggcucuagaagggggcaugaguuggcauugaggaaugaggaaccacuaaaggaggaagaguaguggauuucaaggcuagagggccagaguaaauagauuccuggcaccugcugacggcaucucuguagagaucuugcccacuacauccugcuuggcuggacuugugggggauugccugucuaggaagcaggggaaaucucaguguagacucacccacaggguaucucuauggcucgcuggccacccugcucaucugccucugugcuguguucggucuucugcugcugaccugugccaaaugcagcacagccacccacuacaucaugcagaccuuccuaagcuuggcugugggcgcacuuaccggcgaugcucuucugcaccugauacccaaggucagccgucacucaacagggcccccccccccccacacugcccuuuucccagccucaaucaagccucuuguagcccugaaguuccccagucaguacucgcccccuucucaggugcugggacugcacacacaugguggagagggucacacccaugaggaggaggugggcguuggugggcaggccaccuggcgccugcuggcuguacuuggaggcuucuacaucuucuuccuguuugagagcuucuucaaccucuuguugcccagggaccaggucaggcucuggggaaccacuaggugggauggguaaggucuucacaggcucugaccaguuuuuccacaggauucugagaaagaugggccuuguagccauggugggcacagccauggaauaucucugcagcuggcaccaagcaaucuccgacaguccaaacagacccaugaaagcucucguucagacuugguaagaggcaaguccuaucccacauugagcccuuuaguuauguauuugccuggguucauucuugcucccgccccggcgccccccagguggcagaggagaccccggaacuacugaacccagagacccggcgacugagagcaggugagccccagggaguuccugggggcacugcagaucugggguuugcccuuaggcgcgugcagaaccuggccuacaagacccacgcuugcuaugcccacagagcugagacuguugcccuaucugaucacacugggcgacgcgguacacaacuucgcugacgggcucgcugugggcgccgccuucucauccucguggaagacugggcuggccacuucauuggcgguguucugucaugagcugccccaugaacucggugagcucugggacguggcuugaaaggguggggcuuagugagaagagcaaucuauucuggaggugaccaaggccagagaaaaagggacaaggccuuucuaugagagaggcaugugaugggauggggguggagggcguggcuagauguaggauggauugccggacugccuuugggugugucugucugggaugugggugugacaggcauggugggcuguaccugaccugugggcagaguucucgcugacuuguuccguucuaggggacuucgcugcucugcugcaugccgggcugagugugaagcgugcgcuuuugcugaaucuggccucagcgcucacagcauucgcaggccucuacguggcucuagcagucggaguaggcgaggagggcgaggcuuggauucuggcgguagcaaccggccucuuccuuuacguggcgcuuugugacaugguuagaaaggggaagagccuuauguagggguggggagcuaaccaggggcuccaaccaacuggcagcugaauuggugccaucuuuuccucagcucccagccaugaugaaugugcgcgaccagcggcccuggcuucuuuuccugcuccacaacgugggucugcugggcggcuggaccguccugcugcugcugucauuguacgaagacaacaucaccuucugacagcucuaucccaucccaguccuugucccugucuguugacucugcuuuaccuucuuaagccaccuaauuguuggccccacuacggguagccagaggcuuugagccucauuuccuugcucugacuucaauaaagacuuuucaaucaaacccaacu

SEQ ID NO: 7843 - RNA, 16816 nt, Mus musculus
gcaguuuuuuaaaacuuuauuauuauuagcuugugugugcgcgcgcgcaugccaugguuugugugugagucagagacgaaucaguaaauguagagaccaaacuguggaaucagcuucccuuuagaguuagucuagcuucucuauccgggugcuucacagggcuauaggccuggggcaugaggcacaggcuggucagcaagagaggcuaacagagcacagggagccccaccaugaggcugucuucugguaaggaaacacagacaaaacaugguuuggaauauuuuuuuuaacuacaugugcauacagaaaauauucaaagaaaaaugcaaaccacaaaaaacugacauauaaagucauuuccaacaaccauaaaaacacuugcucugcucuuuagaaaaguauuuuuauuguuuuguaaaugucucacuuugggcaaacugagggauguggugcucacaggaaguggggaugagacagguggaaggagggggaggccuggcuuagcccgcgcagcccccucuggcagccuccccaacaccuacugaggccgaaccccucuccaguccucagagacaacaaagaaccagguuagaacagcaagguaacaagauccuggacacaagccaguagauauggugccccccagcccuaaauaaagggcccacagugacagugcugaaagauuuguaugccaguccccagcauagccaagaaacacuagucuucuccauguuugguucccuaggcuggaaggcucaacagcugcacaugucagucauaguguaggggccacacgggcccuguugcugggacggcuuagcaggucuccuagguaccccuugacacacucuucccccucggugggucucauccaggcacagccucuaacccuauguaccuugggguaugccucucagcuccacauacaaauacccaaagcucugcugccucugagccuccgccagcccagcuuuucuccucaugcccacugugucccgguuggcuuugccguggggaaaaagccuucuaucuucucuuccugagagaccuucaggcugcuuucuaggagucggucgcucgcacauggguuauuagggcaagcuagcccugcccuacuuuuuuacaccaucaccuuggaaucuagagggacucccagaggagccuguuuuccaaagguccucugucccuaagggcagaggacaucgaggagccauaucggaaucgaaggccacugcauucauggaugugcugacucuggcaugggcuccuuuguaguaggcagaagccguaucugcagaagagaauucccacaagccccaugcaggaagccaaacuaggugcugaaaacguucagccuaugagaaggugggagggcccaaguggaaacagacagggccuguaccccauguccuuuccucaucugucagcccguuugcccucuugaaggucagggugggacaucagcacuuguacucacauguccagggcuacccugucccuugguuuggaaggcacagggcaguucagacccaggcucaggcccaggcccaggccggggcaguuugcacggguugguagggacuacucugaggcgugugaaggucugguuagggcagaggaaaccaguucuuugguauuaaagcaacgaaaagcuaugacgaagagccucaucuccuaagcaaagacugaaggaggcaaguccuacccuucucagucccucugaggaauccaagggaaaaggaccagggccuagcccuauucaagcacggcugcuucauaguacgugaggcccuaauacuuguccugcuuacaaccaccacucagagcaucugugaaugggcuagugaggggaaggccuacauugccuacaugauaaaccgugcugcucugccuugguccuguggugcccccgccaccacuaaacgcaggccucggacaguagcugccuccugggcacccugaggacaccuggcccucugugcugaguaaagcaaacagauuccuucucucucacuaaaccugcaucacuuacagagccuguagaguugauuuuuuuuuuuccuggaagagacagaauuucacccugcauuccgaaaacauuuguuuagcccuaccagccaaguccugcuuccucugaguggucagcggcuggggaaggccaacccuuucuggcucacuggccaggccuuagucccaaucccucugagaagacuguggggggggugggggggcagugucucuuaagucuuuccugggaugcacacauaggugcgguaucagagacgacggggcagguucugaccaccaggccaaaccaaaucucccaugaaguccauucacggccacaccuucccccuccaacaaaacagaaaguaggaaacaaggcugccuuuuuaauugcaaucaaauaugcugucugaagucagccagggccccugagcccggccagggaaccaccgugccaccucgaugugaggaugggagcugggauaaggguggcuucuugcccuccucaccaccuguaccugaggcgcccagagugcugucuccacugugaucagcucagccucuggcugccugcaggaggugggaggcagaggggaggaaggugagccagaggcagggacccgguugcacacgcaugcagacuuucucaguguuugauucuguuuguucuccuccuuugcuaaaaugaucauauaguugugugaagcugcugccaagccagggaugggugggacagcacuaccggacugcagcccucugcuccucaggugcccggguccaucuuacuucuguaucuggaacaggaagagccgcagguuaauguucuuggcggccagcagcuuguugcacuccacagagucgaugaugggcagcggcacauagucugucucauugcucucauuggugaagacaaagugguagauaacaggacugauccucacgucgucguaugggcccuugagcagaagaaaagagcacuccaggggugcugugaccuugcucuugaggaguagcuggaaggaaagugugcgcuugcacgacagguugggguugcgcuccgagucauucacacgagccuucaggacccaugucugguucaguacugugaaccgugguguuucauaguacaggcgugugaugaagucaucagugcgguaaggccggaacugaacuucuguggagacagacagggccagacagccaacuguuagugcugaggaaggccaguggguggcgccuuccccaacaggccaaggacaggcucagccagggaggagggccacuuacccagacagcgcgcccgccgcgcucuacuugccacaagguaaggcaaacgcaacuauggcaaauguaagugcacagcuuugggggacaacuacaaacagaauuaacaccaauuagcuggagaguccaggcugugggacauuaggccacguggcccagguguggccaacccacagagccacccuccuuacccucagccccguguccccagaggggcgggguaagcagacacacagacaggauacaguucugagaacaagugcacuuuauugguucugauacaaagcugccagaaaagccagcagguggguauaugguaucugguccugcccaaggggagugccaaguccucaauguugcacugugauguggauucugcccggcuguuuguagggcugucgcuuagcaggcagaccugccucugcaguccuguggcuggcauguccugccguggauguguggguucuuaggcagccaguccuucuuucagggacggggcuucccacccagccucugcuguagccacauggccuggccuacccagaccccgcaggccgugagaucucaaccaaggcuacucuuaaccaagagccauaguuuucugcugcugcaggccccugggcccuuugcaucucaggccuguuugggcuagucuaggcagcauggcaugacuggcuguccaagccugcccugggcgcucugagcuggccaccugccgcaggcugagcaguagagggaauggaguuucccugaguggccccaguaucagcaggugcuucguguucucuggcccaagguguggccuggcucuugcucccgacauguucagagcuggugacagaugcccgggagccaugagauccagugggccuggccugguccagcuuacucauuugugggcauccauucccaguucuacaguuugagcucagacccucagcuuguucuggaacccugucuccaaacagcuucuugccagccucgggaggcucuguagccuucagugaacaucuguagacaggaucugacuugauggaaugcucuucuugcuccgugcuccaaagguaaggcccaaacacccagacugcccaaaacauacccaauuuccuaauuagaccugaccaccccaaauauguggagccccauacagcgaagggggggucaucuugcuaggguggugggcagaggggguggggggaugggacaggugggaaggacauuuauaggagccaugcagguacaucccuccuucugcaaaaucuccaaccuaucuucuuucccgagguaccucccugcccaucggcgcagccugugcccacugcccagagccuacugccuccccugcccuuggcugccagcccuuucaucccaaacagcauccguguggcaugcagaggacugugggaugccucaccuguguagccgaucuucucaaagcugagcaggcugaagaugcuguuguagagcugcaucuccuugcgguggcucugguccaucucgucgaggaucuccaucagcucguugccugucuuggucgggugagcacacgcagcuucaugcacugucagcucauggaaagggccaugccacgggcagccaauacgcuuguacuugcacugugucacccuagcaggggguaagaauagugaucaacucuguggcuggaacaaacggucaugcccaguagucuuuucagagacucuuucugcccaacuacaaacaguucucuguaggauacacugaauugugaggccagccacuuagagcacaugucagcagcacauaagagacugaggagagagaagcacuauaguugguagucaauaugccuccugggcccaguacucaugguguucugccuggggguuagcugguugcugaccauaguaccagacuucacagagccucauuccaggacagcuuguggugccagaaccuugcccggcaaguggcuguuucuauauguugggacuggguugccaaacaagagucucacacaagcuuucuacagcuuuugaacugauccugguguaguggaccuuccaagggccuacucaauagccacagagaauccuacagggcuagcaucauauccagaaagcaacuaguggaaacuguaacuaauugucuucuguagaaagguaugcucuuaccaccuggggccuacacgguuaucacugggcugcauaugugcucuccagggcccagacggugagggcugaccagaucccaaggccacaccuucaccaugguuaccuguccuggcauuccucuuucuggugccucucuaggagggagcgagggaacugacgcagacagaagccacacucugaaggcagcucgcucacagcuuucuccacagccagguuccggcagcagaggcucuuacugaucucacaacgacaguugggacauguggccugcuccuccuucagccgggcaucugcuaguagguggauaaaacagccagcgcacaucaagugaccguuaguacacugcgaagaaggaaagggaggugaagcucacagaccugugggaugcuugcacgcacaugugcccucccacucgugauggcuccagccagaccaguuguccagagggaugcuaggugaggaguaccugaugguucccaagccuugcugguauccagcauacacugagagcugcuucagaugucaugcuagcucugguguugugaagagcggggucuuaucaggucauggggcccuggguacaucuaaagcaggccugucuggcaacugaccugaccacaucugggcuuggaaccuggcuuuuucaccuaucagagaagacuaacaggcucuuggcuugacaugauagaggcacccagccagcagcuguuuaugggaucaugguuacugaugaaguaggcauuuuuuucuuggcuuucaaaaggcuauucauguggggacuagaagggguuccagcugagaucugcccugaucccuccaucuagcccuugccgauacaagaaagaaccaguagcugcaaucagagaaggcaacuaccuacugagguugccccagcaucaauguuacagagccuauggcagggaggaggcuacacuggcccagguaagacuugguacugaacuggguugauauaaaugggaucaccaggagcagacugcuagccugucccugcuuauauacacacagacuuagaauuacucuuguccugggucuccuacugacucaauguauacugaguaccauuuggugccacagauacaggauggacugagaacgcuauaccagggugggcucccacacgguguuaaaggagagaccaguaugucaguacaggguaaucuguacagugugcauuagggaaagagccacgugcagccacuaccuggccaugccaggaggcuacaucugcaucacugccuugcuuaguaaaccuuagcugccaccuuacugcuucagcagguccucugagucuuuggugaaugauggaauccacaugcugaaggcugacagagaagaagccuggugaggaacccaggcccagggagacaccaaaugauuagcuacaaccaaaccuagguuugguugaaaaaguaaaaaacaaucugcugaguccaucucuagaagucaacagacagggcuggagcuggguguagauguagcaggggcugaucaaaucuuuuaucccccauccuccugaggacuucccaggacagugacuauuauuccuucuggaaggcaggagggaauacaacacaaggaaauguucauguguuucagagaggcacucucagggucccccccuagaagugugacacagcauccuucaagaaccccauccagaacugggcguaguauaaucucagaacacaggaggcagaggcagaggcaaaagcagaggcaggacuguuugaggacaguuuggaauaugaaguuauuucugggccagccugggcuacauggugggaccccugucuuaaggaaaaacaaaggaaguucacuuagcaagauagcagcccugagauucccaggaagccacagccccacgagccuuacaagcuuuagucgcuuucugggagcaggcuaccuuacgcaagcuuagaugaugcuuggggcucaggucugcggucacuuucaggauucaccagucugaguagaaggggcaguauuuuccuuugcuguagccugauccucucaagguuucuaagccaggcugaggauaccugcuucuaauaucagcccaggcagacuuggaaaggaguccugggcccuccuagugggagcugagggugccaaucuuaucacuaauucucaguaccacuccuacucccuacccugaaagccaccuaagccugugcuggcucuggccacagagaccauucucaugggaacugcagacuccaaucaauuccacaccacauggcaauagugcuuucuucuaggucccuguggccucugcagaagucugcaaggucuagggaaaguggggugccacagcccugaguggcagaacaagccccaggauguucuguaguguacuggccuacccgaggaccaagacacacccacuuagagccacuuagcagccacucaggauauggucucuagguaagcucucuauaaacaaugcacuuaacccggaacccucucauaacuuccugagcaagacuucaaauauaagugcaggacagccacaguuagccuuagcugggcagccacaguuagccuuagcugggcagccugugccuaucccuaacuuauauagcccacugucuauuccaaagcuugggcacagaugguuccacagugucugcuacagugccuaggcaccuccagaaagugcuccugcaauggccaggccaggcuaccaucccaccaucaaccagguaaauucuagacuucuauccaagaugacgcugcaggucuuuccaggcccucuuaucacagauacugacuuggagcucacaggacugaguucaucccucagccacacaccaccaccagcaucaucuuggacuuaucaucuucucucugcagguuuugguuucuugcugggcacaggauaccacaggagaggcaauguguugcagagaagccucacauucagacugcagcagccucgguacaaacgccacccagcagucacccaugucagagcuucuagggcuccauccccagggggcugagguccugggcuccucuaaguaguccccacaggcuaggauccaguucuuccaucuuccagccugucggcaguucacauccuaagccuaugcauguccagggcaggaguguucuauuugagcuggauucucauucgggugaaaagagcuagauggaauagcuaugguuaagaagaagcccugccccugagccacaaacaggucuuagaaaugggucuuccucaacuuacaguugaucgcaaguccccuguggccaguuagaaucuuucaaaccuagaacauaugguccuugcaaacauugggggcccaaaauagaguauggaugguacccagaccgauaugaacauccugcccuccugcucaggguaccagacucacagacucuugacagagccacugguacccaaaugcacuaauagcaaggugcugcucagccaccuggaggcuguuuuuuucuaguuucccauggugucuuagaugcaguuauggcucuaucaggcauaguggcaucuugagaguuaaccacuucuugagccuccacagucaagcauggaccugagcagaacuggcuccuuguccauggguacaaaucuaauaugggggaagcaaggacaagaaccuuccacucaggcuggaucugaaguuccagacuggccacaugcaggauucagacagggcccaacuauccccuagaagguggcuuuuacucagaaaugaacacugcuuagaguuaaacagcaauucaaaauaacacacuaccaauaugcacacacacacacacacaccaaaaaccaaaacaaaauccuagacucuaggaagccuacaguccuuuggacaccuaagcgauccuuuuuccagacucuuuccugaccuauggaaaugaggggcuggagaguuagcucagcaguuaauaacaccugcuguagcucacagccagccacaacuccugcuucaggggauuuaaagccuuguucugaugucugaaggcgacaggcacauacacggugcacaugcaugcaagugggcaaaacagucacauacauaaaaacaaaugaggaggaggaggaagaggaggagaagaagaggaggagccaagaagcaacagcagcagugccagggcaucccaggcccuggacaauaaauaaccucagaagggggccugggcagagauggaacaaguguuuucuggacuuucugucggccagauagucuucucuggcauucagaggcaaagacaacagcagaacacgccaaccagccuguggccagggagggaaaggacuggaguccuugcagaagggagaauagaaggccucaagauggggucuuguuacagucaggcccaauaggaagcacggaggcggguagagauguggagaggguggcucagaagggaaacaaguaggagcaacaguggaacagugacagagggcccuggccacagaaaucacgagcccacacuagcuacauagccagaccaccguauucuguggcagaggcccauuuaacugaucccugaccucagaggcuugugaaggcugagaggaaggagcacuaucuuuagcagaugcagugcugaggggcugagccugguugacacccaaggaaagggucaaggcugagucuaucuuacaaaaguccacacugggcgguaugugaaggacuggagcaggaagcuacgggaaguaggucaggacuuaagcugcaacauuacaggcuggggcucccucagagaagucacuuccaugugcaguuacugacuggcuacauugucugcuggccucaugaauacaucuagaacagggggccagcacaagccgccuguccaucugcccagucuggacuagccagaaguucuugugucaguuugccucuggccuucaugccaucuaccaggcaccugccauaguggcugccugacuuuagaaggguccucccuagacucaggaagguggcuucacaccuuguugggccaguugcccaggauauaccuaacacccacacagagaacaucaaagcaugcaccuguuguagcaggugacacaggccccagggauaagaacuacuugguugacggccuuggucagacaaccugaauaaauuuccuagucugggauaugucagugggugaguauggcccaugggaauuggcccugcagguccaaaggcugucucaggcccagguggacgagcccgcauacacaggcugaaucuguucuugucugccuccaagagguucucuggcuucacagguggcauauggauaacacucucaaguuaccaugcaccuagccaaccucagcagcccguagcuuccccccaagcccagugccagacguagcaugguuacccacuucuuaucaccccagcagagccaagagucagcccccagaaugcacagcauggcuggugccaccuggagcuaaguguucugcugaggucaggcaaauguugccagcaacagcugaagguggcaacuacggagacagcccaucaacacgggauagacaggaaagcuagcagaagauagaagagcugagcgcaggcagaggugaugacccacacuagaucacuaccagggauagucugugcucggauccugagaagaccaggaaagaagccuggggaggccugccugguaccuuaguaagacagcaacaggacccuccaggcagggcuguacggcacauguaaggagacugccaugaaguguuucuggcagcauuccuagacaccaggacguucccuuccuuauucuucuugcugcacucccauuuuacaugcuaucuguggacagucaaaguuccagcauuugcccaagacucuuccaaaaugacauauucuagaggacucucccaguccuuaggacagggaagcaucuagguaucuacccuggcagaagggaggugcgaaggaggcuaguggcagggcuuggagaucaaugucaaugcacacagcucaucucagagaaccuggcagccuucccccugggucaggaucugggaaggcagccccuccacucacuucaucuaguacaucccucagcugccugacuucagaugcccaacccagagcaacaacuaacacaguguguagacugguuugaaccagcuagucucauuagccacuuugggcagaagcagaacuguggcucucuguguagaccaggagccaaugccauguggccuaccaucaugccaggaccaacugggaaaccccugaauuccuugggacccccuuccauuggccugucuugcuggauucucacgaaauccuaggaaaggaagaacuccccccacuaagaagggccgagaagccaagacaagaaaaaggcuagcugugagcagguucugauggccccuaaaaugagagguaaauaccggugcuagaaucagcagcugugggaaacuugucuccaguucgcccggccuaacaccuaggagggugacugccccauccaggucaucaggaucaccccacaccaccucaaaaccacaagccaaggcagaaagaacacggagauccaaaggagagggaaacggcuacacagacuagaccucuacuggcccucagccaggucuucuguguaaagaaaagcagggaaacaggccccaccagccacuuuuagcuccugaaaguacaaagaaagcugacaagagacucugcucuguuuuucaaagaggcugggaacugaggcagaaagaccaggggaagguggacagacauuucccacugaaccagaggucugcucucuuuuaccuggaagaggacauguuagacccacacagaccaggacucugagacugacuggcaugcugggucuucaagugggaaggcaggacaaaguuccuggauacuggcaaccuuggaagccagcuugguaugggugagguggccccgaauagaaauacuggcuaggcuggggcaggagaaaguacccugacaguaaaguuuguugcggauugcuuccuccagaucagaacugagaagggaugagaggcccuccuuucuuccaggucuucagaaggacacaggacugacuccccagggcacaaaagaagauuuacuuaguuguucagauauggaaggacacuuuuggggguguggcugccagaauuggagcccugucuccaggaaagaaguuucuucacccaggggucuagaagugagggacaguauugaugagcaguagaaaaggguggguaccuguucacagaucucuacauggucagcugaaaagaauguggaaucuaucaaggaggcacccuggaggaaccagaaggugaagagaucuacggaggagaauggaaauucagacuggggaguaaaggguaccaucgaacacagaaaaugagauucagagcaagaaaggauaaggagccucgagagacaggagcgggguuucguagaccuggaagguggauguuuggauaggaaggauucccggccaccggccacaggccuccaggcaacgcggcgccgggccgggccggcggcccuaccugguacacggaagccuugggcagguccaggcacacggugcagcacagcaccgaguagagacgcuccuccagcuuuccacugcccgcugccacugccgccgccgccgccucggcugccucggccgcccgcagccgcuucuugggcggcgcgucggggucgccggccgccucuugcagcugccgagcgccggccagggccgccucguccgggaucccgggccccgccgccucgcccagagccgccgcagccggccccgcggcagccccaggcccggccccuaccccgaccccggccggcacggcacccgcgggcccugcagccgggccacccccgccggccuccucggcgccggacaucacggccggccggcccggcgggcgggugccggcgcgcucgccggcuggaaguuagggucgccgcgcgcccuugccggcuucucacugccgcggcgaccccgcagccugcccaccgugcagcugccucagugggccuggcccgcccgucggcccgcagccgccccggccaccaaccccggcgcggccgccaucuuuguuuucgcugcggaccccccccccacgccaccgcccccucgcccuccugaucacgugggccucgcgcaagccaauggaagcgccgcgagggccaagacgacgcggcggccaccuccaauggacgagcgaggacgccagagagcccacccacccucgaaggugaacagaagggggugggguccaggaggggauccggagaagggcgggggguggggggauuuggggaguccgcccuuggagagguaccaucagcuucggggucuggagaggcccccagacuucagacuccucgagagugcaaagcgccccuaagccucccaugucgcgcucgcgcgcgggggguggggggggaugccugugccaauguguacagaaauucgggcuugugugugcaaggcucuggccuagcugaccggaguauuagagcaggaucuugaaaaacgcaccuaccaccacucuugcgcgacgguauaaaggucaacaagaugcaaguacaggaacagcgaaggauuauuggguucacucccuaacccaccucuuucgucccaaccucagaguuggagaaagaaagaguuggaguagaagaaagaaagaguuggaauagaagaaagaggggguuuuaaguuauaagguaugucuugcacagacaagagggugucaaacagguaguaaucaagucaguccagagagaugugcaauuucugggaaucgcugaggguauagcacucuucugcccuuuaugaaaacagccaucaguuugugaaggucauugccccagagggccaccugccagguccaccaaggauauaugcaaauuuacugugucccaggaaaccaaggcccaaaacucucuucucacgggaaguugguuuuuuuuuuucucuuuucuuuuuuaaaaauguuuuucuuucuucuuuuucuuuucuuucuuucuuuuuuugauacagggucucacuauauguugcacuggccauucuggaacucacuauguaggccagccuggccacccacaacucacagagaucugcuugucucugccucccaacuggaauuaaagaccugcaccaccaugccuggcacucuggggguucucuuggcaagucuaccaggaugccaaagugaauaauaccuucugcuacuuacagcccaucccccacuccuuuacucagggaaaucaccuuacaggccuuaggaagcuagcucaagaauaaacaaauuccauacuccuguauauuccuuacguuuauuggaaaucaggucucugacucacaaccauguuccucccaggccccaaguguccugaagaccuguuguuagcauucugguuuagguaaacuuccacacaugcaugacuagagaagggauagcacccaagcucugcccauuaguaaaauuauaacaggcucuacaugugggcagguaggaggcauaguaguaccuggcacagaagccccaaucagugcuacaaucacucccacugcaggcgcugugugugcagggcccugcaauaggcccaacuaccugcagccagggcccaacgacagacauccuccuuuggcagcaguagcagccugucuucuuccagccugcucaagaggccugccacacccagcaggguacccccccacaucccguaaguguuagcugugaaaacagccacaauaaggauggucacugcaaccaccagcaguacugccugcccagcgacagagcacccuucagggcccaggugaucaccagccacugccagcaccaugccuccucccagaagcagguuggcagaagagcgguccccauucacccagugaaaaucgaaggccagaagaggcagaccgaugacuguggcaacccaagcuccagcgagacagucuucaugugugcucggcccuggggccaacauaaugauggcagcaaaggucuggagcaggaagccggcagcugcuccucgacuggacuguugacaccgggaaagagagacacguuaagggaaaagaagccauuuaaaagcagccacuuuuaaguaggaaagaguuugggacuguuaaggagucccagccucccaugggaggagcaucauccucuuucuaguggagggaucuacauaguuugugaaaguaagaauauucaccuguagccgggcaugguggcacacaccuuugaucccagcacucagggggcagaggcaggcggauuucugaguucgaggccacccuggucuacaaagugaguuccaggacagccagggcuauacagagaaacccugucucgaaaaaccaaaaaaaaaaaaaaaaaaaaaagaauauucaccuguacagagcucaccgcugcaugcagggacaccccugccaauaccaggugggacaggacagugcuccauucaguccuggguuuggaaaccaugacacguugaauaguagugaguuugaggagauaggaaaugaaucuucaaauuaggagagaaguacacacagaggcuggcgaucuggaguccuuaguggagcucuucaggaaccucgaguuccagagaccuuugaguagacauuagaagagauucaguuccaaacuuuuuggagcccugaggucacuggacucaccugcaaggaagaaggacuaauuuccuggggaaggggaaugggauuggaaucuuggcgcccaagcgugguaucagcccagggacucaaaacggcaagaggagcugucucuugcuguggucugggcacgguccuaguuauggccuuccaugccugagaaugauagaagggaagaagcagcagcggagcacaggcagcgcacaacaccuggagacgcggagcugaaggcccgaacccgcccacaacagucugccccgccuccuagcccgcccucccgaggcgcggauuggagcagccggcuuacauccacuaacgagaggagcuccggcuagagcggcggggcggggccuguggagggcugcggaggcucuagagggguggggcugggagcgcggagguggcgaccagagguucaguacuaguuugugguuuagauagucucuuuacauuacccuggcuguccuggaacuuccuguauagaccaggcuggccucagacucacugagauuugccugucucugccuucugagcguugggauuaaaggcaugcgucacagcccaugaucuucggcacggguuugcuggagcacuggcauugcgaagcgccccgggucugagccgggagauguagguggggcuucggggcagcaggcguggacugagaaaagaggcggcacuucgaggggucuaggcggagcugugagaag

SEQ ID NO: 7844 - RNA, 16816 nt, Mus musculus
cuucucacagcuccgccuagaccccucgaagugccgccucuuuucucaguccacgccugcugccccgaagccccaccuacaucucccggcucagacccggggcgcuucgcaaugccagugcuccagcaaacccgugccgaagaucaugggcugugacgcaugccuuuaaucccaacgcucagaaggcagagacaggcaaaucucagugagucugaggccagccuggucuauacaggaaguuccaggacagccaggguaauguaaagagacuaucuaaaccacaaacuaguacugaaccucuggucgccaccuccgcgcucccagccccaccccucuagagccuccgcagcccuccacaggccccgccccgccgcucuagccggagcuccucucguuaguggauguaagccggcugcuccaauccgcgccucgggagggcgggcuaggaggcggggcagacuguugugggcggguucgggccuucagcuccgcgucuccagguguugugcgcugccugugcuccgcugcugcuucuucccuucuaucauucucaggcauggaaggccauaacuaggaccgugcccagaccacagcaagagacagcuccucuugccguuuugagucccugggcugauaccacgcuugggcgccaagauuccaaucccauuccccuuccccaggaaauuaguccuucuuccuugcaggugaguccagugaccucagggcuccaaaaaguuuggaacugaaucucuucuaaugucuacucaaaggucucuggaacucgagguuccugaagagcuccacuaaggacuccagaucgccagccucuguguguacuucucuccuaauuugaagauucauuuccuaucuccucaaacucacuacuauucaacgugucaugguuuccaaacccaggacugaauggagcacuguccugucccaccugguauuggcaggggugucccugcaugcagcggugagcucuguacaggugaauauucuuuuuuuuuuuuuuuuuuuuuugguuuuucgagacaggguuucucuguauagcccuggcuguccuggaacucacuuuguagaccaggguggccucgaacucagaaauccgccugccucugcccccugagugcugggaucaaaggugugugccaccaugcccggcuacaggugaauauucuuacuuucacaaacuauguagaucccuccacuagaaagaggaugaugcuccucccaugggaggcugggacuccuuaacagucccaaacucuuuccuacuuaaaaguggcugcuuuuaaauggcuucuuuucccuuaacgugucucucuuucccggugucaacaguccagucgaggagcagcugccggcuuccugcuccagaccuuugcugccaucauuauguuggccccagggccgagcacacaugaagacugucucgcuggagcuuggguugccacagucaucggucugccucuucuggccuucgauuuucacugggugaauggggaccgcucuucugccaaccugcuucugggaggaggcauggugcuggcaguggcuggugaucaccugggcccugaagggugcucugucgcugggcaggcaguacugcuggugguugcagugaccauccuuauuguggcuguuuucacagcuaacacuuacgggauguggggggguacccugcuggguguggcaggccucuugagcaggcuggaagaagacaggcugcuacugcugccaaaggaggaugucugucguugggcccuggcugcagguaguugggccuauugcagggcccugcacacacagcgccugcagugggagugauuguagcacugauuggggcuucugugccagguacuacuaugccuccuaccugcccacauguagagccuguuauaauuuuacuaaugggcagagcuugggugcuaucccuucucuagucaugcauguguggaaguuuaccuaaaccagaaugcuaacaacaggucuucaggacacuuggggccugggaggaacaugguugugagucagagaccugauuuccaauaaacguaaggaauauacaggaguauggaauuuguuuauucuugagcuagcuuccuaaggccuguaaggugauuucccugaguaaaggagugggggaugggcuguaaguagcagaagguauuauucacuuuggcauccugguagacuugccaagagaacccccagagugccaggcaugguggugcaggucuuuaauuccaguugggaggcagagacaagcagaucucugugaguuguggguggccaggcuggccuacauagugaguuccagaauggccagugcaacauauagugagacccuguaucaaaaaaagaaagaaagaaaagaaaaagaagaaagaaaaacauuuuuaaaaaagaaaagagaaaaaaaaaaaccaacuucccgugagaagagaguuuugggccuugguuuccugggacacaguaaauuugcauauauccuugguggaccuggcagguggcccucuggggcaaugaccuucacaaacugauggcuguuuucauaaagggcagaagagugcuauacccucagcgauucccagaaauugcacaucucucuggacugacuugauuacuaccuguuugacacccucuugucugugcaagacauaccuuauaacuuaaaacccccucuuucuucuauuccaacucuuucuuucuucuacuccaacucuuucuuucuccaacucugagguugggacgaaagagguggguuagggagugaacccaauaauccuucgcuguuccuguacuugcaucuuguugaccuuuauaccgucgcgcaagaguggugguaggugcguuuuucaagauccugcucuaauacuccggucagcuaggccagagccuugcacacacaagcccgaauuucuguacacauuggcacaggcauccccccccaccccccgcgcgcgagcgcgacaugggaggcuuaggggcgcuuugcacucucgaggagucugaagucugggggccucuccagaccccgaagcugaugguaccucuccaagggcggacuccccaaauccccccaccccccgcccuucuccggauccccuccuggaccccacccccuucuguucaccuucgagggugggugggcucucuggcguccucgcucguccauuggagguggccgccgcgucgucuuggcccucgcggcgcuuccauuggcuugcgcgaggcccacgugaucaggagggcgagggggcgguggcgugggggggggguccgcagcgaaaacaaagauggcggccgcgccgggguugguggccggggcggcugcgggccgacgggcgggccaggcccacugaggcagcugcacggugggcaggcugcggggucgccgcggcagugagaagccggcaagggcgcgcggcgacccuaacuuccagccggcgagcgcgccggcacccgcccgccgggccggccggccgugauguccggcgccgaggaggccggcggggguggcccggcugcagggcccgcgggugccgugccggccggggucgggguaggggccgggccuggggcugccgcggggccggcugcggcggcucugggcgaggcggcggggcccgggaucccggacgaggcggcccuggccggcgcucggcagcugcaagaggcggccggcgaccccgacgcgccgcccaagaagcggcugcgggcggccgaggcagccgaggcggcggcggcggcaguggcagcgggcaguggaaagcuggaggagcgucucuacucggugcugugcugcaccgugugccuggaccugcccaaggcuuccguguaccagguagggccgccggcccggcccggcgccgcguugccuggaggccuguggccgguggccgggaauccuuccuauccaaacauccaccuuccaggucuacgaaaccccgcuccugucucucgaggcuccuuauccuuucuugcucugaaucucauuuucuguguucgaugguacccuuuacuccccagucugaauuuccauucuccuccguagaucucuucaccuucugguuccuccagggugccuccuugauagauuccacauucuuuucagcugaccauguagagaucugugaacagguacccacccuuuucuacugcucaucaauacugucccucacuucuagaccccugggugaagaaacuucuuuccuggagacagggcuccaauucuggcagccacacccccaaaaguguccuuccauaucugaacaacuaaguaaaucuucuuuugugcccuggggagucaguccuguguccuucugaagaccuggaagaaaggagggccucucaucccuucucaguucugaucuggaggaagcaauccgcaacaaacuuuacugucaggguacuuucuccugccccagccuagccaguauuucuauucggggccaccucacccauaccaagcuggcuuccaagguugccaguauccaggaacuuuguccugccuucccacuugaagacccagcaugccagucagucucagaguccuggucugugugggucuaacauguccucuuccagguaaaagagagcagaccucugguucagugggaaaugucuguccaccuuccccuggucuuucugccucaguucccagccucuuugaaaaacagagcagagucucuugucagcuuucuuuguacuuucaggagcuaaaaguggcugguggggccuguuucccugcuuuucuuuacacagaagaccuggcugagggccaguagaggucuagucuguguagccguuucccucuccuuuggaucuccguguucuuucugccuuggcuugugguuuugaggugguguggggugauccugaugaccuggauggggcagucacccuccuagguguuaggccgggcgaacuggagacaaguuucccacagcugcugauucuagcaccgguauuuaccucucauuuuaggggccaucagaaccugcucacagcuagccuuuuucuugucuuggcuucucggcccuucuuaguggggggaguucuuccuuuccuaggauuucgugagaauccagcaagacaggccaauggaagggggucccaaggaauucagggguuucccaguugguccuggcaugaugguaggccacauggcauuggcuccuggucuacacagagagccacaguucugcuucugcccaaaguggcuaaugagacuagcugguucaaaccagucuacacacuguguuaguuguugcucuggguugggcaucugaagucaggcagcugagggauguacuagaugaagugaguggaggggcugccuucccagauccugacccagggggaaggcugccagguucucugagaugagcugugugcauugacauugaucuccaagcccugccacuagccuccuucgcaccucccuucugccaggguagauaccuagaugcuucccuguccuaaggacugggagaguccucuagaauaugucauuuuggaagagucuugggcaaaugcuggaacuuugacuguccacagauagcauguaaaaugggagugcagcaagaagaauaaggaagggaacguccuggugucuaggaaugcugccagaaacacuucauggcagucuccuuacaugugccguacagcccugccuggaggguccuguugcugucuuacuaagguaccaggcaggccuccccaggcuucuuuccuggucuucucaggauccgagcacagacuaucccugguagugaucuagugugggucaucaccucugccugcgcucagcucuucuaucuucugcuagcuuuccugucuaucccguguugaugggcugucuccguaguugccaccuucagcuguugcuggcaacauuugccugaccucagcagaacacuuagcuccagguggcaccagccaugcugugcauucugggggcugacucuuggcucugcuggggugauaagaaguggguaaccaugcuacgucuggcacugggcuuggggggaagcuacgggcugcugagguuggcuaggugcaugguaacuugagaguguuauccauaugccaccugugaagccagagaaccucuuggaggcagacaagaacagauucagccuguguaugcgggcucguccaccugggccugagacagccuuuggaccugcagggccaauucccaugggccauacucacccacugacauaucccagacuaggaaauuuauucagguugucugaccaaggccgucaaccaaguaguucuuaucccuggggccugugucaccugcuacaacaggugcaugcuuugauguucucuguguggguguuagguauauccugggcaacuggcccaacaaggugugaagccaccuuccugagucuagggaggacccuucuaaagucaggcagccacuauggcaggugccugguagauggcaugaaggccagaggcaaacugacacaagaacuucuggcuaguccagacugggcagauggacaggcggcuugugcuggcccccuguucuagauguauucaugaggccagcagacaauguagccagucaguaacugcacauggaagugacuucucugagggagccccagccuguaauguugcagcuuaaguccugaccuacuucccguagcuuccugcuccaguccuucacauaccgcccaguguggacuuuuguaagauagacucagccuugacccuuuccuugggugucaaccaggcucagccccucagcacugcaucugcuaaagauagugcuccuuccucucagccuucacaagccucugaggucagggaucaguuaaaugggccucugccacagaauacgguggucuggcuauguagcuagugugggcucgugauuucuguggccagggcccucugucacuguuccacuguugcuccuacuuguuucccuucugagccacccucuccacaucucuacccgccuccgugcuuccuauugggccugacuguaacaagaccccaucuugaggccuucuauucucccuucugcaaggacuccaguccuuucccucccuggccacaggcugguuggcguguucugcuguugucuuugccucugaaugccagagaagacuaucuggccgacagaaaguccagaaaacacuuguuccaucucugcccaggcccccuucugagguuauuuauuguccagggccugggaugcccuggcacugcugcuguugcuucuuggcuccuccucuucuucuccuccucuuccuccuccuccucauuuguuuuuauguaugugacuguuuugcccacuugcaugcaugugcaccguguaugugccugucgccuucagacaucagaacaaggcuuuaaauccccugaagcaggaguuguggcuggcugugagcuacagcagguguuauuaacugcugagcuaacucuccagccccucauuuccauaggucaggaaagagucuggaaaaaggaucgcuuagguguccaaaggacuguaggcuuccuagagucuaggauuuuguuuugguuuuuggugugugugugugugugugcauauugguaguguguuauuuugaauugcuguuuaacucuaagcaguguucauuucugaguaaaagccaccuucuaggggauaguugggcccugucugaauccugcauguggccagucuggaacuucagauccagccugaguggaagguucuuguccuugcuucccccauauuagauuuguacccauggacaaggagccaguucugcucagguccaugcuugacuguggaggcucaagaagugguuaacucucaagaugccacuaugccugauagagccauaacugcaucuaagacaccaugggaaacuagaaaaaaacagccuccagguggcugagcagcaccuugcuauuagugcauuuggguaccaguggcucugucaagagucugugagucugguacccugagcaggagggcaggauguucauaucggucuggguaccauccauacucuauuuugggcccccaauguuugcaaggaccauauguucuagguuugaaagauucuaacuggccacaggggacuugcgaucaacuguaaguugaggaagacccauuucuaagaccuguuuguggcucaggggcagggcuucuucuuaaccauagcuauuccaucuagcucuuuucacccgaaugagaauccagcucaaauagaacacuccugcccuggacaugcauaggcuuaggaugugaacugccgacaggcuggaagauggaagaacuggauccuagccuguggggacuacuuagaggagcccaggaccucagcccccuggggauggagcccuagaagcucugacaugggugacugcuggguggcguuuguaccgaggcugcugcagucugaaugugaggcuucucugcaacacauugccucuccugugguauccugugcccagcaagaaaccaaaaccugcagagagaagaugauaaguccaagaugaugcugguggugguguguggcugagggaugaacucaguccugugagcuccaagucaguaucugugauaagagggccuggaaagaccugcagcgucaucuuggauagaagucuagaauuuaccugguugauggugggaugguagccuggccuggccauugcaggagcacuuucuggaggugccuaggcacuguagcagacacuguggaaccaucugugcccaagcuuuggaauagacagugggcuauauaaguuagggauaggcacaggcugcccagcuaaggcuaacuguggcugcccagcuaaggcuaacuguggcuguccugcacuuauauuugaagucuugcucaggaaguuaugagaggguuccggguuaagugcauuguuuauagagagcuuaccuagagaccauauccugaguggcugcuaaguggcucuaagugggugugucuugguccucggguaggccaguacacuacagaacauccuggggcuuguucugccacucagggcuguggcaccccacuuucccuagaccuugcagacuucugcagaggccacagggaccuagaagaaagcacuauugccaugugguguggaauugauuggagucugcaguucccaugagaauggucucuguggccagagccagcacaggcuuagguggcuuucaggguagggaguaggagugguacugagaauuagugauaagauuggcacccucagcucccacuaggagggcccaggacuccuuuccaagucugccugggcugauauuagaagcagguauccucagccuggcuuagaaaccuugagaggaucaggcuacagcaaaggaaaauacugccccuucuacucagacuggugaauccugaaagugaccgcagaccugagccccaagcaucaucuaagcuugcguaagguagccugcucccagaaagcgacuaaagcuuguaaggcucguggggcuguggcuuccugggaaucucagggcugcuaucuugcuaagugaacuuccuuuguuuuuccuuaagacaggggucccaccauguagcccaggcuggcccagaaauaacuucauauuccaaacuguccucaaacaguccugccucugcuuuugccucugccucugccuccuguguucugagauuauacuacgcccaguucuggaugggguucuugaaggaugcugugucacacuucuagggggggacccugagagugccucucugaaacacaugaacauuuccuuguguuguauucccuccugccuuccagaaggaauaauagucacuguccugggaaguccucaggaggaugggggauaaaagauuugaucagccccugcuacaucuacacccagcuccagcccugucuguugacuucuagagauggacucagcagauuguuuuuuacuuuuucaaccaaaccuagguuugguuguagcuaaucauuuggugucucccugggccuggguuccucaccaggcuucuucucugucagccuucagcauguggauuccaucauucaccaaagacucagaggaccugcugaagcaguaagguggcagcuaagguuuacuaagcaaggcagugaugcagauguagccuccuggcauggccagguaguggcugcacguggcucuuucccuaaugcacacuguacagauuacccuguacugacauacuggucucuccuuuaacaccgugugggagcccacccugguauagcguucucaguccauccuguaucuguggcaccaaaugguacucaguauacauugagucaguaggagacccaggacaagaguaauucuaagucuguguguauauaagcagggacaggcuagcagucugcuccuggugaucccauuuauaucaacccaguucaguaccaagucuuaccugggccaguguagccuccucccugccauaggcucuguaacauugaugcuggggcaaccucaguagguaguugccuucucugauugcagcuacugguucuuucuuguaucggcaagggcuagauggagggaucagggcagaucucagcuggaaccccuucuaguccccacaugaauagccuuuugaaagccaagaaaaaaaugccuacuucaucaguaaccaugaucccauaaacagcugcuggcugggugccucuaucaugucaagccaagagccuguuagucuucucugauaggugaaaaagccagguuccaagcccagauguggucaggucaguugccagacaggccugcuuuagauguacccagggccccaugaccugauaagaccccgcucuucacaacaccagagcuagcaugacaucugaagcagcucucaguguaugcuggauaccagcaaggcuugggaaccaucagguacuccucaccuagcaucccucuggacaacuggucuggcuggagccaucacgagugggagggcacaugugcgugcaagcaucccacaggucugugagcuucaccucccuuuccuucuucgcaguguacuaacggucacuugaugugcgcuggcuguuuuauccaccuacuagcagaugcccggcugaaggaggagcaggccacaugucccaacugucguugugagaucaguaagagccucugcugccggaaccuggcuguggagaaagcugugagcgagcugccuucagaguguggcuucugucugcgucaguucccucgcucccuccuagagaggcaccagaaagaggaaugccaggacagguaaccauggugaagguguggccuugggaucuggucagcccucaccgucugggcccuggagagcacauaugcagcccagugauaaccguguaggccccaggugguaagagcauaccuuucuacagaagacaauuaguuacaguuuccacuaguugcuuucuggauaugaugcuagcccuguaggauucucuguggcuauugaguaggcccuuggaagguccacuacaccaggaucaguucaaaagcuguagaaagcuugugugagacucuuguuuggcaacccagucccaacauauagaaacagccacuugccgggcaagguucuggcaccacaagcuguccuggaaugaggcucugugaagucugguacuauggucagcaaccagcuaacccccaggcagaacaccaugaguacugggcccaggaggcauauugacuaccaacuauagugcuucucucuccucagucucuuaugugcugcugacaugugcucuaaguggcuggccucacaauucaguguauccuacagagaacuguuuguaguugggcagaaagagucucugaaaagacuacugggcaugaccguuuguuccagccacagaguugaucacuauucuuacccccugcuagggugacacagugcaaguacaagcguauuggcugcccguggcauggcccuuuccaugagcugacagugcaugaagcugcgugugcucacccgaccaagacaggcaacgagcugauggagauccucgacgagauggaccagagccaccgcaaggagaugcagcucuacaacagcaucuucagccugcucagcuuugagaagaucggcuacacaggugaggcaucccacaguccucugcaugccacacggaugcuguuugggaugaaagggcuggcagccaagggcaggggaggcaguaggcucugggcagugggcacaggcugcgccgaugggcagggagguaccucgggaaagaagauagguuggagauuuugcagaaggagggauguaccugcauggcuccuauaaauguccuucccaccugucccauccccccacccccucugcccaccacccuagcaagaugacccccccuucgcuguauggggcuccacauauuugggguggucaggucuaauuaggaaauuggguauguuuugggcagucuggguguuugggccuuaccuuuggagcacggagcaagaagagcauuccaucaagucagauccugucuacagauguucacugaaggcuacagagccucccgaggcuggcaagaagcuguuuggagacaggguuccagaacaagcugagggucugagcucaaacuguagaacugggaauggaugcccacaaaugaguaagcuggaccaggccaggcccacuggaucucauggcucccgggcaucugucaccagcucugaacaugucgggagcaagagccaggccacaccuugggccagagaacacgaagcaccugcugauacuggggccacucagggaaacuccauucccucuacugcucagccugcggcagguggccagcucagagcgcccagggcaggcuuggacagccagucaugccaugcugccuagacuagcccaaacaggccugagaugcaaagggcccaggggccugcagcagcagaaaacuauggcucuugguuaagaguagccuugguugagaucucacggccugcggggucuggguaggccaggccauguggcuacagcagaggcugggugggaagccccgucccugaaagaaggacuggcugccuaagaacccacacauccacggcaggacaugccagccacaggacugcagaggcaggucugccugcuaagcgacagcccuacaaacagccgggcagaauccacaucacagugcaacauugaggacuuggcacuccccuugggcaggaccagauaccauauacccaccugcuggcuuuucuggcagcuuuguaucagaaccaauaaagugcacuuguucucagaacuguauccugucugugugucugcuuaccccgccccucuggggacacggggcugaggguaaggaggguggcucuguggguuggccacaccugggccacguggccuaaugucccacagccuggacucuccagcuaauugguguuaauucuguuuguaguugucccccaaagcugugcacuuacauuugccauaguugcguuugccuuaccuuguggcaaguagagcgcggcgggcgcgcugucuggguaaguggcccuccucccuggcugagccuguccuuggccuguuggggaaggcgccacccacuggccuuccucagcacuaacaguuggcugucuggcccugucugucuccacagaaguucaguuccggccuuaccgcacugaugacuucaucacacgccuguacuaugaaacaccacgguucacaguacugaaccagacauggguccugaaggcucgugugaaugacucggagcgcaaccccaaccugucgugcaagcgcacacuuuccuuccagcuacuccucaagagcaaggucacagcaccccuggagugcucuuuucuucugcucaagggcccauacgacgacgugaggaucaguccuguuaucuaccacuuugucuucaccaaugagagcaaugagacagacuaugugccgcugcccaucaucgacucuguggagugcaacaagcugcuggccgccaagaacauuaaccugcggcucuuccuguuccagauacagaaguaagauggacccgggcaccugaggagcagagggcugcaguccgguagugcugucccacccaucccuggcuuggcagcagcuucacacaacuauaugaucauuuuagcaaaggaggagaacaaacagaaucaaacacugagaaagucugcaugcgugugcaaccgggucccugccucuggcucaccuuccuccccucugccucccaccuccugcaggcagccagaggcugagcugaucacaguggagacagcacucugggcgccucagguacagguggugaggagggcaagaagccacccuuaucccagcucccauccucacaucgagguggcacggugguucccuggccgggcucaggggcccuggcugacuucagacagcauauuugauugcaauuaaaaaggcagccuuguuuccuacuuucuguuuuguuggagggggaagguguggccgugaauggacuucaugggagauuugguuuggccugguggucagaaccugccccgucgucucugauaccgcaccuaugugugcaucccaggaaagacuuaagagacacugcccccccaccccccccacagucuucucagagggauugggacuaaggccuggccagugagccagaaaggguuggccuuccccagccgcugaccacucagaggaagcaggacuuggcugguagggcuaaacaaauguuuucggaaugcagggugaaauucugucucuuccaggaaaaaaaaaaaucaacucuacaggcucuguaagugaugcagguuuagugagagagaaggaaucuguuugcuuuacucagcacagagggccagguguccucagggugcccaggaggcagcuacuguccgaggccugcguuuagugguggcgggggcaccacaggaccaaggcagagcagcacgguuuaucauguaggcaauguaggccuuccccucacuagcccauucacagaugcucugaguggugguuguaagcaggacaaguauuagggccucacguacuaugaagcagccgugcuugaauagggcuaggcccugguccuuuucccuuggauuccucagagggacugagaaggguaggacuugccuccuucagucuuugcuuaggagaugaggcucuucgucauagcuuuucguugcuuuaauaccaaagaacugguuuccucugcccuaaccagaccuucacacgccucagaguagucccuaccaacccgugcaaacugccccggccugggccugggccugagccugggucugaacugcccugugccuuccaaaccaagggacaggguagcccuggacaugugaguacaagugcugaugucccacccugaccuucaagagggcaaacgggcugacagaugaggaaaggacaugggguacaggcccugucuguuuccacuugggcccucccaccuucucauaggcugaacguuuucagcaccuaguuuggcuuccugcauggggcuugugggaauucucuucugcagauacggcuucugccuacuacaaaggagcccaugccagagucagcacauccaugaaugcaguggccuucgauuccgauauggcuccucgauguccucugcccuuagggacagaggaccuuuggaaaacaggcuccucugggagucccucuagauuccaaggugaugguguaaaaaaguagggcagggcuagcuugcccuaauaacccaugugcgagcgaccgacuccuagaaagcagccugaaggucucucaggaagagaagauagaaggcuuuuuccccacggcaaagccaaccgggacacagugggcaugaggagaaaagcugggcuggcggaggcucagaggcagcagagcuuuggguauuuguauguggagcugagaggcauaccccaagguacauaggguuagaggcugugccuggaugagacccaccgagggggaagagugugucaagggguaccuaggagaccugcuaagccgucccagcaacagggcccguguggccccuacacuaugacugacaugugcagcuguugagccuuccagccuagggaaccaaacauggagaagacuaguguuucuuggcuaugcuggggacuggcauacaaaucuuucagcacugucacugugggcccuuuauuuagggcuggggggcaccauaucuacuggcuuguguccaggaucuuguuaccuugcuguucuaaccugguucuuuguugucucugaggacuggagagggguucggccucaguagguguuggggaggcugccagagggggcugcgcgggcuaagccaggccucccccuccuuccaccugucucauccccacuuccugugagcaccacaucccucaguuugcccaaagugagacauuuacaaaacaauaaaaauacuuuucuaaagagcagagcaaguguuuuuaugguuguuggaaaugacuuuauaugucaguuuuuugugguuugcauuuuucuuugaauauuuucuguaugcacauguaguuaaaaaaaauauuccaaaccauguuuugucuguguuuccuuaccagaagacagccucaugguggggcucccugugcucuguuagccucucuugcugaccagccugugccucaugccccaggccuauagcccugugaagcacccggauagagaagcuagacuaacucuaaagggaagcugauuccacaguuuggucucuacauuuacugauucgucucugacucacacacaaaccauggcaugcgcgcgcgcacacacaagcuaauaauaauaaaguuuuaaaaaacugc

SEQ ID NO: 7845 - RNA, 9084 nt, Mus musculus
agggcugcggaggcucuagagggguggggcugggagcgcggagguggcgaccagagguucaguacuaguuugugguuuagauagucucuuuacauuacccuggcuguccuggaacuuccuguauagaccaggcuggccucagacucacugagauuugccugucucugccuucugagcguugggauuaaaggcaugcgucacagcccaugaucuucggcacggguuugcuggagcacuggcauugcgaagcgccccgggucugagccgggagauguagguggggcuucggggcagcaggcguggacugagaaaagaggcggcacuucgaggggucuaggcggagcugugagaagggccgggguggggcuuccaaggguuauugcuuagcugugggaggggcgagguuaugaccgaaggggaggucugggccgggcuggguccggcucccggggagggguggagucugggcggggcuaucgagggagaagagguuguacaccugagagcugaaggcucgguucccuugcgcguuucuuggugggggucuugaugcgggauucccaaaagagacuagacagcggcuagaggucuuugcgaaagagggacuaaaaaccgcuugauagggccuuaaguacaaguuuugcagcucuucgcagucgccccucagugagggcccuccgcccguggaagaucguccgugggggcgaccgccgcgagcaugcgcaugggcacugcggcgggcgggugcagagaccuggugcggggacgcggggcggcgcgaagaggugcucucugccgccccgcgcccccauguacgccuuuuacucucugcucaucuacaucuucuacagucuuuuccgcagggauggcggggcugcggcggucucggaccccggggaucccacccaggugagcggagugggccugcaucacgguugguuaccaccaucauucugagauuuggucguggcugaccugugcagcuuaaauccuuagguaccugcucugggaaauagggcuguucagagaccaguauggucucuguuguggggucaaagaucucagccccaaccccuuggcccauuucagaagcgaaagggucgcacauacugccaguacccucacuugcaccucaugcucucuucccagaaaagcggcggccaaccuaggggucgucgccguccggaucaauucacaucagaacugugguccgagcugaacagccuggccgguaggugcauacuaggagcugcuggggaaggaaagguccgggggauaccugcaguugguguacuguaaccucaccgggagggagaaaggccucuccuccaucuaguaaugcagaaugcuuuuuccuuucucacuuggccuccucaaaggcugcucagaaucugaggauggccagaaaggagcggaggguggagcagcugaggugucccuggaagaggcacucaugcgucuugcugaguuccucuccguccaguugggggcagaagagagcugcgggacgacuccugaccugggcaaggugagcgauaccgucgccagcaauuauuccuuucccuagccucugugguccucucacucccaacaccucugcuuugguucuuacuuccuucacagccuggugaaguccccccacuguugacaguaacaagucagcucuuggcccuacuggcauggacacggagcccccgggggaggcaggcccugcuccaggggacucagccaaccugccccgugcagcccuccacucuagauggucuguaaagaguaucaccauuaguggaaggagcaggaucuaucagaacuagcucugcucacuaugccagacaucuccucacuuguaacuggccucaucccucuccagggucucuuucacaagaagaaagcuccucucagcccacucccauccuggaugagguaccaagggaugagacccaggaacaucagccucuccaauuggaggaggaacagagaguuuggcagcgguuggaacagcucauucuuggacagguaaggacugucagcgacugggugggugugagaccuaaaaaggcauucuguccugucucugacuccuccacagcuggaagagcugagacaacagcuggagcaacaggaagaagagcugaguagacuucgucugggaguggugaggcuuuuggggugggcauagggaacaaacaggcugaaaagucaggggaauuucagguggguccugaugauaucccucucugucagggggugacagauucagagaagagaguccagcaccucacauuggagaacgaagccuugaaacagagcuugagccuuacucgggaccuccugcuacacugggggccuggaccacuccccagacuuucccagguacucugccauuuggcuguuaugcuaacugcagcccagguuccuguacaccugguauccagcaacaguaccugaaccuccucaggugggggccaucucuaacuaugaacaaagucagugagguugauuguuguaaaaaucaccccacccccacccccauucuuggucucucugugaaaccucaggaaaacaaagagcaaaaagccuaggucagggagccuugcaugaaguuggguaccauggauuuagccauucuuguuuuggccugagucugugaauuggaacuauaggauacucuuuccugaguuugcauuggcuuuccugaguuuggcucuguggccccaucugguucccacucucuauaggaggaggcaggggcacuguuggagcugcagggccagcuucaagaggcccaggacaccacagaagcucuccgaguccagguggccuagggaaccuagggauaaggcgggaugggaagcugggggugaagucuggggcagggccuggugccuguuuccucagugacagaagugggcuugggagggacagcugggggcccaggagcugcagcugcagggccuucaaggggcccuccggcagcuccagcaggagacagagcagaacugcagacaggagcugcagcaaguucacggacagcuggcagguaagggaugagaagaugguuucaggccaagcucugcaaucugcuuuuccccccucucaauggccuuccuccccuaggacuacgggcacggauggccagccuucgucagggauguggggaccuccgaggacuggucagcaccuuuacgcagaguugccagggcucgcugagugaggcucagggccagguuaggaccacucccuuccugguaccuuuucuauaagcagucugugcacugucugucccaggggagccucuguuacuguuuucccuucccguccuucaggagcugccuggaccagugggccaguuguugacacuuggaucagaguaauuucugagcaacccaaagugucugucuuucucuuuucuuuucuuuucuuuucuuuuuuuuucuuuucuuuuuugagacaggguuucucuguauagcccuggcuguccugguggccucgaacucagaaauccaccugccucugccucccaagugcugggauuaaaggcgugugccaccauugcccggcucuuucuuucuuuccuucuuuucuucuucuucuucuucuucuuuuuuuuuuuuuuuuuuuuuuuuuuuuggugguaggggaauugagacaggguuucuguguagcccuggcuauccuggaacucacucuguagaccaagcuggucucaaacucagagauccacuugccucugccucccaagugcugggauuaaaguacuugcugcugggguugaaaagauggcucagcgguuaagagcacugacugcucuuccgaaggucccgaguucgauucccaggaaccacaugauggcucacaacaaucuguaaugagaucugacucccucuucuggagcgucagaagacaacuaugguguacuuacauauaauaaauagauaaauuaacaaaacaaaacaagacaaaacuacaugcugccaccaccuggcuauguccucauuucuauacugugaaaauuggcaauagcugggaagcccaggacagauaauagacugaauauuccuauguaugauuccuagauuguguuucagaccccccugaaugauggccucagguccauacccacugaaaauuguaugccaccacaaauggccguuuugcuuucaacacccugcuucacuaggacaccuggacaccuuucuuuguuuuccucucagguuuccugggcccuuggggcucugucagcuggaaaggcuaagacucaacucucagaagggaaccaagcacccccaacuggaugcucagggcggcuuuuggaacucaagggugagauuggcuuuaggaguggagccccagugacuacaguauagaagaguucucuauguuuagggcuauggaggcaauaugccgaugugguccccaaugcagggaauauucguguccugugucggcugagaccagcugaagggcagccuuccagccuggugagcguggagccuggacaagggggaaccaucaccacauguuaccgaggacgccagcaucgcuuucgccuggacugggucuuuccucaagaugccagccaggaggaggugacagcuagcuacccauugcaucuauccugacccuuccucagaguccccuggguccagaggaggcccauucccucuuccaugcccaucuggauacuuagauggugggaggcuaggcuccaucagggaagggaaccacugaaaggccuuggaggcaggauuggcuguccagcugagugcuaaggaaaaugccuguccaagaugaguuacuguuccuguagaacuggcugcagagcacuggugcuuucccagcggugaagacagggcuguaauccugugggugaugauagcuuggaacuucuuuugcccaggcuucugcccauaggcagagccucuucuugccuugugacccucagacagguuauguggguguccuggugcucccccacugcccuacuccgaucuuacucuucucuuuuuucuggccagaccccaauggaaaagcagucugcccuagcuugucucacacauggacuccaugugcacauaaacuguguugcuggagcuucugggacuaagaugggggcucagagcugauaaggaauugaguaagggacagagcuggcagagaagacccaggcuaucugcuguucucacagagaugguauaauguagcagggacagacucacugcugacugaugucucaccugcuccugucugucuuauacucgccccuggcaucaucucccaccccaaacuguagccauguacauaucccuagacuuuuuuccugugcuuugggcagccugcacugggugaucuaucuaacaaaccagaccaaguguaucucuugugaaguuucucaccuguaguucccauuuucgcacuaccuagcccugaacuuuuuuaaacauauauuuauuuauuuuguguaugugaguacacugucacugucuuugaacacaccagaagagggcaacaguucccauuacagaugguugugagccaccauaugguugcugggaauugaacucaggaucucuggaagagcagucaaugcucuuaaccacugagccaucucuccagcccaacccugaacuuuuuuuuguuuguuuguuuuuuguuuuuucgagacaggauuucucuguauagcccuggcuguccuggaacucacuuuguagaccaggcuggccucgaacuuagaaauccgccugccucugccucccgagugcugggauuaaaggcgugcgccaccacgcccggcuuccccaccgauucuuuuuuuuuuuuuuuaaauuuuuuuuuuuuuaauuuauuuauugauuauauguaaguacacuguagcugucuucagacacuccagaagagggcaucagauuucauuagggaugguugugagccaccaugugguugccgggaccugaacucuggaccuucggaagagcaaucgggugcucuuacccacugagccaucucaccagcccuccccaccgauucuuaaggcagcugcuguaugaggaagggacuagggcaguuacacguugcucucauuuugcugacugugcuuacuacccuucccggucuugaacaaggagauagggaaggauuuagaacacuucucccacuuguuuuucguucccaggucuucaggcagcuggagccagcuguguuguccugccuccagggguacagugucugcaucuucacuuauggucagacugggacagggaaaaccuacagcauggagguagguuggagcucgcacuugggggggggggcgggaggaagggaaacucagggcuuugaaugagaguccaauguggcacugcacacuguccucagggcccaccugaggacccuggcauagcuccuagggcacugcaguugcuguuccgggagauggggacuggagggcaccaccaugugacccucaguaugguggagaucuacaacgaggcagucaggucagggaugcgugggcgguguucuccuugccccuggcccaggguucugcagccaccuuuaaaacccauacaacuaaacccacccucucucaccagggaccuccuagcuacagggccuccagagcgccugguaguaaggcagggaccugcagggcaggggggaauucaaguggcuggccucacacacugggacguaccuaaccuggaaacccugcaccagguaaggcugccuuccagggccccugucuacugccaccuaagggcaggagcuauauauauguaccagguuagccuugaugcucuacucuccagaugcugagucuggggagaagcaaccgagcuacagcagccacugucaugaaccagcacagcucacgcucccacgcccuaguuacgcugacuuuacgugcagcgucuccgccucgggcccaggguaucacagguaccaccgguuugugcuuaaguucugcagaguuucuagcucccugaaagucuccuccacauccgguucauuugcccugcaggcacacugcaccugguggaccuggcagggucugaacggguguggaaagcagggguggccagcccgguccagagagacccgaauggcgcccggcgucugcgugaggcccaggcaaucaaccgcuccuugcuggcacuaggaggagugauggcggcgcugcgagcucggaggccucaugugcccuuccgcgacucacagcuuacgcgccuguuacagccggcgcucugcgcaggcaccacugcaguucugcugcugcaggugggucccuugggcuagugcaagccuggggugcugccaccgggacaguguaugaguuccccucucuuguagaucuccacaagggcggaagaucucggggagaccaucugcucgcucaaguucgccgagcgagugggucaaguggaacuggggcccgcccggcgccguagagccccacgcucuggaaccccuucuucucucaguacugacaccccacucacuggaacuuccugcaccccuacaccaucucccggaagcccucccaguaccagcccuaacagcuguucuggcuugacucuugaaccuccaggggacccgccucccuagaucugggucaacgccccugguacugggcuugagaauguaccucugcuggcagaggcagcugugaauccuauaccccacuucccaggucaaccuuuaaaaaacaaaaacucuggggcccuaacugcccccaacagagcccuacagugucccccuuccucuucuagaucuggccagagaauguuaugcuuugagaaaggaucgccuccacccuuccacccccagcugagccacaggcccuuaguucuccccccuuccuuaucgccauuugcccuuaucacagcacacagcagggggccagagcugcaggaaccagaccccagaccaagugguuucccaagucgccacccugcccccaauaccagacuuggaauuaaaauguuguaaauuccuuuacuauuaaucgcuccccuacuuccauuacaccaaaauuauguccguuccagucuuucauuucuuaacccuuucccugaaaggugcuacccucuacccaggcauuugagagagggcaagacuucagaucggacccacuuuuggcucucccuccccccagccuggagccaggaaggcauggugacagagggauggauagauggauggcuugagggccugaaaagguaggaucaagaggaggcacucuacaggcugagcuccgcuccuggcacgauuggccagaccucccuaucuagcagagacaacccuuucuggaguaaccuaauuaaagcuguggguuuucagcaaggcugugccugguguuuuaaagcugucgcugcggacaugcuccuagcucugguucaucaaaaugauauucauggguggaagagagaagcagcccuuucugcccuagaauauuacaugcuguaccaggaaaggagccagccuggggcaggagcugccaggucccuaggauggcugacccacacaucauagauacucuuguugggugguacucccuggaagagggagucuagaucacagagcagguccugggacccuugggauucagugccuacgcuccaguaagcugggcuggcagaagaugggcacuggggacaagagguggucgguaguguggccaagggcauuacuacauugggcguauagaugggcaaguaagaaguggguagcuguccccacaaggaggcucugcucccccuccugggcacuccccuggaaucugcggaauccucaaguaaguggaggggccaggagccuugaucuggggugacgggagaaggccugauuaccuccccuugggaacucucccccucuaugauugugggcccaggaagggagcagaggggccacagaggcgucucagaggagcuagaggguccagugcccaucccuucuucccccuuugacaaggugccugccugagcugcagugcucuguccagggagcccaggaugcuggggccauguggauucuuucccaggguccccuagcagggacuugaugcugaaacccucccuaggugguggu

SEQ ID NO: 7846 - RNA, 1726 nt, Mus musculus
gcugcggacaugcuccuagcucugguucaucaaaaugauauucauggguggaagagagaagcagcccuuucugcccuagaauauuacaugcuguaccaggaaaggagccagccuggggcaggagcugccaggucccuaggauggcugacccacacaucauagauacucuuguugggugguacucccuggaagagggagucuagaucacagagcagguccugggacccuugggauucagugccuacgcuccaguaagcugggcuggcagaagaugggcacuggggacaagagguggucgguaguguggccaagggcauuacuacauugggcguauagaugggcaaguaagaaguggguagcuguccccacaaggaggcucugcucccccuccugggcacuccccuggaaucugcggaauccucaaguaaguggaggggccaggagccuugaucuggggugacgggagaaggccugauuaccuccccuugggaacucucccccucuaugauugugggcccaggaagggagcagaggggccacagaggcgucucagaggagcuagaggguccagugcccaucccuucuucccccuuugacaaggugccugccugagcugcagugcucuguccagggagcccaggaugcuggggccauguggauucuuucccaggguccccuagcagggacuugaugcugaaacccucccuaggugguggugggggacuggguggcugauaaggcuggccguggagcacguaggggcucagguccuuggcgaaagcucugugggugccccgguucugccaucgacggcacagggcaguguucugaaggcgcagcgccucagcaggaaucaggcucacauccaccgcccagaaguugcccuuggccuggggcuuugcaggguccuugggcaccuagagagugguuggcuuggcuguggcuguucuacccagagauucggggguuccgagcccacgccgcccccgggauucaauaucccaccuuauggaagcaccgauuagaggaaagguuguggcggauggaguccuuccagcccucauagucgucccugaagaaggggaacacugccuggaccugacggauaaucugaaaucaggcaguauuuggcgccgugaggugaggauuggaguaguacccucucccucuuuuacagccgaccccggggcauccaucccuucuccgggagacagaggucugugccugagggcagaguggauuggggguuuugggagaagggacucaggaccguucucacaggcaaggauaaguggguuaggcaaaggccaagcgugagccuacaguaaguggggaucaggccugggauaguugugccccaaagcacgagggacucucucaccugagccaguuucagccugcggaagggugcggccugaauuaccaaggcgaucauggccaaguagguguaggggggcuugucaugccguagguaucucuucuuccuccucuugggggucuucgaaagagacucugccucuggaggccucagcugagaguugucgcgaggccccauacaagggagguagcccugggccggagccagggcuaacugggggcucgggguagucggaguguaaguugaggccaggucccagcccgaggccaugcugggacaggcaggccaggcccuuucuuuaucauucugaugaaagggggaggggugacagaaagaggcuguggggga

SEQ ID NO: 7847 - RNA, 3717 nt, Mus musculus
ugccgcgcuagccggccguuccgcucucaccuguacccgcccacuucuggaggucugggucaccucagguguguccuaacguggguguggcgugacucuauuaguucuagcccugcugggguuccuaagcuugagauauaccucuuccuugacucuggaaagguagcuauugucuaaaauacucugcguauuccauguuuguaacuucccuuuauuauuuuccuccuuuuauuuccuugacuauucucguaguaacucaggcacagcuuuaaaugugcucucuuuucuauuuuuuuuuuuuuuuuuguaauguguauugugugugaagcaugugcacgcacgugccaacaguguccguguggaaaucggaggacaacuccuuucaccauggguucuaaugacggaacucgcaucaucaggcuugcacagagagcaccucuacccacuccauggcccuuuuaacuucuuauuaauuuuuuuuaagagagagaauuucagauggcccaggcugaccuucaacuucccuauguagcgaaggaugacuuugaaacucuaaucccgucuucaucucucuugugcgaggauuacaggcaccauauccgguuuacacagcugaggaggugaaacccauucuaggaaagcccuuuaccuacugagcuacauccucagcugccauuuggguuuuuuguauuugacgagcucuugcucuguguacccgggcuggccucaaacuuaaaauccgucuuuaacacauuacaagugcguuugucacccucccagacuucggaauauucaguguuguuguuguuguuuuuguuuguucauguuuucguuuuuugagacagguuucucuguguagccccggcuguccuguaacucgaucaguagaccagacuagccucaaacucagagcuaucuaccugccucacuuugcuagugcugaaauuaaagacgugggccauuacugcccgacaccaguucuuuacuuuaaaaagaaaaacacacacacacacacacaaaaaaaaaaccaaacuuuuuuuuuaccuuggcuugacaauuaagaguaaauacugcucuuccugaggauucaaguucaauucccagcauccaugucaggugacucaaaaccaccuauaaugccugacagagguggcacaugccuuuaaucccagcacuugggaggcagaggcaggcggauuucugaguucaaggccagccuggucuacagagugaguuccaggauagccaaggcuauacagagaaacccugucucaaaaaaccaaaaaacaaacaaacaaacaaaacaaaacaaaacaccuauaacuccagcuccaugagaucaauaguauucauguguacacacacacacacacauuuuuuaaaauggugaaaaugagccuucagaauauuuugcuuauuuaguuuguaugucuguagggcugcaugugucaagaccucuguagagaugucagaagacaaacucuaaaggagucauuucucuucggcuauugagucccgaggauggaacuugggccaucaagcuaguggcaggucaucuccagcucaugucuucauuucucugugucguauuuaaauuccacuugcagacaaauaaaauggcccaaagcucuuccaggacugcacacagcguuccaucuguauccagaccaagagagcucagagccuuccacaccccgcagugcugcagacccaagcccuggggaucuccacugugcucacacuuagcacguccuugcugagucauccugggcucugcucuuagguauggaugagggcuccugcucugucuccagcccccucagcaaugcggcuggaaacagacguucuaaaugcugcagaaaggaacgcacaagcagcaaggcuauuuaucuuugcaaaaaugaaauuaaccgggcuagcaaguccucgagggccagaagcucacuucgaguguauccuaaggcagguggugacugugucuuuuuuccuauugccuggggucaccucauagucuuuuccugauucagccugauucaguuuaaaaagauucagcuuggaguaaaugaaagggagagggugaggugucagcugcugcagaucacguuugggaacuggaggagggcagggccuuuguggaaagaaaagcuuuaccagguagaggaaaguaaaagguuugaauuucuuuacacaaaaguuuuagagggugugagauauacagaauauuggccuuuggugacgaauuuuuuuccuuguucacccaccugaaguaagcugacuuggaugaaggaagaccgucuccucccugcggcugaagaaacauuaccaacauggcugacuggauuccuuuugaguguuuuuuguuuguuucaauauuuuugagauguuuguuauguuuuaugugcuugccugaacgagugucugucccuguaccacacaugcagugccuguggaggcccagaagaggucaucagacacccuaggauuggaguugcagacgguugucagcugcccugugggugcuaggaacugaacccagguccucuagaggaacaguaagugcucuuaacugcugagccaucucuccagcaaugcccaccgcuaaccccugcugccucucccccccccccccacuucuuuuuaagauuuauuuauuauuauauguaaguacacuguagcugucuuuagacacaccagaagagggcaucagaucucauuacggaugguuugugagccaccaugugguugcugggaauugaacucaggaccuucggaagaacagucagugcucuuaaccacugagccaccucuccagccccugucucuucccuuuugaaccuuuggucacaaacuuagaaugagugcugcucacucucaagcagucuuguguuucucuucagaaggcuuucaaagaugguggccauuccauaacuucucagagcccuuuaguuaggccuccuauuggaaaccaaaagucucccucccauuaccaaacuacaggacugcacacacccaucucuggccucccacuuucccugccuguggaaaguuugcaggcuguucugcucauucugaagguuggacuagaggucuggacuucuuucugucccuugcauuauuaauauggccauuucuauugaacaguuuucaagaacacucagauacaugcuaacauuguucuuuuuuguuucuuucuguauuuuaugugcauggguguuuugccaacaauauuuguguacuauguuugugccuggugccuguggaggucagaaaagggugucagaucccccaagggauggagugggauggcugcgaggaaccuaacaugaguccucuggaagaauaaccagugcucuuuaaaggccgacuacuugggcuggugagauggcucagcagguaagagcacugacugcucuuccaaagauccugaguucaaaucccagcaaccacaugauggcucauaaccacccacaaugagaucugaugcccucuucuggugcugucugaaggcagcuacaguguacuuauguauaacaauaaauaaaucuuugggcuggagcgagcuggguugaucugagcaagcagaggugcuaaaaauucaauuccuaacaaccacaugaaggcucacaaccaauuguucagcuacaguguacccauauacauuaaauaaauaaauaaauaaaccuuuaaaaaaguaaauaaauacauaagauaaagccu

SEQ ID NO: 7848 - RNA, 13173 nt, Mus musculus
gaacaaacggggcgcgcuggccagcgagcggaagucgcccggguggggcacagugggauaagcuugcaaagcccuuuccgguggcucucuuguugggauccaccacgcgccggggcaggugaguaggcgcagucgcuuuccuuguuuuuagggcaagggacacuuggcuuuuacuccccaaaaggauggaaggcgugggcggcucggugcuguugugaaugccuggccgaagacgugaucccagcggaguagaauagccgagcaucccagcucuucuagccugcucccgggcuccaguguugaaccugagcaaggcugcuucccuccaggccuggggcugggugcaaccucccucauuccucgugaguaaucacuuucugggacuaucucuucucucauuucugcaccugaaugaccuggagucggucacgccugcggacucagaaggcaucucaggauuugcucuucuguaucugagaccgcgauuucccauugguaguccaaaugcuggggucugagaggagaauucuuuucuaguguucacugcuaauuggccagucuagccaguggccagauaccugggccaaaagcuaccugggaaaguagcuuccucucucccauuuugaccugaagguggguguuugugugugcaaggaggggcccaagggcuuugguuuagcagaaggggacuucucgaauccuuuuuugucgucauccuugugacuuagggcagcuguagcucguucuggaauuuagguacaggugaacagggauuguuuuccuucugaaggccuuuuuuucuuuuuccuggaccugacugcuacugccuccaguuaacucuuccuuaucuucucuccuuuggcucacacacuggcucacuuggucccauuuucagauccugaagugcguuuccuaccucagccaccagcuuggccuaggucccugggggaaggcauccuuuaaacuuuaccagcguuucucauuuaaacacuuuacuaguccccccguacuucagcacuguuguugaugugaucuuaguuguccuuucuacuagaugucccaugaagucucccucguuguucaguugaauguguggccuauggcagccauuuauuuauuuauucauucauucauucauuuauuuuuugguuuaucgagacaggauuucucugaguagcauuaacuguccuggaacucauucuguagauuaggcuggcuucgaacucagagacuaaagguguguuuuauacacacacacacacaacacacacacacacacaccugccgcagcuguacaucauggcuccagcccuuacucccacacaacacagacaagaaggcucaggagcugauauucaaauaucagccuuugcccagucuggugugucugugcgucuggcuugggugguaaagaagcagugggguacagagccccuccagucacccugggaacuggggagcuuccuccccucugaccucugaucucguuaugauuucucacaggugucugacucaggacaagcggaucccacccuccagaucucaugguagggagccuggcugcugccuguauucccucuccacuccugucaagcccccacauccuacccuuuccacugggccugaucgcauaccuagcuuugacccuuacuguggcucuggccaggcuggucccugagggggugaauaaauguccgcccagaccagaguuuagcugugucuguucaguggggaggggcauaaggucacuccuuuggauuaagucccuucuuuucucauaagguuuaagagccaaaaggauccaguccugcuggagguauaccauaccuguuugagguauaccauauuauagggauguugguguguguccuuacaggaggcggugaccuuuggcgacguggcugugcacuucucucgagaggaguggcagugucuggauucuggucagagggcccucuacaaggaggugaugcuggagaaccacagcagcguggcaggacuaggugaggcuccccccccaccccccaggucugcuccaaaccccgggcacgugucagagacggggguggguggggggguggggggguggguguguguguguguguguguggugcuaacugcuugggccuugggggcuaaaccuugaaucugaguuugccaggcuagcuccaggcuuuacacacaucaccuaggugauagagcccuagguaaguggaccucugggaaccggucagaccgguuucucccaugcuguuaaauuaucaggugagaacuggaacccauacuugaaguaauagcuuaaacaaaacaacaacaaccaagaaagaaagaaagaaagagagagagggagggagggagggagggagggagggagggaggggaaggaaggaaggaaggaaggaaggaaggaaggaaggaaaagaaagauccuuguuagugugaggaaucuccagggaaaccuguucuggaaccagugacaccucugucaaugcuuucagucugccuugccaucagacuugacuccuguucuugcuaccuucccugcaggcugcucuagcgcaggcagcuuuguauuuugcuucaccuuugugguagaauggaaugucuuacuugcuggcagcugugcaucucaccuguuacugagucgccuucagaguugaccccacaugauggugguaccuacaacaggagagaguguccuggguucuugaggaugccugggcuaguggaucaggagaggggagguagggaugggguguaguugguuuaccggguaccucucucagcauuagagcaggccuguaaccauucauccaauccagccuggcaaaauccaguuuugugagguuuugucaguaggguguaguaagagcuggaggauaugcaggucaaugguagagccucacauuuaaagcugucagugccuagcaccacagagagcaaaaaggaagcaagaagacaaaccaaacaggcuaggcauggugugcacgccuuuaaucccugcacuccugaggcagaggcaggcugauuucugaguuccaggacagccuggucuacaaagugaguuccaggacagccagggcuacacagagaaacccugucucaaaaaacaaaaaaacaacaaaaaaaaaaacaacaacaaaaaaagaaaacaacaucaaaaccaaaacaacaacaacaaagaaaguaaaacaacuuaagauccuuuuguuuguuuguuuguuugucugacugguuuuugaggguucgggcguccuuccuguccuguccugucccugguuguuacugugugaguucuagaaucaugucucugugcagcuccuuugcuuucuucuucagugguugcuguaacuaauugacuugugguguuuagguguuuaauauaucuuguguuagauucaccagaaccaaaaugaccuguuguaaauacagcaccugaaauacacaccuuagaauuuuuauauauauuuuauuuuacacacacacacacacauauauauauauaaauauauauauauauauauauauauacauauacauauacauacacauacauauacauauguaaacccauauaaacccagcuacugaguuucauaaggagcucugcuggucuuucccugcaguugcugcuucuauaauaaaugaguuucaacaccaaguggcugaacauuuuauucuuuuugagacaccaaucucacucugcugcccagucuugaccuugcccucauuugcauuuucucaguguuugaucgucauacacacacacauauauauauauauauauauauauauacacacauacauacacacuuuauuuugcccuauuuugcgggggggggggggggggaagggguguucgggacaggguuucucuguauagcccuggcugccuuggaacugacucuguauguagcccagacugucuucaaacucagaaaccugccugccucugccucccaagugcugggauuaaaggcaugcgccaccacauccuuuuuuuuuuuuuuuuuuuuuuuuuuugguuacuuuuuuuuuuuuaaggaaaagauauauuuauuuuacuuauuacuguagcuaucuucagacauaccagaagaagguaucugauaucccauuacagaugguugugagcuaccaugugguugcugggaauugaacucaggaacucuggaagagcagucagugcuuuuaacugcugagccaucucuccagcccccacccccacccuuagaauuuuaacaugggauacuacuaaugauagcaccaacaacuuaaacuuacuccauacguugcaagagccaucuuaaaugcacaucugguuuaacccaugucacucuaauaaacaaaacacauggaggguguuccguuugcucaaucaucccacagacaaccaggaaggguaaugauuuucuucuuugagauuuuaccuuuugugaggucaaugccugccacggaccaccccagucggguauggggucccuggaaugaggguccuugaagcuaguggguaaggauucaguggugacaaacagacaagcacagaggcagugucaaucugagugcauucugcagcucucaagcaggggauuuuauacauuaaaaaaaaaccacauuacaucucuuagaaacuguauccaaugaaacaaucacagauaccaacaaaaaucauuuggcacaguaaagcacaaaaaucauccaagcauuacaacucugaaacuauguauucagugaaucacaaacagaacaggugacaucacuauaaaucaucaaaauauaacaauucaaaaagauguauuaagugggggcugucaaagacuaguggcguguuuccaggagcagguuaaucuuuaacggucagugcucuuaaccucugaacuaacuugccagccccauggucaguuauuauuuaacaucuaaugccugauuuuuuuauaaucaucaauguauaaauuuaaacuacuuuaauuuuuucuaauuaaggcuuucuuuaccauauaccaaaauccaccuccgaugacacauuguagccauaugaaauuuuauuguugggaaauuuuuuaucauaauaguuuuguaaaugauuuagaaaguaaagcguugguuuccauggggauaaggucauguuaguggccccaucucuagggaugguuucuuacccauuauuaccgcuuaagaucuuggccuaggcuaccaggaacauguaaauaagaaaaggaaucagaggaaacagaacagagagauugccaugagaacuacggcuucuccagugaagaguuucacaagugguuccaggaggccuuuccccuuuugaggucaaucgcuucagucuguggaacuugucacacagauccuauuggaggugguguggcaaaugccuaagcuuucuugccuaguauuuagcagccaugucuuuuguguggcuugcagugacagaccauaccucuuugucuguauuacauuguauauacaguuacucuguaccugugagugggacugccagugguuccuuagcaaaauacccaguuucuuucucucuuucucucucucucucucucucucucucucucucucucucuuucccucccucccucccucucccucucucucucucucucucucucucucucucucucuuucuuucuuucuuucuuucuuucuuucuuucuuucuuucuuucuuucuuucuuucuuugguuuuucgagacaggguuucucuguguaguccuggcuguccuggaacucacucuguagaccaggcuggccuggaacucagaaauccaccugccucugccucucgagugcugggauuaaaggcgugcaccaucacgcccagcuacugaguuucauaaggagcucugcuggucuuucccuacuguuucugcuucuauaauaaaugaguuucaacaccaaguggcugaacauuuuauucuuuuugagacaccaaucucacucugcugcccagucuugaccuugcccucauuugcauuuucucagcguuugaucgucugcucagcuucugugcuuuacugaguuaguuacuuucugcccacuagaguauucagauuuuguccguuuuauuuuuugagacaggguuucaauauguagaccaggcuggccaaacaccaacagaaauauacuuaccucugccucccgagggcuggguaauaaaggugugugccaugccugguuagguauuuauuuacuuaucugucuaaugugugugaguacacugucacuuucuucagacacagcacaagagguuaugggcaucucuccagccccuagauuuuuuaauuaauucauuuauuuauuuauuuauuuaaaagauuuauuuauuaauauguaaguacacugaagcugucuucagacgcaccagaagaggguaucagaucuuguuacaaaugguugugagccaccaugugguuguugggauuugaacucaggaccuucagaagagcagucagugcucuuuccaguugagucauuucuccagcccuaauuuauuauuuuuuuaucagcauauaaacaagaaguaagacccugucucaaauuaacuuuuuaugucucaaauugucuuuuuaugaugaccuuagugggcucugcuaaaggacuuucaucaucuuuucacagauuucccccuugguuuuacuuuuuguuguuuguuuguuuguuuuguuuuguuuuguuuuuucuucccaagcacaguuucucuguguagccuuagcuguccucuguaaaccaggcuguccuugagcugagaaacccaccugcccaugccuuccaagguggucuccugaaucccaagcugaccucucuguaccuuugacucacaccauagcuuagaaugacuugaacuugagacugacucuugccuacaccucccaacugcuucguuuacaucucugggccacaaugcccaauuucugugaugaugcuaggaauucaacucgggauugugugcgugcuuggcaagcacugugccaaccgagacacuaccaacccacugguccuguugugucuuuguuccucuuuuuucuugcccacuuugacuguuuuuguucuuuuuuuuuuuccaaagauuuauuuauuauuauacauaaguacacuguagcugacuucagacacaccagaagagggcaucagaucucauuacggaugguugugagccaccaugugguugcugggauuugaacucaggaccucuggaagagcagucagugcucuuacccacugagccaucucaccagcccuuuguucuuauugauacagauuugugguuuuguauucagagcuucuucagcuugaugggacuuuuuaguuaauuugagacagggucuuacuauguaacccugcccuggaaaucacuauguagacugcuuugaaaucacagagagucaucucccuccaccacccagguauaagggaugaaaggcaugagccaccgugccuggcuucuuguuuauaguaaauguauuuuaaaauguaaaauuuuagcuuuauugcuauagcuacauuguauagauuuugacucauaauaaaaguaguuacugccuggcagugguggugcacgccuuuaaucccagcacuugggaggcagagguaggcggauuucugaguuugaggccagccuggucuacagagugaguucuaggacagccagggcuacacagagagacccuaucuugaaaaaccaaaaagaaaagaaaaaacguaguuaucacuuaaugauucauuguuuauuuuccaaauagcugaucgccucugaauugcccuuuugugguuacuguccucugagcuaugcuguuuuguuguaugcucuuugauggguccacaacuucuggccuggcuugacccaaggauguuuguuuccugaugaaugugggccccugucuguacggaaagcuugagccuguucuuguacuguguguuuaaccuuuugauauugugacauauccuuuccaagguucccauucaugagccuuacaauugaauuaccaaaacaaaaagacaacucacauguuaaauuaguucaugguuuuguguugggccacauuccuaacugucuuugucugccuguggcuuguaggaugcagguuagacaugacugcugggucuuguacacuuggcugccucucuuaccauguuuugagaagccugccguaaucuucaagcuuagggcucugugaacuuuucugguuuuuucaauguguauggguguuuuuccuggauguaugucugugugucugcugaaacuggaguuauguacaguugagaguugccaugccggcauugggaagugucuacuagaagagggaugagugcucuuaacuguugagccgucuccagcccugcuucguugaucccugauuggguuaugccugcuccacuuuuaggaacuggccauaaagggaguuugggaucacgacuuguaaugugaaucugcuucauucauuucauuacuauuuuguuugcuguuuguuuguuuguuuugcuuuguuguuacgagacaggguuucucuguauagccuuggcuguccuggaacucuguagaccagucuguccuugaacucaauagagaucuaccugccucugccuccugaguguugaggugaaaggcauauguuguguaucuuggcuacuccuaccucuuggaguuuccuugccuuuugaacugggagaagagaacacauggcuuugcagagcauggugcuggccugggccuaagcuuccuugcuccguuuugcaccccaaguagaagcagccuguucugugaugauaguguucccugaagguuauggaagucuggcugccccuuucugucuagucaagaagcuggagagaagggacuccuguauacccagugucuuaucccucaucaccgucccuagguauauauaggcucuauauccagcagcuccuguccuucauggcuggaaacuaggaggguggcuggcuccaggacauguuuccagcauuuccuuuucucacacagcaggauuccuggucuuuaagccggaauugaucucccggcuggagcaaggacaagagccguggguccuugaucuacagggagcagaggggacagaggcaccaaggauuugccagacaggugaggcgcaggccuugucacggagauggucugaauaagaaggagcugaggugagaucuuugagacagugggaggcgggggugagcccuggucaccaggcugggugucugagggacauugcagaggaggccagcccuagaaagaaccacagacagguguguggccaccucugggaaggcuguccaacaaaaagacaaggacacaaaacacugguccauuuggcagcuaugcgucauguacuuaauggucauagagaaaucuggccugugggauugggacagccagguagccuguguggauuugaagaguuuagaagggaaguagaugucaugaaggccucuugaggguucugggcacuaagacccuugcaugaacuugccccagggaagaagucaaugugaacuauuggguauagccacucuaaccuuauuguggcacaugguaaaacauucugagugggcuggagagauggcucagcggguaagcgcacugacugcucuuucaaagguccugaguucaaaucccagcaaccacaugguggcucacaaccacccauaaugagaucuaaugcccucuucuggugcgucugaugucagcuauacugaacuuaacguauaauaauaauaaauaaaucuuuaaaaaaaaaaauccuggccaggcggugguggcgcacaccuuuaaucccagcacucgggaggcagaggcagguggauuucugaguucgaggccagccuggucuacaaagugaguuccaggacagccagggcuacacagagaaacccugucucgaaaaaacaaaacaaaaauucugaauaaaaaccacuuaggaaggaaagaguuuauuucuguucacauuucuagguaguaagcugucgaugugggaagucagcguggaagauggcgcacaaacaguggaggaacacugucacucugucauucuguuacucuguuacuggcuagcugggguugagcuugcuugcuuauacagcccagacgcaggugcccaguagugacgcugcccauuuccauaaucagucgucaaucaagacagucucacaaacugaucuggaguugcugagguuucccucgauggugccagucugucaguaaaaacuaaccgucacaccuauagcagcaagguuugccuggcauggguuugcgguuuggguccgucuccaagaagccugccuuggaggacagccacggacagguugagcacccucuucugcucugggccauccugcuaagacauaccaccucuuucuucuucagccucgaucucauuccuguauuuuggucacacccccuuuuguccuuacuugucugauagcaugcuugggaggugggguguccucugacgaauucuagacugacauucuguccucuggcuugcucuguccugccucauuuugcacacuguagaguauuccucggugcccgauagggugggcccuuuuaggacuuggagcgcucagcacucuguccuguaggcauaagcauaucaacgcuguccagugaacuaaauugugaggauuucccuuuguaucuccuugcuauacuuugcacuugggcuguuccccacaucccuggccagcucugcccuuuugcagaccucagauguaaggaacauuuuuuuuuuuuacuuuguguuuauuucagacuccgcuauuagaacugaucgcaagcagaccugugaguacacgagccuccuccaaaggcagauuccuggcuuuggagacaauuuggauucuaaggucuggucagagaauugcccaagaagccuugggcuaagcgugaguggcucacuuuuccagaagcaccguuugaauagcgaggccgugaugcccaagaacuccacaaaggaugcuguccaagaacguaaggagcugcaggccaccgauguggguuaucggccugaugaccagagagaccaccugagcucaaaacugauucggcgucaaagcguuccuaccggagagaaccguuacccaugugaagaguguggcaaagcuuucagguggcgcucucgccugaaucagcacaaacugagccacacuggagagaaaucuuaucagugcaauaaguguacaaaagucuucgcuucuagcucgcgacugauucgccaucagagagcucacaccggagaaaagccguuuaaaugugaccagugugggaagcgcuucguccuggccucgguacucacucagcaucagaggauccacaccggagagaggccauuuaaaugugccgagugcgggaaagguuuccaccugagcgcaaagcugguucagcaucaaagaauucauacuggagagaagccuuaccgaugugaggagugugggaaaaccuuuggucagagcucaagccuuguccaucaucagagaauccacaccggagagaggcccuucauuugucaagagugcgggaaagccuucugccagcgcucacagcucagcagacaccggaggacgcacacuggagagaggcccuacuccugccaggaguguggcaaggccuucugccagagagcaacucuagcccagcaucagaagaugaugcauacagcggagaaaucucaaaugccgagagccucagagagcccaagccuuauugccugucagggaaauaccacugaagagaagccauuuaagugugagcaguguggcaaagcuuucagguggcucucucgccugaaucagcaccaggugguccauucuggagagaaaccuuaccagugcaacaagugcucgaaagccuuuggcuguaccucacgacugauucgccaccagagaacucacaccggagaaaagcccuuuaaaugugacgaauguggcaagcgcuucguccagagcucacaccuuauucagcaucagcgaauccacacgggagagaagccuuacgugugugaugacugugggagagcuuuuacccagagcuccagccucauuuaccaccagaggauccauaagggagagaagccauauaaaugcagccaguguggcaaagccuucagcaugagcacacagcucaccagccaucagaggacucacaccggggagagaccuuauacguguaacgagugugggaagaccuuccgucaaaacucaacccuuuuccaacaccagauaauucauguuagaguaaagcccuaugaguguaaugaguguggaaaggccuucagccggagcucauaccuuauugaacaccagagaauacacacuagagcccaggggggccaugaauuuggggacaccccugaaagucccaccguuuugaaccauaaaaaagugcacacuguaaaaaaguuguaccagugugacgacugcgauaaggucuucagguggcguucguaccugauuauccaccagcggauucacacaggagagaggccuuauaaauguaaugccuguggcaaggcuuuucaucagaucgcaaagcucacucagcaccaaaaacuucacaugagauaaaucauuucccuaaaugucuugguuacuucucucuuggcugugauggcaccaugagugaccaaggcagcuuagacaagaguucucguggggcuuacaguggagcguuaguuucagagauuguucacggcagucuuggcagggagcagggcggcaggaaggccugauguuagagcagucgcuuagagcucacaucgugagacagccaguuacuaggcagagagaucuaacuggaaauggugagagguuuuaaaaaaccucaaagcuggccucccaguuaccuccucuaaagagggcauaccuccuaauaauugccaaacaguuccaccaacugaggaccacauguuggaacauaugagccccuggaauuuguucucauccaaaccaccacacuaaaaguaauguaacuaugaauaagccagaagccuuauuuaauuuggguaauuuaugcuaucagagacuugaggaugcuaggaagauucagauuuguucuuaaagaauagucuacuuaggaaauguuuuauucguuucuguaauauuuuaccauuuacccauuaaauaaaagugugugucacacuaaagguguagccugua

SEQ ID NO: 7849 - RNA, 2395 nt, Mus musculus
uauuuuaugagucuggguguuuggccuguacaacugcaccaaguauaugccuggugcccaggaaugacaaaagaagugauuggagcccuugaaaauggaguuacaaacagcuaugagcuguuacguggcugcugggaaucaaacccaggucuucugcaaaagcaacaagggcucuuaaccacagacucaacuccccagcucccaaagacacucuugacaugcccagugguuccaaacuccccauggagugggagguaaaguacuggacaggugccucggacacauucaaagguuuuaauccacuaacgcugcauggcuucacuagcagccgacacaccacuugauccgucugcagaguacuccugugaccaaccuucuccucaucugaccuggcucuauucaauugucacaagcuguacucauaguuuuauuguuuguuuuagauuuacaacuuucugaguaugaguaguuugcuugcauguauguuugaguaccacauaugugccuguguuggaugucuugguguuggguccccccugcccuucccccacaacugaaguuacagaagguugugagccaccacgugaaugcugggacuugaacccaaguccucuuugcaagggcaagugcucuucacugcucaaucaauccuccggcccuguucucaugucuuaauauuuaaaauauguauuuaauguuauauauaccaaacauuauuuaaugcauauuuaguauuuguaaugucuuccccccacccccucugaucuuuccacuaggaugucagcuucaggaaagcaggaauuuagggcaaaagaauaaacacguccgcagcaaagcacaggacuuaggaaagcaaaugggcagaguucagccaugcugagcaaccauguuguauguuguaagagaucuucaucuggacuuagcucugcacaucgucucauccaggagcacagcuggggaagggacagguagguuuaauucccuaauagaauaacauguuuuuaauaguugcuuuaccucuuuaauucgaaacugagccucacuacguaaaacccagccaggccggccuuacauuucacauucuccagccucagcccagcuguuuacuuguaaaacaaaacccaaaagucccagcugucuuuucacuuaaaauauguucuuacauccucaucaccagugcggcuggguucugguaccagcuucagcaccccacaguaccaggguucaguccugcaguuugcgcucacacuuucucuccagcucugccaucuccuuaaggaccaacgccacgcuguagcgcagcuccuggaauuuggcuaugggcaccucgaagcggugugccgauccaucugugagcuucagcugcaugagaacacucgguugcagggagcgggacugagcacugguugagauggccacauccacccgccaccggaaauucgacacacgaggcagcgaggaucccugcugcugggcuacagagucgagaagagggcguugacucccaaaugccaaacuggccagaucuccaaucauaucuuggggaaugccaaguuccuggaguucguccuggaaggcaucugguuucagacuggcagggggcagccggagagccugcuggagcagggugugugugcccgccagcaggacggccagacgcuccucugacagguuggcgcuggcaccaaggugcugcacggccucucugcagucuuucccauggagggccccgacuacgaguuucaacaacuuucugaaggugcuccugucuaaguccuucaagagcugggccacugccgucacuucugcagagggcugggaacccaggaaacugacccggccgcugugacugucaguuggaugguguaaguauggagccgcagcccccaacgcagacauccuuccuuucccuuucuugaccaggccggagagaagguacuaaccacaguagccuggagaggugaaggagagacaagugacuuccuacucgggagcuucauguacuaaaaacuggggguggaugaggggcucccacccgccugucuaccaaggauagauagcaaauaggaugcaugcuuuggagguggcccugagaccuugcggcaaaggagcccgccugagucuagcagaagggaggcgucccggagauuuaacaguuggcagggaaaagaaccaagaaacugaagcgcgcaccaaaauccuacauaaauagggaacgaggacccccccaaacccugaauccucaucauagcucuggaagaccuaaaucacacauuacaaauacaaacuaagccuugaacgcccucugcaccuggaggaagcuauccgcaggagcuggcuguggcuggcagcagcugaaacuuggccgagucucaggaagugccacuuagacacu

SEQ ID NO: 7850 - RNA, 796 nt, Mus musculus
agacauucucaagagcaugacaaaagaaaacacacguuuacauuagauguucaccgugcccacuauuguuuccuauuugaaaacagugcaaacagguaacuuaugcuuuaaacaccaagaccccuuccccaccccccaaagucccuuuccuccuaauaucugggagaaaagucugcaauuuugcaaacauugccaugcuagagguuugaguaguggagaacuggcugggccagaggggaagguuggccaggcagcuucccgcccccucccccccuuccuggcacacccgaguuccagacugcccuugauuggccuuguucgccuggcgcagggaggggcgcacuaugcucuucuugcauaggcucacauccuucucaucucagugucuggaagcuacaugacuagguacaggacggagguggucgcggaccugcccgcugugccucaaagaaagcacagccuaaaccaaacaguucagccccgaggaguccaugcuugaggaaaagccacaagcucuccuuaaacuaagagccaagcgccaggcaguuuccaagggaaggaaacacggcucaguucagacagcggcugcugcaggguggcggugguggagguuccuggaaaccugagagccuuaaaaugacaaggagcauggugcuucugggcugagguugaacuaaguaacacagaaauucuagaaaagaccuaaggcagcucuccgggcugaaagaggaacauccagacaaacauuuucacuacaagucuccuuaaaggaauccagcuucuaguaauauucgca

SEQ ID NO: 7851 - RNA, 796 nt, Mus musculus
ugcgaauauuacuagaagcuggauuccuuuaaggagacuuguagugaaaauguuugucuggauguuccucuuucagcccggagagcugccuuaggucuuuucuagaauuucuguguuacuuaguucaaccucagcccagaagcaccaugcuccuugucauuuuaaggcucucagguuuccaggaaccuccaccaccgccacccugcagcagccgcugucugaacugagccguguuuccuucccuuggaaacugccuggcgcuuggcucuuaguuuaaggagagcuuguggcuuuuccucaagcauggacuccucggggcugaacuguuugguuuaggcugugcuuucuuugaggcacagcgggcagguccgcgaccaccuccguccuguaccuagucauguagcuuccagacacugagaugagaaggaugugagccuaugcaagaagagcauagugcgccccucccugcgccaggcgaacaaggccaaucaagggcagucuggaacucgggugugccaggaagggggggagggggcgggaagcugccuggccaaccuuccccucuggcccagccaguucuccacuacucaaaccucuagcauggcaauguuugcaaaauugcagacuuuucucccagauauuaggaggaaagggacuuugggggguggggaaggggucuugguguuuaaagcauaaguuaccuguuugcacuguuuucaaauaggaaacaauagugggcacggugaacaucuaauguaaacguguguuuucuuuugucaugcucuugagaaugucu

SEQ ID NO: 7852 - RNA, 11919 nt, Mus musculus
uccuguguauucuuuuuuaauaacuaaaccaucuguuuacauggaagauggcaaggaauaaguccaguguuuccuggggaauagccuagaauuucucuccucgagucgcuugugagccucugugcucuuaccacauuggguucagggauuaucagaacucuuguagaauccagugaauauucacaauaaaugauuugacuuacaauaaaauauauccauguuucuaauggcaacagucuuuguagaaggauguguuguagucuuugcccgugcccgcacugacauugaugaagaguaacuccccucagccucugcgcccauucuucagccuucaacuaugcaagucuuuuaggaaaauucaguggaaaggcagacucaucccaauaucagacucucuaaguacguggagacuaacgcagguaaagccugccuacagacaccagaaguucaucugcuucuccggcugcacaaaacagaggucuaguguuaggugcauuguaaggugugaccuugcaacucuuagauauaagacuuagcagcccuacuuguuagcucauucauuauaaugaaaaaagaaauuauccauuuuauuuugcuaauaaaccaaaacagauuuuuagaaauauguaaaacagccaagucuugaccugacaaaugugaaaaaaguuagucuuuucucucugccacuguuaaugucuuuuacucccaaaauaauacuugggggaaaauauguacauaugcacacuucauaaggcuggagaaaagucagcauuuuaagaauaauaguauacuacuacuccaguuuuuuuguuuaaaaaaaaacuaauagugccugcuuggcaaagcccauucccagacaggagagugagccaugccauuggcuuccuuaaggucaccgucaaggacaggccuagucaugaccaaagcuugagucaccaauuguauguuucagaauucuuugaauacucaguuaggcaagaacccuuaaaaucuuccaguugcuccuucccacucuggauuauguuguuacuaucugggaucccacugcaccuuucaauccuuggaccaaucaccuuaaccuugagcucauuaccucugcuugugaaagcaaugcauuguggguauuuuugguuguuuuguucuuuugguuuuuuuuaauuacauuucucuguuuacuuuggucagaauugauugacuuguuuuuccaagguguugcauugguucuuaaaaaugcugaauaauaauacuuugcaugcuugugugaucagccaaaucuuaucgcaugucuaaugugcaggguaaaaagcaggugauguauggauaacaggaaaaaaucuauaauuugaaaaaugaaaauaacuacuaagcaucauuugaaacacacuuagcaaauagcuccuguccuaauggaauucaccuuguucacucuccuccugaagugaagcccucgccaucccuacccuuuguacgcuguuaaagaauagcaaauguuuaaaaggacuccagaugcuaaagguggucuguguaacccagcagaucucaggcagcuaccugcggcccugccaggagcucggcuucugucacuagucugcgguauccaggguccaggugcuucgucuaguuuugcagacccuuagcccuccucacauguccuggagccauggaacauauacaucucugucaccagcuugccgcggucccguguccaggucacauucauacaucaccugcccguguagcgcaugugcaugcugccguccucaauaaccggaauguguuucuguucuuuuguuuuuuguuuuuguuuuuguguggauuucugcagugugguuuaccaggacggauuuuacggugcugaccucuauguaaguacacacacuggggccuuuuugaccccaaccccugacaagccagccuuuuuuuucuguuucuuuaguuuguuuuauuuuuauuuuuauuuuuuguuuccuuuuuuaaaaauauaauuuaacuuuuguuuuccuuuuuccuuguggauauauauauauauauuuauauauuuuaagaaugcaagcaugcuucucugccacugcgcuugccccugggugcaaaaacuaagucuuugggucuugugaugguugcugggccagucugcuggacauauucuccccuugccugugcccacccacgagugcucugggcaucucuuacccugugagaugaucagcagcuuuaaagucguauguugucgcaucaucugcauacauaaaugacaggacuagcuuaccugacaccagcucuuuccugucucugcuuuucucuccaucuuacaccgucuuuaaagggucagggcuuuguuuauguaaugccaggaaguuuucugaacugugugcuaacuucacaugacgugaagagcauaaauuugugcaagugaugucaguagcuggucucaugguauaguaguuauagagaaguguagagcauuugagggucacagagacucaguuucggucuaccuggaaguccacagccagugugucuccuucuuaggagucaagccagggaaaccggagaguguaaguagcagccuggacucugacgcucaguuaucaugcaggcacauugacauuaaacccauuguccuucuagcuggagaugaaguuccauguuccaugauuuguuggucacauaccuacuucaaaggaaucuagcugacaugggaaaagcuuuugagucucaaggucuaucauuaggugccuuccaaauggccuuucucugaaugucagcauagucaacugacccaaaucauuaaggcaauucuguaaggaagacuuagcagugggaaguuacucugaggugggucaguguguucaggaggcgcuuucuugcccucuccucuccuuccucagcaguaugaugucaguccauucagagacacugacgccgcuuucucaggccaggugaggcuagcugugcuaucuagaguaggucuucagagugugucuaccuuguaaaagaaccacagguagggauccuuggcccaucccuuagaugugacuacuagaauuucagaaauaguuuacacagccaagcaugaagaccccaugcccaugucucauugccuuucuuuauacuuuaauuaaaaucuaacucuugcuuuagcaaauuuuuaagaaguaacuuuuccuccuguguucacaguugaaaacugggcaaaucuggcuuaccuuacagcacauugcacauuacacauuuguggauguguauauuuacauaugauguucucuauauucucaugaaacccauuuucauaaacagauuauuuauguuuuuggaaucuacuauaguugaguuauuuccccaacugagguuugggcuuaggguuuuuugucuuuguaguuguuguuuuuuuauguaauaucuuccuuauuugggauuuuuuuuuuuuaaacauauccugcuucuauccugguuuugccugcuuuuaccuuaaaccagccaacugaauauuugguuaugggucuccuguuuccuuauuuugcauuguaaaaucuuaauggauaauaauuuguucugugcccaucaaaaggauuuuuugguuuguuuuucaaucuaaaugaauaaucuacagaaucuuaaacagguaauccaguggcuuagucagaacacccuucccagcgaccccugcuagcaagagcccuguugccugcuuccucucccucucccccauguaacacagaguccuugggaggacacaaguuggucacuagugcugagaucauuucaaagccuucugcugcaaaccagagcuguacuauaguauucuagcuggagcuguuaaacugauggugcaggugugagggagcugaggagggcucauaaaggcacacacaagcugacuguucccugaguuuguucugcuucucucuguacauuuccugacuggaaauccaucaccaugccuuugcagcugguucccucagaagugcauacugcaguagggugagagcaggauuuagugugucaaaaccacuccggcccaggcagagagugagaagaagucgcucgggagagguacuucaguguaggcgcuacugagucuuccucugcuguucugagaguggguccugggagccaguguuuuucuuuucuuucuuucugcuuccuuauggcuuacuuauuagagacaaaauguccugaucuagcuaucacauccuccauuuguaaagagcccuucucuuccaggauagggguguguccacuccccaucccugcugccucccuuuuucccauuaaaaaggccauaguucacccuaauuuaccuuaugagugggguaacaaaugcuccugauucucauccugugaaaagcaugcuugcauccaaaggaaagaaaaggcuggcagcccauggugggcucuuuguaugauuguuuuccuuccacagcuguguuuuugaacugcucuuccuguguucuguuauagaauaguguuacaggaaccaaucauuagcgcuaaaauaccucagguaggagugccagugugaccugccaaucaaucagauuguggauugcagugaaaaaauugaauuauacuaaccauuccagcuccacguuagagaugggaacagaggcuuuuuuggacaaucaagacuugugagcgugugaucuaagcccugcuaccucagcagugcccacaucacauccacacaucaugccacucccuucagaaugagccuuccagcccccucagcacacaugagccacaagcacaucacauguacaguccacgaucuaacacugcugccucuuucagccugucagucacaguugccugugcuauuuaaacuagucuuuuauauuggagaccuuagcagcugagagugcuaacagugaaagagauggcaaaaggaagcaggcagaagucugccugcacagggcguuaagucccauguuuagcugcucaguaaaaucagagucagaaauggacugugcugcugcagaaguguggcguuguuaucggucugcacgugccgggacgcauagcuccugugcccucuccuuucacuugauaagaucggugcuuggauaauagcacacuuguuagagaguuuucucaauagcuugacacucagagaaaaaaaauaguccauaauuuaauaacccagcuacgucauguaacccagugauauugcagaaaugaacuaauuuggagaaauguggaauaccaaaguauuugaaagauuuaaucauuaaaguucaucucucauaaaucauguagucaaagcugaugaaguugauccuaacagcuucucucauuaaccccaaguugaaaugauaacaagagggaucuuaagugacacuugucccuucagagcagagauuaugaauucuguauucaagccugugcugugucugcaugagcucacugucuccuguggcugaggcucucagcuggcguggggaaggagggcauuaggaucauccagggccaaacccagugguucuuagaggccaaacauuagacccuggcuaaguagaacagaucucuacuccucgguggugauguuaaucgucacgccugccagcccuuacacacgugccuguacaugcacacacuugccuugcucuguccaucugcacacuacaugagauaacaagcuuucauuugucugcuggucuugagcuacacacuuuccuccucagugucacaugucauugucucucagguagaaagaaggugucuugacaucacaugcucaccaaaguccuguuuuaauguaaaccuaaagcaaaaauacaauaaaauuaaaggcaagguuaaaaucaagacaagaugagaaucuuuagggguucagacaagggucacauguaggggacaaugguuagaacuucugcuuuguuucaaacauaacugcagaaaugcuacagaagaggcccagugguacagugucaaucccacgauaaaccugauuuagggaagaaguagaaaaccucaaagagguagcacuggguaugggaaacagcuuuccuuuaacacuguggaaagucauuaguaaaggggucuaaagcagcagcauuaagccuugagaagaagcugggagugggagcaggagugugacaaguaacugagagaacgagauucucaaacacaggggacuuggaagagcacagauagagucugcaguugcucccagagagcacgucugagcagcucuguugaagaaugggcucgggccaccaaacggggagugucaggcauuacuuagaaagguuacaaagaaaauuaaccauuuuucaaggggcauguguggauuugagccaggcuuagccgugccagacuuaagcagcugaguuccagaagccgucugugugugcccuccuacacucuggugugcuguggccaugcuaauccccauuuuuuguuuuauuucaaaucacacacagauagaaucugcaaacugcuucagaucaaacaggucugauuguguguaaauacauauguccuuuuuaauuuuuauuaaugguugcuucaguuuugcaucagugcaugguuaaaagcaauacacaucagcuauucaugacuucauaucuccaaaugaauuauuucuccucuuuuuuuguuuguuuguuugugcagucagcugaagaaauguuaacaucucacucuaaaucucucaguggagucucuguucccuucucugauauaacagauggguuacugcuuguuauaauuauuaacauugugguaugggccagggcucgggugggcaagauuuacuccuccuuugggcuggggagggaccaguuguuaggguauggaauguuaacucaaguggugacugacuguuuccguaauaccaggucguuguggcugcacgcucuaguaauugaggcuguguacuucaccgagcuugugguagagccuagggcaaaccgcugucccaagagaaugcugggauagauagaguuagccagugccagucuggacguggugguuuugcuguuguuuuagcuccggaugucggcaugcucaguuuuaaugugauuaauauuaauguggcgccacccccaccccacccccacgccugagcccucuucuccuuacucccaccuuguucuuuuugaaaauuuuaagaaacaguaaugaaaaucuugguguuucaaacugcacuuugcucucauguucuguauauaagugccuucaaauuuacucguuaaagucaaaucggggaaugggaaaaucuuagccuggaaucuuuguacacuguaaaaccuagaaugcaguuaagucaauuguuuguuguaaauuuuguccugaguuuuauguaagggucuguggaauaccuaaugucagcaaaagcagaaagccucuggaguaagauguaugugagaaggaucacuuccuggugcacagugcacuucccauaagacgggggugaagugcuggguugccuugauaaaguguuacccauaccgcccacaaguagcccuccuuuaaaugacuucuguuaaaagacgucugaugaucaaaagcauuaauguuguucuccuuguugccaguauucucccaagcucaucggugucaauaaaauauuucagaccccaaagucagugccugcucgugaaagcaaauuacugcaaugaagaaggcccacuucuucccugauaggaaggaccuaagccacugagggaaccauugcugucaguugccuugcuuaggagcccauccucccuguuagcagccacgacucagagcugcaauuggagacagcaugcaguagccgccaagcucccccgggucagcccugaaucuaaaccaucagaaagaaccugcuucagucuguaaaugcuauaccuagcuaagcauagaccaagauguaguugcuuucacuaucuuaaaguucuaaaauugugaagauuaucuugguguuugaaggaaugcugaagagaaagcauaguaucaaaguaccuuuauuacaaagacagcucacuaaagauucagcuuccauucugaaaaauggaaccauaucuacauagacugaacagcugagccuucaugauccagguaaagacugagcuauaaccaugagcuuuuuguucucuaaccaauguuuucaucacccuguguccucugugaaggcuuaaggacugaggucaaaaagacuggagcuagcccuguggagccaguugugagggauuucgggggggggggggguaguccagccugcucuuguaguagauauggcugaaagucacaaggaugcuuccugccacacuccacuuuggccaugucauuacagggucugauaaugguaacucagacugucccugcaccuguagaaagggugacagcaaaggagugcugcguagcagcuaagagccagugcgcuuuaaauguguaucugaagcugcugacccugaauucuuacagcguagacugggagagccauaugaggugagaaaacuuacaagcucauaaaauaauuuuccacaaugaaagguaucaggaaucagggaagccacacagaacugcuagguauggaaaggcaagggucccauuagaagauacuucuuagccaggcaugguagcaccuguaaucccagcacucaggaggaagaggcagguauucuguaaguucaaagccagccuguucuacauugcaaguuccuagacagccuaggguagcucugucucuaggcaaaucugugugcacgaacaugcacacacacacaaacacacacaucucuucaacccuaaaaaauggcccaaaaacuggaaauguagaauaucucuugcaaaguuagcaaaaaaaaaaaaaaaaaugagcauucaaaggggggaaagaaugggauacuugagcugacaugggaugugggccuucuacaggaauaaacacuguuuuaugugugauucaugacugaaccaccugagucaauuggaccaacugaacagauauuuuugacagccaaaggauggcaauaaaaauguguaacaggccaugugguaguggcacauaccuuuaaucccagcacucaggaggcagaggcauguggaucucuugaguucaagggcaaccugaucuacagagcaaguuccaggacagccagggcuacgaagagaaacccugucuuggguuuuuggaguuuuuucuuugcuuguuugguugguuuuguuuuuaaguaucucugaaucagauaaaguagguagguuauagaaggauacaaugauaccaguuguaucacccugccucacuguccuugagugcuuccagaaggaacaucucuguucauacacacaucaauugccuuuguuuaguucaucaaaaugcagguggaguaguaggcugugauggcucugaguuccucaggacuucucaagaagguauaugauccacugggaaaaaaagcucccaaagguugcugugggaaaaggaagcagcugaggcauguaugaccucaucagagcuagucaaacacucauaagccauuugcaaucugauuuccccaagucuggaaugugggcuagaguugagguuuuccuggagagaaauaggguuaagcgguuagcuuuuaaggccacaaucucuguccuagccacucuaacuagcagauuuauugauucacaggcaguucucugaugucuggucugcuuggcucuuccuucucaguauugcucuugacagacaugcucugccagauggaucuaagcucuggguuagaucuuccugugaccugcugcauucuuagugacaagcuaaucccaguacagagagucugacauugacacugauagggauaguaaauuuuaauucuuucaacuguuacaugaauguugacucaauucuccuaacauuucaugaauauuuuccaugucaagaguuccaaaaaaacacugcgaaguaagauccaaaauuauaucuguauuucuuaaaauuacuagguaguaccuguauacuuuauuuuucuuacugucacaaauuggaaagcaaauuucuacauuggcuaaagcuugauuuccuaccauaggaggaacaugcaaacuggugcaguuugaaacaucucuuuccaugugugucuguguuugugucuguccuugugucuacacgugugugucugucuggggggaggggugucugucucggggagagguagcuguaaagucaguucucuucucuccuguaggguggauaugcagccuacagauaugcacagccugcuacugcaaccgcagccacagcugcugcagccgcugcagccgcuuacagcgacggguauguacagagccagagcaagcaggcccugagcaccaugcuaucugcagcauuccucucgcccuucacuauuuccagaauugcccugaguccuugggcuccugccagccuggcucuuucuggagucuguccuucauggcuucugccacacagcacccaggccuagccucuuccuguacuugcucucuuguucugucucuucuuuggcugugaauacaguuggucuucuuucccauuugaccccuucuuugccauuuuauaguagucaggauuucccaguuacugcacucaggaacagagauaggaaaacuucuuccaucugccauuuucccuauuaauaguccuggucugcagcacagggccuucagucucggucucaacugcuucugucugacccccaugcuucuccuuuccaguuacggcaggguguacacagcugaccccuaccaugcccucgccccugccgccagcuauggaguuggcgcugugguaaguuuauauaccuuuuuucuuaagccauguuacuccucuacaugcaaauuuugaaagaucugggaaaguaaugcguuguaauuucacccauugccaaaguguggaagccaugugagacccugggaauuaugucacuugcuuuaccuguauaucuggaaaggcaguaggaaggagggcuugauggugacaauuuucccaaguaauggcaucauuuaggagagaacaaagggaauggguuccuuuaacaggugcauccaguagcaagcauaguguucuugauaguaccaaaggcuuaggagugguaagguguccagcucucccagcaagcucucggugugcucaguuugcaauugcugaugccugacaaugugccugcugccuuccugccuucugguauauagcacugggacuccaguguugugaacacugcagaggcaguuucuaguaguaguuguagggaaguauggaagaaguauauagagcaagucuagaauaauccauagaacugauguucucacuuugccuucuuggauuuggcuuagaugccuuuacuacuuacugauugguauucauaguugcaagggcaggccacuccauagugaggcuaaaugaaaaaucccagacccaggagaagagaccugggaaauaagauaccagagaaagucaguugaccaagguaaggaaacaagcagaguagcaagcacacacauaccuccaacgaagccacagugucgggacauuaucuucguugaacacauguagaccuguucuccuuguuagcuuccaacaguacaguguagcagccauuugcagagcacuaagccuucugugagucuuuccuggugcuguauagaugagucaugcaggaggacaggucuaguuauaugcaaacaguaaaccuuucuaacaagagaccagaguuguugcaguuugggcauccaugggcauuucuugaaucaguaccccauggauacagagaaacaacuguauuuuauagauuauagaggagaucuguuucauugguugaaaaauuaucuuggguuuaaauguggcaucauccugaacacaggaugugaccaccucuaccaagaaguagucaaagguagcacacucugacagucauauguuugaagggaggucagcaauccaguuucagccaggacuguagcagcauuaca

SEQ ID NO: 7853 - RNA, 804 nt, Mus musculus
gagggcuccacacccugccgcagggacacuugcacggaucaggcuuauugcugcucuucuuauagaagucaggaaauggaagcaaaucuggaugcuccugcagcagcagaggucucacagaacagaaaaggcagggagggagagacaguuguuacacuuacuaaccucgggaagccugaguaacagucguaucuuucccagcacggagagcugaacagagcagucucuuuccagcagccucaaaccuuugccuugucucaauauccacagcuacagcccccacaugaaugcugguguccccacauugucccgugguccuauugccuggucuguguguguguguuugugugugcaugucuucucagcacacaaguuacuccaaugcaggcaaggaggcucugaauacagcugugcuccccaaauucugcccugcaccccuccugugucuugggcuucuuguggcaaucaacaggcacagaggaugaagugagcucagauugaccaguguuaggaaacuucaucugggacugucuguaaucccacuacuguggagguugaagcaggaggauuaugaacucaagacuagucugggcuacagaaugaguucaagaccagcuugggcaauuuaguccgucuuaaaauagagaugggcaugggcauggggaauggugggggggagagagagagagagagagggagggagggagagagagagagagagagagagagagagagagagagagagagaaagacugaagacaguuuagugaauuccugucuccagcccagugcagaaacccuuug

SEQ ID NO: 7854 - RNA, 3135 nt, Mus musculus
ugcucuugccggcuugccgcaccucacuagcaaguccguuucuacaauggcacuaggauuccagaguguacugaaaaccagcugagacauccagccccguggacugagcagcuccaaccugccauacauagacagccuuuguuggacuagcuaaaccagagccugugagucauucuaauucaugaaucuauauuaaugauucuauauacagagagaggugccuucuguaaguucuguugcucuagagaacccugaugaagacagauggucaguuccuccuaccccacucuggccuuacagcgagcuagucugagcuccgccucagaccccugcacaagguuuccucugcucacucugcugccugcuugagauguggauguguggccccaccuggacauccuacaagccuggcaggguguugggacuguccuauaaaacuccacauccuacaaccugacagcuacagcggagaugugccccaagagcaggaucaauagacaucuucccaacauguaaauucuuuggccacugggugagcuuuaaagugcaucuuuguauuuauaugauuuucuuuuuuuuacuugcgaaugaugagaugacuccaccccuguccccuaaagucccaagucccuguuagcagcauugaacaggagucuggaccucaggagcugacuuugguuucccuuuggggaggggacuucagaacacaugccaugucucagacucugaccugcucuucuguuuuuuaaaagauucucuuccuaucaucuuuugacuucaugugaguaugggaaagcuugagcgagguggggguugggggaaacacagcugcuauccuggcacuuggguggugcaggccuaagauuagaaguucaagguucuuucaggcuacacagugcgugugaggccagacgaggcuacauggacacuuggagagcuuuggcaagaaaagggaguuauggguuagaaggguggagagugguucugagacugagucaccacugucuucagcucucaccauagcaacccguacauucauucucaguuuagucaggucccaggaagaggggcuggcgccuucucccuauacugcuaaccgcaguuucuuuccuucuuacuuagcucccaaggcaaucucagugcaguuucuguuucuguuuuuaugagguccaccccucugcaaaaucaccugaucacuggugagaacgaaggagugaacacucucacacacggccuguguuuagaugugaauguccuuuaacccaguuaucuacuuauacaaauagcauaaggauaaucucaaaugcaggcagacugugauuauuauauaaucugcgacaggugagcccucauuaagcaaggcugugagggacuaauuuuaggaaagauuccuguuauuaauaugcuuuuccuguaauuguuaaacauguauaacaaucacuaaguaguaguauaucccuuuggagcagaucucugcagauccacaaagauguacuaucuuguaaugaugcuauauagacaaauaaaugacuuaagucuuaaugauuguauuagucaggguucucuggagucacagaacuuauggauagucucuauauaguaaaggaacuuauugaugacuuacagucugauuauuuccuuuucccucugaaauuucacaagccaggccuccgucuucugcacuguucucaacauuaucuuccaagcuccuacacaacaucugacagagcucuuaacaccgaauggaucuucuggcccaaguuccaaaaaccuuccacaguccuccccaaaacaugaucagguugucacaggaauaccccacuccugguaccaauuugucuuagucaggguuucuauuccugcacaaacaucaugaccaagaagcaaguuggggaggaaaggguuuauucagcuuacacuuccauacugcuguuuaucaccaaggaagucaggacuggaacucaaacaggucaggaagcaggagcugaugcagaggccauggagcaauguucuuuacuggcuugcuucuccuggcuugcucagccugcuuucuuauagaacccaagacuaccagccacaaggggccuuucccccuugaucacuaauugagaaaaugccuuacaguuggagcucauagaggcauuuccucaacugaagcuccuuucucugugauaacuccagcuguaucaaauugacacaaaaccagccaguacaaugaugauccuauaagaauuccuaaaauuauaucugugauuauuaagcucuuuuagaaugggacugcuguuaaguccucuuuugauaagucaaagcugcaaugagaacucugccagucuuccaaguaucaccaguuaauugcucuuagaugguaacaagacuuucuccuacucagagcacauuccaaaaggucauaaaacaauuaaccaaaggccauaaaaagggaacuaaugauuuauuauggguacuaggacagaagauaaaauccugucuggguuuaucuauacaaaacuucacuaauaacuuaguuacgguuuuaaaccuucagugagccuguggagcucagacaggugauggauguuuagcuagauaguuacuccuaauggauaagcauguaaacauuugccgguguaaacuucuguuucaauuuaugauuugauuuugugugugaacuugugaugcacuuuguaacaugugaucauguauucugaaugauguuuaagagcagaggacaaagagaagagucagaacuggggacaggggugagaggaaccgaggugagaagaacugagcugagagagaaacugagcugaggagaaguuuuuagacagaacauuuuuuagauuagaagaagaaugcagaguggaguaacuuagaaaugauaggucacauaaaauacuaagagagcaaugugcagaaugcagaggaaaagaggaagaaagaggaugucgcagagagcagaaggagcaggcaggcuucuccuuaucaugggacagaacaggccccaugguaaggacaaggcagguuuagucuuauuaaaagaaacaaagcuuuuuuuucuuacaaacauggguuuaauucauuuaacauuaaaaaggguagaagccuuuucuuucucuauguaauaaagauuggaaugca

SEQ ID NO: 7855 - RNA, 14665 nt, Mus musculus
caauauggagggagaaggcggguugaugaugguugccaggagccuguuuggcgcgacucuugggaccagaggacuagugguugugucucaacucuucuuugggccgggucuaaggcuggacuuggaacggguucugcuccgccccaccggaaccuuugcaggcugccuggggccugaagcccuccguccacccaacccuagcacccgggccaucauccaucccuccaucacggccucaggcccuggugucagcuguccccgaauccuaacccccuuucagcgucccccacccccacgucuccgcuaguaccugguuacuauggugaagcuagcugccaaaugcauccuggcaggugagugcuauauguguuugaacgcgugguccccagagcccuagccguccuaacucgggcgguuuugguucaccaucgcguccacucucugucucccuuaggaauggcuguagugaccaacagcagauucuagaaggcgcgcggggcgggggaaugggcuccacaggacacuccccccaccccuagggcacauuuguagaugcagcugugucccggucucccucccauauuuugagacuaccuucaccagauagacuuaacaaacuugagcgaaguacaagcauggacuugucaggggucagcguugcuggucccacucacucugaugucaggaagaugggguggcgcaucugagagcauuaacuuagagauuccccggaaguaagauguuuauuauuguugacugucagggaaauagccugcacagugcccagaguguggaugaguauuauauagauauauacagagugaucugguggugcucacacucgugggcuugccuugagccagucugaacauucggaagccuauaugcuuagcuuguagucugguugacagcugagcacaugugucuaccgaggcgacacugcagccagugucauguggggguauuucauuuaacccuuuugccacagcgcccccagguagcuucugugaugugaccugaugugaccgaagcccugagugguguugccaugggugaacccccaguggaagucguacaccccauucccagauucgccugacuucugccugugggucaggaguguuggcuacuucuuauugugacaacuuacuggaccggaaguugggaguuuauugugcucacggguccagaggacugcccaucauggugaggaaggcaugguggcaagacugggaggcaggcuggccacguuaagucaacagucaggaaauggagcaugagccuuggcucucagcucucuuucucccuuuuauucagucaggggcuccagccuguagaguggugccacucaccuuugggggcgggccuucccgccuuaaucuaaacuagaacacuucuuacaggcauguccagaggcuugucucuuccgugauucuucuuuguaauccaaagauuagcaggggugucuuuugaucuuuauucuaccgaguaagaagggggggcagggaauggaggggaacgguacccgugaugacuuuucuaauuugaaaaugaaagcgucaugcauagacaugagugacagguugucacucagacccuagugcagcagaaggaagccaggcucugcagagaaucuguaguucucagggugccaggggaggcagugugguguaacaaaagcagccaguccuugcccagcucuguugcuuuggacaguguucagcuucugcauggguaaguuggggacauuuauuauuuuuuuuuaaaguuaaauuucguuuuaagugggcgguccugccugcuguucucuuccuuagcugguuagcucucgaggagcuccuguggugagccccucugcuuagacuugcuguaugcuggcccuugucacucccucacagucuucuggccaaaugcucaaagcuaccagccaguucucauguaagaugaggcaagcaaggcccagagcaaugaagacccugauccacaggcuacagcuucuggcuaacuaaaaaaccaccuccaggcucuuuucccuuaggaguauccagggaccaccagaccccaauggaaccacauucagauuccuaaucuccacaccucccuuaagugcacaugcgcacgcgcgcgagggcacacacacacacacccuuccucuuccccuggcuuuuucuuuucacuccuuguaggcucacauaaucaccgguccacacauauagucacucagcagauguuuauugagcaucuaauacauugagucaccaugcaagcugcagucgccccacgcccccaccaggaagagcccagaagugcaagugugugacucaugggcccuuuguguacuguaugagccuuugcugagugccucagacacagcugcggcuucuuuggcuugagaggcagagagagggagcaccauugacaggcaacuguguuucauuuauugaaccaacagccaggugcaccaacacggcacacacugguucauuaacucuggcaacauucuguaguggguccuucacaaaagcuguuggccuaacuuacagauguagcaaaguggccacagagcacugaggccuuaaguggcacagagagaaaggacaggauuuggagcuggauuagaaagaggauugcguguguguguguguguguguguguguguguguguguguguguguguguguguguguguguguguguugcggggggcugggggagguccaaggaagaaagagcaagcacgccuguccagacuuucuuuuucuuucuuuuuuucuuucuuucuuucuuuuuuuuugggggggggggguucgagacaggguuucaaaccaguauagcccuggcuguccuggaacucacuuuguagaccaggcuggccucgaacucagaaauccaccugccucugccucccgagugcugggauuaucuauaagggacagcuggggaccguuggaguggucaccuaggaguugauggaagagcuacggaugcaugcugugggagaaugagaggacucaccgccggucuguucuaugacugccucucuggugaggcugagcugggcgugggagucacagaaaguuaaagacagaaucaguuugugaccgugagagacuggagucagcccgaaggagcagagacaugcagcgguggugcagacccggaaggaagucacugagcuaggcacaggccucuggggaggggcgaugccuggcggggacagaacucagcucagucacacuagggcaauguuaccacgugccacacugccgccgccagaaccuguuucuucugguagaggacucagcacagccccagagccaagugcaagccaguccauuucuguguucaggacagacgugagucccgacaacuacgcucuacaucagugacugucacauagaggcacugggguuagucagguagagggaucaccaccuccagggccggacagagagaagcccaaagagggggcucccagcucuacagaugauguuugagcuccuggggcaaccuuggauuguggggcaagugcccaaaguguaggcuugagagagagcccagaaccagaaggacgggagaggagacagcaggauggggaggagguagugaccacauccccagcauccucggacagcgaggauaucggguccacggcggcaugaugagcagaaggagauagagaaaucacucaggucuguggugagacauggugguggcuguggccagucaaacuacagaaaagaguagaagcccccacaagggcugaaaacacagccagcugggaaggacccggccuagggcagcaaggaucaaggaaugagagaagccagggcuguggauguagcaggagcagagcccucuccucacaugcaugagccccaaacuaagaugagggggagggucugaggcagaagagccaagaucagagcauggaggacagaccccagcaguauacaccauuggaaaacugaagaggaugaacacguggggaggggggggcacagaggagcaggcaauggcgacagaauagagccuugcaggguccccacaacuacacgacggggguggguugggguguggacggcaguuggggauugcugcaggcuaccaccccaucuagagaguucacuaaugagagcccaggaguggccaccggacauggcaguuaauuacgaggucaugaguagccucccauggugccuucccaaggcagucuggucccccagccccugcugcagccccggggaaaccccccugcacccagcaaccacgugggcucagaggcucucgagguuuccccggcucccucagaugcccugcuucucagcugugcuguuuggcuuuccgcuugucauccuguugcuccuagaguguguuuaucaguuccuccgccucuccaugcucagaucccuccucgcagcccacacaggagucccgcugccagccuuggugacuggcagucagcagaaagauucacgaaauuaaccaaagccaaucuguggggaaucucccagggggagaaaaagccaauucccucccggguuuaggaacagaaugggugucaggaugguggugacuugacucccauucuggagugaggggguuacggaggcaagcguggagaaggagaugcugggccauaugccccggggcaagugagaccugcagacccugagaggucauagugaaaagagcccgaaggugguauuugggguagucagccagaccagccuggugaaacaagacaguauuaaaaucucagauaaguucccuagcuucugugagccuggcuggcuucaccugugaccucagugguggucacagcacaggagggacagacugagagugaagggcuugugaggagagcguggcccacugcuguucccuucuaagaagcaccagcaggaaaccaagccccucguggcucacugggcccucaaagagauaaggagacaccauaauugucucauaugggaagauugcagugggaaaagacugcagagugccagucuggagaggucaggcagagggaaccgcugggaagcaaacagaagacagcguuguuccaaacgcugggaaucaagaaacacagaaugggugguggcagcaacaguggugaugguggugguggucauuguggccauggucacgccccugagggucaggaacucgagaaagaaagccgguguccugaaacaccugggcgauggagugagaaucggcauacugcucucaaggccagaaagaugcccgaauauguaaagcaaccagguaagcagaggucaggugggacagaggagagagcaaggcacccugagcuguccccaugaccacccggaugaacucuguaugaaaccacucccuccuauuguggaaaagacccaaaucugaucugggccugaaaacugacaggaaacuuuguuucgggggguggggggugggggucguccuccuggaacuguuuauugaacaaagagagggaagggcccagggaggcaaagaggccauuggagaugacugaagaugugugugugugugugugugugcgugugugugugugugugugcgcgcgcgcgccuaagucuggcagcucccuguucaccuggcaggucaagauggaguccaucacuugaaaaugaaauuucucacagugugugcaaccucuugacuuccucacugccugugcagaugagagaucaggcaguggcucagccagguggggucacagguuguugcucaccccuuuugcaggccagacucuagagugaauuggaguuuaaaagugacagguuuccccacaggaugugcuuuuguggaagaguguaacuucuguugccagggcuccgaagcccuccuucaccccuguuaccgcuaccuucuaggucauucuucuaguugacagggcuaugggguuuauagaaacauacucaggccuggauaagcuuuaaagacggaucucccggaccaguugcccuacuggcgaccccucugcuucccacgagagcugcagacauuugcucugaaaacucagcgaaguuucugauuucgaggcaagcacucuagagcaggaggaggguucucaugccucgugggauccaagcaaugacuuuuccucugcucuggccccaggggacccagccguaggcaagacggcccuggugcagauguuccgcagcgacgggacccauuuccagaagaacuacacccuggugaguuggaguccccaccuggccacuacugucaugaaacguggcaguuaaccaugagagugugacuuggcaagaucccuagacuaugcccuaaggggccugagaagagauggggaaacggccacauggagauccagucuccauuggccacuaguaagggaccaaccaggauagcacaggguugccaggaacaguggagggcagggacuuguaaccgcaauuggcuacuuuauuggauucuuuucccuaccgcccuucuccacccuuagcccccaacauuaaacaggagagaagaagguugggagagaaagggugagucccuaucauuagaaacuacuuccuggugauuaggggcaucaaguuccuuggagaaagaccuuucucaggacauuagagagcaggaacagagggagcagcagccuccucucucagacuaugguauuuuucuacccucugaauaguccccagaauuccaaagguaaacuaucuucagcuggcaaagucgcgcccccaccagagcacgaggcaaaucacagucagcugcugaggacagacugaagcagucccacaucucccaccugggauuaaaacaacaacaaaaauaugaacguaacauaucucuuuucuuaaaccaaaacucucacuaaagagauugggaaguccugacggccucugacuucugcuuggcugggaacaccuccuucaaggaaguggggacuuggcucauucugauugccccaguguggggcccccuaaggccugugaucuugguguccccugcagacaacuggaguggauuugguggugaagacagugccaguucuugacacaaaugacaguguggugagugcuacccuggcccugaagucacuuggggcugcuccugugagcugggguucccucacuccaaggguaauagaaucguggaacaaggacacggggaaccuucgagggagggccuaggguaccggggaggggauugggaugccaggccucaccaaaaggaacuuguuaucuuuuaucugaguucuuaaccgggucccuccaaagacucucaccgcucuugggggagacuggugcagcaucgugucauguuuguuuggccucucccaggcugcauucaucggauguguaaggagacaucugagcaaaaagaaaggcacagaaguccccccccacaggaaaggcugagacaggaaccacacuguacagggccaguccguggagcaggcagugcugcccuucagggucuagagccaggcaggagguugggcaccaggauggggcucagggaccucugaggggguuucaagcaagcagcagcaucugggagggucuccacccgggcugggaaggcucggaacucuguguacagagcccguguucacugccucagagcagugacaggcuguccuacuuuaagcgccuuccccaggccuccucagcgaccuccuuuaccaagaauuguuagacgcucugagaguccauuugguuaacaaaguacagaguggccuuuuggacaccaggacccuugccagccugcuuagcauucugucuugccaggugggcagucagccuccucccccucccccccaccccccgcgcgcgauuuuugugcuugggguuggacaaggugagccaccugccacccaggucacaccagguggacagaagccuauaccucugccucucggacacuccggucuguucucgccaucucucuggggcaucggagacgguagcgcacgugugaaggcagccacgcgcaugggcaugcucacucgcucuccacgcaaaccuuguguaugggaagcugagugggacagcucggcccaacucucccugcacucucuucugacacgagcuuuucuggucccaggaacucuucauuuuugacucagccggcaaggagcuguucucugaaaugcuggauaaguuggcaaguagugugcugauuuuuuuuucuuuuccuucacuacccacuuccgcccaaccccuugucccuguggggcuccuggugggaugccccaggagcaucagaagugaccaggcaggaucuucuaaggggcaucccugcuacugggucuuugagccacauggcaaauauagauguuccuccuuacccauccaucauggucagccccagcuccagaaugugccaggagcuacgaagcuggucaguccuuguagcugcccaaugccccccccccagccugcuguuuuuaauagcccuuccugagcguuuuucaacccuccccagucagcauccucucugagcuguuugcuucggcuacaaagugagacucucccagacaaccuuacugacuggggcaucucagugauugacaggcagcuccugaugagcggugccugccucugccagccacugccaucuucugaguagggauucccccaacccagguucaaguuccucuuucccuugcuugucccucaugagugccacugcaccuggcaucccuucaucuguggugaccuguggccaucugugggugggacaguuucucagcucacaccccucucuuacccaccuccccccgaagcccauuuuucucccccuccccaccccuguccccauccaagagucccugucacaucccuaaagcaggcuucuccugucucucgcuuagugggagaaucccaacguccugugccuugucuaugaugugaccaaugaacaguccuucaucagcugcaccaagugguuggagaagguccggucucagacuucaggcaucucccucccagguaucaaacuguagaugggccuuucuccaacucugacuccguccuucaacucaagggucucaucaggucacugugcaagccaugguggaaauagaacaggagccugaaucccugacucucugaccucagcguccuugcucagccucuaaauguucucgaaaaccuaccgagcauggggguggggagacaaugccacccaccaggcagagcugggcgggcugagauaaaaagaagggaaggcgcuguguuccgaauggauguuuccagaaagcuaacuccagggaagaaucccucaucucccccucuacacuggguacaaguuacauuccaucccgguugucacuccugcacgcuuuaaaucagguucuuucucaucccugugugagaucaacaaauucuccucauuagaggccagggaaagcggccuccagagacggacugagaaauuagcacagccaaggcagcugggaacggagcucaauuaccugagucccugagucugagcccaggcccgagauuagcauuaaugaccacguccgauguuggcuccaugagcugagaauuagcacaaaugcucuucuaaaccugauccaggccugccuggugcuuccagcccuaaggaggugaggaauauagauauauuuuugaagccacgugugacggcgcugagcugagcugccugugcacagcaaaaccagucugucuucuguggccuugggggaccuucccugcuggcacauauucccucaagugggcagcuucugucacuugaugugucacacgccccucucucugccgccacccugccaccucaaaaccuaauauugugguuauuucuuuugagcagguguuuuagugggaacuaagacagaccuggcuggccgacaaacaguggauucagcucaggcccagguaugggcacugagucaaggccuggaauucuuugagacaucuguggugaguucccccaacccucugagccacugggaugggggccccagugcuagagguuugaucgugaccugggacgcaucaagugguucugccaccagaugcaaaaucuaaauuagaaccgaugcucacauucugcccagggacucugcucagugugugucaggagagucuucuguauggcacacugugaagcagggcagacagccuacccugggcagagccgugugcaucucucuuggaaagacuuugaaguauggggagagggaggggguugcaagggccauuccauuuuccugacccuuggacuccgagagcugcagaaggccaugcaugucugugagacaggaauuggccccccaguuccaaauucagcauuaaaguuaaaaaaaaaaugaguagccccaggcccacaugacagggugcacccagccccgggauccccgcccccaccuucucucauaccagaggagcaucuagugucauuuuuugauagagucgucuugcagugggagacuccagaugaugggcagcugccaucagaguuguguagcacagugaaaugccuucugacaucuggaaccuucaaaguuguggcuuccggccacaugauucugaucacaccagucagaucccugcccugugucguccgucccgucccccgucccccccgccccaccacaggcaugaggguggccuagacaccacuagucucauaagcagccacagaccucacgcaggaaguugccagagaguccuguuaggccugcaguggcuaugucguauggggucucacuuuagggucucuagacccaacuacauggcuuuccaaaaaucgucagcaagagaagcgcauacccugggugucaccuccuccaacuguaggcucugucaugccuacgaagcagccugagccagcacucuguugcuguguggaugugggcaucuauagugucucucacuggcacacuuccccagacaaggcaucagcuuccagggcaaguguucugccuuccgagggcaagaagcugaacugccucugggacccugggcuugggaugugugcuguggggccucaggcucuucaccuguagauacagggcuaggaagcugcccuuagggcucaucacgcacaggaaugaaaaacgccuagcacaaagucuagugccccauaaacacucaccaugcuaguguuuuagacaacgaucccuuucuacaggguuuuuaacuguuacuccuuacuaaaccccagggccagcggcugguacagagguggacgucaccccugucucgaguccgauuaucacaaugcuggauuaguucaacugagauagcuccuacuacccagggcacccuguugagccaagccacacaccuuugagcaagcagcaagccuacagcucuagcaguagcuccccguccccucccuccucugccuucuucugucacauccccccuccuccgacgccccauauuuccuagaaauuaaaacccaccccaacccaucaucagucagccacccaaagcuaccggucagcuuccggcucaggugucgggaaggaugcgcauaaauucugcuugaagaggcugugguugagugcuccguauuaacugugcgaguuaacuagucccccuugaguugcugcuaacaggggcaccacuggcggcucgguuaagaaagccguaauuaaaaagggaacauaacccaacgugguuugagaugcugccaagccugcccauccccuccucccuucuuccagugugcagcugccucggagagacaccuccgugguccuuccaguguacagcugccucggagagagaccuccgugguccuuugguucucagacaccuccaggccccaccccacccccacaacagucaaaaaggauuccuuugaacaaaguuuaaaggguuuucaaaacccaaaucaaaauccacgauuucccccacugagaugggaugucauauaaaguacaagagcagggccaagcccuccucuuggugaggaggcgcgcccuccccaggcagccgagggccuaccgcuugauugguguugcaaagauuaaguuuccaaccucauagcaacccgacaaggcagcuguuccugucucuguuguucaauuagcagacggacucagagaggccacacgucucucucuaguugcacagcuaaggagaaguaaaaccaagaccagagugcagcccuguccaccuggaaagucaggucuuccaagaguucgaacccuugaccccugagcggaccugcucgggagcucucggcgacagaauucuaggucaaaucaagagcuagucugagccuccuccagacaucaucucccaaacagccugcuccaucaguguccaaacugugcacaagaugauaauuagucaucggauaaaagggcuucugucgcuggcgggcccccuuaaugcguuuggaaaaugguucaauuuccaucuauuuccaggcucuccacggugucugucggggcuccugggcauugaauuccuuacguuuuuaugauggguucucccaguuauugcuuuggagagcuuucaacuccugucuaaaaacccucccacagggucucaccaccucccuucccuccacuuggugcucgaggagggagggaagcuguucagugacacugacuggccuggacaugaugccacacaagcagaagagagagacucgagugcccguguggaaccucacacaggcagucacugggcacugcacccugcucagugacucccugaccugcacuuccuucuuccuggcugugggguccagacagcuuucucccccaggcaggccuggugcacuucuguccuuuuuacggccacaucauuaaacaguccccugcccgggaucaggguccaguguccagcugggccacuccacccucuugguuucauccacuccuccauaaaaguguggccacacugacuucugggauauuccucccguuccaucagggacacuucaaugccucuuauccgggcugcgccuuugccagccgcugaaaagcuuucagccaggcccuuguaggcucuuagcugcagcuccugugugguaguagguucugccugccacuuuguucauuaaaacgccaggccuuaugaugguguguaccuguaauccuaccacuugggaggccgaggugggaagguuaagaauucgaggcgagucuggacugcauagcaagaaccuaucuuagaaugaugguggugguggugguggugauaaugauggugaugacuaugucaugaugaagugugguggugguggugaugaugauggcaguuagggacgugccucaggugguaaaaugcuuggguaacaugcagaguacucuugcguguggucaccagcacugugguacauaccuguaaucccagaauuccagagguagaggcaggaggauuagaaauccagucagccuugacuauagugaguuccaagccagccugaguuacacgaguccuuaucucaugaaacaaaugaaaaagcagucugggagaugggcuccuguguugggucacguggcauugcaacauuaggcuugauuuuugaaaaacuuggggaaugggaacacagagaaaacagacacccacauuucaggugagcaguggccacagugucagggggaagcugugugugcgcaggcccccucucuccccacagccccauaugaccucaaccuggaggccacaccauugacuccucuuagaugcagccuaaggcaagcuccugaauuuucccgaucaucuggccaguaaaaguguccucugggcaccuuuggccacuccagcuccgucagugucaccccaggggucagggaugaggaaaccuaucaggccaccagcagacagccagcucugcaccuucuaaggugccuucaccacuccccgcucccgugggaggagccacgcauucuugcugggauccggcaccaucccggaagucucaguuuauuccuuugaaauaagccucuuuacacucggcccuaccggggccagccaccccaccggccuuccuggucucuggaaugaguagaaggacacuccugcagccuggcaucauugaguaggggcugggugugcugcaccucuccuggcugggcuggggccagacuuucuccuauaacacaucugucugcuguucugcaucggccuuugguccucugucggggcuaaguaaggggacucaucuucacguccuccacacagaacccuaguggccacaaggaugguucuacagguagacuucagcccuggcuccacccaucacacaucauauagcuggcagccuguccuaucuaucucucaguuucccuauaaaagcuacaccgugacagcagcugcccaaacugcgugaagaugcuccgacaccaagugucaggggcccgaagggagggaagccucuagcaugugcccacuuccccggacuaaacucucacgcccccucucacgucuuacagaaggagauggauaauuacgaggccccguuccacugucuggccaagcaguucuaccagcuguaccgggaaaaaguggacauauuccauacccuggugugaggguacaguggacuguccugaagggcugcccacucugccgcugcugcugugagcccagcagaccauugucuuuucaggagacagaagacgggaucaccugggauuucucaguauccaccaugguuuucaauaaaaugagaagagcaacaacgg

SEQ ID NO: 7856 - RNA, 10742 nt, Mus musculus
ccaggacaagcgcagagcaucccagcccuggcuccagacuacagcucccggcaugcccugcaccugguacucgcccgcggcgugcggagggaaggaugcagacaacgcggccggcgaugaggauggaggccggggaggcagcgccaccggugggggcgggcggccgccccgggggcggcuggggcaagugggugcggcugaacguggggggcacgguguuccugaccacccgccagacgcugugucgggagcagaaguccuuccucagccgccugugucagggcgaagagcuucaaucggacagggugagcccugagcccgcugacagggggguccuggccccgcgcucccgggcugucccgccugcgcgucccucggccucuggcuuuccuaggauucugaggcggggagccgaggcaggaggagggggaggaagaggagccgagaggaauagcuauacccauugccguggcaacgggacagcacaggccgcagccauuuagagcuuuggagagcugccccagauccgggacgcuuccuuacuguggagcgcuggggagggaccaacaaaccgggccugccuuacugcccuggcugacucuuaaaggaguugaugcggcugcuucuccccgcccuuagggugugggcagcugaaggguacaaggaacuagauggaggaggccugggugucuuggagcugggcuuaauguagggaagagcacuggcuuuggagcuaucacuugugggcucacccugcucuccugccaaauucccaaaugaccagggaggaaucgggaggagaggggaacuucccugcucucugacuuuggccuccuagugugcaaggccucuggaguuggcuugucaaaguccccugucccccauucuguggcccucuuacacugugcccuugggugaguccccugucccuugaugucuccgucuucugugcuggguuguccagaucccaguccucccugcaggcugcacuuguccaaucagagugcagcuucuuuggaaacuugcaaacaucuagugaauagugggguuggcugggggugggggugggcgcgguacacagccuccaagagggaaacuuuccuaagagggaaauucacuggguccugugcugagagagagguaaggggccacucaggaauccggucacccucuauacucacaucuaauccucugacuaugggagaaagaagcaacgcuccagaggccagaugauuggcucaaggucacacagccuggaaaaggcagaggcaggguucgaacccagauccuuacugcuuucuuccugcuuccucucucccuguagccauucuuccagccagccuguggugacuugaguuuauguguguguguguguauguguguauguguguguguguguguguguguuaggagggguggggguggcuggcuuggggaagcuugcacaccccucacuuccuguggucaucuccuccacaggaugagaccggggccuaccucauugaccgugaccccaccuacuucgggcccauccugaauuuccucaggcauggaaaauuggugcuggacaaggacauggccgaggagggugaguugguccauugcgcuggucugggucucuacagccuaccggagccuucaggggaggccuaaaaaaauugucuugaagccaggacaguggcuacauuuccccauuauuuucugccugucccagaguggagucccauucuccaggucucggcaagaccgacagacccccguggucacuggguaaauggcagggaaacaggaagugguaaaaaggaagccagccagguccugaaacaucuguagccuuugggaauguacguccuuccucccuggccucuggcaagccaggcguagccugugaugcuccaggcuggaugggggaaggguugggucuuuuuucucggccuuacucugugucucccaagcaagggcuucccaucagccaggaggcaaaguuagugguucucccccauagcuggcagccucuacggcccaguggcuuguuggggagaacuuuggccuuucccagaccccuggaggcucauauccgggcccagcugauguggaaucgggguggggaauagaucagagcaaggaccacagucauccccaaaccagcucuccucgguacacuugagcucuggaccaggcuagcucagacgugucaguuuucuuugagucucucuuggugucuccaaaaauaccaaaaaaacaaaaacaaacaaacaaacaaaaaaggcaucacgacccacauucagaagacuguguguugggacagauggguccuguguaccuguggguguuuuacacggcccucgcucuaggcuaugguccucuccagcugaccccaguggaguacggugauccaaaggcuccccaaaggacaucacgcuuagggcuuacuguagguagcuagcucugcguuagccugcugaagcugccuagcagucugaggggaagcgaucacguggguggggccugggcucaggagcaggucccucugggaggcucauacuccagcugcgucacagcuaauaccuguuuacagguucuagcgccucaacgcucugugcucuccuacccucagaugcucuccuacccucagaugcucuccuacccucagaugcucucauacucucagaugcucuccuacccucagaugcucuccuacccucagaugcucucauacccucagaugcucucauacccucagaugcgguggugguggugggguuaucuggagagauggaguucucaaggaggcaguggaaauguuaguuuaaccucucugggucugugaaggguagaaacaguugugcccgacucaguaaacacuggggagguagaagggaguuucucacagcucggagcugccuagccugggguacacagcuugcuguuccucucugccagagauuucugucugucacucugggcaguaguccuugcuggcugucccuugaggcagguacuaguugagcauucauagagaaugcccucacccccuggccccagacccaguuacagccgcaaugccuagggaaguacaggggauucuaaguacagggauucuaaugacagccaccgaucccucccugcucugcaggcugugauucgaggucacugugcuagcaugggggcuucuagccugaccccuccugcuccugacaacagcccacuugcaugguccacgcaggcagggagucauuggcugucagccuuucugucagaccucucacuuccuuggacuucuguccucaugacucuucaccuccagcagggcagagucccucccuccaucacgugguuuuuagguuucaaagguuaaguuuugagaggacguagacacucugugauggucccugagccuagagagcccaguaggccccugcccugcagagacuuccugcaguccagacuccugggagcucuucccaggucacugugggaggagggggauggcuggcuugaucucucagaucagucccauaacacacaaacagugacucccgcuucccugugucccagguccugugaaggacccacaagggcuuuaccuaccaacagcucugagugguagcugagcugcacaaaagcuuguuuacuucuacugagaguucccgggcucugaagguggagcuugccuuauuucuguggcuuaccgacccugugaccuuggacaggcuguuuccugucuccuagccucaguuuccccaguuguucaguggacaugaugaagggauucacuucuaguucuaacagugccgucaagaacgugaagaacccggcucaggccugggacuuagcgugugcucaauaaaccagggcacacaguggguagccucggcccucccuguuguauucuagggcacagucccugugagccuucucucuugaugcccagaacaucuccagguugugaacuagccaguaugacagguaguccugggucacaaacucaucacuaccagggaaaacgggguuggcugaggagucacaucucagccucuuacuuggggaccaagggggggaaaauguuccuuuuuuuuuguuugggucuccuauagcucaggcuagccucaaacuucuuacguaggcaaggauguccuugaacuuuugguacuccugcuucuacccaccaugugcuaggauuacaaggguuugucacacucaugguuugucuggcacuggggaucgaacccagggcuuugugagugcuagucagcuccucuacccacugagcaaaucccuaggccugaaaugucaacucuuucuugacccuugaacucauggacccuuacgugcccaagugacuagagcaggaaguaggucuggggacaaggagaacaagccuggggacaguaaaggugacuguauugcucugugccccagggguccuggaggaagcagaguucuacaacauugguccucugauucgaaucaucaaagacaggauggaggagaaagacuacacaguggcccagguuuggagagaggaagcagggccaguggagggagggggaggggaugaagggagggggagggggaggggaaugaugggugagggagaggccgagcugccugacaagggaggccucccagacugcuuagcacagccccagccuggcucuacacugcugggguuuuaccucugccuggcuucugcugugugugaccaaggguuaucaugcccuugucuuccucuaugggaagcagagaugcucagaguugccuagcuacccaugcucacaagaugguaucaguagcagcccagccccccacacacacccggccacacagcauggguaaauauccacuucauggaaucaggccauccccggguagguacucacucagggcuagcauuucagagcucaggccucaggccuuugagggauggggugagacaucaccucccagccacggggacuaaggaggugagggccugacuccacugauaacccagaaugucuccugucuucaaucuugugccacccauauuccacacguggcucugccacccuugaacuggugacccuaggcaugucccugaaccuuucugagacucucaguauaaaauuuuguaauccguaagggucucagaaggagugagucccguacgcgaagcaucuggcacauaguagguguucagggcaugguucccauacgcgaagcaucuggcacauaguagguguucagagcaugguucccuccuuucccaucuaacguuccugcccucccucuauguuaugggcuggggaaggagcagccgagugccuggugaccuuggacaugcccuccaugugagcgucuuacccacaggugccaccuaagcauguauaccgagugcugcagugccaagaggaggagcucacacagaugguauccacuauguccgacggcuggcgcuucgagcaggugggcugggcacaagggacacccuaagccuguccuuucuagccuccagccccuccccaagcccugugguccucgagugggacuaagcaagacuacaaaaguaccugcuggucacaggugggcugggaaggaacgaggcagggaacccuugcuacugggcauccuggucacuggggaucugcacagcagccagucucugguccucagggacagcucagguguaggagaucagaaccagaguugaguagauuuccugucaugccccaggccugaccuccagggucucaugacacaaccugcauagggcuaaacaucccucuuuccuggaagccccaggugguggcuucccacgugugacuagccaggcccccaggccauauguagggcaccaugggagaguacuguuaucagccacgcuaugcaucuuaggauacuaggggcgcagaggcccaauaugaacucaaguucuaaacagccuugagagugagagaagaguugagcuagcccacaauguaccuagcuugccaacuucuacugcauggaaacuggaaaaggcuggccuuccaggauagccauuauaaggaagaccaaccagccaacugggacgggaggauacccucucuuccagcgcugcccucuugucaguccucugacugcuccucccccagccucugcagccugggaugugagcucaccgguaccuccuuuauaaggccuuugugacagugagaagagccaucaggaaagguucuaguuugggacaggacucuacccaucagcaccagugucacaccauucaaagaggccacauccacaguccagacauggagccaggaagucagugucacccucaguugcauagucucgaaacaccuagaaaugaugugugugagucuguaagacuccagggaagaaguggugggcucuggaacuuggucccuagccugccucuugccacugggguccucugauagucuacugucucuccugcccucugcuggcagagaggguaauguuuuucuuugcccgcugaguuggucccaagaacucgcaucucuucacaguuuugucagaagggccauacagacaggacaccguugaacaaaggaggccuuugaucugagaagcgagauggggggagggggagaggcacugagcaguugcucuaagagacuaggccagcaggucaggggccaccagucuggguccuguagccuggggaguuggcugcuucuucuggaaauaaaaggaauauuccauaggcucugcucugccaacccuagccugcaagccuaguccugaagcugcugcagcaaugucagggugaggggggccccacuuguuucaggaaguggcacccgguuguaggguauagcugggggggggugauacuacucucuguuucggggucagguucagccaugcuuggggagguguggguggagaccaaggagccugccuuccuaggcucugugccucugggagaccaggagcuuccugcacaggcuggugccugugucucuccugccccccaccccacccuucauccccguccuauuggugucucacuccagcuggugaacaucggcuccuccuacaacuaugggagugaggaccaggccgaguuccuguguguggugucuaaggagcuccacagcuccccacacggccugagcuccgaguccacucgcaaggccaaggugagucccugcccugugcgaagaaggcaccccccucccccauucugcugcuuccuccucccuccugccacacccacauaacacucauggucauggucacagccaacaccauccaucccacgccaccacaguccagucagcucacacccuuggcccaggcuggggagcagacaggcaggaccauugcaaggcuccagacagagcgagcuugaugcugcuuuucaaucacguggcaucaaaaggggucacgugggcagcuguugaggcacgaaguagagcacacugaagcaggggcacacuguggcaugccgcuguauaugaccuccggcaggucucucuucucgcaucuuuugcuggauucucugugaagggaguggugggucacacgcucuggugauuccaggcuggaacuccuggguucccauagguugcuguauuucccagggacuggugaccgccuggucacucaucagccuaggucaagauauccuagccuucuccaggcuuuuuggguagccugcuugaaaggugucaggagcccucugggcuccggccuaggcagccaguucccaagagcacaauugacgggcagcccgugggaggaauugaguaggguccugcccucuugggccugcgguagggccaucaaagaagaaggcaugcuucagguugggaaggugggagcuaugcccaugugcuggagucguaggaacuccggcucccuguguguuccucuucccacuccccaagccaguggcuggcuccucccugcaagaaugcagggugcccugcugcacugacccccucccugugucaccaaccuggcccaggcugccagacacuguugcuggcaucuagaucuggcuggugacugcccugggacaaccuuggcuuccugcucuggacccauccuuccaaaguaaggccuuuccaggagccggcgggcuccucuuccagccguccccuuagccggcucucuaacagcagccuggcugggcucuaagccuucccucugggcuagggaagacccaccaacugcuuuggcugcagcccucccucucccagaggucccuuucauccugccugccccucaguccugaggucgggggucccugcggacagccgcccgcagccccgcccccucgucagugucuccacucucucuucccuggucggcggcgggugcacagagcacggacgagcagcuggaggagcagcggcggcaggagguggaggagguggagguggcccaggugcagguggaggcggaugcccaggagaaaggugcagcccgcccccaagaggacgauugcuaaugacagcccgggccucccgcccucucccugcuggagcagcugccgccgggaacugcgggggcgggccaccaggguuagcucagcgccuggcgccucgcccauaaccaucccucucucacuuucucuugcagcccugucaucucaggaucccgcuaaccuuuucucccucccaccaccgccuccuccuccuccgcuuccugcuggagguccugcuucaucuucauccaccuccucuuccuccuggaucucaucugcacccugccucuucccucucugccccugcccagguuuccucuccgccugcucccgucuccacccuggggcugcccuagucccagucucccgcgcccucuccccaagcccccucgcccugcauccccaagcauccugccugccgccuccuucgccccuuccagccccuccugccuccuggccuggggaggaggggcguggccgcaucugcucuuuguccuccaacccagcagagcaccucugaggcuggccuuggccacaggccccacucuucccacuugccuccucacguuuccuccuugcaggucccuguccgcacccucccagacccaagccugagcuugcagugagagcuccucggccccgcgcccgcccccagagcugccgccccugguuuguagccuggcagagcuggagggaggggcggaagcaaggagggugcucgucuuuugucuuuggacucgagccgacuuuuuuuuuggcugauucucuccaaagucucucaacuuaucugguccuuggggugaggcccugagagcugacaugaguccagagguggagacucucacacuccagcacugaggccaggcuggggaggggaggaccagcccugugccucugccccaccccgcaugccuagaagaucgugcagcacugcauguggguucugugucccccuaguucugcggaguggguggacaggccauauguggugucccuuggcugaggaguuggcaagagccuaccaaggauuguaguguggcagaaaaaaacaaagccugcucucugacuggcugacuauagccuucagucagccuuagcucccugugugaccuugggcaagucaccgccucucucugggccacgguuggauucuaagaugggggcggacagcuguuuccagugaccccuuuuugccugggacagcagagaucugccucucccauuccugcccugccaccaggcugccaccaccagcccaagaccucagcuucucccccccucgguucugacuccaccuucuuugggccucagccccaccccuccuccagagccagccugggacucacuugccuuucucucucccucccucccccacucuccccaacuuuccugucccggcauuacccuguccucaccacccccccaacccuggaucucugacccccuuuccucuuccucuguccccccccccucuuauuuucuagcuauuacaagccagaggcacccggaugugagcccccagaucaccuccagggacuugggguuccgaucugaaauccuuuauuuuuguaccacggggugggccccuggcccgaggaggaagacaagcccucuaccuugucagugcugccugcaucugccgggcugagacucacuccugccuuggggcccaggccuggggcccucugggaccuuggaaggccugacauggguccuggggucuccaggcagagacgccaaggccaaacuguggcacuaccuacccauaucuuccaggcccuuuuguccccucaccugggcgcccuugcugcauggcggauacacucccucccagucccaucauagcaccucuuagagccucagucucuauggcaccauagggucauccucuccucccaccuaccucacaggguuguugugagaaucagggaggaucaugggguuccugggagcccugaguguguuggggcuacaaucauuaccuucuuaggggaagggcucuagccccgccccuguaugggacacuauggccucagauacuggugggggacaaugugaggacuuugccaggcaggaaggaaguuacaggcuuaacagcaccuuggccaccacuucucugugccaccguguguuuggcagcagaguacaguguccagggacuugggauggggaaggggacagguguaacggguugagcugucccgcccgugucuugaccaccccgggaugggcacaugucugucaguugugucccacccgccaugaaauaaagcugaacaaacaggcuuggccuggcugccac

SEQ ID NO: 7857 - RNA, 15076 nt, Mus musculus
ugugcauagcuaggucccuguaccacaguaacugugugagcgugugugccaccacauucaguggcugccccugggcguaggaggagaucuuaucagugcuagguguguguggaguuucaggcuaccucaucaccccccaucucuccaccucccauugggccuugccccucauccucuauacaggaagugggcucgccuuggguuucagucuguugcuggccuagcuguugucugcuaccuaagcugcggagcaggagauggccguggacccaaccuccagcaggacugcagggaacaucucgacacaacuccauguugcagccaggugaugccccugugugguccccugggagcccugggcaccccacuaccucuugcugguccucccaagggacagggagcugggagggggcgcucaucucuaacuugguucccuuuguaguuuguaucugggcuuugaugauuaaccuugucuuaggauucccuggggaaggggguagccuggcugucaugguuucuccuuuaagaauaaaccccuuccaaugucagggcacaguggcuucuucccagucuacucugugggaagcugugugccauuuucgcuaggagggacuucccuggauccuguguggggaugucuuagcccagaaggguggaggaaaagauuuguagcucgucaguauugggagguggcauggcguguaugggacaggugggauucaacgcugacgccuguggaguucaucucagccuggagaauucuccuuagugagaaagagagaaggaaucucccccugggaccuggcuguccagucagcuauguugauugacagguuucugagggcccuaggcuggaggucagagguagaguucuagcuuagauuugucucugacauuaccgaguggcuagagagguuaaggacaucgccaggcauggggcuccgucuccgaggcugccugagguaggagcuucccaccguuagcuguguuuacaguacuucagggccaagguggguggcugaggaaggcagaacuaccuuugaagguccccuuucuuucacacacuccucagcugaacugaacagcaagaggugaacaguggugugugugugugugugugugugugugugugugucuuugugaaugugugugucucuggagagguggccagagaaaggaucucugaggucaaaggccaccagaucugacagacaagcucuugcuugccguccguccucccucagucgacccuguaccucacagaccugugaggccuuggacugccccagcacuggaaccuuuauccugggaaacaggcugcuuuaggcccugaucuucccauagggaaggagcagucagucacagaaccugcucuugugcugugagaccucucugugacaugugugggucagucugacgcagggagugugacacgacugucacucauggcugacccuccuccuccgucagcaucaccacuguacuggaaaucaggugacccaguuagagcagccugggucugugggaugacagaccuuuucagggccucagcggagacauauaugagucagggagaugaacgucuggugguugcgaagggcauacgugggugagccucagggggacagugccugggacucugagauucuugggcuguacucacucugcccgaggcuggccuugugcugugugguuuuggagugguuuucuuagucucccagagauucaguuucccucuugccgaaggaagcugcaaccaccaugacugcuugaagcuacccugccccccagccugacccuuccagaaccuuccauaugcucuuccgucuaacccuguccaugauggguggaugcuuuugugccucuucagccagggguggggagcagguuugagugccuuuucuuaggcauucucuguuuuuggcuguggcuuguggcccggcuauaaucuugccucuuucauuccucuuccucucccccaggguuaugcccucccucaccccaaccccacgccaucaugaggcugcucagaugucuggguccgaccuggcuugcugccuuauugaaugaacacguagagugcuucagauccuguugggcucacaaggggcuguggaaggccccuugcuugggcugaaccuguuagggcucccuuucuacccaagcaccugcggggaguugaucuuccagggaagggaggucugggguggaaccccaguuccguagacuugguccugggauccuuggucuccuugucugccuagcaaagacaccaaauagcugcugagcugccaggcagcauagaguagcuggaaguaugagggccugggcacaaggccugggcaguguuugaugaacauacccggcaaacacugucaccgggccgccacccaucacuugcugucccacaaacccuucagugcaugacauuuauugagggccuccuguguuccgaggucagugguuuggagugggcacacugccuuggcagugugguaggugacaagccagagggauggaaggcaacccaagguagauuguccuuccuucaugggggagaccagggcgagugccacagaaccagcagaaaagagaaugagaaaugggauaccaggagccuugggugcaaugugggaaggacaaguccagggaggcuuuuagagguccagaccaaagccaccagcuuauguggacugcaagaaccaccuaaggcaggccacggucuugccuuccaugcuccucagggcugaagugggugcucuugguagcccugugauagguauucauuuggagaucagagacccaggaaugaauggaauccaaauguccuuguccugauagacugucuaugacucauauacauagguacgugaaugcaugcguguauguguguuuucaaacugaacacuguuuuaagucaugugcaaaagucuugagcuggucucuauccugcuuggggccugagcgauuccuuuucccagaacagcuaugauguggaugcuucucgccuauuagucacccagggacuuggcuguccaaucacagagcugagucccugucaccucaccucaccuggguacauggggugggcaucugccaaagaugcuuugggugggagacaccucauucacaccgugcuccggagagccgguggcugccccuaggaacuccuugcaugaccaccuacugccaccaguuucuugugauggguuggucauuuauagugaaaacagaguccguguaaggacugguuuggucugacauuuuaggcaccucuggaggaaggaagggagcucagagggagagagagccugggccugcuuugcucuggcugggcggagagaggguagaguggggugggguuucugacuuguucuuuccuucuccacuuaggguuugcauccucagcuccucucagcugugauggcuaccauagcucuucccuggagccugucccucuacgucuuccuccugcuccuggcuacaccuugggcaucugcagcagugaaaagugagcaucuggcauuuugauguccauacuuuccccagugggaggucacaucccagauuccugcuucagggaggagauccaucuagccugggaggcaaggugaagagggacaaggcagugggacccaagggcagguauccaucuuccugagcuugcacaggcuucucccagacacaugcagaggcugcugauggggccugcuuggccauggauaggcgcucugugucuucccuuugaaaugggucuggauugggguugugacagguggcucagugggcagagugccuggcacaggcguacaagcaugagaacuggcguccagaauuccaacacucacauaaaaacaagucaggaaugggcuggcaaaguggcucacugggcaaaguguuugccccacagacuugacaaccugaguucaauuucccagaugcugugguggaaggagagaguugaucucuaaaaguuguccucuggccucuauacacauaccaugaccaccuacugccaccaguuucuugugauggguuggucauuuauagugaaaacagagucuguggcguguguaucuacauacaugcacaugaacacaaacacacacacacacacacacacacacacacacacacacauggcaaugaaaugaacucgaauuccuuuucuucccagcugaguccccuaccucuuccuggggcaggcacagggugccaagcgcaggguaguggacauauccagaggccauguaugucucguagccagccacucacaccccacucugcccacagacuguucccaucuugaaugcuucuacaacucaagagccaaugucucuugcauguggagccaugaagaggcucugaaugucacaaccugccacguccaugccaagucgaaccugcggugaguguagccuggucucgccaggaccucagggcugugggaccuccaagcuguggaauccugccugggcuugagauccacagugguuagcaccaggcucagacacucagucaugugggcccccaaaaguggcugugauccaggcuuuaguugagagcuagcaagguccuggaccagguaguuuggggacagugacugugagccuuucaugcaagguuagacuucauaaaaagguaaucaggguacuuagugccugauauauuauauauauuauacauauauaauauauauaauuaauauauauauuaaucugguauuugggagaccccacaggcagcugugggguuacauugccuggggaaguaucuggggagccauaggcuuugucaggcugacuuuagcugccuggagguaagggcucucgggcaggaguggggcugaauuucuuggucacucuggcugcugggaggccaggcugggguggggagcuggcugcuugccuacugugcugcugucucuggcacaauggagccugagaaggguccuuggauggcucugugguccugacuugguuucugaugugacuuuucuguucugcaagacacuggaacaaaaccugugagcuaacucuugugaggcaggcauccugggccugcaaccugauccucgggucguucccagagguaaguagccugaguagcagugugugugcaugugugugugugugugcgugugcgugugcgugugcguguguguguguggucaaguccuuccagcugugggcugaggccucgaggugggcuuggaccucugcaagcaucaaccugguaaugcagaccaggccaucugggcugagagggaggaacaggaaguuggauuuugagguguagggucuguauccgugcugccccuucaugagcugucauccccacucuccuugugagucuugccacccuuuugcaucccagacaacggcaaucacgccagacuccggcugaggucucagcaucuaggggguaguggcaugcuaucgcugagugucccggcccuggugcuaccucacaacagcucagugccucugggcagcuucagggccuccguuuccccucccauaaaauaggaaagaaaauggaagcucccucaaaggguuguucuuggacagaggagaugcugagaguccuacguagacccugaugauuuugucuccuugccaaggaaacaucuaagucucagagagaugugguaacugccaaggucacccagccaucaacggcugagcugggguugaccccagaccuaugggcuucugguggcuuuuccauauuguucagcugccgcuugcauauucucagguucagaccauguggauguaacuucauuuuuuuccucaaacccucugggcagggcaagggcagggcagugccaggguuugccuggggaguccaggcuguguuggcagguucacauuuuuucucagagaaagagaaugggagauacacaacacagccgguaagucuccagcuauaccaaucugggagcuuugcaggaaacuggccuccauccuggucugauuaguucuuagcuguguggccuuaggcaugccccuaacccucucuguguuucaguccccugggauaacugaugggaauggcaauaguauaugucugucucaggggguggugagagcucagugagguaauuuauacagagaagaggggacagaaguucccagcagccucauacuggcgauaccuucagaccaaccauaacaauaauaaucaaguugugcuacgauuaagugggugaaccugagcugguagcagcugugagagaugaaggccgugcccuccaugaagugagaggaugcaguacccagcugauugguuggucagggaacucuaauggucaggcucaaggcuggugcagguaggaagggccaggccucaaggcuccgacugcaaaccaccaccuagucccagagcauagguccuaccauggccugccacugauucuccuccugccgccuacuuggagguagggcgggaggggggacagccauucaucucuaagcuuuggucauucugaggagccauggcugcaauggccuugugugucaugggucucagaggggaggaacuacugcgcucaucagcaagcugugagcagcggcugccuggggcacacucagcagcuagccaucaccuuccagaagagucaggguuauugaacaggucuaacacugccuucacuauggcuguccuucuugggggcuuggcuacuuguauuuuucuuguaauggggagcuuccuucuaauccuggugaccuacuucaguuuauaucagggauuauugaaugacugcucucugugccaaacuuagcugcugccuguguuuguaaauaaaguuuuauuggaacauggcccuugaguugugacagagaccguguguguguguguuuguguguguguguguguguguguguguguguagcuguggagcuaaaaacacaaccuggcugguuagagacauuggcuaccccuugccuuagauagcuugguagaggcagaacauguccuuaccuugacauuuuaacgguuccccuuucucaaugaccucugcucuccucccuugcagucccagucacugaccuccguggaccuccuugacauaaauguggugugcugggaagagaaggguuggcguaggguaaagaccugcgacuuccaucccuuugacaaccgugaguauggaaccuggugugugggucugaaucucugagucugucccugcgccuaccugaaaagcuccccccagcucugaccuucccacccaaccccaccccugccuggaagauucuuacuucagcucucgccuauuugugggucugucucucugcugggcugagagcuuccugagggucucugcuggcccugaggcuccucucaggaacacucaacucuaggucugaacaggcaggaagcucuuguugaauugcggaguguuuuucaaccucuagagaagagaaggugcagaggggagauccaggcaaaauucaaauugcagcccugccuugaugcaucaggcuggcagaucacaucugggaccuuaguguuuucuuuguagaauggggauaauugagguccuugugacaggaaggaauguugaggugcauaaacugcucagcauucaagacauagggaaaaaaaaacuagugcucugugggcacacagaaucucaagguuacauguagagcacuugccaagcugugccaacucacucucacaaauauuaauaaacaaguauauugaaugaguguguaaauaguauaauugagaaaugaaucauagcucuuuauaauuuauauuuacauuuaauauguauacugaugggauacacggauauaaauuuauaugagaggcuauguaauuauagcuacauguucuaauuauuuaaauuuaugucuuauuuaaauguauucauauaaauacaaauacaucaauaauacagauacauggauaaaauaagguacaugagcuggugccugcacaacucucagaucaguuuucgagcagaacaaggcugccugccaaucacucagcaguugauuagucauuccugaagagugccuuggguaccaaaagcucuauuggcacggcacagcccauacucaggcauccugggaggagcaugggcacagaaggauccccuauagauuuacuuuuucggguguaggcagagcaacaagggcaagggguguaaggggugacacauggccggggaaggcugggccauuugagcacaggaaugaggaggagugggugccgaggaggaggaacaggggccaggauggagagaagaagguucaaacugugguagagugggcucagaggaaggggaaguagguagguauagaggaggaaauagaacagguucacagugggaugugaggaagggaagaaagggggcacauguggaagagggggacagcuguugcagaggagggggaagagcaggugcauaggagaaggggcagcaggugcagaggaggagggacagcaggugcagaggaggagggucagcaggugcagagaaggagggacagcaggugcagagaaggagggacagcaggugcagaagaaugauagcaggugcagaggaaugauagcagguguagaggaggaacaggugcagaaaaggaggaacagcaggugcagaggagaagaagcaggugcaaagaaggaguuggugcuggggguguugugugguggaaacugguuugcaaguucuugguaucauaccgauugguccaugauaucugcucccuccugucuucugucugcaguucgccugguggccccucauucccuccaaguucugcacauugauacccagagauguaacauaagcuggaaggucucccaggucucucacuacauugaaccauacuuggaauuugaggcccguagacgucuucugggccacagcugggaggugaggaauggccaagccucugccucuacaccuuccuguucuggugucuacccuuuucuguuucuacaugcuggugugacacugauucagccugguccuccgacauggcuucucagugccugcuuggcucaugcuuuuacugcuuggggucacaucuggcuccauaucuauguagucccucgaguuaaggcggccucugagacuuggcagccacuuuuccacauucuaauugcagcguguucccuggcugcaagggauggggugguggugguggugaggaaugacggggacugaggcuugccaucuacacacuugucccuuacuugccuggugacccugggacucagggccccagcagccagugagucagggagccuuugggaaagcuggggaagaggcuguuugcuuagccucuugaccucguugcgggaggcgagguggaaaguggagcugagcugguacccaucucugcccaggaugcauccguauuaagccucaagcagagacagcaguggcucuucuuggagaugcugaucccuaguaccucauaugagguccaggugagggucaaagcucaacgaaacaauaccgggaccuggagucccuggagccagccccugaccuuucggacaaggccagcagguacaguggguggcacagguugggggugggagugggagaagcuggguaaggggaaggugcucugggagcugcaaaugugggucagccugcuucccccucaucugccagcaccucccgugggcucacuuaccagagacagggaugcucaagacaucagucacggccauagaugguaggaagauucuccuuguauuagcucuaaauucuuagaauucagggucgggggcuccuuuuucccagccuucccugcaggacaggugcuguccuaggcaagguagcucuaccagaaacaagguaggcauagccucucaguguggauacuguggagcugucaugguggggacucuugaggcuccaucccucaucaugucacuugccaaguucaagggacauggacgcucuagguguggugugaugcucaaaggcugcagauggagaaaaggucucagugagugagguagggagucagaucagccaugggcucugcugggagugccacagggacauagccuuuaagaacagccuugccuuucuggaaagcugggcuggagcaggacugaggauggagcccccagcaaaagcaagccuggcuagacacugguaccuggcagagugcgauuguuguccaagauguguguggccuucugaggggccaugccucaacuuccacuucucauaccccggacagaucccaugaaggagauccuccccaugucauggcucagauaccuucugcugguccuugguuguuuuucuggcuucuucuccugcgucuacauuuuggucaagugccgguaccuugggccaugguaaggagacgccuacccagucuuccuuucccacccagucugucuucagcaugcacauguuuccagguuggccugggcugcauccuguucccucguaucugcccucucucugucucccuucucagcagcuuccuugucccugugccucaucccacagguagaagcuggugugggaaagggaggcaaagcucaccuggaagagucccccgggcaccccugaagcccacuggagucccugucuuuccuguugcucuugguccccuccuguccauucugacugugucacacucuugucuaacccuccuuagagauuccccaccacaccagucauacauccugacccuugagggcuuccacuggaaacugugugccaaucagaaagugccuccccuuucuccgguuagauauguccacguucuggguagcuuagugguagaccaaguagaucaguagaucgaguagauugugauguagggauucaacuucaaacugccauugugaaaugcacagcgucgccauuccccaggggaguguucaccaggaggucucucuccugccucccucucuagccuguguagucccucccacucuacagccaucuuuugacuagcacacaggucuguguccacagacugggcaauccuauuacauguuugguucaggucugucuucaugucagcaugucagcuccgggggagcagaggccuucuuugcuguccacucauguguccccagcacccugugcaguguucucuguuggugacugcucagucaacaucauugaaggagcgaaugcaggaugggcccauccccuacucuaggggcuguggggcugcuggugggaccucaugacacccacuaccuggucucacucuucaccccucccccucuuccuuggccaggcugaagacaguucucaagugccacaucccagauccuucugaguucuucucccagcugagcucccagcaugggggagaccuucagguaggaaccagggguagaaaacagagggaugguugauggacagcccaagagcaggcugcaggggagagaugugauagggugacaauggcuuugccuucugugaggaggcuacaggaugugaggcaagcaguuuccccauggacaacagcucugucuccgaacugccugggagccuucugucuaaggcguguggccuuggcucuaauccuggcucugccacugccugccucuguaaacuuggaggaguuacagaucuucccagugccucaguuuccacccuuauacggcccugggaguguugcugggugcaguacgggauucagggagcugcagagaucccugccucugugaacagagcaauuccaggcagauccagugagcagagugauuccuggcaggccuagugauucaucacaggaaugcaagaccucaggccaucuggacucacaaaaccugggcuuguuuucaaacuguggcccacacaguccuaucuucugucccccuagucuaccugccucaggcuagaugcuucuugaggcaagaaguggauagaggguagaggaaaucuacuguuucuacccccgaccccacuggguuuccaugaugggaagcguguggggggcagagugaccuguggcacuaugcugagaaugggaggcccacaggccugcuggacuggccugugaccauuagggcugagcagggcccuucuagaauaucugagaggcucccagaauugaggaugucuuauuaugauacuugauguguguguguguguguguguguguguguugugugcacacauuccugcaugcuugagugugugcauguaauggggugagcagcuccauaaaaaguuuguccagacuguguuaugggggugcacaccuuugaucccagcacucgggaggcagaggcaaguggaucucugugaguucgaggacagccuggucuacagaacuaguucuaggauagucaaggcuauacagagaaacccugucgcagaaaaccaaaccaaaccaaacaaaaaagcucaaaccaaaucaaaagaaacaaacaaucaaaagaccaaaauaacucuguuuuuccugaaaucccuuaugccuuugaucgugguaagauccugaccaacagacaaaugcaaacaaaccuugaccuugacuggcuaugggucagcaaggauucaugucuuagccucuuuggguuguggccagggcucugggucaugaaucucacucacacacacgaagguuagccugagggguauaugcaggccaugacagggaggggcgagcuggggauccaccaguucuugaccacugugucccuuguccuugcuacaccagcugccugugacuugagcaggcuagaccaucaaggacauuggucagcucauugacucuggucaagacaguugcgauuguccuucuguguucgcacaccuaguucaguccagguacacagcagguacucaguagccagccacauucaccccuagccaacaucccccagacacaggugagccagcacugagccuguguucaucuaggaucugaccuagggugacaaguugagagaguccaccaagacagcaaggcuacaagaugauaucagguugggggcagggaggaggcggucccgggugguccugaaggauggagaacaggugggagggaagggagaggaggaguugaguucagugguggggaggacguugaacgacccacuuacucuccucacuuucucuggcagaaauggcucuccucgccuguccccuuguccuucuucagccccaguggcccugccccugagaucucuccgcuggaagugcucgacggagauuccaaggccgugcagcugcuccuguuacagaaggacucugccccuuuacccucgcccagcggccacucacaggccagcugcuucaccaaccagggcuacuucuucuuccaucugcccaaugccuuggagaucgaauccugccagguguacuucaccuaugaccccuguguggaagaggagguggaggaggaugggucaaggcugcccgagggaucuccccacccaccucugcugccucuggcuggagaacaggaugacuacugugccuucccgcccagggaugaccugcugcucuucuccccgagccucagcacccccaacacugccuaugggggcagcagagccccugaagaaagaucuccacucucccugcaugagggacuucccucccuagcaucccgugaccugaugggcuuacagcgcccucuggagcggaugccggaaggugauggagaggggcugucugccaauagcucuggggagcaggccagugucccagaaggcaaccuucaugggcaagaucaggacagaggccagggccccauccugacccugaacaccgaugccuaucugucucuucaagaacuacaggcccaagauucaguccaccuaauauagcagguggccaggacugggauccagcugccuggaucaggucaggcuugaggaagacugcuuaagaggucucuugaggacaguccacugcugaggacuguccuggcuaucccugcccccccccuccaaacuuaaucauccacuucugaacuccauuugcuacuuccuggucuaaccaggguuugguggaggguggggagugggggagcgguggucagcuccacugcccuauuuagucaugaggucacuagcuuccuguaccugccuccuucccuccugcuugccuucacagggcagcuagaacuugcuucccccaauacaaacauaaccuugcuccucauuuaucccugagcuugcuggggcuccuuacuucccucugccccauuuccugucucaacucuugcccugccagcacggcuguggaacagcuguccucagguugugauguggcuguacacugucuuaaaaucagagcagcuuugacaacccaaacgaagagguccugauaagacugaaugcagccuguugacuauggagggucccucguagaaggagggguugggaagggucaucagucaucaccugagaucguagccacucuccugcaccccauccucagcuauucugcuccuggagcaugaguuauuuuauguguucuugggcgaugcuggucuauguaaggggugggggcgcgggguugauugaagugagggcuccuucuauguugcuuuggggaccuugucuauucugggguggguuuuucugugaagcagcuucuuugggguaaccuagcccccuugucaguaagccuaagagagucaaaggaccaccgagcuggacuugaguguacgccuacuuuugaugcaacaucugggaaaaguacuuuuuuuguuaauguauccuugaagcuaagaaaagcuuacaccacaaacauugugucagcacuguccuuuguggagaucucacgaggauccucuggggucuccuggagucaugaugugucauucccuauccccuaccccaccccaccccacucccaacccccuccuuugcaggcacuguucauugugcuccgccuagguaucaagcuucuccaucaucuguaagucccgccuaccuagagggaggggcuucuguaaaucccgccuaccuagagggaggggcuuauccuauaaaucccgccuaccuagagggaggggcuucuccuguaagucccgccuaccuagagggagggacuucuauaagucccgccuaccuagagggaagggcuuuuuuucuuaag

SEQ ID NO: 7858 - RNA, 8070 nt, Mus musculus
auugccaagagaauccaauaucuuuauucacacuggccaagcaggcaaggacagucgggcugagggugguuucguagagccagcccucacagcacauggcgggccuugccucuguuacccugccauggcucgcuugguuguaagcaccagagaugcccucucagggccagcccugccuuggaucugcagaagcaccaauggacggaggccaccuuccccugagaagcuugggcaggcuacagugggagaggggaagguuggagggccaccaggcuacacacccugggaaagacguggaggucuugcuuuuuucacaaccucccccagggccugucuuggcagcauggcucagagaaggcccccagguaaccugaaugucacuggcuucagucccuagaccugcuuugggcugaaaccugccaccucuguccugccugacuugcccacgaugucugcaagggcaauacaggcaggagaagcucugaaaugggagccaccuccagggggacaggggcuuaagcaccuucauaaacccagggugagccugggccuuggaggagccaggagggccagagagcacuagugcauggucugaccauggcuaaugucugggggaaagaagggggcaggaggagucuucuaacaucagggaagagaacaggcuccaguucccagaugccccuucaucccagauacaucuaaacuccugggucuccucccagcuaagauuauaccuauauuugcuuuauugcugggcacagggcaagaacguggagcaugggaaagguuaucaucccaucuccgggaccugucagaccauggaagcaguggagaaggaaccacggugcccgcggacccagucuagaggagcacccaguaugugcucaagucuuaguacccacuucugggcuuuccuaaggccugagaccaugugagcgcucagcauuagacaagugcacaaaugaacaauggcuggaaaaggggaggaggggaaaggucaggcaugagggagggccaggaggaggaggaggaagcuagaggauguggaaagaaugcuagaguuuggggguaggggagcaauuccagaguguuccugaagucccuagaaugcugggaacacuuuagagagagcacaacuccucaagugugauccacagaccuguagcgucaaugucauggaggaaaucacuagaaaugaagaauccugggucuaccccaaaugcaaagccagcaucuaccagauaauaaagaccccagggaugaauagagugguggagugucaggauagccacucuagaggcuggcaaagucugaaauauguaagccccaaaguaucagaaaaacgaagcuaagaggagagggauggagacagacugcaguaacuguggagacaaggaauggagagcagcagacccagcccuaggaccugcccuagccaccagcugcccagcugugaaaguggcggggagggaggggagaaggggggaggggggagaggggcggagcucaguuguccucugccuugaucagguggccacugaaggugauguacguguccacgucaucacuguagaugccguuuucccgcucccgcuugaagagccgcacccacacacggucacccggcaccaguggcagcaucacacucuggcucugcaugaugcugcguucgcugggcugcgcguacaggaucaccacugccugcucauugugcacgaugugcacguaggucuccuuguaguuccagcuguguacguugaggcugaagaaguagaggccgcgcaggggagccacaaagcugccaguggccaugucaaaguggccauccguguucacaaagacccugucgaacagcagugagaggaaguucucgcugcugugcaagccagucuugcggcccacagagaaggcugaguaaugugucuggcacgagcugccagggcuaccugccugccccuugucaccuuugacacccugagagccacgguccccucggguaccauucuugccuggcuucccugguguuccuguaggaccucuguccccuuugucaccugugaggacaugaaggggaagaaaucaggacagggacccacccgugugcuaagcacucaauuuuggaagugucugcccuuaccuggguccagacaaaggaguugguguuuauugagcaccuaacugcaugcugggcaucaccaccccaaacaucccauucugcagaagugaaacugaggccauuuccaagaccuaaaguguguccuauccagcucagccugggaccccuuccuagcaagaaaaggguggcaagcuuccgggagguugacccgccuaggccagccagggggugggguaagguaagacauacuuuguacuuuugguuagagaagaaaauugccuuugggucuuggguguuuaggguguaccuaaaagggcaaugccuacuucaagguuacacgugaguccuuccuuggcaaggagaggacaagauauccacucagcauggcccagcccaucucuacccucccuggaacuggugaucuccuagucacuuucccagcccuggcugcaggccagaugugagcauagauaugacaccgacgacgccccccaccaccccaacccccaacaaacacaccuaguguguacuaaagagaccugacugcacguauuucccugaugagguacaccuccucaggucuccuugaccauaauggugaggucagcggaugguagagagaaaauggggggcccaggucuuugaagacaggccaaacgaaagugggguggggugccauguccugggagagguaccucacuggguacagagcacuugagcacccucucugcccagccuccggccaccguggcaguggggaggagagugcuuuccuucuacauucaagcuagcaggagguuuagaaagaggccaucuugaccugcaagguauggccuugugcuacagggaaccauccacuuuugacagccugauccaaggcaacacagagcuugggauggacagucacaggaaggacauccaggcccaggcccucccaccuccagaagcuaagcugccugaaguugcauggagugaagccaugaaguauccucacccaggcaaguagagugugcaggagucucaggggccagcuggcuaucagaggggaaugcccugcucugucucugacaucgaagugacuccaggaaagucccucucuucuauuggacacuaacucguguccucacauuggguggggacacagugagcaaagauggagccaggaugucagugguguggcccuggcauuuauggguccccucgcagagguggcacuaauucugucacauccgaugcuauauaucaaggaaccaccggucauugagcucucccaggagcuggggccagguccucucucugaugccgcugagagaaaccucuauccuggugguggcuggugacccugugagcccacgucuuucucccaugacaucucucuucacacuccugcuggggagccccuuacgcugugaacauaaguuugcacuucaccuuccaggagcccuguguaccugccaugcucagucugucgacugugccccacacuucaccccaauacccucugcccacauuuuggauuccagggccuuucccacuacccaccccauuaaccuggggaaucgguuggcugcacaucaucuauuccuuagcuccuuauacacccuagguccuguguacaugcagauggaaggcagacagggccuaggcaagaccugcccuguuuucuucugucccucccuccccccucucccucccuugcucccucccucccuucguccuuucuucccucccaauuuggcccacacccugcccagugugguaacucacccuuuaggauaguaauguugauguacggccugacuucaggcaggacauaaggggaaacaggggccuggaccguaucaucagaggacaucagguccucggggucacagcaucgucgacagccuuuggggagaugggaggccacagauucuccaaagguagucuccucuguggggaccccaaacacaagaggaagcaggaauacugcccagaggaaccccaggcuggcuauccccaugaugaccuggaaggagagacagauagauacauuugucucagcacccccagauaacacugccauggcagacccaguguuucuaggggaguagggaaggaccucugguaacagagucuggggccaucugggaagcaagccugggggagggcauuagacuggccaucgagccuccugguaucugucuacuguggccacugccacauggccugggaaggaugaaggccccguggagacccucagauggcacaaaccagguucccaggccuucauuggggcaccaaggaagaugucagauauccacauggcuagccagggaaauggagaaugacucuuugacccucucaucucuaaaggcuguuugcugaccucggcucccaccaccucuggcaagcaccauaggagaugucaggagcuagggucccugagagcauuguagauccugcaggccacuucugcacagaagcaagaggucucccucuugaagaacaagguguccccuuuaguacagcauaaggcuuauuagcagggcucauccuucuggcaucucuguguuguuaacaacccacucuugcccaggggccaagugauucgaaggugguugugucaaucaugacaggccuaccaaucagccacugaggugguaaauugaaauuaaggggggugaacagaaagcaccuggacauugaaaggaaucagaaaugggaauguuccaucucgggccuugaauaugaugaggucuccaguuuccagacuagggcaggaaguaggccggacaccagaggagcuggcucggugggccggaagccugcagugggcccuuugagguggugacaggcucgggggcuggcacuacccgaugaucacagaucagaaacugcuauugaaaccagacugguuuuuacaccucuuggcgucucuuuguuuauuuccuuuuuguuccucuuaacauuuaguacaaauucaaaaauauuuuucugugguuaauacaggcugagaagguaaaaugauuacuucuugaaaggcuaugaagagggacuauguuuuaaagggacagaagcucagagccuucucucuagggauuggggugacaacaggaggugucuucauagacacccccuuucuggaaugaucauacugcuggggccugcuaguucugcuccacaggcagggaauucccucagagaccaacuccacgccuauucucaacuacaggucgcagcaacaccccccccccacacacacacacacauacuuuauucugaccauagaugugcccacccugugaaggaaauccgaauaacucacaaacacgugaccugguggucaugugaccuagugauugcagcuuagccccucuuucauucacacaagccgccaacaugucuuccuugccaggcaauaugggcgacuuacacucgggggaaacugcccaguuugucaaagacuucaaagugcccauuccuuccucuuccuguauagaccucacucuagagucuauggcuugaaaggcaaagaacuuccggagagucagcaugguuuggagacauuuuuguuuccuaccggucuggucccuugggagucagaugcucagagacacagaacuggagcuuuggggcaggaagcaggaagcagggcccucucccuagaaacaggacuaacugcagcugggaucccuggcugggugcuaggagaggggccaggcaguaccaagugugggggucacaccaaccauagaggggucuugccgguccccaccaccucaccuaaaaugccagagccucuuggugggaggcugggcuaccgaccuuaucauccagaugggcggggcuuaguggcuggggguggguggguggugaggaagucccugcaggggcagguaaacaccagaagcagugcaggguggccagcagugcaggguggcagaucuuccaaaugagcuggcuaggcgagagggaaagagcuaugugcuugccagaaagaggggaacagaggaaucucagacugugaccccaacccccaucccagucagaagaagagaggccaccagccacucacccucauccugcggccucaagcucaacucacagaccccggacggccucuggcuccuuggcccaugucugugaugauaacuuguugcaggcccgaccccuaggccuacgacugagcuaggagggcggagggauggagggagggagggagggaggagggagcacgcugagcuggcuucccaguccccuccuccugcucccgccccuccagccuggggcucugccucggagguacugggagacuuggaucuuuaacauccuugggcaucuguggcccuggcccagcgcuggggaccuguuugagucaaaugcccugggaguuagacaggacgagcaucaagagccuagaaagacuccgccuggaaauuggaggcugcacgagagggggcggggcucugcauuacucaggaaaagggaggcagcccggaucuagucugagcccaagagccaucugccaagagcuacagagacugaguggcaugagccacugguacccauccuccauagguauaaauccugguccuaacacccagcaacauggucgagcauugccucuccugccggagguguucagggauucugccccuaccauucaugcuggaccaaagauggcuuauuccuucuuccccaccuggaauccugccuucacugacucuccuaaagccagcucccuuacagaaguauaacccccaacauguucaagguggagcugggggaggcagccugugugcccugggacuaggcaaaacccugccucaguuuccuccugggcaaacuggggaauguuuagcaaagaccaccgcccuggcuccuagcccugguuuccuggaggucggaaacccugugcaauuccuguaaaaugucccucacccuuggcgaccuguuauuucaguuuugcuggauaccuccuugccugagcuagguuucaccucucuggggaaccuugguccucaaaaguauuuagauuuauuauuccuagccccaccuccagccucucuccagguuagcagcuagagggucuuggcagugguauuacucucuagcccacugcuuaggggauagauuuaggucugggacuucaauaaaaaauaaaaaaguauaccagcccuauuucuuaggguccuugacagggcugucucuggguucaggcuuccugggcauuuaggcagacaauccaacagcaagacuaggccuggaacgagccucagagaugaucuaaucccaucccuuaaucagggacauuguggcccagggagaucaagccuuugguacaaggucacauagcagagcgaaauccaaguugagaggacgccagauucuucuagucuggugcugccucccaaaaugacuuggaguucucagguccagucaggaauacauuggcagaagaaagcagagagggggaugauagcccuauaagggccaccacaaagcucacacuggcauggcucuguguggcccugccggagcagcauucuugaggcacagagccagaccugcagagaggcuacccgcuucaagcugcagccaccagagcaaagggcugagucagcggccccgggggugggaacagcaccaggcagucucagaucucugggaagaaggccgggaagauggaugaaagaaaagauggacggucagggagaagcaggcgaagggcacaguagugcagaaggcugugugccuagcacugugcaccccacuacacuccgcaccgaacuauacagggacaaggcugcucauccggcccuagcaaaccagaggcugccggcuacugaccucagacacgagggcguccaggcacaucagguagacuugagacaugaaguccagcucuggaguaacagacagacuauggcucugucccaugucuucuuucuaacuucaugacauuggguaag

SEQ ID NO: 7859 - RNA, 931 nt, Mus musculus
uagagucugcugugggaggauauuugccugaacucggaggagacagauuuaugaaacugagaagagguagccagccguguggcacucaugaaauagaauaaacaguuaauugaguuacgaguuagucggggaacaagcccaagcuuguggcuuagccauuuauuaauucaagaaguaauuccgaagguggguucugggccgcagcaauggcggaggcggcgggcugguaacgugaagguggguuggaaggaggaacagcagcagaaaugcagacagcacacacagguuuaagccacacugcagauggcgccuacgguccgacuagccgcugcuguccugguaaugcaggcacaaaggcaguuauucccaguggagcgcacccuguuggaagagcacuggaagccucccgaaaucccagcaaaagcaucgugccuuuaacccaaaggccuggaagccgauaucguagauuugcccucuucgugccuuucccgaccucuuuggaggcagaaaucgccugugggucccuaguuccagaugucgaaccacaccgaggacugguagggaaggagcuuaaagugagcggcugccugcuggagguacgcuggaucgcggaagauucucgacuccuccgaauuuccaucaucaacuuucuugaccagcuuucccuagugguaaacaccauacagcuuuuugggcccccgguuucccauuaagucuggcuggggacccaugucugaccuuauuuccaucuccuccuaagcaauauauuuuucccuagggaaaagauucuagaaauaguaacuacugcauaaaugugggggccuaauauuuuuuuccugacuugauccucaggcacuuaggggccauuuagucuggugcuucaauguuuguugcugaagaaaauaaagcuaugcugcuaaucugcauuugg

SEQ ID NO: 7860 - RNA, 27910 nt, Mus musculus
aggcgcggcuggcccgcagagcggccgggaggacgaccggagcgcagcgggucgcgggcaauguuggguggcccgggaggccgccgggcugggggcggagccaaugaccccgaaggcaccgccccgucgcgccuccggagccgucggccgagcacagagccgggagcucagggcagcugcagcgcccguggugagugcggggaggacacgggcgggacagcagcguggggacgugaaaggacgccgacgggacgcccgggaggacgcgggcgugaccucucggggacccgggagggugcaggcagagcagcuugggaucccgggaagacggagcccgacagcgccgggacccgcgggcgacgcccaggugcggugaccgcggcuccgugcccaccgugcuugucgcccgcaggcucggaggacgcggccaugcagggccgggcggacgcgggcgaggcugacgaggaggcuggggcggguucggggucggaggccgaagaggacgcgcugugggagcggaucgagggcguccggcaccgacugacgcgcgcccugaauccggccaagcucacgccguaucugcgccagugccgcguccuggacgaacaggacgaggaggaggugcucagcaccuaccguuucccgugccgcgcuaaccguaccggugagcccgccgccagggguuuccucucccuuccuaggcccgcuccagagcagacagcuggaugugguugccggugccgauggcgaccccugugggaucuuuacugugcucuuugaccucucugguucucucugucccauuuguguaucccuuaaagaaucaguuuuucucaagagcucaaauccgggcucaguucuccgaggcuccucucccacugggcgucuuuguaccaggacugucagagggacuaaaaguaucagggaacuuaagucaaugagagcauuuugccugggaaacgcaggcauccgaugcccccgggcaugcguaacguguguguguguguguguguguguguguguguguguguguguguguguguguguguguagggguugcuggggaccugcuccagugcaggugcucuggggagggucugguguuccuagccagggcagacugagcuuugcucccugauguguugggacaggccccggugugugucacagcccaaaaaucuggggaacguaggcccuggagcauugucgggguggagagcaggggcacugggggaagaccucauccugaccccugucacaaccuuuacccucagggcgccucauagacauuuuacgcugccggggcaagaggggcuucgaggccuuccuggaagcccuggaauucuacuacccagaacacuucacgcugcucacuggccaggaaccugcccaacgcugcuccaugauccuuggugagcaaucucagugggugccccauccuugccaccagagcagaauuuucuuaccccaacugcacugggggugguggugucuguuuucacuauacccauuggacagaugaagaaacugaggcaccaacugcagaaguuuacccagggccccagaguucagaguccaugugcuuaacaugacucucucucucuaaucaucuuuaugaaugguauggcuaguuucucauguaaacguucaagaauaaaugagauggcuuaguggauaaagaagcaagccuggccaccugaguucacuccccgggacccacacaguaggagagaaccaacuccugaaaguugugcauagaugcuuuccuucccccgaguaaauagauagauagauagauagauagauagauagauaaguaaaugaauaaauaaauagaaauguaaguucaggguggugguacucgccuguaauaccacucaggaggcagaggcaggaccagguuuaaggccagcccaggcuacauagagagugauaagcaagccaguuuugauacauaucuagaccuugugaguuuuguuuuuugcggucaguggacaaggcugcuugucccuagcaguuacucgggaucugauuccacuuguuugaagagacagcauagguaaugugucgcgaaccugucucauaacucauugguggagucccuugaggguggacaagcagauccuuucagguuuugugacauucucuccuccccgggggcagcucugcucuguucuccucugagcugggaguuucugaaguggagacucucaaggaauguauacacuguaagugucuuaugaccacagcuccccccagcagagccugugggucugcuuugcuuuaugaaucccuagccugaucuugaaacauuuuugccagguaguucuguaaaaaucagguuucaaguuugcaucuucuggguuuuuuuuuuuuugucuguuuuuuguuuuguuuuguuauuuuagaaacaagguuucucuguguagcccuggcuguccuagaacccccuccauagaccaggcuggccucaaacucagagaucugccucccaagugauggggugaaagguguuugucaccacagcccagccagcucuguaucuuccuaagugauguaguucauagcuuacuacuuagugaacaguagguaaacagauggguagaguguguuuacuauccagugucacgaaguuuaaauaaguugauacagugucuaguauaaagaaggaagcuaaggaacauuaguuacugguauuacuggcauugcuguucgaugaaacauuaguuugguuuucuuguuguuuuguaggaacucuuuauguauuacgguuuugagucccauuauaguuuuuuuuccuauaguuuuugauuguuugcuugucccuuaacauuguuaccucuuuuacuauaaaacuuuucaagaguuuuguuuugcuuuuggauuuugagacaggguuucucuguaaagcccuggcuacccaggaacuugcucuguagagcagguuggcuucaaauguaaaggucuaccugcuucugcuucagugcuggguuugagggcgugcgccacugcugccuggcugggucagcuuguuucucuuguuguuguuguuguuguuguuguuguugccuggcugggucagcuuguuucucuuguuguuguuguuguuguuguuguuguuguuguuguuguuguuguuguucuucuucuucuucuucuucuucuucuucuucuucuucuucuucuucuucuuuccuucuucuacuccuucuuuuuaaaaauuuuuuaaaagauuuauuuauuuauuuuauguauaugaacacauugucacugucuucagacauaccagaugugaacuaccaugugguugcugggauuugaacucaggaccucuggaagagcaguuggugcucuuaaccacugagccaucucuccaucucucucuccucucuuuuacuuuuuaaacuuuauuuuaauacagauguguccaccuuuuucucucauaacucccagauuuuaugucuugugugagaagacuuccccuguccaacaauggcaaaaauaccuuccagaauuuuccuccagugcuauuacuguuuuugaguuuuucuguguaguccagcggcucucuggauuuuauuugacccuucugaauauucuuuuuuccuccccugaccuggcagaugaggagggucccgagggccugacucaguucuugaugacugagguccggaggcuucgggaagcucggaagagccaauugcaccgagagcagcaacugcaggcccggggccgggcccuggaggaggagcgggcagggcuagagcagaggcuucgggagcagcagcaggcacaggagcgcugccagcgacugcgggaggacugggaggcuggcagccuggagcugcugcgccucaaggaugagaacuacaugaucgccaugcgccuggcucagcucagcgaggagaagaauucggcugugcugcgcagccgagaccugcagcuggcgguaggcccaggagagacggugggguggagaaguggggggggggggggggaggggauguuaacaugauuaucaauacaugugucagaauuaccauccacucgguugugacugcuaaucaaucccucuacucagggagacacccccacaaagcuccuggccguucugggaagaguuuuauuuuauugcuuuuuuuuuuuuuuuuuuuuuugagacagggucucagguaucccaaguuguccauaagcucgauauguagcugaggauagcccugaacuucugauccuccuguuucuaccuuacaaaugcugggcuuacagcugucuuguucugcuaggaaccccagagcuuugugccugcuacgcaagcacuguaaccgacugaggcauaccccuaagcucugggaacaguuuugguugucacaacuaggauggugacauuagcguucaguaaguagaggccaaggaugcuaccacgguuccucccgugcccaggauagccccuucaacagauuuaugaugcacugaaugucaguugucccaagaggaugaaacuuugggcucuagggauucagugagguccaggcugggaaugucagcggcagagcgcuuggcagaggcugugcuccacaucugcauucugucagccauuguaguucuccagcgcugguuccacaggcggccucgucucguccucaccagcgcacgcacgguacucagguuccauuccccaguacagaugcagggcuugaucaaggucucagagccuuggggugaauuacaccugccugguacccaaguaggccuccugagggauaccauucugccugucucuggccagugaagucccgcucguucuccagaggauccccagguugccuuuuaaggacggagggcccccucaaagaccgagggauagagucucucccucauccuccuccauucuucuugggacuccaaauagaguuucugccaugucuguugaccuccgugugcuguuccaagcucugagaagcugucuggcucagagguuuccugugccaaugguuucacaguggcuucugacguugguauuuagagcccuuccccgagaagguugguggucaugguguagguucugaggguccugagcagcucgugggacucuggguucauacaugcuggcuggcucuguguuugggugaggggagcccagauugccaaggcugcuggcccugcuugagguguagcugauguguuugcagccggaagcggauuggacagccaucgucugaacgucugcuucguauuuggugcuaaguggggacuccaauugcucucaguugcugaugagcagugucacauagggucaggcuucacucucugugccccaguuuccuuauccuuaaaguaacaacaggucacugugaggauggccuaacauugugaaguagcccccaugagcgcuggguguuuguucugcacguaccuuuuacuuccccgcugggguugggugcgguugugguucucaaugcuggagggggaacugaggcacaguaugguugucuagagcucuuuccuagcacccugagauugaaggggcuuugcugccugccuggcugaggggcggugggaucuuccuucuuucuucagcucauccacuuuucccagagacagacauggaguuuugucagucugaggaggccgcuacucagggagagcagugugacggucacgcugccccaguggagcugcuagaggcuguggcaggcuggguuggcauccucuuugugaguugggucugugcgugugugauugggagauguccugugugugcccagucguuggggcaggagcuacugcgggaaugguuggagaagaugcagaggaagggcccuuugucaccugaggugcucacaguugggaccggcuguuucggugguugcgcuugcgcuugcguuuggaggguggagggugagaucagaugaauaaagaacaccccccaacccaccugcacuucuuggagcuguuccugucuuaaaguuuaaagaggccuugcaggugggaguucucagcgcagcccucggggccuggcuccacagcucgguuuccucccacuguggacaggugucugugguggcugauuuaauacuguguuuuauagggugcaaaguuaaugagcuguuauuucugagcaacauaaauuuaaggagcgaacgguguaauuuggagcucaggaguuuggauaccgggauuaaaggcauccggguuuccuggcgacuugucuuccgagcucccuggggaagccggcuggccugagggucaggcaggauccugggugugcaguugugguuugcugcgaaggguguggccagccuggccuuugaaaccagcugucuuucucugcugggucacaaagcauguuuugugagggaaaaggaaugcgggggucaagccucucugagucuguggaggaguggacuguuaauuugaagagcugcugccccagcuucagacgaggguguggaugcgugcgcuguucugggcuccgggaccuggaggacuggccgucacucuccagaccaggacacuugugggacaccaggccuuguuucucuuguggauguucccagaggucauugugcuuuucccaccacagugaccucagugauggcuggcaccuguugcucuucuucccucaacccggccgccccagaucccacaugcguuuggcaaacaucccuggccaagaacgcuguccuccagcaaacugaucaugcgugucggucccugggccaagcugcuaucaucaacugcccacccccacccagcucccaagccaggcucuggcuucccgcacggaguuggugacaggccagggcccugggcuuucuuuaaagcccugcaauggcugugucucacugguugugccucauagccugcuucguccugucuucuucaguuguuaacaguucugagagagagagagagagagagagagagagagagagagcuugugcugauaaagcugaggcugugaagagaugagggacucguuuaaggugucagaauauaguggucaauaaccucuccauaaggauugucuucccuuuuuuccuuuguuuaaagacagaaucucccaguguaggccaggcugauuuggaguuuaauauuagcccaggcuaaccuugaaucuuuggcaagccuccugcuuaagccuccugaguguugagaugaugggcaugugccaacgcaccucguuccuuugugaggaauuuccugaagggguccccacuccccuguguggguugaggccugggugggugggggcugggcuggaggggcaagucuuggcuccugggcuggaugaggcccucaggccuauuacuucuuucuccuucuggucuagauaaggagacccagagaggcacagccaaggcuacccucaguccaggcagggcuggguucaggcccuguccccuuuucuauacucaaguagcuacucccugugucacauugacuuuggccaaacgguguguugcaugcagggcaucuuuucauggcgaucgcugggaggauagccuuggcucugccugcuucccuccuccuuauucuguauucgcucagccuggugaguugagcaaaccuuaggaaccuggggacaccuuggagugguuuccagugggucccauccaggcugacucacgucuugggccucagguggaccagcucaagcucaaggucagccggcuggaggaagagugugcgcugcugaggagggccaggggcccaccgccuggggcugaggagaaggagagggagccagauggcgcugaucuucucucugagcuucgugcagagaaccagcggcugacggcuucacugcaggagcuucaggaaggucuucagcagguaggacccugaugcuggaccucggcugcucacugacaccagagccugagaacaucagccccagaggcugagggcugaccuggcccacgcaggcgggggcucuugguggagauuccuuagcauacugcucugggggguggcgggggguucagucugggcuccguagccaacccccagaagucucugaacuccauaaaaucgcaccccugaguguaugugagcauuuucuuagaaagaagagucccacuuucucuuuuuaaauguggcgcuagagaucaagcccggggcccugacugcuacugcaacccuaguauuuuccuguugugugauuguuugcuuugaccugggcucacucuagucccgccugaucucgaacugguuauguagaccagacuggcuucagauuuguagcaguccuccugccuuugucuugugagucuugugagucuugugaguguugcaguuacaggugugagccaccaugcuugguaguuagggguuguuuuguuuguuugguuuuuuuuuuuuuuuuuuuugagacaagucuggccuugaacaccugaucuuccugucucagucuccugagugcuugccuuguagacccgugccacgcacaccuggcuuuucuggaaucugugauggagucucugacccugaagugguugagacagcgccuagguccggguggcucuaggacucggcuuggugaccucccucaggacuguggcaguguggacuugccauuguuccacacagaaaguggaaacaacaugguuuauuuugugguguuggaguggcuugauuagccgugggccuagggacagggucuuggauucaggaucagucucuuggaaacguggugucagaggguuagggauaggccuuggggauuagugcucuggugugggcccggagaaacgagagggggcuaggguuuguuugugacugggguccuggcugagcucagagcacaccuucauccacucucucugagcagcgcacgucuuccagaggacaguggggcuggaggggccacaccacucuucacacagggaaaacgagguccaagugccaagccuggcauaguagacgcuugccugauuuggagaguugagggauguguguuucucccuuccuccaugugccgaagguggggugggagggccaggaguugagguggccucccacuuuacccugcaggagaugagccggccaggagcugcaggcucugaacguauccuacuggacauacuggagcacgacuggagggaggcgcaggacagcaggcaggagcugugucagaagcuucaugcugugcagggcgagcuacagugggcagaggagcugcgggacaagguaggggccacugccugccuccccaccccccuguuccgauccaccaacaucuacugaauguccuggucuaggagggggauacugccaggcauggaggguauacccuggcagcagccggccacuggugccuucagcaggcacucagcuccuucauccccacugaugaauccuugugugucaguagggccuguuuagguuuugcagagucaauaguaaacacaucuaagauucccuaaaaggagaaaaaaaaaaacuuaaaucaaaaccaaaaccaaaccaaaacaaauaaacccacaggguuuggggauuuagcucaguggaagagugcuugccuagcaagcaaaagguccuggguucguacccaagucccguucugagcacccaugucagguugcucccaggggcugguaaguguuagcugcuuugucugucaccuguugacaucauuuguguguauaucccccgcccccaacacacacauauacacauacuuguaaauaacacauaaaucuucaauccaaggcuuccauuccuggagagguguuuauagcaggcgggugcacagggcguacaccugagacccuaagguaauucacagagccaagggcuguagugccuacaaggagcugagaaggucggggauuggaggcugaagucuccaugagugaccagaguugauguggagggcgcuguuggcacugucaaacccguuuuuuuacgacuuaggcaguugagggucagcucgacaaagacagugguugaggguaucccgcuggagaggugggcacucguuccuggguuuuugggguucugagccuggcccaccugcccugccccacaguaccugcaagagauggaggaucugcggcucaaacaucgaacgcugcugaaggacugugaccucuauaagcaccgcauggccacuguguuggcccagcuggaggagauugagaaagagcgggaccaggugagcugcagccuguugaggggugucccucaucccaucucuagcucugauuugggaggggaaggaggagcagggggaggaggaggaagaagaggaggaggaggaagaggaggaggagggggaggaagaugcaggauuggcauugcaggaagagacauuaaaagugcacuggugaauugagaugaggcugucaggucagggagaccgguaagcaucuucacauaugcccagggaagccugugaggaugcuggagugugaaacaugggccucagaagauacccaccaaccaauaugggccucacaguuucccagggucuuugcuacaguccucucauugcacagggcccagagagggucagucuuguagaugaucacaugggcaggcaggcagcauuggagcaggguucagacccuugguaaaucacacagggcuccucggauggcagcuaagagccucgucccacggagcacgugagagauccuccuuaggcccugagcuuccaugcccucccagaccguccugccucucugcucucugcauggaggaggcaccuacaaauauuugcugauggagaaauucccaaagguuuggucuuuauguuccuggcaucacaggcuuguguccugugaaggcuccaggguagcugaggcuucagaccaguuccuuuaugccccugaccacugugugggaaggcgccuccuguaggcagggcaggagguuguugugcuacuacaugugugagaaugacccugggagccguuagaacguagguuugggggucaccccuggcauugugauucuggugcuuuggggccaccagggucuucccagccugccagggcuuuuauccuggcucccucaggagcagugugggcaaguccuggccugggccuggcucucagggacuucaugagaggaaagagcauuggcugcacugggcuggguuggacuccuggcaccuguagggacccaagugcugugagaaaaguuagcuucccaguggaucucuugaaaguaucguucucguuguuguuguuguuugagacaggguuucucugugcagcccuagcuguccuggaaauugcucuguagaccaggcaggcccuaaauuuagagaucugccugccccugccucccaagugcuggguuuuaaaggcauacuucauuaccacccggcuggaaaaagugucuuaaguuuaggggugugguguaccuggacccuggccuucccagccagagacgccuguacccucugguggugguguuuuugguuccaccaguaagaccagugauccgucauccucuuaguccagugguucucuaucuugcuaaggcugcgacccuuuaaugcaguuccuuauguugugugacccccccauacccucaagcuauacaauuauuuucuuugcuacuucauaacucuaauuuuugcuacuguuaugaaucauaauggaaauauuuuuuggagauagagacccacagguugagaacugcugccuuagccugucuguguauagacaaaacgagcugacacuaaacauaccccccccccccccgcccuccauaaaggaagugucccucaggcaacagacagcaccggucuuguucuauccagcccacugaggcagcgcaacuccccuguucucuccaggcaauccagagccgagaccggauccagcugcaguauucucagagccucauugagaaggaccaguaccgcaagcaggugcgggggcuggaggcggagcgcgaugagcugcucaccacagucaccagccuggaggggaccaaggccaugcuggaggcacagcugcagcggacacagggggguuccugucucaaggugaguggggccagaaguauaaugcucugggacuggugugcuguggaccuuguuucauggggaaaaaaaucuaugcuggcuuaaggcugggccucuguggugagugagcucuaggccagggcugggaacgugugaggccugaguggggaccucggcugggugggaccgugguggacauuaacaauagguugcagcugagagguugugggcuggccuuuggguuucugcgacuucucugggcacaugggauaguuugagcugacuguaaacacuuggcaaggcuggaugccggaggguucaugagcaggacucucaggcagggcuaggcuaggcuagcaugggucuugaagucccacaagagaacagcuguuccaguccuuucagagugcaggggcccagagagggccagaggucugcuggaggucacccagucaggugguacuggcacagggccuggaccucugggagaucaggcagugguccucggacucugcccggagcucugcuguuuccuguuuuuggucauuugugaugagcuugugagccuggaggaggaggaggaagaggaggaggaggaggaggaggaggaggaggagugggggaggaggugagaggagaaggaggaggggaggaggaggaagaggaggaagaagaagaggaggaauauguauaugaucucuuaugugucagaaccuugguggcuuucgcucugagguaaagacugaccuguucugcccccuaggcccaggaaguguggcuucucccacccacuuagcuugguucugugggggucuuaguauugcaaauccuaggcucuguccugccucaggacuuuugcauaugcaucugccuagauuauucuucccaacuuuguaccuccauauccugagucugcagcucaaauuccacuuugccuggaacgaugugccaggcgggguguggccucuguugugcucuguguucaggucacacuucuucugcugcccucacauuugggaugauuuuuuuccucagcuggcuuguagucuucccccguuuuguggcaugggcucuaugaaagcgcagaucuggcaucccgugucuauaucuucccugugccuggcacgcguggcaggugcgcaguaugggcaggccagccugggcucggcccugcucacccccucccuccccucauccucuggcaggccugugccuccucccacucccugugcuccaaccucagcagcaccuggagccucagcgaguucccaucgccccugggaggcccagaagcuacaggagaagccgggggaucugagccccacaccucgguaagaugccaccuaccccaaucacggggaagccugggacuucccuauguuguccccacacacaguguguccacuuugccagccauugcaugucacagacacgcacagcaaagcccagggaggcugagagccuuuuuucccauuugugugcuuguaugugcagguguuucugcauguucauguguguguaaguacacguguguaugcauguggagaccagaggucagccuuggguaucuuuuuuuuucccaggaggcauucacuuaguuuuuccuuuaagauauuugauuauuuuuaucuuuaauuauacgugugugugcauaucugugugugguuugugcacaugaauauauauggauagccucagaauccagagaugucugguccccuuggagcuagaauuagagguaguugugggugucugaugccaggaaugggggcuuuaucuucuaagagcaacacaggcucuugaccauugagcgcucucuuuggccuuuacuuugucauuuuuggagacacucucucccugggacuugaagaucucugauuaggccaugcuccccaucacuaggauuacaagcguguacaaccaugccucugugugugugugucuguauguagguguaugugaguguguguuuguauguguguauguguauguguaugugugugugugcgcgugcgcgcgcacgcuggagagccaacucagaaucuccugcuugcccaguaggcucuuuacugguuaagccucucccagcacucgcagguauggggagcccucauacacuguagucuugccuaccuuuccuuuguccugggccccaggucuugucugagagcugagggcugggauggggggcuggagaugaccaggacuuaugcugggcuuacaggaggaagccacagacagcgagaaggagaucaaccggcucucuauccugccuuucccacccagugcugguuccauacuccgccggcagcgugaggaagacccggagcccccuaagagguaacuugcuggagguagcaggagcuccccaugaggcaggguggcugggucuugauugacacauucccugaguucagcuaccagagucaggcaggacuagcaguccccucacuggacugccccgagucugucagaguccuagaaacagugaaguucaaaaaggaaccagguugggucagguuaaagccaaauagcagaaugggcucagcugcagcccagugcucuggugggcaguucguugcaggcagccugaaaucucagguucuuaaccuuagagacuggguuggcucagguuggggaauagagaggauuccaugugcaggguacgcaaggcaagaaagccaggccucagcuuccauuagcagcagcagcagcaggaggaggcaggcaggucagaaaacccagccacauccguaauggccagagcaggauaugggauuuccugucuccugguccuucccaucacugucuuccccucuaaguggccuccugaugggaggcugggcuggggguaggcuguggugaccacaggcuugcugugaagugacuugcacucacagggguggaugugaggaggcugggcuaguucagaaaguacagguaggagccaagaacucaagguggcaggggcggguaauggcaggguacauacacaguaagggaggcagcauugaaggauaagucagcuauggaucaaagcaagaacucuuugcuuugugcuuuuagggggcuggguggccugggugcccccuggccuggguccuggugguuugcugggguacugagauacgagguggggcaaaaugucacgggucucauuugcuaccccugucuccucucuguucaggucuuuuagcagcaugucggauaucacagguaauucucagggucccccggggagggccucacuuuggggaguuccuugccacuggccuagauccugugugccugcucuucuggccugugcuccuucccccauggccugucugugccccgugaccaguccuggaagcuguaugggagacuucugagaaauaggguccagcuuuuacaccugcuccugggcgugccacguggggcccuucucuuccugccuaucuccuccuccucuaggaaacuggagccucacccugcggcccaucccagcucugugcucccggggccacuagcaugccaaacccccuuuuguugccuucugcugucucuguuguccaaacuucugacuucccucuuccuccccagggagugugacccuuaagccaugguccccuggccucucuucaucauccucgucugacaguguguggccuuugggaaagccggaaggccuccuggcucggggcuguggccuggacuuccucaauagguaugcaauucuccaggaugguagagaaggguuugggugucccauggagcugcagaggguccaggucucagcugggaggcagcaggccauggcucugcuccaggcuuccaugaacaguacaguuuucagacagcggcagccccacgauucagauccuguugucugugcugugugagcccuggcugcugucugggcugcugucuggucccucggccuccauuuccucaccggcuaaaggcaaccaugaucucuuuugcaugugggugucuggacauuucugguucaugugaauagagcauccagcccugagagguacagaccgugucacucaugccacccucauuccagcaucuuucuagcuacuccucucugcccugagcucuuggugggcaggauucagccaagccgcugaaccacauaacaauggccagggccaccacgggagccccuguagcuguuguggcuacaaacccaaaacagaaguuacaaaacauuagggcaggaugcccugaaaauggcccacuugguccaugagggaagggcacuccuuacccccaacuccccacacacacaucccgccccgcccucccaagccacaagaccuuugaacucagaguugcuuuggaaaggcaggaaagguuggccagggaagagccagugaggaggggagaaggggagauggaagggacgaguucaggccagaugaguccccgugggcccaugacuaaggcacggacauguggauuuuggcuugugugaauuggaugccugggaaugucuugcugucauucagugccaaggcagcugccucacuccugggacaaaguguuguuuugauuguccuuguuucauaaacuacagaaccgaagcucagaauucuuagugaauucgcuugagaccgcauggcugaaaaguacuaggaccaucuucagggaccggaccacacuugaguuuuaggaaagccuuaggaagcacugaaugccagccagugugaggugggguuagggguagggggauuucaagcuaaacagaucagggcagagcaggaccagaggccuccugccuccuagagacggcuuggccaggcgucuagcaccccacccaccaacccccacccccugcuucuguugcaaucccaguguaggcagugggcccagugugacauugucucaggccugugcaggacaugcuuaugggggaaggggcggaggugccucccuuccugccugcucuggcccuuccuccagccgagcuugaggcagcauccuggcugucuuccagggggcgccaggaugcaguaccgggaaugaggcucugccccaauccuccugggccugggcugggucaccucucccgcucaugcaguucuggggaagagggaguuggaggaagaccacagaccaggcugugggcucagguggcugaaagagaaagggggauaggcacucauuuaacugcaggucagggugacccacuugggucucaagauauggcuauagguuuggaagaucuggcucuguacccaaugccuagaguucaaaucuugcuguuuauugcuccccugggggcuugggcaggccacuuaauuuccgcuguaugcuguagaccuaugacaaugcugucucucaggugcccuccccccaacccccaccaguaguccugaauuaaacaauaccuggcucaaauuuggauauucuagcuacuacggugccugugcagagcccauaugggugcgugugcaaggagacauggucuagguaguagaauauggggaugucugcacgcacaggugugcuggcaugugugugcagguguggaggacagaguugacauuagugacuuccuuguauggcuguccacauuaagucccugcauccugggauguaggaugcaucacuguuuggcuagaccugcuggccaguaaacucuugggauccuucugucucugcuuccugcacacugauguuacagaugcagugccuggcuugcaugcggguacugggcauccaaacccggguccugguguuuaugcaccaagcgcuuuauuuacugagcuaucuuuccaucccagaaccgguauaggaauuguucaaagccacuggaggcugguguaguuugggcacaccugccuuccgucugcuguguacauuuuggagggccauauacauagcucuuggaccucuuaguugcaaacugucacccccuccagccucuucacuccuguuaggggacaucacagagcagugucagucaggcacugggguagguggaguaaagcuagaacgucacuggacagauggcuguguggaagagaugguaggaaugaugugaggcccuggguacugggagagcauuagagaaaguuagccugcugucuguccgcagaauccuguaacugucuauacucaugugguccuagaggucucuagaaccuucugaccacacacagagaaaguucuuagacucuuuguucaggucuacuacccagcauuuguacuguccuugggaagugauaacugcuuucuaccucuguugcccacacgucuaacauggcagcaucauugcuagaaauauucauguuucuggucugugcagcaggcuucgaucucagcauccaggucccugauuggugcaaaucugucacgugugcagccuggagaucuucccaccguguucugggacagggacacucacaagccacagggcccauuaucacucacuguuggcagaaaugacagcuucucugacaagacaggggucgggcuaggagcccuucuaggaguuggacaaccccugucccuucugggcuucagggccucagucucagacauagucaggaucagcuaacauguccuguucucuccccuccucugcauccacugaggucccaaacaagggaucucugcacaccguucccacccagccccaggcuguucucagacacugacaagugccagagugggcuaccugcuugugaggcucagggaaguuuacagaguccuuggggucccugggaagggugguuauccacagcguuccagaggaggggugccagaaauuaauccuuaggucacugggugugcagggguguuagaggaauccgagaucagcaguucugagugauggcagcggucuguggguuuguaacaguuggggagacuggaccagcaggauuguccucagucccaccugacaacaggaaauagccaaagcuuuuuuuuuuuuuuuugcuuguuuuaauuauauuuuguuuauuuaaugugugugucuguguuguguguauuguggaugccacagauguggaggucagaagacaaccugugggguuugauucucacuuucuauccugugggucagagauggggcucaagucaccaggcuugauggcacuuuuaccugcugagccaucucaccagugugacgggaggaguuucuuuuuuuuuuuuuuuuuuuuuuuuugguuuuucgagacagaguuucuccauguagcccuggcuguccuagaacucacucuguagaccaggcuggccucaaacucagaacuccaccugccucugccucccaagugcuggauuaaaggcaugcgccaucacuguuuggcagaccagaggaguuucuuaagcaugucccuugagcccacaaugcugagagcucgcuacguuuccacucaugaccggccgguuuggggugagucggucgugaggaguggggcacgcacauucaggguucgucaggccacgaugcugguucccucuguggcacuuuccucucuccguggcuucugaccuugcucccaggaaaggaaaaccuggaagaaccugcaaucaaaggcucaugagacagugguccaggcuuggggauguggcucagauuucuuaccuagcaugcacagagcccagcgccguguaaacugcauauggugagacacaucuguaaucccagcacuugggagguagaugcaucagaaguucaaggucagccgggcgugguagugcacaccuuuagucccagcacucaggaggcagaggcagguggaguucugaguuugaggccagccuggucuacagagugaguuccaggacagccagggcuacacagagaaacccuaucucgagaaaccaccccccccccaaaaaaaaagaagaagaagaaguaguucaaggucauucucaacuacauagagagcuagccuggaguacucaagacccuguuuaagagauggagugugguccaguucacuugagaggaggcgugauugcguuuuguauccuguucugucaagaacagaauuagucagggcccggggaauuccacagcccacaguggcuucgcagcuccuugcuucgaccuucugacccucacgcccacagggucagaggggugucacugucacccucauggacaagcagggagucugggucauggcuuaagaagaguuuagcacaggcaggcucagacuuuugacauuucaacacgagguugucaucuacccgguuggugcucugugcaacugaauucucaaaaauggcaaaaaaaccaaaccaaaccaaaaaaaaaccaaaacaaaacucaucuuuuaaguaauuuaggauuuuguguugggcugcaccgagugccguccagggugaccugugagccauggcuuggauagauagauacacugaauggugcccuccaggauauuuuugcucuaacugcugacuggacaaauuucaagaguucccccauucugccucccugaaccaggacaggccccaggggccuggcucuugauuugacugaagggacaggugccagcugcagggggcagugugaguaccucgagguaggggagaggcucugcuggcucauggaagagacuuuggggucaguuugcccgagacugguccucgggccuuaucaguucuuauccagggaugggcaggauucugcucuccuggggaucauggcguguccuuggcuucaguggccacagccagcgucucccuuugugugaaggaauaggguggacagauuccuuccugugacucagacacagguuccagcuggcuuuucugggggcuguuccucaggcuuuuaaguuggugcugggggacacauguagcaccuggacuuucuuacugcguccgcugcugcucuugauauugaaccugcugcaaagcugucucugugccgcaagccuccccaucaccccagagccugacuccucacccugugucacaaagcacuuggguuccauacugagauggcacccagcuguauccuccccuuccuacccucugcaccccucccucuaauuuagcugcuucuaaauuagaggcuaacggguccugugaguaagcuguguuccuuuguucucaaugugucaggugcuggguuugguguuaggggcgcaggcuggauuuccgcagaugucuggaccugaagggcuuugaaaugggcagaacugaagagaaaauacagaaccuggcagggggugcugcuggguaggggugggguuagugggagggcggaucugggagggagaggcuugaguuuugaagcagcagcaugaugaccaggcuggggagaggggggaggguguugcagagggcacuucaggaacacuggcccugggugagauccauggucucuucaggcagcagaaucaugguugccuuccggggacucugugacaguacugacuggauucucauucccaccuuccucccuuucucucaggucucuggccauccgaguguccggcuggaguccccccgcaggccuggauccccaggauaagaguccagauagcaugccgggccuuggagacagguggucuggggcgguggugcgaaggguguugucugggccugggucagccaggacagaacagaaagaggugagaucccucuaggggcagggguucugcaucagcaaggguggacauugguugguggagcauccacggguggggcuucuggggacugccugaaguagaaguugcucugcccucagccugcagugacuaacaucugacuugguagacggggguggggaggugggguggggugggguggggugaggguagggguguggcaugaggaguuggggggaaccuugggggggcauggugacagcauccugacagagcuacaucccuaaaaucauccacugucugcuugggcucagccgagggcggaaggcacuggucuggagggggcaggccuggaagcggaggcccagcagaggaccuugcccuggaaccagagcuccacccuccccuuccugcuggacucaaagggugagccuggccuacgggagaaccuguugaacucaugagacccagccagucagggcuccuucaguccgggaugugggguaggaauagaagggcccagagguagauacagaagccuaugucccaguacccugcagggcuguggcauccuuuaggugugcacgugcgcaugcguucucuuucugcagcuaguaagcaccaacggugaaacaguaacuccuguaccuaaguuccuugcucaaagaagguccuugcaggccaagccuguagagggucucaucaguccccgaggucccuugaagcugaucucugggcucacuagccuccuguguccucccuacccugccaaacccagccugucauuccuuccaugaggcccuggaugccugggcaaagggaccgggugccgagcccuucuacauucgagccaacuucucccugcccgagcggucggauccccaugcccuuugugugaaagcccaagagauccugcgguugguggacccagcccacaagcggaggcaggagugguucuguacucgaguggacacccucaccuuacgggaccuggaccggggcaccgugcccaauuaucagaggugaugccggaagccugggguggggggcccgugggaccugguauggggauguagcccucuuucccaaggagucccucccugccuucugggacaggauggauuggaggagaagguguugaggcuugcuuuucuuguaccaugugugacccaaccuuccucccgcagagcucagcagcuccuagaaguccaggaaaaauacuugaucuccagcagacaccgaaguccucgaagcaacguaaguagggaugaugggcaggcugaguauucggucaucccugaggagagaaaagagggcaggccuccuugaucuaggugcccaggagacagaacauuaguuucccugugcaggauaguugagagaugaaaugucuggaacgggcccaugcucuagucuaguguuugucuaguacacagugggcaccagagaacagucauacucucuuuuucagucccuggggugggucaccauugugcccaugguaaagugagggcccuugauaaggccccugggggaucccauugcuggagaguggccagggcauguguguucaggggggcugugaagagcaugcagcugugcauguucaccugucugcugcucaccugccuccuggacagcaagcagcgucugugaguccaugcaugccuggggcccagugcccgcuccugugcgugcuccgugccugccaggcuugggcuaaguagugugagugaguguccuagguuuuccuacccaagggcuugcugcucguucauugguggagagacugugcuggaguagccugaggguggggaugugggaugaggaguguggggauggaacgauaacuugggggggugucgacgggauaggaggggguggggacagggaggaggguggcuaugugcggaacuguugaaucuggacggcaguggcaggaugcccccucagcauucccucguugcugggauggauugugacaacgaucucccuuccuuguccaccuagcugaagaagcgagcccuaggguuggugaggcccaagccugcagggggcacugcaggagacucagcagaacagcucccugcagagcccugcucagguaagucugaggacauaggggacaugcccucugcucaagugcccagugugccucuggguggccccuggcuuagcagugggaacaauccagagcgacaaggcucccugauggugggauggauugaagagagcccacuggcaggugcugguguguguguuugcaaguggcucugaggagcguggacaaccaguaacauccaccacacugaggagagcaaggggcuggggaggagccagaugagaaaaugguacuucugaagggcaccagggaugcggaggugagggaagguuugggaagagagggagaggagccuacuccugauggaggugaggcucaugcacggucacaggagcucgguguggguggugacuuugaagguggggagagccucuuugaaguccagggcaaucagcaaccccuugcuuaggggcgucuugucuagcagaugagaccaugaguguaguuagagccaggugcccaugugcagggaaccuaggaaggugagacuugaguuugugguggcuaguggaaguuaccugggcugacggugcauggcucugagcggcaggcaaaagcccuaacauugcaggcagcuaaagcaagagcagguccgaugcugaauucaccccaggcuuucagacagggccuuuguuaccacugggaggaugugaccuuugcccugggauguugggaagucagcccagcauugaaagcagggagucagucacaugaucguguugauggcugggagccuaggugcugacugcagaguggccuguagggggcagaccugagacaggaucagaaagaugccuucugcgagaauaccagggcgagggagagggagagggagagggagagggagagggagagggagagggagagggagagggagagggagagggagagggagagggagagggagagggagagggugagggagagggagagggaguguguguguguguguggcagaagaugauguugacuuaaguacgcuggggaacuccucaccucuuccauacuccuucucugcagagcuagaacgaagccuaaaacccuacagccuggugcgaccgcuguuggugucugccuugaggccugugguccuccugccugagugccuggcgccucgccucauccguaaccugcuggaucugccaagcuccaggcuggauuuccaagugugcccagcaggugagccugccugccgccuggguggguggcuguauugguaugggcuggaggggcaaugcaucuggguggcagugggcagccaggccugugguccugagucauacacguccuuguucuccacagagagccucucuggggaggaacaguguacguccucagcucccggagcccccaaagccuggccggccacugcugggcuaggcagcaggauccgugccauccaggagucugucgggaagguaagugccagagggggcaaggcugcccucugggacccagaaccagcaucugggccaccccuugggcuggguugagaugaugaccuuguggguuacuugaggagugggcugguaucucuuaccugaacauuguuauuccugaacuuccauuguucuguuuguuggcuggggcugcagggggguggcugguggggaugagaguagagucggagguccggagagaccugaccgucucccagcacacacaugagucugcgucuccaguuuccuuugguucuuugcugaugaagcaggacuguccccugagagguguuggcagggguggaugcagcagggaagggugggcccaggaguaaacugucugucugucugucugaaaagaagcacugccuguuggagcugggugcacggggagugcgggaguuggugcacagcgaggucuaccccauugucauccacguggaggugacugagaagaauguccgugagaucaggugagugguggccacgugugggugccuucuguggaauccucugucucugcaccugccaccaccuguccaccuguccaucugugugcaugcuuguauuguuuauguuuauuguggguauuuaucucuagagaggguuaggucuguaacagagggagguccuguguauguauauguauggaucauaggcauuuguacuaugugucucauagauaugcauguaucauacauguaucaugugaauaauguauaucauguguguauguauguucuggauauguauuguguggguguaucauguauguauaauucauuauaaguguaucuuguuugaguaucaugcauagugugaaucacauguauagcuuucaugccauauauauaucaggcaugccacaaaucauacauacuauguauuauguauguauuauaugucauauguauauugugcuuuuguugugucaugcauguugugguuauaugcguguauguguauuguauaucaguauguauugguaugugcuauguguguugucugucauguaugugugugcauauguguaucgugcauguaugauauauguaugcaugugcgugcacauacacagccagcucugaucacccucuuccucugcaggggccuguugggccggccgggcuggcgggauucagaacugcuccgucagugucggggcucagaacaguggcucuggggacugccguguuccugggugcaggugccugcgcaugcguggggccaugcagaggagcuggccaagguggugcguggccgaaucuugcaggaacaggcucgccuuguguggguggagcgaggcagcagcagagggggcaguggcagcaguagugaggccugaggacccaucugaugcccaggcucuuccagccacugucuagaccuccuccaucagaugccuaggccuccuccaucagauaccugggccuccuccaucagaugucugggccuccuccaucagaugccuaggccuccuccaucagaugucugggccuccuccaucagaugccuaggccuccuccaucagaugccugggccuccuccaucagaugucugggccuccuccaucagaugucugggccuccuccaucagaugcuugggccuccuccaucagaugccugggccuccuccaucagaugucugggccuccuccaucagaugccugggccuccuccaucagaugccugggccuccuccaucagaugucuaggccuccuccaucagaugccugggccuccuccaucagaugccuaggccuccuccaucagaugucugggccuccuccaucagaugccugggccuccuccaucagaugccugggccuccuccaucagaugucugggccuccuccaucagaugccugggccuccuccaucagaugucugggccuccuccaucagaugccugggccuccuccaucagaugucugggccuccuccaucagaugccugggccuccuccagcuggugccugggccuccuccaucagaugccugggccuccuccaucagaugucugggccuccuccagcuggugccuggacauucaccguuuauacaugggcucacacccgugugagcagaggagacccuguguuuucaguggaaucagaucuuccucaguuggggccuuccuuguccccccguggacucuccaaugugggaccucgguccugggcucucaccggggucugucauuggcucugcacaggcugcaugaacccacgcaccugucccugaccugcugcucuggucuccucacuagcuccaauguucccauguuuccauuugugugucuuauacguguaugugugcccucuccuuacauacacacccuggaauagaguucucacaccguucaauuuugcacauauguccucauggauccccaguuuugucccuccacuugggcacacgaggucucagggguccucaaccugggucugugcccccagcugugcccagcaccacgggaccuccacaguccaauggcauugccugugugugcugucaugaagauaccacggcuguucuggucagcuccuacccuuacaucucugugugugucgucccucaucccguguaaauaucaccauccuugugacacuggcacuaagcaaugugugcucugcccagcacaccuggacauguucucucggcuggcuuucuguuccccgccugccuccaggaggccagggugguggugcugcuaggccaucccaauguuaggcuugugggugauuccccgggccuuuucauucaagcugcacacaaugagucauuaaaguuugucauagaag

SEQ ID NO: 7861 - RNA, 17400 nt, Mus musculus
aauccaggaaaaaagucacuuuauuuucauaaauacucccacugccacccauccugacccuacuugaccacaggagggugggcagaugugaggugcucccgggaggccccagcagaaggugauaauggagcauggaacucugggaguuccauggcccuccagggggcauguccucuggcucugcuuucaaguuuccauggcccgugggagccugagagcaaagggaggccucuggaggccccgggggcugaguggagagcuccuucagcucugugaccacagggccauuccaaaagaaaagcaacgagccagaccacacaccaagugcacacagcuagggcgcgggcgucacccccacccagucacuggguccccgcagaggaggccugggcuggucccaguuuccagcauggccuccaaguuauggcugggccuuuccauaaggcauaaaagacaggugaggacgaccccaccucaggcugggguucagggcugggccucacagccccccuccuucccucaccccagaguccuuccagggcauacggccccucccugcuccaggcucccacuggugauggaggucccagcagcuauggcagacccaggcgcagccuccugcuggguuuggcucagcaggggaagagggagggggaagagucacugggggccacaggagggagagaagcacaggaugaacagguccagguccugcugccccuccucucuccagccccucuguccuagaggcucccccaggucucugguggggggaacugauccacaucucccaucucauuguaggucuggucgcccauagugaagaugagcuuguagcggaggcgaaccuucuccugaggcacaagcacagcagucagaguggggaagggagguuagcgccacccuggggcacugccacgucagagcugggcccucaccuucuggggguuagcaaggagcaggaccugggugauggcugagggguggacgaugggguugaacgcuggcagcucugugccggaagguggcugcagccucaccuucaugaccugggggcaggaggugacugcuggucaggcagccaccacagcagaggcagcucccuucccagagucucaggggucucucuggcuccccaccccuuccccagcuccccagggaaggagauaccaugcccaggcagcaggcugcccaccaggucuaaagucccccugccuugagggaggaaggccugccuggucugcccuucaccuuggggacggcugacuggaaaacgauguuccggaugggcuggggcgccgugcucagcauagagaccaccaccaccagcacaucggagcgcccuggcagugggucccgagcaaaauggaagaggacacggaagccaugcuggucauaaacggucacuggcaagaugcugccugugggaggacggguaggaggucggucaguggguggagucagaucauaccaggcgcuggccucuuagaggcaggaugcccacccuggagccaagucacagccaggcccuucccaggcucuguucaaagugugggucaugcauucuuuggggucagagucaguucuagugcuaaggaggacagggaagacuugagcuucuuggucacaguuucuaagucagucagccaauguuaccuacugcuaccuacugcuccuggguaauaccuggggcuuccuccuggauccuucuuugaggcucuauuuuauaaucauaaggagccuucuaguucuggccccugcccucccugggaacgagggggucaggguucaauucuaagaagcccucuccugugcaacccagagauuagaaagcagccuuucaucacucuaggauggggaggcccuacugcaggguaacaucggagucaucaggcucuggggacaagagcuggccuggccuggcccuucccaccccuccccacucacuggguuugauagacuccaggggcacagugaugcugguuagggagaacucaguggguguggccugagguggaggcccagggggcucuggggacgugguguggaggaggcuggcggcuccugggcugggcgagcugcucuuacucugcaggucacggagggugagccggggggcuggcugcugcuucucccuuaauugggacaguguauuagcacgugauuuuguagugggcuacccagcucuguaccuguggguagcuuugagaacccccauccgcagggggagcccccccacuccuugccucagcauccucccaugcugaacccccuucuaucuuuuccuagggcacugggaacucgaggggcaugcaggucaguggauguggcccauucucaugaaugcauguaguguggggccaucccugggcacacccuugucacagugggugaucaaacuugcuggacucccaggaguuacagugaugggcaauucccugcugggcccagaagcgcugacuugcugggacagggagggccauggcaguggcagcccucaccaccgcacuugcugggcuuccggaggcagagccugcugcauaaggguuuuccccaagagguccaggucguccaggccgcugcucguugguggaggggccugggcugggggucggcaguccaugcugggggccugggcuggaggagggacugaggauucagugccaucugaugacugugggcaaaggagacaggugugagacucuccaaaguguuagggucaccuccugaguccugaggcccucccuucccugcaggugacaucugagagagguacaguagagaggauaauagacucccuguccaugaggcaaaacacuggaccuaaauggaucuccacacuggggggaccuuaaguuuaagggaagaagagcugaaccuugaagguggaacugugguccuaucaggacccuaagcugacgcccaggcaccucugcuggagguuagaaaagacuguugggcucuucgcugggaugguacugccaugucccaggacccaccugccugucaccucucaggcuacuggcuccagccucccuucccuggggcugggcugccacaggcagagccagcuuuagcccucuuaccuggaaguugucccaccccacacuaucugagcuggugccugaagguggugucgggucacuuaggccuguagagaaagcaggacagguggcuggacuggugggcagaugaggcgaauagccaccaguguggcgcuagggccucccuggauuccucccuuuagaggcucaugagugaaauccacaguuucagaggggaccagcagcagcacagaaauagaaagcaucaucccggcagccaccuugcagcccacauuaacuuccucuccguccagcaaggccccacagaagccagcuuggcaggaguuggaacuuucaccuugggcccucggcagcuaagagcaggagccgagguggugaggagggaaggagagucugaccucgugugucaggugaguaucugugggcaggguguuauccugggugagccuccguguccccagguggacaguggggagguggaauaggcagacucuaaaggcacuggcauaggucaguaaggccagcuaacuggugcugagggcccuggggacggccugcuggcuggcaggagagucagcacgaccccugucuauccugaacaccucagccaagcucgcccuguauuugucuuagaaaagacaagugacccuguuucuuagcaagugcucuucagcgggcaggcagcagcugccagcucuccgcuaugguacaggguggcacacacuuuuaaucucagcacuugguaggcagaggcagguggaucucugaguuuaaggcuagcuuggucuacaggguaaguuccaagacagccagggccacacagaaaccaugucucagaaaacaaacaagcaaaaauccccaaacaaaaaaggccagagacucagacaaccauuggccugagcacaggauccccaauggaggagcuagagaagggacccaaagagcugaaggggucugcagccccauaggaggaucaacaauaagaaccaaccaguacccccaaagcucccaggagcuaaaccaccaaccaaagaguacacauggagggacccauggcuccagccacauauauggccuugucaaucaucaaugagaagcccuugguccugugaaggauuuaugccccaguguagggcaaugccaggaccagaaaacagggguggguggguuagugagcaaggggauggggggaggaaaugggaguuuucggaggggaaacuaggaaaggggauaucauuugaaaucuaaauaaagaaaauaucuuaaaaaaaaaaaaaaaggccaaagagaucagaguucacuucuucacuuucaaucuucucagggaccgggcugacuagaaguggggcuuacuaaauaaauccuguccuuccugucugcagaacuuagggagggagagcccacugauccuucaccagggcaacuccacuccuggaaucaccccaucucucccaggcaggcugagcuggccagcccuaccuucugccacgcugaucuuguucucagucucuucgagccagggcuucacccagaauagggaagccaugcugcucgccauggccuccacuggcuucccaaaggagcacagggccauugcugugugccagcagaacgcuggugccagcaggcugcccugcacuguccucuuccuuacccagagacaugagcucgucaucaagcagggacaccgaggcacugagcugcucaggacugcucugguugccagggcgggugggcguggcuggcuggguggugcccgggggagggagguccaggccugagagguccagcagggcugacgugcuuccugagaggaagagagccggcagguccuggggggcacugggagcagcggugagcacagcacuccuccuccuccuccuccucccaucucauuacaggucuccuagccccucagagccacuccagcccgccaagcccuuucuuuuguucacaauaaaccagcuuugcuuagggucaggaaugugaccuuagugucaacacagggcgauaccaaccaagcaccuaagguguuacucugggacacagcuuuaagauauggcugccgcucucauacccaaaggcuuggcuccucccgaccugccaagacucccucgcugcuagccuuuucugugacgccccuccuccccaccccacccugccacaguccccugagaagagccaaguuugcaucuaaagcucuguccuuuuuucuggaagucuaaugaggccuaggggaugacccagccccacacaucuggguccagauucaugcgaggaagugucuuccuucuauuucaugacaaacuugggcucccuuccccacagcuucaggcuugaccuucguggucacacugaaggucaugccgccccgcaccugggccccccagagcccuccugcucucuccauaccaggaauggagcuggcuguggcaucaccguugaccuccucgccccggaccagcugcuuguacagguugaucaccugggugagauugucauuagccugcaggaucucagcuggaacaggaaggcgaggagagggggguuagaaguggcggggccuccggauagggcagaggagcccuccacacccgacccaaaaguauguaaaggggucaggcaucccacuccaaauguggguccagacagccaggcugcuguaaaggcuuggagguggaaauguacccagaauguccagggagagccaggcagggaguagagacagagaggccugagugacugggaaggggugaugugauacacuggggcugugaccugagcucgucauucugcuuaggagauggggggagaguucucccuccugggcagauaagaugccugcacaggaccuguucagggguuuccaagagcagucugcuuucuguggccuucucagaugagagccggagaaaggggggcaccucaugguaguuccuuccaugugggugucuagcggggccuggaagugggaggagguaagacagggcugggccucaucuuggcaguugccuggggcucaccuaaggccucaucauugucuuccgugucacuggccagucggaagagugugggucgcaugcgcucacagcgcugguacaguuccuggguggaacaggaugaguagacaaggguuaugaguggguuaugaguggguuggggugggcugggguggguuggaugggcugggugugagcuggggugggccggggguaagauggggugggcugggagugagcugggagugagcuggggugggugggagcaggagcaccuucaugagguccucacugcugcuggaugcagcacccuggcuguggcucaucaccaucucugucagcaacuucacauuguuguugaccuccucgauggcauucacccgcuuggagaucuuuuccauccgcuucugguccuauagagcagcagauggccaaaggccgucucagaccucgggagguaauggcacccgagucugggaagagggcuggaugggcagcucuguuuggccaaguccugcugauagcuugccaugcaggacaaguacucuucaggaagcagugucucacuauuaugccacucccuaccgaacuucugccagaguccucagucuaggccacugcacaggcucaagucucuagaggugguccucagucacaucaccagcuucuagacucgugaccauggcucgcauuucuccccuccuaguuucugacuccugaagacacuugcccauccucggucagcacucacaacccagaaacaaguauggagucccuccuugucugcaggugccugccuggccaguguguggguccaggccuuuaaaggcaucuguaggaggcagccccguucuuucugcuccccaguguccuugugcugcaggagguaggcuugugcuuggcagccucacaucgcuuagcccuuuaagaccucccugaaaugagcaguccaggccgugacacgcccucuccugcugcacaggaugcagagaaggcccugacagucaagcugggcccaggcugagccccaccaaccagcacaacuagaucuugccuccgaggaagaugagcuagcagucucgguggggcacacacuauuaaaacguggaaaguuucuuugcugcugucauuagcgagcugggagauuucauguaaacguucacauuucuggaucauuuucaaggaaaaacccaucaccugaugauccugcuacacaggguuacaggugggcagucuccugccucagaggaaccugccauguggccuugaucguuucuuuuccugcggucaauccuuagccuagagagcuguuacauuuggcugcuucugccugugcaucugagugcuaaccagagaucgggguuugguuucugacaaaguuucauucuguagcucaggcuggccuggaguucaaaucaaggccaucccccugucuuagccuccccaguguugggauuagaggugugagccaccuugcccauccucaacaccuuuugaaauuuuucugucuugagacagucucuuucuacauagcucugucucggaacucgcuguagaccaggccagccuaaacucacgggaauuccuccugccucagccucccaagugcugggaucgaaggugagccagccuuggccuuauuaaguuucaguauacacuucuaacauaugcuagcuuacacauuaaacauauuaacagagccgggcgugguggcgcacgccuuuaaucccagcacuuugggaggcagaggcaggcagauuucugaguucgaggccagccugaucuacagggugaguuccaggacagccagggcuacacagagaaacccugucucaaaaaaaaacaaaaaaacaaacauauuaacaucuguguuuugcucucuguguaugcacauuuaaacauacacacccauacuuacauauguuugggggauacagaggacagccaccaggaccucaugcaugcuggcaagcauucuacacuaaguuuuggucucaagccccaauacauucccaaaguacuuuugaaaaauguuuacguguguguguguguguguguguguguguguguguguacaugugccauggugugcacuuggaaguaagggcacuugugaaaacugauucuucccuuccaccauguggguucuccgggauccagcucagguuagcagcggauaucuauaccuguagagccaucuugcuggcucuuacauuucuuuuuucuucccucccuuuuuuuuucugacagggucuugcuaugugggccagacuagccucaaccucaggauccuccugcuucagccucuggaguuccaagauuacagauacaugccacuaauucuugggccucauuacuaacaaauaacagccccucagaaacucaugcauagauagcagguucucccaggcuacuucccucuaaauaucagccucugagcaccugucaauucuuuacuguggcagcuguccugcugggccacuauaggacaucauauguacacacacgcacagcuccugugugguggccuagcuccacaccccaucccuucuaccccuguacaccaggccagccaucaccuccugcaccaucucuuugaugagcuuauuggcagcccggagguccucagggugugagcucuucagcaggcgggccagcaucugcagagacaaguaaauggcugugggcagcaccaggucagaaccuacaacccagcuccucgguuacugugugugggaccucucugugaaauggucagaacugaucgacaccugacgggugcccaugcggauaaccgaggcacugcacacacuccccacggagcauagcagaaggguggccucagcaugcacccccaccccagccucuaggaaggcacaccagaaaccacagcgguagccuugggagcuggccggggacuuauuucaacagcuccucuccaagcaaaugcaucuguaacugcuccacuaguacagaaagauaaagcuacccggcuccucaaccaagcccuggguucugagcugugcuuccugaaggcagaugccugcaugggucagugcauucagccggcuccacacaggaugccaccuccacagagaccacguucagcaugagccucugcucccgagacugcagagcucucccggagcgcagcuccucagccuuaccuuggacuucuccucaucuucaaagaucacauucuugggccggggaggggggaggggaaagauggcauccucuggaagcuugggguccgacuucacaaucccuggggaagacaggguuuggaaggcugucagugagugucagcuccagaggucgcaggagacggaucugggaauagggugcccagguuaaauggagcucacacuuucaucagcucccuggcuugggaaugaugggugggacuacuucugcccugcagugagugaacuccaacagagaugguuugagcccaauauauauaacuuguaaacaguaguuccuuuuguuuuuuuuuaagacuuauuuuuagccgggcggugguggcgcacgccuuuaaucccagcacuugggaggcagaggcaggcggaucucugaguucgaggccagccuggucuacagagugaguuccaggacagccagggcuacacagagaaacccugucucgaaaaaccaaaaaaaaaaaaaaaaaaagacuuauuuuuaauuacgggucugugggggcuuugguaauuuuuaauuaccagcuccauggggcuugugcaucagaguacaggcgccuguggagguaaaacgcagccacuccccuagagcugguguugugggugguugugagcuuccucaccugaguguaggaaaucaaacuuggggucuucggaagagcagcaagugcucuuaauugcugagcucucucuccaaaccccauacauaguuuuugagaaaggguagcguguaauuccuuuugaauccuauguagcucaggguggcccuuguacuuuggauccuccugccccaguaccuaagugcuagcauuauaggugugcaccacuacgccugaguacuggggauugaaggcagagcuucgugcaugcuaggcaagcauucuaccaguugagcuacaucccuuguuccugggcgcccauguuuugaggcuacucugaagguaaacuugauccguuaccaucuuuugucuacucaagcuggccguaggcacagccacagagaggccucacuggcccuguguucuugagacaguaaaggcagaccuugcuggcagaaggcccaagcugcagguggggccugucacgggucccccacgcuggggcucacucacccugcuucuucagcaucugguaggcuucugcaaucuucaccuccucaggcaggcaaaccguccagcuguacagcagcuccaagaucuuacucuucaccuucucagauguccgggagcccaaguacuucagagacacacagaaggggacuucucggacacugcucggcccccucacuugagcccuaacccugcagccucucagaugccuccggaguccucauaggcccugcaagaggccugguggagcugcuccaugugagcaccugcucagccacacagaccugaaccuugagaccccagcagggagccuggggcuccagguggaggagggaagagcucgugugcagccaugaggccccacacaucagcuccagcagcaaacuaggccaagagauggggcucucacuacacuguucucuccugggagacacggggcugcacagcccacucugaguucuguucagaggaaggucacagggggcugggcaucagauauguacccaaacugugaccaaaguccaguagccaggauguggcccauuugcuaacauaacugacuaagguuucuggcuuuggacacugaggcucaaggaaaccacauuuaggugauucggacagggagaaaugucaaacaccuaagcagcccgggcugggcacgcccagugacaguaugugugugcccugagaucagcuuucccugcaugcucagaggccuaggcuguccugacacagucagguccuggagaaggauuugugcuagguuccuaacugggaggccccuagggaccuugcuccugcagccuguaucaaagccagcacuuggagccugggccaggacgcaccuugggagacacaaccuugaugagcucguugaggaagcggaacuugcccaccucaucauggaaccucuugccgcagcucuucaugcacgucuccagaaccuguggggggaagcacugagguagccccgauccuugccagggcccagagggaggaaaggacccuggagggcacaagaugcagagguucccaggucaccugccagggcacugggucagaggucgucuagugaccaguacugcucagguugcucgaccacagggccuccguggcuuggcccgaguaucacuugcacauggucauuuuacgauucuucuuuagagacaggguuucucuguguagcccuggcuguccuggaacucacucuguagaccucaaagucacagagauccauuugcuucugccugcugaaugcuggcauuaaaggugugcaccauuacugcuuggcaguuugacacuacuuuggcuuuuccuaaacccgaaaaaucacaagaucccugcauacuuaaggaagaaaccccaaacaaaaaucaacauguugaaacaugcacagguacuuagagcaacuuccacuuagccucagacaaucauguucuacggcgacugguguaugggcuaugcagggguucagagacagugucccaucucuuuugcuccugguguagcuauugacuucaauccugagccucucuuacugcaaaguucagggucuacagauccuauguggucugaauggccucugcagagaaccugggagcuuuacaaacacagacuccccaacaugcaugcugauucaguguguuuaacauguguccuacggucgggcagugguggcacaugccuuuaauuccagcacuugggaggcagaggcagguggauuucugaguucgaggccagccuggucuacaaagugaguuccaagacaggcaggacuacacagagaaacccugucuugaaaaaaacaaaaaacaaaaaaaaacauguguccuaugaagguguccauugugugugaguuaaggaaucccugccaucacccucagaggugacaaaaggcuaacuaacucucugcugcuguuagguaccuugaggguuggcccagaccuauauccaagaucaucuggucacaguucccuuggacucaugaaaccccaggaucuuuucuuaccgucaaggccuggauggcuucccauuccuguggggacuggaucuugugggccagcaagcgaguggcaaguggaggccuggguaggaggaauagagucaugacaugguaccugauucacucagagggacagccacuccauuagccuguagcacaucagcccucuacuggccuugugaagcacaugccaaagccgaugugucuccagaucaaacagggccugggauggugacagccagugccagguggccaauguaggcaagggccuccaagagauguacaccuagccccuuuuggcuuuaagaacaagacaugggucugcagaaguugcuuacugguagauccacuugcccagcaugggugagugaggcccuguguaaacucaucaccagcaaaagcaaaagcagcugugucccuggccugcacagggcaugguaagaucaggugguaacagcucgagugcuaaggccaugcgagguggcucaugagcacccgggcuccuuccuuuccucuguggcaggaaaacccccauagccuuccauauguaccuuggccagugccacauuauagcugaggacuaaggcucagugaaggaccugccccagagaggagggugggggcggagcucacugugcggagcguucuaucacccaggagcaccaaggagccugaggacauccagaccaagcccuggggagucacuuguggaagcauuuuggacaagcauuccaggucuaucugguucuuucuuacaggaagggccugcuggggagagugcagucugcccucuggaaggcccccaguacaucaucagccacauggcacaguuagauuugaccagguguaggacuccucaugucccgguaagguucaagaccagagaguugagccucaguuuuuucauuuauaaaauaaauccaggaagggcuccccucaagggggcggcaccccugaagcccccagcaggaagcgccacuguuuuugucaacugucacugcacuuagaaugggaacugggucuccagccuacauggcaggggcacaguguguuuuguugagugugucagccaaagagagccaccuaccccucaaagucuucguugagcugcucgcagaaacuguugaugcuggcccaguucagcuccuuguucaggggauuuguggcucugucugcaggagcagagggagucaguaugggagagugggaguccugccuccucuaacgcuguccugcaacuggcgcaguuaagaggggucgagcacaugggacaugauucccuccacuucuugcuggacacccccacgccugagcacugaccuuccggugggaucagugggcagaagaacacauggcuacugcuuaccucgccuucucccaaaggccccauccucagagacuacauccagggacggccucccauggcuguaccccacuacgcugacuuucccaucucucacgcuguucucaagagcagcgccccaauccuccugguauccauacucaggagacugagggguaagaaaaaggccaggguccagcccuggaggaacuguaggccugggcagugggccaagagaagcuaggcucuuagagaaagguaagugacuaagaaagcaugggaacccagcgcaggggacuuggaucugccuggggccggggcagcugcccaggcugagggccgcucugcucagguaaggacauagccugggaaagacuggacccugggccucacgucuaguucugccagaccuugucccuggggaguggcucaggaacacuucuuccaagggugccuucuucacuucugcccaccacggcagcggcuauguuccuagcuauucuuuacagagggcccaaguggacuauuacacaaggcugugugacuccugcagagaacaugccuugcuccgcucucauggaugcaugagggauugguggcagggaggauggggcuggagaagcugggaugcagggaugggcaacagcacagaggagcaaauaauaugagacaguccccuuguggagcccccaacacugccgggugaagagccgugcaguaagaagaacuucuugaaccucuguuucccuacuuguagagcuggacaguacgcaggcugugcacugugaggcagaaguguucucaugguucugggacacuucugcccaugcugcaggcgcagaggaccacagcccaagggguggggcuauggaagaucuguggacaggaagaggcuagggcccaggauguggcaccugcucaguuggggaccuaugcuaugucugggggccuagacacccucaguguccggcagccauucacuuaauccauaguuaaaaagaaaaagaaaaaauacggugguggacaaaagcucuucuuuccugaaacucacuggcgcaaacagagcaucucugaguacucagauuagcgaucucagaagcgcuaugaagacgggcagagcaggggagggagcaggggagggauggaaggagcuggggcaggcugcucucucccgggggcucagaggcaagauggauggccagaggcugaagcagcauucuuucugguaccaaucuaucccaggaaccuugugggugacccuccaguccuugagaggaacagaugucaccagugaggcccccagggacaccagcaacaucucuucuuccuuaggucaggcugcacauuucccgaccucccagucccccacaauggcuaagggacugaacacugggaagagagccugcaaucuggaggcaaggagaagguucgggguacuggccucucagugacagcugagaaaaagggcuagaacaggaaguccucgaagugucaaaggcacgugagccccagcaaggguggagccaagcaauccgagucaggagccagggaagaggaaacucuggccaggaucaguuucuccccagcauugagcaaacggaagaucuuagaacuggaagagacaugaccccaccccuuuccccaaccuccacagugcgugugcgugugugugugugugugggggggggggcucaucuccccuggcaaguggcagaggaaaguacuugagggagagagguauuucacaacugggcaugacucuucagaugcuguccuggcuaguuuugugucaacuugacacagcuggaguuaucacagagaaagcagcuucaguuggggaagugccuccaugagauccagcuguaaggcauuuucucaauuagugaucaagggggaaaggcccauugugggugggaccaucucugggcugguagucuugguucuauaagagagcaggcugagcaagccagggaaagcaagccaguaaagaauaucccuccauggccucuguaucagcuccugcuuccugaccugcuugaguuccaguccugacauccuuuggugauuaacagcaauguggaaaauguaagcugaauaaauccuuuccuccccaacuugcuucuuggucaugauguuugugcaggaauagaaacccugacuaagacagauggggaaaauaucuaugguccucuuuuaccucugaccuccugagacccgugcaguacuguaucucaugcaguccauggucacugucuccuucuaaccaccaaucaaccccacugccaggcugacucuccuccgcccccccccccccccccagaucggugagcucugggaaucaaccuuccaguucaacuuccuucgaggcuggcuucaaagaugcugaccaugucggcccacaccacccugcacagauccuugcuauaucucagaccaggagguugagcuugaggauagaccggaaggcuucucugggucacaucccugaaaggccuugggacagaccugucacuaaauggaccagaagagccaaccugcagcucccaggggcagaguucaggaaugggguuggcaaggccaaggaucuucaacaagcagugugggacagggagaacagaggauggggcuuggaagccagaguuggaggaagcuguuucgaaggagacaggaaacaaggacagaggccuggggaggaggcucagcaggggcuaggaaagcaaucugggacgcaaagcaaggcugggcuuggguauaacgacagagaacuugauuuccuuauggagucuuagacgggacccuuucaagcacugggaguuucuccaggcgcggacagagcuggaucagaugggccagggguccccccuuuccugggcugggggaccgagcagaucuaagaagagcugcgggcacaggguuugaaagacucaggcccugaggaaguggggggaucccucuaggggaagacucgagggucugcgcuuuggugcaacaggcagggccuucggggguccgggauaacucugcgccaccgggucaccggggugggugggcggcgcccgcucccggccaggcugcgcgcagcugccaggguccgagcggagcgacagacuggggcgccgccccuccgggucggggggcggggcgugaggagggggcgcgcggaccccgccccgccgggagagagagaggggccagccucgcgcccccgguuccgguuccgguccggcucgcgccccucccggacacucacugauucgugccuccagagucuccggcuccaucgcgggcuccauccgccacgggcccccggccucggcgccgccccccgccccccggccgcucucgcgggaacuccucggcuccgcccucggccgguuaaaggggccgcguccaccccgcggaguaggaacgcggcaccgggacgccgggcaccaucgagacgcggguggagccgccuagagcgucgccucgucggcgccccucccccuggcggcuggcggagucgccgguggggcuggucggcggccucgcagcuccgggcgcucgggcgggagaggaagaggagagccuggggguggcgggcggcaccauagaaaccccgcgggaccgcucuaacucaguuagcgucacgcagagacccgugaccgcuuccgggacaacgcuccggagccauguuucug

SEQ ID NO: 7862 - RNA, 1745 nt, Mus musculus
uagccagggucucauguagcagaugagaauuccuaauccuccugccucauuuucccaagugcugguguuacaggcaugagccaccauguaguuuaaguuuaaauauugaaagaaucagcacagauaacaagagguaugcauaccugggcugacugacuggcucuguacgauggcuuaaagaagucauauugcuuaaggggauguguaaguucuagggagagggucacuccuucucccgggugugcaguuaccucaggaacacuccggugggggagggguuguccugcaaggcuuggcucggcauuuuugagacagugacuagucuucgugccuuuggcuuagaagggugauggucaggucaggaaggcggagggaagcgagagccugagccaaaggaaggagacagagauacaaagacaaaggcagagagggcagacucacccuuucaguaaccuuccagggcacgggaggaauccaggcuuuuuggcaagagcagcuuugaagugccuguauuaucacacacccuccgcucugcucagugaaccucccuaagucucucaugucaccccaugacccucuguagcuccccaagacccucagguaaaagacacugaaacccuuuaccuggcccacaagacccuucaugaucuuuaacgcccagcuuucuccuacaugguaagcagcucguuccccaggcacgggcuucucaucuccaagccuuugcccaguuggaaugcuggguccuuucaaaucccugcuucauaugucagucucuaccccaccauggugaguguuugcccugcucagugccagugcgguguuauuucuuaauucaacgcauagucacauucuauccaaaccgugaauucugagagcagggccugggaggggcucaucuucaugcccucugaggccagcacggagcuagacacacaguaggggcucaggaaaauaacugcuaaaugaaugggaagggauggccaagucucuucucuaaaagugggaaugagaccaagggggcacaucuggcacacccuggacugccccgaggcuugccucucaggccccggggaugucacagccaaggcacucagaacucucugcaggcccugcaguggggugaaguccaagguaugagccaaggacaccagccucaggccuggcgcccagcccaggcuuucuuuagcccuagugagcugcacugagccguagccacaguccucugcuuccggggaaagcccugguggggccugugcuuugugguccuccucaguccucccgcagaagcccacagugggagucacagcgagagccacacccuggccugccaggcggcagccucuucagagagccuugcucuaauucucugcaggcaucuauacacacaucccccucccccaccagcugcgcugggaccuaggggcuuucucccugcuggccccaggcccuaucccgccaacucuuagguuuaacucauccuuaaacuauuuuccauuggcucccccaaucucugccacagcacaaaucuuuuuuuaguggaaagagggauggagaagaauaagaggcggcgccaggacccugagggaggggcuaggagggggggucuccucucugacuggucaccucugcuccaaaauugacuuuauaauccauagacuccacuucugguggcccccauccuuguccugacaugcaauuggcugaacucccggggaggggcgggacucaccgggucugauccaguu

SEQ ID NO: 7863 - RNA, 3764 nt, Mus musculus
ucggagcgggccuggggcccgucucucggguggagucuucugacugcugguggagcaggucucaggaaucucuucgcuucagcuucaaucauggccugugugagugcgggacccucuguuccaaggucuaggggacugagcagaagcagaugggcacaggagaguagacaauuggggacuugcuucuggucccagcugugcugccuuggacagguguuuucucugguccucaguggcuacaucuguaaaauggggguggcugucacuguuccccccugaaaccuuaagcgucucuggcuuaagaauguucuggacuucucguaguucuggccgcauaccugccuugcaaaguccaguauucugcugcuuugccguuuucugagaagugggagugggaaggguguggccacccggggaaaagggaggcagggggacauuuuggccaaggccauucccuguucacucuuccucuccacucuagagucuccugaccccucccccgcugcagcuguccccagucacagggccagggcucaguuggucacccucugcuccagaaaacuaaaaaaaaaaaaaaaaaaacccucccgggccuaagauaggcuccaggcuggucaguggaggcgggucagggcugggcggaggaaacugcaugcauuugcacagacaggcaagcccucagguauaggguucaaaugucaaagaaaccccuugcccaaaugaacuccugucaacucacccagguaggugcacagcagugcccugauauguacugggcucucuagcgugcuaaguccacauugccacucucgggcugcccagucccaccgccccucagccucuccgcucccucccgauggugugcaucuaagcagagagccuugaagccgauuggggaggcaaaggcuguuuucucuaucucagagaagcaaggccuuaggcuaguggucgccuaauccuuccaucagcaaaaugaggauuuaggaagucacacuccaucuccccuccacucuaaguccaggucuccaagcugaugucuuuuagggcuuguucuguaggacagucacaaguuugacacccugcugggaaugaagucguuccccaucaacuuacacccuauccugaccagcccaucccaccucgggcuuccccuagggcuggucaggguacuccagggugggaaugaccccaucccuacaccccagcccaaugcagguaggucuaacuccaaccuaaacacagcucggugcucuugucuacacagggucuggucgccagcaaccugaaucucaaaccuggggaaugucucaaaguucggggagagguggccucggacgccaagaggugagacuggagaaaagaauggagcgggcagggggccagguucgcagauuuagguugcgaugggcguggccggccggaaccgcucauuccccagcccgcagcugguuaacgggcagcugcagaugcugcguuuucugggugagucacuuccucgcugggucuagucgacgucgccguggucucccccucccucccgccuccuuucucccggcugaaguuucuuaaacuaaagcagcugcugcuucaacgacuccggcuugccccuccccuuccgcgggggggggggcggggguggcgcgagggagcgggggagaggcguugagggaguggucacccacgugccugcugccugagggugcccugcaggggcucaaucuuuuuuccagagcuuccuccucauucauaccgccccaccgcccccccccccccgcccccagcagccaugugaguuuggaccagucacccaagcucacgaggccucgacuuuuuuuuuucuuuucuuuucuucuccgaagacagggucuccuuauauagcccuggcuagcauggaaucuguguugaccaggcuggccuccacgaagacccacaugucucgucuccccagagcugggauagaaaguguguacuuccauauuccacaccccuaagagccugggguuccuaauaaagccagagggaaagugguggaggggagagagccagggccaguuccaucaagcaggcagcugcugcugucuguugucuguuguuaguaaguuccugagcccuuucgccucuuccuaccauaccuccacggugaacaccgcuaccaggcuccgugcaacaaacuccguauucuuuuuguuaguuuguuuguuuuuuugguuuuucaagacaggguuucucuguauaguccuggcuguccuggaacucacuuuguagaccaggcuggccucgaacucagaaauccaccugccucugccucccaagugcugggauuaaaggcgugcaccaccacagccagccaaacuccauuuuuuuuuuuuuuuuuuuuugguuuuucaagacaggguuucucuguauagcccuggcuguccuggaacucacuuuguagaccaggcuggccucgaacucagaaauccgccugccuuugccucccgagugcugggauuaaaggcucaaacuccguauucuuauuuacgcuucuucuccacagugagggaaaaucuauggugugcccugcgcuguacucggcaccagggacucagauacacaagacagauaggacaccaucuggagaaucuccccucuugaccaaagggguugacaacuaucaaugucugggagagagcuccccuagugcgcacacacacaccaccaccaccaccaccaccaccaccacuguacagucagagagaaucugcagggucuagcucaguucacauggugagaccagaaguagaaucgaaguuccuggccuuccuguugcuugaguuucaacauggcauguccauagccagcugcugauguugcauuuucucagugagcuggggucuagcaccauccaacauggcugaaagcccaccuguccccccccccccuagcuuugugcugaaccugggaaaagacagcaacaaccugugccuacacuucaauccucgcuucaaugcccauggagacgccaacaccauuguguguaacaccaaggaagaugggaccuggggaaccgaacaccgggaaccugccuuccccuuccagcccgggagcaucacagagguggguggcgcugggcagggcccugggugugcugggcaauauggucagagccagaggcugaccauucccugcugugugauuacccuugaauggcaucacucucucaacauaauagaccucaccuauacagaaccuguccccggggcucugagcugguccaaggcccagcucacugcccuucuccauccaccaggugugcaucaccuuugaccaggcugaccugaccaucaagcugccagacggacaugaauucaaguuccccaaccgccucaacauggaggccaucaacuacauggcggcggauggagacuucaagauuaagugcguggccuuugagugaagccagccagccuguagcccucaauaaaggcagcugccucugcuccccauaauccagcccuuucaugggagaguguuugugugugucuaugugaggggccccgcccaaccugguccaucuucacuuccauucaugccuccauguguucuuggucucagugaccucucuugugcuuuccaggccaaagagagcccagcacagagagggcuuaagugaccacagagggugagccagugucccacugugacagggacagagcagugggagguggauggaugaacagccggaccgcauuugucuuaauaaaagccagaaaccacugagc

SEQ ID NO: 7864 - RNA, 3764 nt, Mus musculus
gcucagugguuucuggcuuuuauuaagacaaaugcgguccggcuguucauccauccaccucccacugcucugucccugucacagugggacacuggcucacccucuguggucacuuaagcccucucugugcugggcucucuuuggccuggaaagcacaagagaggucacugagaccaagaacacauggaggcaugaauggaagugaagauggaccagguugggcggggccccucacauagacacacacaaacacucucccaugaaagggcuggauuauggggagcagaggcagcugccuuuauugagggcuacaggcuggcuggcuucacucaaaggccacgcacuuaaucuugaagucuccauccgccgccauguaguugauggccuccauguugaggcgguuggggaacuugaauucauguccgucuggcagcuugauggucaggucagccuggucaaaggugaugcacaccugguggauggagaagggcagugagcugggccuuggaccagcucagagccccggggacagguucuguauaggugaggucuauuauguugagagagugaugccauucaaggguaaucacacagcagggaauggucagccucuggcucugaccauauugcccagcacacccagggcccugcccagcgccacccaccucugugaugcucccgggcuggaaggggaaggcagguucccgguguucgguuccccaggucccaucuuccuugguguuacacacaaugguguuggcgucuccaugggcauugaagcgaggauugaaguguaggcacagguuguugcugucuuuucccagguucagcacaaagcuaggggggggggggacaggugggcuuucagccauguuggauggugcuagaccccagcucacugagaaaaugcaacaucagcagcuggcuauggacaugccauguugaaacucaagcaacaggaaggccaggaacuucgauucuacuucuggucucaccaugugaacugagcuagacccugcagauucucucugacuguacaguggugguggugguggugguggugguggugugugugugcgcacuaggggagcucucucccagacauugauaguugucaaccccuuuggucaagaggggagauucuccagaugguguccuaucugucuuguguaucugagucccuggugccgaguacagcgcagggcacaccauagauuuucccucacuguggagaagaagcguaaauaagaauacggaguuugagccuuuaaucccagcacucgggaggcaaaggcaggcggauuucugaguucgaggccagccuggucuacaaagugaguuccaggacagccagggcuauacagagaaacccugucuugaaaaaccaaaaaaaaaaaaaaaaaaaaauggaguuuggcuggcugugguggugcacgccuuuaaucccagcacuugggaggcagaggcagguggauuucugaguucgaggccagccuggucuacaaagugaguuccaggacagccaggacuauacagagaaacccugucuugaaaaaccaaaaaaacaaacaaacuaacaaaaagaauacggaguuuguugcacggagccugguagcgguguucaccguggagguaugguaggaagaggcgaaagggcucaggaacuuacuaacaacagacaacagacagcagcagcugccugcuugauggaacuggcccuggcucucuccccuccaccacuuucccucuggcuuuauuaggaaccccaggcucuuagggguguggaauauggaaguacacacuuucuaucccagcucuggggagacgagacaugugggucuucguggaggccagccuggucaacacagauuccaugcuagccagggcuauauaaggagacccugucuucggagaagaaaagaaaagaaaaaaaaaagucgaggccucgugagcuugggugacugguccaaacucacauggcugcugggggcgggggggggggggcgguggggcgguaugaaugaggaggaagcucuggaaaaaagauugagccccugcagggcacccucaggcagcaggcacgugggugaccacucccucaacgccucucccccgcucccucgcgccacccccgcccccccccccgcggaaggggaggggcaagccggagucguugaagcagcagcugcuuuaguuuaagaaacuucagccgggagaaaggaggcgggagggagggggagaccacggcgacgucgacuagacccagcgaggaagugacucacccagaaaacgcagcaucugcagcugcccguuaaccagcugcgggcuggggaaugagcgguuccggccggccacgcccaucgcaaccuaaaucugcgaaccuggcccccugcccgcuccauucuuuucuccagucucaccucuuggcguccgaggccaccucuccccgaacuuugagacauuccccagguuugagauucagguugcuggcgaccagacccuguguagacaagagcaccgagcuguguuuagguuggaguuagaccuaccugcauugggcugggguguagggauggggucauucccacccuggaguacccugaccagcccuaggggaagcccgaggugggaugggcuggucaggauaggguguaaguugauggggaacgacuucauucccagcagggugucaaacuugugacuguccuacagaacaagcccuaaaagacaucagcuuggagaccuggacuuagaguggaggggagauggagugugacuuccuaaauccucauuuugcugauggaaggauuaggcgaccacuagccuaaggccuugcuucucugagauagagaaaacagccuuugccuccccaaucggcuucaaggcucucugcuuagaugcacaccaucgggagggagcggagaggcugaggggcggugggacugggcagcccgagaguggcaauguggacuuagcacgcuagagagcccaguacauaucagggcacugcugugcaccuaccugggugaguugacaggaguucauuugggcaagggguuucuuugacauuugaacccuauaccugagggcuugccugucugugcaaaugcaugcaguuuccuccgcccagcccugacccgccuccacugaccagccuggagccuaucuuaggcccgggaggguuuuuuuuuuuuuuuuuuuaguuuucuggagcagagggugaccaacugagcccuggcccugugacuggggacagcugcagcgggggaggggucaggagacucuagaguggagaggaagagugaacagggaauggccuuggccaaaaugucccccugccucccuuuuccccggguggccacacccuucccacucccacuucucagaaaacggcaaagcagcagaauacuggacuuugcaaggcagguaugcggccagaacuacgagaaguccagaacauucuuaagccagagacgcuuaagguuucaggggggaacagugacagccacccccauuuuacagauguagccacugaggaccagagaaaacaccuguccaaggcagcacagcugggaccagaagcaaguccccaauugucuacucuccugugcccaucugcuucugcucaguccccuagaccuuggaacagagggucccgcacucacacaggccaugauugaagcugaagcgaagagauuccugagaccugcuccaccagcagucagaagacuccacccgagagacgggccccaggcccgcuccga

SEQ ID NO: 7865 - RNA, 2159 nt, Mus musculus
cagacgcaagugcggcugccggggacgcgggcuacgcguggcuccuguccucccggcgcgggucgcgagcugcucugcgcucccagcccccaccguucggucgcucgcccggcgccuggcgcugccuccgccuccacagccucccuuuucccagcucugcgucuggcgcucgggcggcgcauccggguauuuagcggcggcgggcggaccgcggugaggacugggcugcuggcugccugcucccggcccggaauggcgccgcgcugccgccaucuguguuucuuccgccgagcaaacucgaccuuucccggcggcccgggccuucccgcugcccgccgucucucgaggucucugcccggcucccuaggcuucccuucuggggacccuggcgccccggccgccgccccccgcgcccgccacgagccucaaacggcgccgaggagcgcuggggcgccggcacauuuccccuuugcggggggcuggcucugcggagccggggagccccggggcuugagaccccccgucggaaagcuccccccugggacuaccaggagccccacucccggaugccugcggggucccccaaccuggcggagcggcucagaagcggccccaacuaacacacgcggcccugagcugggcgacucccagccgggccgagucgggacaaggggggaggggucgccuccccaggguccggucaccucucgggggucacccgaccacagcuccucugacaccccuacccccucucugccugcgaggcccucaaggaaacuuucccugaaagaguuggaagggcacuuucaaacuuugucccuucccccucuugagucgccuucuccccucgaugcacccccggaccucggcgaguugauugcucucugagcccgagccccccaaagcuuccugggaccccuggaagaugcggacaagccucccgggcggccugcucuccucaaagaccccccacaucucccauguaucugaguaugaguucauuuacaugccugccuuguuagcuagggaguuuuggggauguaagaagcaggaccaccaccccccaggcccacccuaggggugaagguccccucucccacuggccucuucaaggugggguguggcuugaugugugugcagucucuaucauaggugcuguccaauggcucugaucagacauccuggggacccuuaggaugcgcagaggcuccuugugcuuuuagagacuuggaaaaauggggcgcagcgggagaagccgaggagagaguucuccuuucccuggucgugacuuagguguaggagguuugcaguccaccagggagccguggucccgaccaccgccauuuugcugggaagaugccaugucuuuguuaaaauguauccaucuuucccgcccugcuuggcaaaaauccaccaagugagcaaggggcgccaccaucuguaguccgaccuggggcuguugggaguccuaggcuccgagagaguuuagaggcuccgagauuugccgaagagacccccagagagcccagaaccucuugucugcugcagacauccuacucacaauguuaggaccucuuggcagcggcuccguaggguucuggugguauugccuaccugagcuggauccccggacccugguguuuuuauucccuagcaaaaaggcacgaaaguguuuaauuaaacauuaaccugggaguggggaauuguagcugaucaagaugaacuaaccucugcuaaggccuggggcuguuugucacaccagaaggagcagcuuagaugagggagcuuugaauuugggggagauguggggaaaggguuacugggcuugggagucccugagaccaggcacacacacacacuauagguuaauccaaaugauuggaggggaaggccaggugccuucauuacuagcuuaucugggugaagggauugcuguuugaggccagguuaguucaaaggucgagguuuuuaacucuggugcuuucagugacccugaaguuuccuaauuugaaaacacauucuaguagguuuguuugggauauuuugaaaacagauucuccugguuuccacaaagauuuuauggagaagguacccaaaugcaccucugagauacuacuguacaaugcccucccccgcgaauacaaaugaaacggaucaca

SEQ ID NO: 7866 - RNA, 2295 nt, Mus musculus
cggcggccggggcgccaggguccccagaagggaagccuagggagccgggcagagaccucgagagacggcgggcagcgggaaggcccgggccgccgggaaaggucgaguuugcucggcggaagaaacacagauggcggcagcgcggcgccauuccgggccgggagcaggcagccagcagcccaguccucaccgcgguccgcccgccgccgcuaaauacccggaugcgccgcccgagcgccagacgcagagcugggaaaagggaggcuguggaggcggaggcagcgccaggcgccgggcgagcgaccgaacggugggggcugggagcgcagagcagcucgcgacccgcgccgggaggacaggagccacgcguagcccgcguccccggcagccgcacuugcgucuggccugcuaguggagcgggagagcagaucgcgagucagguucugcacagccuccggcgagggcuggcccaucggaaggcuccuugaacagugggagcaggccggccaccaugaccgagaacuccaccuccgccccggcggcgaagcccaaacgggccaaggcuuccaagaaguccacggaccaccccaaguauucagacaugaucguggcugcuauccaggcagagaagaaccgugccggcuccucgcgccaguccauccaaaaguauaucaagagccacuacaaggugggugagaacgccgacucccagaucaaguuguccaucaagcgccuagugaccaccgguguucucaagcaaaccaaaggggugggcgccucgggguccuucaggcuggccaagggcgaugagcccaaaaggucgguggcuuucaagaagaccaagaaggaagucaagaaaguggccacuccaaagaaggcagccaagcccaagaaggcugccuccaaagccccaagcaagaaacccaaagccaccccugucaagaaggccaagaagaagccggcugccacgcccaagaaagccaaaaagcccaagguugucaaagucaaaccagucaaggccuccaaacccaagaaggccaaaaccgugaagcccaaagccaagucgagugccaagagggccagcaagaagaagugaagacuuugcuuggggacacuccuuccucccuccuguuuucuguaaauacauuuccucacuugauuccaucugcaacccuuugcccauucuauucugacuuuauuaaagaggacagaguuuggaucccucauacagacauuguggaaugacuccuuuuuccuuaaccuauugugcaaggacagcaaacagaccucaucuuuguaaugauggagacguacuuuuuucuugauuugauauuaaccuucuuacgggguuagggaugggaggggggaggauguguguuucagucggugguuuguuuacuaugaaggaacuggcaaaguucuggcuaggugaggggacccaggaacuaagguuugucuuccaagacuuucuuagacugcuugucccucgugagcuuuucaaaaccuuugauggggagcaggugacaccccaccuagcuggccaaggagggagggaaaauucccuggggcugcccuaccaacggugguaaguuggagaccugguugcuuuuucucuucugcccuagugccuccccauugucuaaaggggcaaagggguccaagugacagcugguuagagaagccauagcuucucacaaccaggaucuagccauugggaaggaggggucuuuuucaguagucucugguuaaaugcgaguggacuuagggggagggguggguaaucagccaagugccucagugugccuauggaaacuuggguuuuuuccacacgauugauggauugcguccuagcaggacuuuguacguuuccuuucuucccuuuccuguguaagauguggcuuugcuuggugccgcuucaggucuaccagcugccacuuaaaacccuccaaccucuuuuacucuuugaguuuuuuuucuaaguagcggaggagggggagaggcagggaguggacuguaagacauacuccaguugauucgaauuugcuagguagcuuuagagaggcaggauugugugcauguguguauauguauauauccauaucuaagacuaggacuuagucucacuucgggagcugggagaaaaaaaucuguacaguugucuuucucuuauuuuaauaaaauuagaaacucgcgcacccuaccccaccccuuuuuaaacaaguguaacuagugcccgggagaaauuacugugguuguaauuuuaaaacuuuaaaauaaaacuggaaaggaaaaaau

SEQ ID NO: 7867 - RNA, 2295 nt, Mus musculus
auuuuuuccuuuccaguuuuauuuuaaaguuuuaaaauuacaaccacaguaauuucucccgggcacuaguuacacuuguuuaaaaaggggugggguagggugcgcgaguuucuaauuuuauuaaaauaagagaaagacaacuguacagauuuuuuucucccagcucccgaagugagacuaaguccuagucuuagauauggauauauacauauacacacaugcacacaauccugccucucuaaagcuaccuagcaaauucgaaucaacuggaguaugucuuacaguccacucccugccucucccccuccuccgcuacuuagaaaaaaaacucaaagaguaaaagagguuggaggguuuuaaguggcagcugguagaccugaagcggcaccaagcaaagccacaucuuacacaggaaagggaagaaaggaaacguacaaaguccugcuaggacgcaauccaucaaucguguggaaaaaacccaaguuuccauaggcacacugaggcacuuggcugauuacccaccccucccccuaaguccacucgcauuuaaccagagacuacugaaaaagaccccuccuucccaauggcuagauccugguugugagaagcuauggcuucucuaaccagcugucacuuggaccccuuugccccuuuagacaauggggaggcacuagggcagaagagaaaaagcaaccaggucuccaacuuaccaccguugguagggcagccccagggaauuuucccucccuccuuggccagcuagguggggugucaccugcuccccaucaaagguuuugaaaagcucacgagggacaagcagucuaagaaagucuuggaagacaaaccuuaguuccuggguccccucaccuagccagaacuuugccaguuccuucauaguaaacaaaccaccgacugaaacacacauccuccccccucccaucccuaaccccguaagaagguuaauaucaaaucaagaaaaaaguacgucuccaucauuacaaagaugaggucuguuugcuguccuugcacaauagguuaaggaaaaaggagucauuccacaaugucuguaugagggauccaaacucuguccucuuuaauaaagucagaauagaaugggcaaaggguugcagauggaaucaagugaggaaauguauuuacagaaaacaggagggaggaaggaguguccccaagcaaagucuucacuucuucuugcuggcccucuuggcacucgacuuggcuuugggcuucacgguuuuggccuucuuggguuuggaggccuugacugguuugacuuugacaaccuugggcuuuuuggcuuucuugggcguggcagccggcuucuucuuggccuucuugacagggguggcuuuggguuucuugcuuggggcuuuggaggcagccuucuugggcuuggcugccuucuuuggaguggccacuuucuugacuuccuucuuggucuucuugaaagccaccgaccuuuugggcucaucgcccuuggccagccugaaggaccccgaggcgcccaccccuuugguuugcuugagaacaccgguggucacuaggcgcuugauggacaacuugaucugggagucggcguucucacccaccuuguaguggcucuugauauacuuuuggauggacuggcgcgaggagccggcacgguucuucucugccuggauagcagccacgaucaugucugaauacuuggggugguccguggacuucuuggaagccuuggcccguuugggcuucgccgccggggcggagguggaguucucggucaugguggccggccugcucccacuguucaaggagccuuccgaugggccagcccucgccggaggcugugcagaaccugacucgcgaucugcucucccgcuccacuagcaggccagacgcaagugcggcugccggggacgcgggcuacgcguggcuccuguccucccggcgcgggucgcgagcugcucugcgcucccagcccccaccguucggucgcucgcccggcgccuggcgcugccuccgccuccacagccucccuuuucccagcucugcgucuggcgcucgggcggcgcauccggguauuuagcggcggcgggcggaccgcggugaggacugggcugcuggcugccugcucccggcccggaauggcgccgcgcugccgccaucuguguuucuuccgccgagcaaacucgaccuuucccggcggcccgggccuucccgcugcccgccgucucucgaggucucugcccggcucccuaggcuucccuucuggggacccuggcgccccggccgccg

SEQ ID NO: 7868 - RNA, 896 nt, Mus musculus
uguguuucagucggugguuuguuuacuaugaaggaacuggcaaaguucuggcuaggugaggggacccaggaacuaagguuugucuuccaagacuuucuuagacugcuugucccucgugagcuuuucaaaaccuuugauggggagcaggugacaccccaccuagcuggccaaggagggagggaaaauucccuggggcugcccuaccaacggugguaaguuggagaccugguugcuuuuucucuucugcccuagugccuccccauugucuaaaggggcaaagggguccaagugacagcugguuagagaagccauagcuucucacaaccaggaucuagccauugggaaggaggggucuuuuucaguagucucugguuaaaugcgaguggacuuagggggagggguggguaaucagccaagugccucagugugccuauggaaacuuggguuuuuuccacacgauugauggauugcguccuagcaggacuuuguacguuuccuuucuucccuuuccuguguaagauguggcuuugcuuggugccgcuucaggucuaccagcugccacuuaaaacccuccaaccucuuuuacucuuugaguuuuuuuucuaaguagcggaggagggggagaggcagggaguggacuguaagacauacuccaguugauucgaauuugcuagguagcuuuagagaggcaggauugugugcauguguguauauguauauauccauaucuaagacuaggacuuagucucacuucgggagcugggagaaaaaaaucuguacaguugucuuucucuuauuuuaauaaaauuagaaacucgcgcacccuaccccaccccuuuuuaaacaaguguaacuagugcccgggagaaauuacugugguuguaauuuuaaaacuu

SEQ ID NO: 7869 - RNA, 12687 nt, Mus musculus
cgucacgugacggggagcacuagacuucaggcuggccagcgcacuuuagccugugggcgcgaugugggccagcuucauguggcacggggcgcuguccccuggccgccgcgcacauucagcgcuggcucaguugcgcugcauccuggacagcgaacuggaagggauccgcggagccggcaccuggaagagugagcgugugaucacgucccgccagggaccgagcauccgcguggacggcaucucgggagguaacuuccccuccugagaguccucguaccuggucaggaggccaagagcccuuccaaggcuugcaugugaauggaggcccuagggugggugugggagaggcacgugcacucuuagcugcuggucugucuggggcacacuauggccuccuuguguuaacuccaccuguuuaaaccuguuucaaaggagggaggugauuuuaauccgucagcaccuuuugggugagagagcuaggcugcacugagaccccacccuaugagaaaaagagagcgauauccagcugccucagcucccuacaccuaguuuccaggaggagugacuggaacaaaacuuuccuugagcagaugugugugaagggcuccaguugcugcaccuuuacucaugauggcaucuguaugcaagagggaccauucccccccccccccuugguuuuuugagacaggguuucucuguguaguccuggcuguccuggaaccugcucuguagaccaggcuagccucagccuccaaauugaucucagcauccaaauugcugagaucaaagacauacagcaccaagccugguuugagagaccaauuuuuagggaaaggaaauaugcuguuaucccagcauucaggucuauacagagaaacccugucucaaaaaacauaaauaaauaagaaaggaagaaggugaaauacaaguagauuuccccagacccuucacuggucagcuccagugucccaggauauuggaguggaagaccagcuuccucccaagaggcuaaagucuuuuuuuuuuuaagauuuauuuauuauuauauguaaauacacuguagcugucuucagacacuccagaagagggagucagauuuuguuacagaugguugugagccaccaugugguugcugggauuugaacucuggaccuucggaagagcagucgggugcucuuacccacugagccaucucaccagccaugaggcuaaagucuuaagcaaguaaggggacuaaggcugcagaaguucucaugccuguaccugucuuucccuaaagagaaccauaaaaugaaccucuugucuucuaacaauaccuucagccggaccaaacagcucucccggagugauuucagagagauauauaaucaguagguuggggauguggcucaguggcagagcgcuuacccagcucacaugaggcuguggguucaauucccagcacucacaccacacacaaaugaugagacauugggagaaucaaguucguaggcuauguguuuacuuuuacuuuaugugcauugguguguuugucuacauguaugucuuugugagggugucagauauuggaguuaaagacauuugugagcugucguguacgugcugggaauuaaaccccgguccucuggaagagcacucagugcucuuaaccgaugagccaucucuccagccccaccuuauuagcuuuuuaagccauggauagcugaggucucugggacaccccucuggagaugcagugcuauggcagcagauguauggucauuggaacuggaggacccaggccccuuugacaaucaagaaaaggaaaaccgagaugaucauaguccugaggcugcagaaaugugaggaaggucugggauccccuuagauggaaugucauucaaagccaggguuuaaacuucucauccuucaagguacaaagcagagagggacaaaccucuuauaauccuccuguguacauguauaauccauguacuguggcaguggauucaaagccuggccucucccuagaaugggaucuuuugugcagcuguugccucucaaggacaaauccaaguagacuuccucuggcccugucccaggaccuagcguauggucuuugcagguucuuccuauucuuuuuuuucuucuucuuccuccuccuucucccccccccccccccccccguuuacucuguccagagauccaccugccucugucuccugugugcugggauuaaaggggugugucuuagucaggguuucuauuccuauuccugcacaaacaucaugaccaagaagcaaguuggggaggaaaggguuuauucagcuuacacuuccauacugcuguucaucaccaaggaagucaggacuggaacucaagcaggucaggaagcaggagcugaugcagaggcgauggagggauauucuuuacuggcuugcuuccccuggcuuacuuagccugcucucuuauagaaccaagacuaccagcccagagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaggacagggugcaucaccaagucugguuuuccuuccuugcauuucuucuuccuuuucaucucuucucucucucuuucuuucuuucuuccuuucuuucuuucuuucuuucuuucuuucuuucuuucuuucuuucuuucuuucuuucugucucucucucucucccuuccuuccuuccuuccugucuuucuuucuuccuuccuuucuuuuuugagucaggguuuuucuguguagcccuggcuguccuagaacuugcucuguagaccaggcuagccucaaaaucagagggaugccucugccucugccucugccucugccucugccucccaguuacagagaugugccugccucugcccucugagugcugggauuaaggccacgggccacuaugcccagcccucuuugcauuucuaagcugcaugcuuggucuucuccaccuuaggaauccucaacuucugugccaauaacuaccugggccugagcagccacccugcagugauccaggcaggucugcagacucuggaggaguuuggagcuggacucaguucuacucgauuuaucugugggacccagguauacauaggguguugggugggcacuggcuucgacugucuguguguucagccaauguaacuagucccaaggcagggcccacugucagccccagaguuucagugcuaccaggcuggggcaggccuauucugagaagccugggaccaggaaugugaccucugagcuuccguuuccccaccuguccccaccuguaggacagacagagcgccugcaauggccaugcugcaggaaagggacaaaagguagagcuggagcucugucugcagaaugucuaguagucgcugugccuccgaaggugguagccuucuuuuugguucuuugagagaggguuucucugugcaacaacccguggcuaaccaggaacucacucuguagaccaggcuggccucgaauuccuggacuuccaccugccucugccuucuaagugcugugugcugugccggcauuaaaggugugggccaccaugccuggccauauauuuucuaacaaaacucuuguguugaaccaaacagcucccaaaucucagugguggagccccagauaagcauaagcucacuucgugugauccucuuguuugcuguggagaaaccaaagacagucugaugugaaggcaugucuucuguccccagcaucacucagaauccuaauacuagacagaccuccacugcaggcaaagguccgcucgggaucggaccugccagaucccagccuccaaaguggaaguagcugcgacaguccaaggcucccaagagucaucugugccaagagcaaugcaauguguggcugaggcuauaggcuuccuucauggggucuggugauggccaucuaagccucuguccucuaggacuugucccgcaaagccugcuggcacugauuuuaaccugccuguguccuuuagagcauccauaagaaucuagaagccaagauagcccacuuccaccagcgugaggacgccauccucuaucccagcuguuucgaugccaacgcuggccuauuugagguguguagaggcugugggcagcuuggaguugggcaucugggagagcuaaccuauguaaacuggaaggcaggggugacaggagccugguacuuuuucaucuggcccuaggcaccugguagagguagaguuuugccucgaggggaguuaugagggaagggauacuucugggggcuauauaagaacuccuccccauaggcuuugcugaccccagaggaugcgguucugucagaugagcugaaccaugcuuccaucauugacggcauccgacugugcaaggcccacaaguaccguuaccgccaccuggacauggcugaccuggaagccaagcugaaggaggcucagguggggugaggcccuggggcuccagagaaaggccuacauuucccugcucgaggaaacgaaacuuggaagcauuaccccuuuuccaaagagcuggaagagcagagggagccauuuugacuuccucaucccuuaugcccaagacuugucugucgcuccauuucaccugaggucaggaagcaucuuuuaagcaggugugucuaggaccuguccccacuccagcuuguccacuugaggucugagcccuuucucagggacaggccuaaaguggcuaagccuagcagagaugagcaaggcccaggacagggccucaaggcugccaaagagcaggugcucugguccuacaccguaucaucugcccuucucugucccacagaagcacaggcugcgccugguggccacagauggagcuuucuccauggauggugacaucgcuccccuacaggacaucugccgccuugccgcccaauauggugcccuggucuuuguggaugaaugccaugccacuggcuuucuugggcccacaggacggugggaacauuugagggcugggugggggcuucugcaggugggugggaaguccgguggccagugacaacagugguuacuuucuuugcaggggcacagaugagcugcuaggugucauggaccaggucaccaucaucaacuccacccuggggaaggcgcuggguggagcaucaggugccuacagaauccuaucuaugggcucuccuuccccacacgcagggccugccucaucgcuguagagaaaguagggacaggagucagagaggaggacgguaugaacuauagggguucaggcgguuccuggccucucuucaacuuuuuuuucuuucuguuuucagggggauauaccaccgggccugagccacuggugucccugcuacggcagcguucucggcccuaccucuucuccaacagccugcccccugcuguagucggcugugcuucuaaggcccuggaccugcucauggagagcaaugccaucauccagucuauggcugccaagacccggcgguauggugcccacaggguuggaucagagagagggagagaugguagccacgcaccuuucugccuccuccugucugcuuccuuuccuucccacccucucugccagagcauccuccuucagucucuaaugcccucucuugauacagcuacuuccccaccucccuuuguccuuccagccccugcuugugccucaccugcucuuugggccuguaugucuaucuuuuuuuuccuuccucuaaccagugggcauagacccugagccucuuccucaggcucuauggccuucagcucccugugacacucagcuguguccccagguuccgcaguaagauggaagcugcugguuuuacugucucaggagccgaucaccccaucugcccugugaugcugggagaugcacgguugucuucucaaauggcagaugacauguuaaagaaagguaagaggauugggggcagaguuguccucagagaaaagaacaccuguaaacuguagcuccucccuacauccacgcccugcuccuugcugcccacaucuccuuagaucagccaucauccagacuuaacaaaccacaggcuaugagguggucucaugccugucagcuuaggcaucccuuguucuugcggguggaccaugggacagcaggcccuuauaugucauagccccaaagccugucugccucugguguaccccugcuguuuucccagguaucuuugucaucggauuuagcuacccuguggucccuaagggcaaggcccggauccgggugcagaucucagcuguacacagugaggaagacauugaccgcuguguggaagccuucguggagguggggcggcugcauggagcucugcccuaagcucuugguagggaccugcagagccaaaguuccuccacugccgcugacauagggcuccucuggucagcccagaucagaggcugugacucaacccagacuucuagagccugguugaaaaugggccuguacuugucaucagagagacaacaauguggaauuuggcuaugacacuucagucugcuuuauucuggguaggcguaccucuggcuaccugaagaaccaggcaggggcuggaucucgcaugaggugcaucuucccccaaacuaagucgggaugcugugucugggagccaccguuucguacauaaagcauucugugcugcugugcagggcaguggagaaccagcccuguggacccuuucugcagccuaagcugggugggcaccuugucuccugugcccuagcagaaggauaaaauguaacugccaaaugagaauuguuccuagaccuguguucccuaggagagggcagagguucaggccccagaaagaagaaagcagaucaccccugaaggacaucgaauccuuguuuuccagagcucuuuguccuuaaccccguggccuuaggccccugugcaggucccaguuuccccccacuuuagagagcugauguuccauagggacaccuuucugucucugauucaaaagccgauagucugucugaugguucagccgccagggggcgcagcgcguucacgcugccgccgcuggcuacuugggggccuuggaucaggcuguugggcagcccucaagccaggccagaagggcugguuugcugcuacgaaggcccuguccuucuacccugucuuccuaccggcaaccaucacaccugcugcuccauuaccauagguguggccuccuucccauuuugcugaccuugcuuuacugugggaaaggagggguggaaucucgcaggcucagccccgcaggcuuaugacugcugcuguaggcucaguguggggguguggccuuggguagcucccuagcuaucuagaaguagaacguggcaggcaaguaggacuuacgguuucauuaaaaaaacaacaaugcaaaaccaaaaacagaaagugaggcaccugccucuuccuccagcucacuugccuaguaucugaacagcuugggacggucagagcaagcuccaaccuaaccuugcagauucuuaaagcugggguuccgagaauccuccuuugcaacccgguagugcugaaagggucgcagccuggcaggaggcagcuguggcuacgucguucugaaauacaaagcgaugguggugguaguuagggaguccccggugggcccaugccaaagugucccccugagaaaucacagcacgcaacagaccugauauaagaaaguuuauuguggaggaagggagccucagaaaccuggaaaagggauagaggcagagaaagggggaacagaaugagagaggccggcuaggaacacauggaaacagagaaaaagaaauugggggauaaagagaaggaggggcuggguggggagccauccuccuuauacccugccacaucuggcaggcuaugguggcaggugaugaugcaagccuucgcuaggucgcuguugggaggagccuaauggaacuguaagccaauaacaucaagagcagaaacaccugcaggcuaccccagcaagucgggcaccugaugccagguaccccaguuugauguauguguccugugcaggcugauagcucaugcccagggaccaagagcagccacuaggugguguggguggcauacccagccagguccagaauaccaggccuggggcccacccacaccuacgcuagacugccacccagcggcacagugggagagccaccuccugcagcucccaggcacugcugcaggcauugucugucaggaggcgguuccuguagcaguugcaccaugaccucccaggccaguuggccucaguguuaacuccaugcugucaugcagcguggggcucagcaagcccgcugauccaggaucgguucucucaccuugcaacucgucugccauccagaagggguccuagaaggugcccaguaggcacagcaugugauccagagugggcauauaccaauagucuuugggcuucuguggcaagccaaaaggcauuggaagaccagaagaccagcuucggaucaacccuaagggaagggaggagguggugguaaggacaccccgaggcuccagccaugauggucuguccucccugccccacagccaggcucucugauugccucccuucccuucucuccuccacuacuguaccagcucagcccugcugcuucucagaacccucuacacggguacuuugagcccaaccccagcagggaaggagagaguuauagaggccgggccaguggggguguuccaagagguaauagaauccaccuacgucugggacucuagguauggauauguggauucacacuucuggaagucuacugcguugccgcccuugauuuucaaaaucucacaucaagucuagagaccuacaagggaucuaaagagcccuccuuucugaucaccggcgccagagguugugaaagucagcuuugcggcuucuaggucugauuccuaauagcuccauccagugagccucuugugagugggguuggugacacuagagaggccccgcaagcacugguaacugcauaggggggcuucccacaggaacuggucuugaguguugcccagaucuuccaguccuagcuccauggggcacucgucucugaugugcccuccaccuuccgguucuggaaggauucuucuccuccccagcucucugcccuugauacauacgguuguccaauauccagucucuugguuggcaagucuagugccccucccuccccaaguggcagcugcucuaccccuggaagcccauaggccacuccucccagggcucaugccuaccauucagcaacaucugguuugugccugggcaagaggcccucaggugaauuaagugcaaauccucucuccuuucucaucucagccauaacaaacuucuuacaagauggaaaggcacaggucauguucucccucuggaaccuuccuagcuucccuguggcuuucaggcuaaaucaagaccuggcuuccagucgaugaagccccuuaaacuagcuuagggaaugaaaugggucuugugauuccuaccugaaguccacaacaaagagcuuuugguccugguuucccagccuuggaaacuccauuuaaaaauagaaauccuuucugagcuuagaucagaguucuacuuggagccaaggaagcuaaggcacuaggggggaggagucacaggccacaggaggugggaggugccaggaaugggcugagcccugggcaggaaaggguuaaccacggaagccaaucuccuagagcggagaucaguggguuacugcccgugaaagcgagaaugagguggcaacaacgcagacaggcagagaagagcggcgcugaagagcaugccaccccggggaaaucgggggucugaggaggagguggccaguccacuccggagcaguagcgagugcccaacauccaacucagcggacagcugagggcaggggagaggagaggaggggccuugaaaaugaagagagagaaauaggaagcagaggcguaccugcauggaggcaaucaagggcugaaacaagaagcuccagccuggccguucuaccaggaagcaugcaggggcccagugccuagggcugaggugggugccgccuauccugggcuugggggcuuacugcuuguaggugcuguguaggggcagaugucccccuucuucuguccucccugccuccugaaccccugcuccuaagucaucucacugcugcacugggucccugagcacaaggggacccacagguuguaaacugcggcucaggguaggguugacaccaggcaaugugcgcacaggcacgugcauggggacacaugugaacagucggguagcaccuguugcaguuuuuccgaugcgcauuccagccuaggagucaggaucccagcagccccagagcugucacucagguugugauauuagccacuugugucaccucucuaggccucaguuucccuacgugcagagcggaggcggugacuucuguggucuuccuagcucugcugcuguagugcucucaugaggaaggacucuucauugacucagggguguuaccggugccgccuguugccacaaaaaugccccuaaauucaaaggucuccccugagcguccaaugugguugaaaaagaaaauauagccaguuuguguugccucucagcggccucggcaucuucuuauucugccugugucuucaugugccuuauaaaucuagaauaacccaaacagccuuccagguucuggguuaaagagguguucccuaggaaaccaaggaucagcgugugugugugugugugugugugugugugugugugugugugacacacacaaccaaugugacugucucacaugcugacuuuggcuuuguucuacccucuucuguccuucaugaacuucuagcccagauaccuggucagauccaggcugaaagaaccagauuccugggucaagugccuugagaccuggccuccugucugaagacccguuuucucuuccucguuugcuaggaaaauggcugacauccagaacauuucgcuggacagcccagggagcguaggggcuguggcagugccgguggucuuugcccucaucuuccuguugggcaugguggguaaugggcugguguuggccgugcuucugcagccuggcccaagugccuggcaggaaccgggcaguaccacggaucucuucauccucaacuuggcgguggccgaccuuugcuucauccugugcugcgugcccuuccaggcggccaucuacacacuggaugccuggcucuuuggggcuuucgugugcaagacgguacaucugcucaucuaccucaccauguaugccagcagcuucacccuggcggccgucucaguggauaggugagcuguaccugggucaggccagagagggaccuggacagauucuuauuagcuagcggaauauaacuagggaccagacuuuggugggaggaaaggaaggccuuaguggcaccugcccuuccggccuccaguguggacuuccagagggcauuucuaagccccaaagugucagcgcagggggccagguauaaauuggaauuguguaguaacaaaagaaacucccaauacacucgucagaugcuaagguaccuauaccugacucacauugccucacauuuauccauggcuugaaauucccuagacgaugagucucuucucuuugagcccuugcuaaauggcaggcaaagggauuggauggggaaauuaaggcaggcacgggggcgggcucucaggaggccccgccccugaccuccccgcccucacccgcagguaccuggcggugcgacacccgcugcgcucccgggcccuccgcaccccgcgcaacgcgcgcgccgccguggggcucguguggcugcuggcggcgcucuuuuccgcgcccuaccuaagcuacuacggcacggugcgcuacggcgcgcucgagcucugcgugcccgccugggaggacgcgcggcggcgcgcgcuggacguggccaccuucgccgcaggcuaccugcugccggugaccguggugagccuggccuacggacgcacgcugugcuuccugugggccgccgugggucccgcgggugcggcggcggcagaggcacgcagacgggcaaccggccgcgcggggcgcgccaugcugacgguggccgcgcucuacgcacucugcuggggcccgcaccacgcgcucauccucugcuucugguacggccgcuucgccuucagcccggccaccuacgccugucgucuggcuucgcacugccucgccuacgccaacuccugccucaacccgcucgucuauucccuugccucccgccacuuccgcgcgcgcuuccgccgccuguggcccugcggccaccgccgccaccgccaccaccaccaccgccuucaucgagcccuccgucguguccagccggcgucuucgggccccgccggcuaucccggcgacgccagaccucgcgguuggaguauggagcccagaggggaugccuugcgcgguggagagacuagacuaacccuguccgccaggggaccgcaauaacccugccugcuuagacucugacagcugucggucugucuucuucccugggcaguagaaugucaccaaggagcaucuagggcauggca

SEQ ID NO: 7870 - RNA, 10870 nt, Mus musculus
gcaaugacucgcccuaguuacgcuucgcaauccggaccucucaucacgagcaaccugggagucugagaagcuggugcccgaccccucggcuccggacagcgcagugaccacagucccuaucgugacgguccggggaggagcgcucaccuuaggcgaugaccugggcgugacagagcccuccgcacggagaaacuccaaggagcuagagugucagcguccucacuaaucgcuccuuguuaccaugguaacuagcgacacgccuccacgcacgcgcauuagcgucuggucggccgcugcuucccggaaguaacugcgccugggucacggcgcaagcgcaaacuacgcguggugcggcgaggggcaaaggcgcgcguucucugcucugcgccccgggcggagaaggcaucaugucagacaacgaggacaagugagcacgggccacggaaggagggaggucguggugcgagcagggcucuuggagcacaggcuagcccagcugcuggguugguggggcgaagucuucagaacuuccuaccucgcggagcaauggggacaguggucagagaguucaguccguguggccccuguccucugagcgcucucuuucuggaagggaaugccagagguguguagcuuguguagucguggaaguaggaaggaaaaagcaacccagagaauggccuggaaggcugggagcagacgcgggcuugggcuaggugugauaguagcagagguggcagaaguggggauagacucuagagagcaugaaguuuaguguuguuugaggcaaggccucacucugaaacccaggcugcccgggaauucacuauauagcuaaggcuggcuuugaauucgacacaguccucugcuucagcuucccaaguguugauauaucuggcaugaaccaccagacccagcuggauuauggacauuuuuuuuuuuuuuuuccgagacaggguuucucuguauagcccaggcuguccuggaacucacuuuuguagaucaggcugaacucaggaauucacccaccucugccuccccaagugcugggauuaaaggcgugcgccaccaccacccggcuggacauauuuuuauuuuauuuauuuggagaccaaauauaaccuuauaucaggugguucgaacauagagauucaucuaccucugcuuuccaggugauuuuuguucuuuuuuuuuuuuuuuuuuccugagacagagucuuucaacauaguccuagcugugucuggaagucacuguguagauuuggcuguccucaaacuuacagagaucugccugcuuucaccuccugagcacuggauuacaggcgugcgccaccaugccuggauccugauauauuuuaaagauagaaccuaaaggauuucuugauacgcuguauauguuaaucaagagagaagaugaacuaugguaguccugauagaucagucagaauucagagucugggcguggugguucacaccuguaauccuagcacuugggaggcuacugcaggggaauuguccugaacuagaugucaacauagugagucucaggccagccugaguuacauacugugcaguaagauugacuucaaaacaagcauacaaaauacagucaaaaaugcaaugaaagcagagaugacggcguugaccagggcagugauugccaccagagaagagauggugagugagugacuuggggggaagagaacccagaaaagcauccccucccccagagugggaggcaggagggaggagccagguaugcuggcuguccaggggaaggguucagcauuguaaagauccuuagugaagcuggggguggugcaagccuuugauuccagcacucagggcagagacuugggggggggggggggaaucucucaguuccaggccagccuugucugcagagugaguuccaggccagccuugucugcagagugaguuccaggacagccaggcagcacaaagagacacuuuucuuuuuuuuuuuuuuuuuuuuuuuaaagauuuauuuauuuauuacauguaaguacacuguagcugucuucagacacaccagaagagggcgucagauuucguuacagaugguugugagccaccaugugguugcugggauuugaacucuggaccuuuggaagaacagucgggugcucuuacccacugagccaucucaccagccccuuuuuuuuuuaaagauuuauuuauuuacuauauguaaguacacuguaguugucuucagauacaccagaagagggcaccagaucucauuacgggugguugugagccaccaugugguugcugggauuugaacuucagaccuucggaagagcagucgggugcccuuacccacugagccaucucaccagcccaaagagacacuuuucaauggggagguuguggggugcgaugaucagugagcacaggaaggauggcuguggagcuugaggguguggcgaaagccuuacugaggugaggcucugacucgggaagugaagaauuggagacagcgaguuugggcagcucccucagacauugugcaccacgggaggcugaugagauggaggaggggcuaaaggugaaaguuuugcugcccgagccuaacaaccuagguuugaucccuagagccccugguagaaggagagaacagaaaagggagucuuggugguguaugugggccuguacgcgagcacgcaucaugugcacguuagcaauaaauaagcauguuuuuagaagccuggugaccuuaggcuaugaaaauggcaaugucaccuuggucuuauguaguuuuguuuguuuguuuguuuguuuguuuucuccaccauaagggaauauggaauuaagcuguagcaggaggggaaagaauaaugguguguuguuuguuuguuuuuaagagggggaggugaugcugguagugugcuggugcugugagugccagcggcuucaugcaugcugucuacacacccuacuuuugaguuacagcuccagcccugaaguacacuucacuuguuuuuguucuugagacaaaaucucacuauguagcccaggcugggcucaaacuccuaguucucucacuucccauuuccaaaugcuaggaguacaggagugugcuaccacccuggcacguuuauauuucucuccuuauguccuuaugagaggcugaaacugucuucaugacgagggggauggcgcagagguuaaccacacuuggcugguuucccagggaguaaaaccaggcagacaacuccggcuucgggggcucccacacccucuucuggcuuccaggcgcacuuguauguguguacauuuacauacacaaacacacagauaaaauaaaccuuaaacacacaguccccggaccagaacaguccauguguacauguaacuggcgugguucacagagaaggaaaccacagugaagguguccuagcaaacuguggggacacauggcacaugauuggaggcacagagugacccuccagaguuugguucccuuguugagauuugccggccccuuguccgacacugcugagacaugggcuguaucucugguucuggccggugaugcucuaaccaccaguuucuucuggcaguuucgacggcgacgacuuugaugacguugaggaggacgaaggacuugacgacuuggaaaaugcugaggaggucaguagccagccucggccucugcccugcagcccggacaagggacgggcagcguucaccaagggcuuucccuguucacuuuccaggaaugcaauuccauggaucugcuccgggccuuugucugagugccaccucaacuaggucuugggauaaucgugucgucuuauguaugguuugguggugguggaucuuaguauagagccuggaacuuacuauuuaagccagacuggcuuguagcucacgagaaaucagccuuccucugccaccugagugcuaggauuaaaggcacagguagaaguaacuuugguccguuuuauucacuacuguauccuaaauacgguucagcauguaguaagcacacagcaaacaauuacuuuuuuuuuuuuauguauuuuuaugcaugugcacgugugcuguaugcaggcgcacuuaccugugcaaugcauguggaggucagaggucauccucucuccuucuccaucuuauuuuucaagacagggucucucuaaacuugaggcucagugcuucaauuaggcugucagccagcaagccccagaaacccuucugacucuaccacuaguucuguggcuaugccuguagcacacugcuacagacccagacuucuacauggaggcuaagacccaaauuuagguucuccaguuuagguagcaagcagguuacucuaugaggcaaacccuaacccuuaagucuugguuuuagaaucauguaaacggaucaugagcugcgcaguucucuggcagccgccauugcuaucagaaacucuuugcuuugugucagaucaccauuauuccugugugcguuugugcaugcgugcugcaggggaugaaacccauggucucguguguucucucucucucucucucucucucucucucucucucucucucucucucucucucucucucucucucucucgccuaaauagagcagaggacagcagguucuugcucaguauguguuugacucucauuuaccaugacuguucuagucaccugacccagugacucauuugccauaugaaagagcagguguuuguccugagcuuccgguucagggugugcucaccacuuacagggccagcuguuugggcaaggcggcuggcucuagaguucugaacaccgucaucuuuacugcuagcuuggagguuuuggucagguuggcugacucuugaagccccuggauuggggaccacaauccuuaccuuacaagguugcaugcgguuaaggauugcguggugucagugagugguugcacgguccaugacauccagaaaggguugaggguggugggaagucucugugucaucaucguccuaccugauccaaaacuugcccugagauuuccccucuuuguuugcuugcuauccaggagggccaggaaaaugucgagauucucccaucuggugagcgaccacaggccaaccagaagcggaucaccacuccuuacaugaccaaguaugagcgggcccgggugcugggcacccgggcucuucagaucgcguaagugcugcccuuuggccgucgugucugucaguucaccacagugagcccaagcugcugguccugcccagcccuggugugucaggacuugugcagugcuuuagggcaccugugggaaaauguaagaagugacaugagaagugacaguaagaacccuggucagccgggcgugguggcgcacgccuuuaaucccagcacucgggaggcaggggcaggcggguuucugaguucaaggccagccuggucuacaaagugaguuuuaggacagccagggcuauacagagaaaccgugucucgaaaaacaaaaaacaaacaacaacaaaacaaacaaacaaaaaagacacaggaggaucauggguucacgggccuaccuggacuaccgagugaguucuaggcuagucugggcaacuagcaagacgcugccccaagauaaagaaugaaaagaggucugggguggagcccaguacaugugauuaccugaguucagagaauuccugucaguuggucaaacaaaauaagagugaauucaggcaaggcugcaacagcuccuucuagcuuacgcugaugggagggaggcuggccagcccagcccaguaagcaggccccucacuugggaaagucuggagcaacgguggcucugggcgcuaggaaacugaagagcauguuguuuuucuaaauuuggauggccggccagugagcucagcccauccagaggaggcaggguguuaguggaacucuagugggagacccaagccuaagggaaacuguugguauggggcgcgugggugcugcaggauggacuagggagaaggaaaaacacagcaacagcagaacauucucccauggggcuggggaggccugcauagggcugugagcaucccuaccacggguucauacagcccuggguaaaguugacugcagugucugccucgguaaagggucuuauguacagucaagguugaccucagccauccucagcuauagaccuuucuucagccuggcugcacucuuggcuccuugaguaaagccaccuucagggggauaugugguccuaguggccuaaggauagucucuguuauggcacucauuggcuacauguggccauuaaaucagcccugugaggcagugcacaccuuuaaccccagcacucaggaaccagagguguguugaucucugugacuccaaggccaaccuggucuacauaaggaguuccaggagagccuugacuacacagugaggcaccaucucaaaaacaauaacaguaaaccccaaacaaccaccacuacaacaaaaaacaccuacccaaacaaaggaaaagaaagcacgcacacauacauacacacacacaccaauacuagagauaccucagaugcucaggggccugucuguggcucccaguuagcacggggacaucacagguacaagacauuuccaguuugcugaguguucugggacacauguuccuuuagcuaagauugcccuguagcaggaagccuucauugugcaaaucuagcagugcucaccacugcaccugucgaggaugcagaggugaugaagacaucaccucuagcuccccagggagcuucugauguaaaggcagugugggcagugcccugcaaaggauacagaaaagcaggcgccucgcggaggggcuagagcuaggaggcagaugcagggcagugguuuugcacgugucccuggugcugaaagcuauggguggguacagccuaaaggcaagcuugcagcacaaagaaggcaaaaauguuacuaaaggggaccagcaagauggcugagcuggucgagaugccucauuuacaggaacccgcgugguggaagcagagaacugauuucuucaugcuauagcaugcaugugcucacacauguacagaccugaacacacagaguagagucugaugaagugguucauagagggcucgaugcucuuugggggcucagcacccucuucuggccucugugggcauccacacacauguggcaaaagcugcauaaacacaaacgcauauaagugaaaauaaaaacauuucaaacucuucacacacuaaauaaauauauauuuuguuuuguuuuaaaguauguccugaccuuguagggcaaccgagucacggccaccuguaacuuuggcuccagagggaucugacacuucuagccuccauaggcgccuucacuccugcacaaacccuaacacagacacaugaauacaaauaauuuuuuuaauaugauaaauaaaauaaacuuaguaaaagaugucagcaaaccuacagggacagguucaaguuggcacacaucugauaagccagcaugggacacucacaggaagggaggcguccugacaaccccgaccuaagccaauggaagggucauauucugugggaggaagagggcuccagcuuaagccaggcucuagugguccuuccccugagagguccccugcccucuguccaagcacagccaggcuggauccuguacaccgaggacugggcugugccuucgcuuagcugcugaaugaaacaccagcuuggagcucuuuugguugaguccagucuggcucgcuagcaccaccugcuggcugaugucacucaccucuuccuaacugggugggugacagguuuauuuguagugacugcagcacaggacagccacuucaaagccugcacuugcauguccacuggggcacugauggacgaugcccuucaguuacucccauuauguguagagcgcggacacaggcagaucagggcaguggguacucggguauagccguguggauggcagacuaaacccaggaccuuacaugcucuacugcuugagcuacuccucaaguuuuggggacauuucaugauucaggaaagacauuugguuucugcccuugggaaaauuucaggccuuuaggauuagcagagaccagaauauuuagucauaaacuaauaagugucagucucaggguggcugguccccaaagucacccagcaccucugaaguuacaguucucagaccccuucgugagaugaaggauucugucucauggcucuggaucagcaauuaagagcacucagugugcuugccagguuugguuccugccaugaacacgguggcuuauagcccccuucccucugguaccaguguauccaguguccuccaaaggcauggaccuccauguaagcaaaacacccacacacauaagauaaaauauauucaaacccuuucaaaaaaaaucuguccugaugguguggagacggcaucgggccuggauuucagaugcuuguuagucagucugagucuguuggugugagcccgcccaggguuauuggaggcgucugucugugugcaggaagugagccuggagugauguguccuuguugcuguuggagcuuuugcuuggagcaagcauuggcuggggucuggacccucuuagugcaccaugugugguccuggagcacuggacgcucaugggcugcuguggaugguggugcagucaguggcuuuggugcccagaaaggcauauguaacucaccaggggcacagcggauggagauucccaaaguggcgacaucugagccucucucacgcuuguagcgacagagggagcacugcgaggacggagaguagaagugaaaggacucuguacugagccugcugucugcgccgugacaggucccgaggccaggcuucuggcucagcccaucuggcucaguccuggagcuuggaagguucuagagcauggcaccucaccuguggguccucaagcugcaucauaacauggcagggugucauuuggugggacugagcaaccccgcuggcuuggguuucucuuccuuuaauaaacccccuuagggcaucaugguggucacacccucauggcuuuccaagggcuccuccuccaguaccgucaucaucuuaauuugggggacacuuaagaaccaugauacgguugguuaguugugguggcgcacaccaguaggaugugcugaaggaggcagagggaucacgaguucaaugccagccugggcuacacauuugggcuggagagauggcucugcccuggccgcucuuccagguccugaguuccauucccagcaaccacgugguagcucacauccaucuguaauggaguccaaugcccucuucuggugugucugaagauagcuacaguauacucauauacauuaaauaauuuuuuuuaauuauuauuuuuuuuaauguuuuuuuuuuuuuuuuuuuugcuuguuuguuuguuuguuuguuugguuuuugguuuuugguuuuucgagacaggguuucucuguauggucuuggcuguccuggaacucacuuuguagaccaggcuggccucgaacucagaaauccgccugucucugccucccaagugcugggauuaaaggcgugcgccaccacgcccgguauuauuauuuuuuuuguuuguuuuuuucgagacagaguuucucuguguagcccuggcuguccuagaacuuguucuguagaccaggcuggccuugaacucagaaauccgccuaccucugccucccaagugcugggauuaaagccgugugccacuacgcccgacuuuuuuuuuuuauuuuuaaagccauaauacaguggaggcauggaaguuuguuguggcuggaaugaaggugccaggcuggaagaguguggcccugcuggggauguugcugugaaugccuuugcuguuggagcauuacccagaugacuucaguauguuacgugagacacauccuagcauagugguuagguacagaucucggcucugccacucugccuacgugaccuugggcaggacacuuaccucucuguaccucagguuccucaguaguaaaauggaagucagaguaggccucccucgcugaagcggaggaucacggcagagggacuagcgugcagggagcagugaggcaggggucucuuaggcuaggggauguggagagaauucagggacuugugcuuggaggcacauuuuaaauccagucugcgagccuuccccugcgguggugacucccugagcaccacugccgccaugccugccuguccaggugcccuugcgagaugaggagcgggacaccagauccaccuuccaugggccuugucugcugacuccaaccucucugugucccugcaggaugugugccccggugaugguggagcuggagggggagacagacccuuugcucaucgccaugaaggaacucaaguaagguccuccuccagagcccagcaggccucucuuggaccucuguagaccucuggcucauucauggucagccccugggaaccgagggaggguguugaugugacccgugcugcugccaccuguccucugccgggagccagggcaccagcccucaacgucgugugacuucucuccacuacagggcgcggaagauccccaucaucauucgccgguaccugccagacggcagcuaugaggacuggggcguggacgagcuuaucaucagcgacugagccgggcgcgcucggccugcaccagcucugcugggcacccucucugugcccguuuuauauguguaaauaauaaaccucacccuuuccacccccucuccccguuaccugcgugcugccaccugcccugcuguaggacugggcauacaucaagguggcccugugacuguuagcucuuucuaaggcaccagggcccuuagc

SEQ ID NO: 7871 - RNA, 42169 nt, Mus musculus
cauugggcaguuauagaagauggcggcgccugaccgcgugcgagguccacgcuuggggucggggccacagccugccugcggcaugggcucgguggauugguggagagccguagugucgucacgugggcggggcgcgucaguuugcggaaguaggagggcugagaagugcugaguaagccgaggugagugacggcgcggcgggggcggggccugacggcccuuucccaaaccuccuggugccccugucuugaaugucgucaccuggacccugcuuaggaccggccucgugucugcgacucugaggcauguccuccguuaacuccuaucuggccuccuugagugcucccggcuucuguccuuucauccccuggcguccccaacucccauccggugaccgcauucuucuccguugccgcccucaguuucccaacuuccaaaaucaacccuucucccaauucauugcccgacuuucacccuggacuguccacuguccccagcuccucucucugcgcuucugagugcuccugguuuucugccucauugcccgauuucccccacgccaccugcuuccugcguccgucccuuugugcccaaccccugagcccccauuucuaacucccugcuuaucuucucuugugccuccgguuuccauuugcucccccguguguuuuucccaguucucuagccuccaauccuggguucaccuccagcucccuccgaugaccuggaagcuggcgacuaggagccugugacccaggugacugugacuagggauuugggugugagugcgacugggagggcacaaggguuuauggaucucugccuguauuuuuaaugggcaguucacaugaucgcaaacaaauaccaauccuuccucuaaaguucccccaccugcccucuugccagcccgacaggauugggcagguuugguuuggccucguugaagcuccacccuuagacuagugcaguguuuuguucuggucucugccuucacgugguucuggagcuuggaggccaugcucuguucuugucuguuuucucacugugccagauaggacugaauuuucugcccacauuagugacugccacgaggcucaguauuugaaugagaagauguagaagacaaggcuuggugaccaguguggcccuguacaagcucccugcuuugcuguuguuucauaggcaggauggaaagggcugggggauagggagagagaggaccaaagggagagcauuccccuuuguucauguuuucaguguuuauuaaucacccugacaaccaggcgcuuuuauuucuguuaccuuuauucucugcucccuuuccacugagcaaauauugauguagcuagcgcccgcccgcuguuccugcuuagccuggggaagggaggccagugaccuccuuugccagggucaugcuaauaccuuuggggcuagguuuucacuguagagaguccccaguuuauuuauuuuuuuaaauuauuuuuauuuuauacauaugaauguuuuucccggaucuauguaaguacacuccaugcaugcugaauucacucggaucuggaauuaaaggacuugugggggcuggagagauggcucagcaguuaagagcauugacugcucuuccauagguccugaguucaauucccagcaaccacaugguggcucacaaccaucuguaauggaauuugauguccucuucuggugcgucugaagucggugacaguguacucacauacauaaaauaaaaaauaaaucuuuuuuuuuuuuaaagaagguguggguugccguguagguacuggaagcugagcccgaguccucuucaggaguaucaagugcucuuaacuuccuggaaucucuccagcuuugagggcaguggcagugacccgccccaggcagcuaugcccaagggaccauggcagacacuguucaguguggcguguugcugaauccaauugcucauggggcagaugccuuuccuccugcacccuguaggaagucaggggaccugugcccuacagugugacaccagccaugagacugccaugagacugucauguugucuaagggcuccuucuguuggcuuacagcauuuccccucccuagggguugcuugucuuguuaaauguaauuaugguggcaugcuuaagagggauuuccaaggcauccaauagaaugauauaacuaagaauauccuggaaggaauugccuccugagcacugaguuuacguguguguguguguguguguguguguguguguguguguguguguguguauguguguguacacaugaauaaguguggccuguguagagggugugcucuccugggcagcgugaacagauacaaaaguggcaggaagucaagugacagcaggggccugguacuuggauuggaccucagguccucagccuggagccauggagguggggugggguggacagggauaggugucagcugcucaggagggugaccccaguaaucuaaucaugagacgugcugugggaauuggcgggcaguccuguguguuugggugugcuccugaaagccccuacagccauuaccugagacaagaaggcucagguguucuggccugguucuccucccuccaugcuugucugugucagguggaggcaguuucaucucuaaaaaggcugaaacacugagaaccgauguuggaaccaugcugggcaguaaaacugauuuucccagaggaaccaaccagucccaagagcagcagugcuggaggaagggucuccuggugggggagcaggugguccuuggaggaaagccagaggcuggguucacccgccuugcuuuguggugugagagccagaugugcgggggcaugggaucccugucccacugccuuagggacgcaggcugguggcucacagauguccauugauuuguucacuuacaucaaacagcugcuggaagugggugccaugcacccuaaggaaucaaagcagugccacgguccuuugugagggaccccauggaguaggguugccaaggggaaaggcugaggggagaaaagagcuuucuggaggaaguggccuccaaacugguucuugagagacaagaaaggggagguuuauuugagugcauauccuuugucuauuaugagagagauguuaaguggggguaggagugauacaggccagggagugaaggugcaggagcgcccaaggacacugaggcacacaugugaccugucugcugggacugaaugacuagagucacgucagggggcuggagugcaggcugggccuuuucugaggauucugauacauucucuagaguuugggcuuucugaaguauuggagauccauauggcauagaguccaucagcagugagguacugucauuccaccgggagauauggccauucaguuuguagucugugugcuagacagccauagaggagccauguguguaaggcuagaccaugaccuagacucauguaccuccauuuugaaccacguugagugccggcuuguagggaggggucaguccacugcuuacucugccuuuggagugagaguggacucagaaugaggaguggggguuggggggggcucgcaugagcagggaggacauucuggguuuuguagaauggacuggauggaucauggcucccgccaagcaguuucuaccugcaagcauccaaaagggaggagggaaggugaacagccuggcagccuugccaggagagugacccucagagugagagcagucuuccugagacccgcccuucaccacggcagagguggaugcagaccuccuucagccaguccaggugacagugaucacccaugguggccaugcaugccucuguccucccagcugugaccccugcugugcaugccaggagggccucuccccaccccccucagcugucuucugucuuuccuuagaacucaaguccuguccuccaguguccuuccccagggaccacacacucugagccuggcccucauggacccaaguagccccuccuggggggcucacugaagacccuuccauggucccuccagggcucuuguuugguuuucauuuugguggccagaguguauuucuauaguuugucaucugaacccuccaucugaggcccucucuggauggaucucuccaucucugaugugaguauacucuucucuggucuugucuuccguuccuccaggagagcuguagauguccacagacaccaucugccuuccagaagcaaaccaaggcggcacacugacagggaauggguuagagacaaggggagaagccacagaucuuaaccuuaggcugcaugaagggucgucaccggcacuggcaccaugaauggcuuggcuuggcccuuuucaguuguggcaucucuggcuggaaacagggguucugugucagaugaccucaucuaggagccagcucuggggcagagcaguagugacaguugucagcaguagaaaacaauguuacaggaauguaaaaacugugagacuaagccccaagagguuugagggaggcccccaguggaagauuccuuagcugcccugauggcagccuggccgagaugguagcggcaggaugccaagaaguaggcacauaaaugcuuuguagcauuccugccuggcccugccaugcuuguuccaggauguguguggcccauggguccacagaguucauuuccucucuuccaccugaagagaacaauggcugcuggugguguugucacaguggguuggcgucuggccuuuuccuuaguuacugugucauauccuguaucacacuggccccaggaggcuggacagaggccaggccuuucaacauaggggacaugucucugucagagaaugcuggggugaggacuuccucugagugaggcugcugaucccacagacaaguggauuuaaaccagugaggcucuugggugcacccugccccacuuccuggagcaccucucugcaucuggccuggccucuggcacaucugcauaaaaccacagagcccaggacucagccuacaccugcuuucuauaaaaccauaguaauuuugugugccauuuggaaaaucgagaacagcaacaguguuacucauguaaccaggaccuucaucuccuccagauauccugguaugcuucuccugucuaugccuuuuuuaguuuuggauuuaauuuacauuuuuauuugugucgggguaggggugggggaagggaagaauggugcgcuaucucaccagucccuuuuuuuuuuuuuuuuaaaagaaguuugugcaaaauacuuacucaguuaaauuuccucacaagaaucuugaauggagccaagcuuggcacuagggugagagaccuugggagccuccugaagaagcuuagacucuggagcugcucgccuuggacuguagcacucgucccugucccugucagcugugugaccuugggaauggcccgcugccuuucugugccuuagcuuccucccacucgaagcgaggauaaccgugugggaggguggcugugcagaggaagugauacgagcuuaggauggggcggagggaggugccaggugugcccaggcugacagucacucagaaucugucagagaaacaguucaguugguaaagagcagcucucacaagccggaggacccgagcccaguccucagugguggugugugcugaugauucugcagcuggggaaguccccagaacucgcaugacaaguuaguuaacuccaggagcugcugaggaggccuuaucucaaaauccugagcaauggcagcugagguugaccucuggccucugugcacauuuacacacacacacacacacacacacacacaucugaacaugcacaucccagugacauacacacacagagugcuugcugggguauaaaaggaaagauuuuuguuguuacuugagacaaggcuacucuguccuagagcucacugugagaccagacuggauccaaccgcuuuagauuccuaagggcugggaucauaaugugaaccaucauacccuguaagauugucuucuugccaagggcaguagauuauucaguggguaaaggcauuugcuaccuagcccgacaacuugaguuugauucuuggcaccuacaugauggaaagaugcaggggccacagcacacggauuccugccacuggcugacacagcacacacacuucgacguuugugcacucauuuauuuguuuguguguuuuaaucccgagcugggguuucuaccccuccuuugacugcuugcuuaguucccagauaaaagaaacacaugaccuuuauaucuacaguaagcaagccuuaaacagcacaagagcugggcagcugucugcccuccaugcuguuaaacucuacuuuccgaucgauagauaaccccgaguuaucaguuacuauguuucaucugggcugcccuuaacuccaguuggccagcccucagggcugcguuuuuuuauggcucacuuaacccauggaggcuucucuucuucuuccucuagguucuccucugaccccuagcuaggggauccuaaaccccaccucugucucuucugcccagcuauugacuguuggcaucuuuauuuaccaaucagaaauagcuuggggacagggucacaggucuauguacagaguccagggcugcacuuagcauugcaacagacagcaagaccaaaccucaacagguuuguguguguguguguuugucuggggaggggauccucuuauaucuauauuuucagccaaaaaauccugaggcuggccauauagucuaguagaguauuuguuuuguguucgugaggucaugagauggauccccaaagauaucuagaaauaauuaacucuuuaaugaguguguauaugauuuuuauuacauuuuagcauuguuagugcacguguguguacaugugugucaugauacauguguggaggccagaggaugacguaagucauuucucuccuucuuccuugcuuguuccucaaggaucaacuuagguugucaggcuuggcugcaagcacuuaaaugugccaagcucucuugcaaucugguggucuuauuuuuaaccauaaccucauauugucuguuuagacugauucauucauccucuguaucugcugcuuuguggucucuggguuuuuuuuguuuguuuguuuguuuuuguuguuguuugagacagggucucucuuuguagcccuggcuaucauggagcuuacuauauauaccagacuggcuauccuuuuuuuuuuuuuuuuuuuuuuuagauuuauuuuuauuuauaugaguccacuguaccugucuucugacacaccagaagagggcaucagaucucauuacagaugguugugaaccaccaugugguugcugggacuugaacucagggccucuggaagagcagcacucagugcucuuaacugcugagccaucucuccagccccagacuggcuauucuugaacucacagagauccaacugucucugucuccugaguucuggaacuaaaggcgugcaucaccaugcccagcugugacuuuuauuuuauauugcucuuuuuucugacccacuagccacuguucauuuguuguuguuguuugaauuuagucccaccuauaagaauguguaauuuuuuucuuacuaucauuuuaucaagcccuaugucuuaccauuuuaagaauguguaauuuuuuucuuacuaucauuuuaucaagcccuaugucuuaccauuuuugagguuuguuuauuuuuaucuucuguauauggguauuuugccuucacaugugccugccuguguaccacaugaauagccgauaucuguggagggcagaagagcuuacgggauccucugggacuggaguuccagaugaguaugagcugccacaugggcuuggggaacuaaauucagauccucugaagagcagccagugcuccugacuugugaaccaucucuccagcccuaucuuggcuugucaagacaggaucucacuuuauagucagaacuggccuggaucuugcugugcugccugggcuggcuaccuuuauuagccuccugagucugggauuccaggugugggccaccaucguuggcugucccuguguugaagaagacacgacuugcguucuuccccaccgguucguuauuauuagaaaagcagggacuuccaaagcucccggcuguuuccagagugauggagucauauucucuaggucuuaguuuucuuaucuguaaaaugggggaaguaguuaaguaaagacaggccaacauuuaaagcaguacugucuuucaggugccaggcuggccccaagcucacugugugggaccaggaugcccuugaacuccaccccuguccuguagugguccuggguuuccagguauccaucuccaucccaguuaaugcagugucagggcuggaaaagucugcucugugcuagacaagcgcagugucagcccuugaugccauuguuaaguaacgcuagggucacuuacccuacccaucugucagugaagcaggcugcuaggcgcugcacagaccaugugugugcggugugcucucgcccugggaagagacaugcgcauacacccagcugagacccagcaggcuggucuaagacucaccauguugaagagcauaauguuuacaacaaaugaguuaacuuuuucuggaauguucugugcgugcuuucagaccauagcugcugaaacuggaaagggaaacccugagguggugucaugggcgacccucacgcuguuuuuagcuuacuccacaguuugucuccauuccaucaccaagguuaguccuuucuuccaaccuggggucagagcaggaccagacugagagcuaguguccaugcagugcccggcucccucggggcauccuuacugcagggcucugugcugucugucaggccuacucuuucaacaggcgacauguugccucagagguagagggcggccucuggggaaggcaauauacuuucuagaagcccaagaaaacacaguucucuuaauucuggagcuggggcuguagccuaaugagugugaagcucuggguucuauccccggugcacaugaacacacaggcuaaggcuccaaucuagacugggagacaauuuuuauagcagaaacccugacuuaauguguaguuaaaacaacaacaacaacaacaacaaaacccaucucucucccucuugagugagugcuaaggagauagcccagucauucuggugugagguucugucccaacacucaccuauaaagagagcuggacacggagacaugcacucgggaucucagugcuggggaggcagacaggacacugccuggaggcucgcuggccagccagucuagccuacuugguaaguuccaggucccuaagagucucugucucaaaaacaagguggagaaccccugagauaccugcaggugauccuggccccacaaguaccugcagacacucagacacgucucuaugcacaccuauccccaaaugcacguuugguguguccgagccuacaugucuucuuucauccauaucagagaucuaugugaaaccagugaaagggugcagacagacaguugcuccccaccccgauccccugcccucggugguguggugcauucugguaugucauagugaggggcccuuggcuuugcuuguggaguuggccugcccauggucaguucugccgucucuaggaugucagcucuggcuugcauggugagaagcuguccgcuuggccaggccuugcugcagacaccacauccauggcuuacuguagcauccuuacuguagcacuaguccccagucaguccuggucagggaguggucccuggccuggccugagagcucuggggcuuuccaucagaccugcuacacacucaggcucuuucucucccuccaucagaccugcuacacacucaggcgcuuucucucccuccaucagaccugcuacacacucaggcgcuuucucucccuccauuagaccugcuacacacucaggcgcuuucucucccuccaucaaaccugcuacacacucaggcucuuucucucccuccaucagaccugcuacacacucaggcgcuuucucucccuccaucagaccugcuacacacucaggcgcuuucucucccuccaucagaccugcuacacacucaggcucuuucucucccuccaucagaccugcuacacacucaggcucuuucucucccuccaucagaccugcuguaugcucaggcuguuucucucccuuucagguucuugcuagggcacagagcugguguguguguguguguguguguguguguguguguguguguguguguguguguauguguaugacuccugugaggugggugcaggagacugcaucugacugaccagagaucucccuuucuuccagagcagaggggcaggcugggucucuccgcugccccacagaggaugcaguucuucggacgccucgucaacacccucaguagcgucaccaacuuguucucgaacccauuccgggugaaggaggugucccugacugacuacgucucaagugaacguguccgggaggaagggcagcugauccuguuacagaaugucuccaaucgcaccugggacuguguccuggucagcccgaggaacccacagagcggcuuccgguaggugaugucagugggacgugcaccccucaguucguucccuccauccuggggcuucccuggagcucugccugggaguucuauuacuagaaggaggagcugggagcagaaaagugugggucauuucccgaaacuuugcuccugggaagggugaaggaugaggaagcugaaaggacccacggugguggccucaauugagucuucagugguagggguaaggguuuaaacagcugcuguguaagggcuggcgcuaggcaugcugggacuucuugguucuagaagaucaggguagaacuccagggcaaggcagagugggagaaggggauaguuggcagagccaaaccuucauauugugguggagcugggcugacugacgaaguuuguacccauuuucuuucugcuuguucuccuggcuaucccaucauccgccuguucacaggagcccugggccugaggccagugggcucugugagaagccacacaugguuuucguucuuagggaacauguagacuggugaaggcagaucugcagauagaacauucuguacacuguacccagagccccuucaccagggaacgacaaccccagcccaacaacuguguuccucacacagccuuuccuuuuuuuuuuuuuaagacauggucucauuauggaucccgcugggaucaauacacuaccaugccuaacauucacuuuuuuuuuuguuuuguuuuguuuuugguuuugguuuuuuuuuuuuuuuuuuuuuugagacaggguuucucuguguagcccuggcuguccuggaacucacucuguaguccaggcuggccucgaacucagaaauccgccugccucugccucccaagugcugggguuuaaggcgugcgccaccacugcccagcccaacauucauguuuugaccacacguuucucagaaugcagccuguugucacgcagcacaugacugcacgucacugguugauggacgugcagguccucucuuguuucugcugugugcgugucauugugccuuccugucugucguguacccaggagugcugguggaccgaaggccauggcagccuugguagguaaugauugugagggagguuucuuguugcuggauacucugagacuuuuuauugucagugcaaagacccgagucagccccuugagugucuaguggagcaucauuauaaucuuacgguguguuuauuugguguuaguacagccccuuucagcagugacgagccacucuggcaccuucuccagugauguaccugcucggcucucagccauuuaaaaucguuaccuauuaaaaauauuuauugcuguauuuuaucuuuguauguguaugaauauuuugccugcacacaggucuguacaauauguacaugccuugugccuguagaagcgaugaguguauauuacacaugaucaugaguccagccguuucuacuuacgcuuuuguaauuuuugauggucuucucuacuuauuuauuuauuuauuuuuuagcuuuguuuuugggggacagagucuuacuguguagcuuuggcuguucuggaacuuacuauauagaccaggcuggccucaaaguuagagauccuccuauuucugcguacugagugcugggauucaaggcguguguuaccaugccuagguauuaauuuuuaauauucacuugugcaugugugugugugcgcgcgcaugagagagagagugcaagcaugccugcagaggcuggaagauggcaucagauucccuggacuuacaggcauuucugaucuccccuccaugggggggugccgggaacugaacucugacuuaauguguagucaaaacaacaacaaaacccaacucucucccucuugagugagugcuaaggagauagcccagucauucuggugugagguucugucccaacacucacuuauaaagagagcuggacacggaggccaaggcucuuccagggcuuuucucugcagcucccugcauuguccuugguuuacugggcuaagcuucuccccgagauucaugcucuuucugcuccguagagccaucguuguguuagcguuggcuucugugugacaagcagcugucacacuguggcuacccucugccauguugaccaccuccuugcaucugugcacacaucaguuucuccucucgugugccucacugccagcacugcuguguaacaaagcacccagaaccuagugaccuaaaacagcacugauucauguagccuaaaagucugugagcugugcggagcucugaggcaagggcucgcuucucugcagggcaccugcuggcgugcguugacugcacuucccucuucggaagucucccagccuggugguuuggcgcuaguacuugaguucauccagggcccaggcaucuccgccauugcuccaucucccuguggcguucuggccaggucccgauagagacgcagaaucuucuagugucuugaggccucugugaagacagugggaugucuguccuuugcuuguugaaaugauaaagcauuuagacagucaggucacagagcagagcaaucuagauccuggugacuuggugacaggcaugcgagggggcuugggacccuguuuuauagccuacacaugauaguaggugugcauugggguuuugucuuguuuucuaagagauuuauucaugggccagugagaugauucaguggguaaaggcucuuuccacccagcccagcggugugagcucagucucugauaccuacauuugcacauguauacauacaaauaaauaaauguaauaaaauauuuuucuaaaaaagauguguguguguguguguguguguguguguguaugugggaagacaguuuucuggaaucccuucuuuccuucaacugugugagcucuggggaugguaccugggucagcaagcaccuuuacccacugagccauuuugccugucuuacuuuuauuuuaccuuauuuucugaaacagguucucaaacuguugcccugaaacuuacugugaggucuagguuggucuuaaccucccagcaauccccagccugagcccucugaaucagggucauaggcauguccaucauacccagccuggacauuuagauggggguuuaauagggagaucgacccagaggagacccaggagagcuuguuugaaaacccguuuuggagaguuuguagacauuaaccuuuuaaauaagacguccgucuaguuucuucugcgucugacgcccucgcgaugguuuaugcuucuuccuuguuuuccuguauuucccucugccuauuuucugcaaacauuucuucucgaucaacuaguuuucuaaggcccuuaacuugagccuuuuaaagacagucucauguaccccaggcuggccucacacuugucuggauggcaguguccucauagcauggauucccucacacucuucugagagcucuauguugcugcccagcccccuaggagcagacacucagaagagcaggguguccacacuggcuuguuccuuuaguugcucuguugagaaccuuguccggcacagacaggcuggcuccauugacaaagccgggggagggggggggcgguugagagcccuggugagaacugcaggccagugugucugccugguuucaugaugucacaaugcuuuccuacuguccuacaguagugcccuuggucuccgucucaaguuucacgugaggcucagagacggggagaggcguaccaaagucacacagcaauuucacagcagaacuggacuccagcccaacucuuuuuaaauaaacagagcuuuguuuucuuacuaggaaaauacugcaugcgcucacuggggaaguuaagagaaaugguaggaguguuagauuccuucugcuucugagcagauuuuugacacaucucuucacugcccauuggguaguuggguaguugaaaucacuuuguguucuauauuauuuguacccugcuuuuuuucacauuucaaaauaaacaucucccuauuuuuuuuuuuauuucuuaugcuuuacuuauuuugauugugaucaugucauaguguagaggagagauuggagggcaacucugggagucagcucccuucuauguggguccuugggaccgaacucaggcaacagcagauaccuuuagccauuggaucauuuugccagaccaucccuaucacuuugaagaacuuuaaugacuguguaguagauagauagcugagcuguaacccacauaguauucuguagccagccauuugggugaaauaucacuuauucaauucugaccguauacaaagagacagaguuugaaagagaggcuucuggaugugacagccaaguuagaagagaauaugacauggcuuccauuaaauaagauauaagaucaccagcucugaaagacccccaagcaaauccaaagcaagcucuguucugaggguaguguuggaacaagaagaucagccugcagccuggggcagagagaggcuggccugugugugugugggggggggagcgggggggggggaccgugugauuaugcuaggcacugccccugaucuggcccaggcucccugccucacgacuuaccugaguggccucuccugguggcaggcucuuccaacuggagucugaggcagacgcccuggugaacuuccagcaguucuccucccagcugccgcccuucuacgagagcucugugcagguccugcauguggaggugcuucagcaccugaccgaccucauccggaaccaccccagcuggacagugacacaccuagccguggagcucggcauccgggagugcuuccaucacagccgcaucaucaggugggggagugggugggggagagcgugugcugccugggguggggggcggggugggggagagcaagugcugccuggggcggggugggggggcacugcgguguggugugggcuguccaugcugccuggggucuccacaccuggcccuuguucuuccaaugacuugggugagaaaagaauagcguugccauggcuuaauaacuugagaacacuaauuaaagucagaaggaagugcagacagugaguucuuccaacuccucagucaucucuaagagaggcuauucaguaggagagggcugcugagggaggggcucggucacagucucccucccaagcccugccguuuuuccagaagccugucuggucuccuuuauauuauccaucuacucaaugcuguaucagcaaauuccccaucgaggucaccguggccacgcuugcaagucaccggcugaccaccccauacuccucugcucaaugccugggcccuagcuaagcuucaccaagccaggcagugguggcacacuccuuuagucccagcacuuaggaggcagaggcgggcagauucaugaguuugaguucagccuggucuacagagcaagaccuuauuuuaaaaaacaaaaacagaaccugugagcugagcugcuccaagcaggaccuuggagaccgcggugucccaucucacagucugaagcacagagguucagugcauugcucacgacacugaaguuucuguccugagugcccuuucucugugucaccuguugucauggcuguuguccccucaugcuggcauggcccuagggcacaucuccccacaggugagcagaaugcacuguagccuggacugagucaugccagaaccuccagaccuugcuguauccugccucugcacucaggguucucagcgugccugccuuugguccccugccugucucuuaccuaucacugcccacccaccccaacccuuuaacagcugugccaacagcacagagaaugaggagggcugcaccccacuacaucuggccugccgcaagggugacagugagauccugguggagcugguacaauacugccacgcccagauggaugucacugacaacaaaggagagacugccuuccauuacgcugugcaaggggacaauccccaggugcuacaggugaguacugggccgugggcaggggacugagcaaccaagcaccuccuugugcuggaaacuugacuugggggccucaaguucaugagucuuucugggucuucucacucauccguccuugauuccugauuccuuugucaccucccacccccauccuccacccugugacacuuagagggagacguaucuuuagguaaggcgguucuccagcucagugagcugaacuccauggaaacuguagucaggcauggagcucagcagcuacccagagcuagcccuugggcugguugugucaggucagccccugucugggggggcucaaggugcagagagucugaaccuaauucaugggcacucagauugccccagcggguguagguguuugcgcagaggcacuccuacaggcuccagauuuucaaggccuacuuuaauaaggauuuguacaugcuuuaaccucccuucuagccuaccaccucccagagguaauggaaaaggaagguuauugggauacaggggaaguugagauauuguucuuuggagcagauccagucugcauugucaggauagcagcaguucaguucuuacgaaucagcggcagcagcucaacccacucgcaaacaccauucacgaaucagcaacagcagucaacccggaggaggcugcgaggcucugcugaaugguguuuggaagcagcuccuuggggcgauuccauucuccaguugucagaauaccagcaguccugacaaucuuaguauauguacugcugaagcgagcaugacaccagcaguccaguccugugugucaggauagcaaacgugaaucagcagcagcggcacuaccuagcagagacaucggcacaagacacaagucagcaggcgcgauugggaccagcagggacuccagaaguucuccgccauaccucagugaagugaagaucaacgaagacaaagacacaagauccaugaagcucaccgccacuguccaucgaguccuauguauacuccuccaaacaucacguguccucccacgggucuugcuucaagaaaacuccaugugaaucuauaucagcugacauagccagaaacuuccacuucacuuugcccaucagcccaaguccaaggaagcugccagaacaccaccaggaguuuucugguucguuucuuucuaugaugucaugacaggagaugaccaauaaggaguggcaaggcaucugucuuagucaggguuucuauuccugcacaaacaucaugaccaagaagcaaguuggggaggaaaggauuuauucggcuuacauuuccauacugcuguugaucaccaaaggaugcaggacuggaacucaagcaggucagaaagcaggagcugacgcagaggccauggagggauguucuuuacuggcuugcuucaccuggcuugcucagccugcucucuuauaaaacccaagacuaccagcccagagauggucccacccacaaggggccuuucccccuugaucacucauugagaaaaugccaguuggaucucauggaggcauuuccucaacugaagcuccuuucucugugauaacuccagcugugccaaguugacacaaaacuagccaguacaauugaccccuugucaacuugacacacaaaaacaucacuaguaagccucaacccuuacaaucuuauucauccccaagaucuaaauaacuuuaaaagucccacagccuuuacauauucuuaaaauuucaauuucuuuaaaauauccaucuuuuuaaaauccaaagucuuuuuacaauuaaaagucucuuaacugugggcuccacuaaaacaguuucuuccuucaagagggaaaauaucagggcacagucacaaucaaaagcaaaagucaaucuccaacuguccaaugucugggauccaacucacgaucuucugggcuccuccaagggcuugggucacuuauccagccaugcccuuuguagcacacgcaucauccucuaggcuccagaugccuguaccccacugcugcugcugcugcucuugguggucaucucaugguacuggcaucuccaaaacacugcaugaccccuucaguccugggccuucaauugcaacugaggcugcaccuucaccaauggccuuccauggccucucacaguaccgagccucagcugcuuugugugaccccuucaugccuucaaaacuaguaccaccugggugacccuuacauauuaccaagucccgcugcagcaggaguacaaccuuggccaucucuggaacacagccucuuugugcuuucagaaaacacuucccagaagaugucaccucaaugaugcuggucucuucuuaaucaccgcuaauuucuuagcuccagcuaacuagcaucaauagucccaguaaugcaaaguuuuugcuuugguaguucugguaucuuguuaaucacagcugauucuucagccccagcuaaccagaacgacaaaaucuucacaauccaaaauagcaauggcccugaaaagagucuuuaauuuucccucugaaauuucacacaccagagcuccaucuucugcaguguucucaacauuaucuuccaagcuccuacacgacauccgacagagcucuuaacaacggauggaucuucaagcccaaaguuccaaaguccuuccacaguccuccccaaaacauggucagguugucacaggaaugccccacucugcugguaccaauuugucuuagucaggguuucuauuccugcacaaacaucaugaccaagaagcaaguuggggaggaaaggguuuauucggcuuacgcuuucccacacccacacacugacccugcuggucagccauucuuacaaucuccagagcagccuuucucccccaugcuccucuguccucucggaggcaaauggcgccuggggcguuggagaagugagcggccagugcuuaucauguuguccugucagcuccuagggaagaacgccucagccggccugaaccagguaaacaaccaagggcugacuccacugcaccuggccugcaagaugggaaagcaggagauggugcgcguccugcugcucuguaaugcccgcugcaacaucauggggcccgguggcuuccccauccacacagccaugaaguuuucccagaagggguaagccucaccaccacaugacccccaccuccugcagggccagggacuaggcccugcuuccucaagccucaccagguaaccggcaagggugcagggcuggagaaagcgccugaugcuguuaugugguggcuucacaccaaguguuccgcaaacacugugcgaagaacagacccuuuagaguuuugcacucaugcacccaccuucccgaccaugagccccuuuuccccugcucuugagucugcugcuuggcaggucagcaguacucagccccugugcuugcuaaaggcccaaggaugcccuggugguccaaggcccugugcgucuagcacauugcuucuucccagcuggcagcccugcaggaggcaggcaccaggcucuggucuuagggagucuagggccacucccuagcucugcugugaguucucaguuccugggaagucccccauuuguguuggaggagaaucagagaggucaaauacagcaaauggcugcccagcaggaccgucuggagugaggcaacaaauggggucacuuggucuucucgcuggcuccugugcuaagcucuggccuugagagauaucugagaggagcccuguccaugguagugggcagggcagccuccagccuccagccucucccacacugcaggcuacaguguucagcgggcaccuccuccccagcucugugucuuaguaugucuugauaauagcuguccucacaguuagagaugggaucgcagaggcuuugauuugcauuucccuguggguuacugagguugaacaguuugccauuucuaugucuuuagagaaauaucuaucugaaucuacaaagugaaguucccauccaucccccgucccucccuacuucaccuuuugagagaggcuugugcuuuguaguucaggcugaucuggaauuggaauccuccugucucagcgcccucaacauugggauuauagauauaauaccagcuaugccugaccucaguuuucuauuuuuaccccagcauauagguugacuuauuuuguuggucauuugauuugucauuuuucacuuuaauauaauuuguuuauauuuguagugugugguuguguguuuguguguaugcaugcaaaaucuaagaagccauugucaggcuagcuaguugguuguauugcaaccucccuaauuaguaggaaaagcccagagucacagcuagugcaauguccccgagucacgacuagugcagugccccucacugcccugccacggccucuccgcaggugugcugaaaugauuaucagcauggacagcaaccagauccacagcaaggauccucgcuacggagccagcccacuccauugggccaagaacgccgagguaggcagggaagguccagaggagacuccugggaggaaggcaguggcaccuggggacaagucucacaagcccaggaagaacugaggucccaccacuguccugcugcucacuggcugguggccuugauuuaucugugaccggggguccugggaaguuagugagacugugugggaaacugugccucaugggaagaagguggugaugguaauauggccacugggcacagcagcccccaaagagccugguggccacauaggcugaggucuccccugacgcuccucaguggcucuguccucccgagaagauguucagguagcccagcuuggcaacacaggugccaccaacacccuggccauacuuacaugugacgggcgagcaagcagguaaggccccggccucuguggggcaccagcuuguucagauguguuccuucacugcaacauccaugaggcaggcagugugagggcugcggggcugcggcugcagugaaugagccaggcucaggcugcagaagggccgcugggcuuugggcucagcacuguccuccccgauaucucaguuuaaagugagcuuggauaccgugaaagacccuggagcacauccuagggaugaccucaggagucagugcuguggggcggggucuagaggagccuuuguggcucuagaaaagggccacgagcuucuagaccggucuucaccuaauuguuacccaguuccuggggagcugguguguguggguuaaggucuagggucacgcccagaacuggggcugccucuggacuuccuuugcugaugacugcuccgggaggcugcaacccugagugcccgcccugucuguguccccagauggcccgaaugcugcugaagcggggcugugacguggacagcacuagcuccucagggaacacagcccugcauguggcggugaugcgcaaccgcuuugacugugucauggugcugcugaccuacggggcuaaugcaggugcccgcggagagcacgggaacacgccacugcaccuggccaugucggugagccugccgccacaugccacacggccucaucccugggccagcucugcuaucuccccagcugcuccacgguaggggugugggaggagcaagagaggcagagcucgacucacucuccuuuccccagcugcuacaucagacaugccuucucccugagcccaguacauggggcagccgcugguuuguuaggagacaccaccagcccuugaagcuucuguggcgugacaagacagcuauauuggccacauaggucugaucuuagguagccagaagagcguacaggagggacccuaaggcugaaggacgcagucagccacauucagaaccuguggaagagcagagggaugcucuggaggucacuugugaggcucccgucaagcaccauucuuggacagucaggaggcccugugcgcuaguuguaggugggggucucaugauauugcuuauuuuucucaccuuccauucccaacagaaagauaacauggagauggucaaagcccucauuguauuuggggcagaaguggacaccccaaacgacuuuggggagacuccugcauugauagccuccaagaucagcaagcguauguacccugcaaucugguaccagaguuucagggaggccguagaagcgaggagggaaguuccaacuguagaugucacgcuggcccagcgcuccagcugaguggccaggagcauacgcagcuugugaggaaggaggcuucuuccccaaagacgggcucugcacaguagaagcaggcccaccaagggcuugcugagcaugguacucaaggcgcgggugggcugggacuaggucugcagcagcagaacaagcagagggucauugcaugcgccuugcaugugcacacacgccgugcuucauacaugcuggaggcaugcauagaaucgcaugugcauugcugccccgucuacuaugcuuggcuucgcagucgcaggagguggcuuuucuuuccagauggccucuggagagcuugaaggaguauaggguuaucucugguguggcccuaauuguuugacccccccccccuuucccagcagagagcucagccucaccuccacuuaaacaaccuaaauaggacccgacccuccccuccccuccccuccccuccccuucuccuccccuccccuucccuucccuucccucuucccuucuccucccucuccagcugugcuuagccgcccuggguucagagccagcucuacagaaaagacauagagguccuggcagccuccccugcugucccugcacguaggguuaaugccauuggcuggcucauccuccuggaugucgaaagggacagcuuuuuuuuuucuuuuuuuaaagauuuguuuauuuauuauauguaaguacacuguaacuguuuucagacacaccagaaggcggcaucagaucccauuacagaugguugugagccaccaugugguugcuggggauugaacucaggaccucuggaagagcagucagugcucuuacccgcugagccgucucuccagcuuuugucacuuuugagaacugcagaccauggaguuaggaacuuugcaucacagcugguguagaaggaaagacaggaccucuaaagucacugagccugugacucuggcuagccccaguccucagccccuucccuggugccagaggcagcuuuaauguagcugaccuguuaacaugccagucaggguaguuaccccgcacagccaggucaccugcuagauagggaccaugugcaaggagggucucccuugauguugaugccaugucugcccugugccaucucuccuucccaaacccugacaagugauuaccaggaaggcgcucuugacucugcugaaaacggugggggccgaccaccacuuuccaaucauccagggggucuccacggagcagggcucugcagcugcaacucacccccucuucucucuggacaggacucagcccccagcgaucagcuuaaacaaccuagguaggcugcugcuuccccucccuccuccccagcugggucugggccuugagucccagcagcccccagugaaaggaacagggcuucauggcugcaguaguugaagggaggagagccaagcauuacuacccaguguaggcaagacccacugaucccugaugccuaccgggucacugggugaggccccaugguccaccaucccuaagagagugcccuggacgugcucaggguggccguuucccaugaucccucucaggugagcacugucaccuccugugcuuccccgggagggaggugagaggugagggaggggugcugccuggcuacuggcuuuaacucucacuguuuggcucugucuaaccugagacuugaucugcccuuugcuggcuccuucgguuuccuacaggcuuuugaggugauuaagcagccagcguuugcccccgugugucaccuuagagacaguuccagaguagauggggacccugcucagggccuucuguccugacccacucagggaccuagcauacucggaaguuagagucaccagacagaaugaggcuuagccagccggaccucucugaccguggagggagagacccucaagcccagccccuccugccaagccacccuagccaggccuagaagucuggaggacagagaagcuaaaaucucauggcacaccaucuuucucucuccguuucacaggcaggcagucacucaaaccaggcuggaugguaggccuggggugcggcggugaauggguaacgccugggccuaagagaccgcugagccugccuugucccaccauagcucuagucccugcccccaccccuucuugagcugcacacccaggcuagauuccuucccuacacccaucuguccccggcaccaucagcugccuugcuggucagucuccugcuuguauaccuugucugcauuguggcaugugcugcugagggagccacugcgggcaccugccugccuugcugccucuagucucccugcacgguggccgucaacccugcuaugcggggcauggggggugggagguaguacacagaggaagaccagaccagaugggggcagaugggaggaugugagcccagaggcauggaggacgguucuagacccgggacaaggacgaggguggucugugggacgagugacugggauguucccuucaucguggaguuuggcccugaguaguauccucaucaauaaaguccuuuuggggucuguggcaugugugguggcugucagcagcauugcucuacagaccauggggcacagcugggaggucaagcaggauccuaggaaggggaucuguggggaucugagagcuagcaggggaaagagagagcccgucccaaagcaguggccucccucaucccagcaccccuuucuuagcaggccugggacacccugguucagguuuauccaggggcuggaggcagaugggggaggggcaggaaguguggguucagccaugggcagagcccagccaugaggagaugcaccccaugguguggcacagcucuguuucucuagagacccauggggccuuggggagggagcugccagccucaggaugcccugcccuguucccacagagcuucaggaucucaugcccaucucucgagcccggaagccagcguucauccugagcuccaugagggacgagaagcggagguaaguggggugagggacagaauggugugugagaccugaggcauccucagcgggcucgucccucauccccaccuccugaggcauccuccucacaggcuugucccucauccccaccuccugaggcauccuccucacaggcuugucccucauccccaccuccugaggcacccucagugggcucgucccucauccccaccuccugaggcacccucagugggcucgucccucauccccaccuccugaggcauccuccucacaggcuuguuccucauccccaccucccgaggcacccucagcgggcucauccaucauccccaccuccugaggcauccucagcaggcucgucccucauccccaccuccugaggcaucuucagcaggcucgucccucauccccaccuccugaggcauccucagugggcucgucccucaucccuaacuccugaggcaccuuagugggcuugucccucaucugcacccugugcugagagcucuucuccuagcuguacacaaccauggucgagacccaagucuuuggagccugugacagcucccugguggcaggugauguucccucuggaggccagcacagggccaugcagcugggaugagcuugggcucaugguaguguggucccauuaucuuuuccuuaacuuugcaguuuguagggagagagggaucugcaucugccucucucugcugcuggguuccucacccacccuccucccucacagucacugcuucccaggugguguaggagcagagugauggagacugcauccucucauggucacuagagucugcaggacaaacacccagccauacagccuggacucugggaccaacccuugccugcauugagagaaaaugcugagauagacacacacacacacacacacacacacacuaucuguauaucuguauuacuguuuugguaaaccucuugcucugccucuguuuuggacaugguguuacaacuuacaugaagaaaaugaacagaagucaggagaugugcagguguggguuuggcuggaaaccggaguuagcaaaacuggcagagaauucucuucugcugcuaagggcuggaccccccccccccccgccacaauggucuuaauauuccugucaggauccuaauuccuaggccccggaaccuuugaacaguuccaaggcuugcucuugaggugcaggccccuguggccaggacuagggcuggccaucuccacagccucccuuuguugucauguacuguuguccauuuugguuccccucuuguuggaggccuuccugggaggaacagucuucucacuuagcagauucccagucugaggccccaaaaggugagguggcaaaggcugaguuagagugaaggcuccccccaggccucucaggggcgcacacucacugcaggcccaaagagaagucacucccaucaccagccacagcugcugcuccuguggcucagaagcccagcuuggaggugucagccacuggggccacagcccccauauuuccauggucacugcucaccuaugccuuggagacacaccuaccccuuuagcauccuggcucuugcuuccacggugccuccugcagccauacaccauuucauguguuuguacaugugcacgcaccuccacagaggccaaggcagagcaacuguaccccagaggagaggacuagccccuggccagaggaggacgaggagguggacucuccaguagguagggugugcgcgcuggaccagcgucugaggaguuaggagauccuugaaggacccacaggggagugugagccucggccucuggccgaccuugcucuugccaggcccaucacugagucuugcuuauuucuucagcccuucuggccaggguugcccagacuccgaucaucugugccacugccccugcugcacucugaguucacugaguagccaugugccuaguucagaagacuccuucauuggcccucccucucauaccuguuggaagccagugccgugcagagccgagcugcccugucauggagcuuuguccagagguggagcaugagcagaugcuugccucggagggcagcaggcaagggagcuuagcgaaaaaggagcuuguuucaucugauaauucuagguuacaguccaucacuaugagagguugaggcgggaauuucaaacuagucacaucacauccgcauucaagagcccagagaaauccguguacccauguucgcuugcucgcuugcuugcuugcucgcuugugcuuggcuugauuuucccaccuguguagaguucaggaccucccugucuagggaauggcacugcccacagagggcuggcuuccuccucccucuacagauuugagcagcuaccccaguguagacagucucacguggggauucuucuccagagguucucaguugugucaaacugacaguuaaagccaacagucacaucuggcucucuggcgacuggagaaggcggauccucucacaaaaacaaagacauaacaaaaucauaaaacugaggggagcccagagugagcuuaaaaggaaggguugagcauagacuacaaguauccccagggcauggccauaaaggccuggcacuuugcauguuuugccaucuucaagacuaggcuggacugggcaggcucuuaacaggaauguacaaacuuuuaacauugagucauggcauugucaucuacagaggucaugcacaagaaccaugugauguauucuaacaacaacaaaaucucucucucucucucucucucucucucucucucucucacacacacacacacacacacacacacacacuccuuaugcuuuaacucaguuuaugauuauauccauagaaguuggacaagcccccuagagugugugacucagaggccaagcauguaacuuuauaccauugccccuaacuuuccaagauaauaaggacaacagagaguagcuuccucaguggggcucggacccaugcagugagcuaaugcuagcuacccuucuccacagacuucccauccuuccuugaucucucuugaggaguggccccugacccugcgggaaggaaccagcccuuccuucucuuccccguuuacucccaacagaccuugggucaggccugcagcugacuugcugaccugcuguggucauagagccccugacccuguuccucaccucgcuuguggccuugcucccuacccucuccucaccccacuccucacccucuccuuaccccagcccccacccuggucucugccucaccccauccuuccuuucccuuugcacaucugaaguuugccugcuaguaggcucggcgcagccuccguugcucuguccgugucugccugccgugugcagcucaggggacuugggcggagaaagccauugugacccucuuggcccauugcuguccucgcugcagucacgaccaccugcucugccuggacggagggggcgugaaaggccuggucauuauccagcuucucaucgccaucgagaaggccucgggaguggccaccaaggaccucuucgacuggguggcaggaaccagcacagggggcauccuggcccuggccauucugcacagugagcacagccucuggggcuuggugggguugggcagggcuggccaacugcccuuccauggcagaggacagaucugguuuauaggguguuauggauccguggucuucaucuaccuccucguacuccuaaaaggcuguaacacaacccugcuggcugcugccaguagaaacgccucucauagguagaaugggcguuugugggguaauggggcagucagaggcugccagagccacagacauuccugugggagucccaggcugccaccucacaggcaccgaccugccuccuuuuguguagcuuugaagauaugcaaacacuugguuaacugagguugccauagagggccagcguugccauucagguggccuggcaucuccucuggggagugacugagguguguguugcuggcugauuggacauuccuagcauugggcucagcugcauccugauaggccuuguuccugcacuccaccuccccaaauggcaccccugccuggcuguaggccagauucuguaguuucuaaaguaucugccaaaaucaggacucuggugauccagagcccuggagacaccagaggaggguaccucccucccuccacccucagcgcagacacccugagagcuccugggcucugggucugaggaugcuaagcugaggcauggcuucagaaagcuucuggugagauagugguacagccaucagggcaucugcugggcccugggaugaggcccuggggucagucuaggggcuuucaggaguaugggcucagccugcccauggagcuguccagagccauuuccuguggggcucuggaagagucuucuaccauauugaaaacugcagaggcgggggcggucauuaguggugguugacugucaaaugguucauuugugugacaauugucacccuaguuguguagggugagcacacaggaaucugagggccagagaggaucacaaugaacucagacuagagccagggcugggcucgaagagucggccccacucuccccugauaucagaggcccugagucccuuccagccuccugugacagaacuaccucaggaccugcucugcccacaggguauagggugugcuuccugcagaguggccagagguccccgaccgucuucagauuggaagagcuguggcaggagagggaggagcugcccagugcagccacacacaggcacaagcccugcuucaagcaccaggcccuagggaacuuacaugauggcugggcaucuccuuccccauagccugucuggccuguaggcuuagaggacagugcuguucuucuuuuaugaugacgaggagcuaggaccagcuuuuguacaacuuuauaucuucaaggcccuuuuuagaagagaauccugaaggggcuuucuuucugccuguaugggcagguuucauagaagggccuagaagccuuuccauuaucccuuuggcagauggacccuuccucuaccaccuccugugagugcuugccugugcuuucugaagcuguagggacuuagcaugguauacuggggccugcacgucauccuggggccgcuccaguuccacgucuccucuucccagguaaauccauggccuauaugcgugguguguacuuccguaugaaggacgagguguuucggggcucacggcccuaugagucugggccccuggaggaguuccugaagcgggaguuuggggagcacaccaagaugacagaugucaaaaaacccaaguaagccauacucucuccuccugcucugccuaagucuggggagcaaaacagcagcucaucccauguaggugaggggcuccuccugagaacguggggagacugucugcaugcguggggaggaggggacugagagagccggagcuggagcuuccuggagaaaguggggcuccuuucuccaagccagauggguggcuuuggcaggccuaaugaccucuugccuuuggugggauauugucauggugguuuacagacuuguacucauggacaccaugggacuaaaggagcaggaagaauggcgggggcgaggggagagcaguacccaagagaguuguccaggaugaagcaguguuccagccugcaguuggggcuagaaaaggggugugacucagaggaugggaccuuguuuuuuuaaaacaggguuucucuguauugcccugguuguccuggaacucacuuuguagaccaggcuggccucaaacucagaaauccaccugccucugucucccgagugcugggauuaaaggugugggccaccaugcccggcuagaagaccuaucuuaaauaagagaguagaacauugaagucuccacuauuauuaucucaggaccuaugugcucuuuuuaugucuuuuaaaaaauauuuauuuauuuauuauauguaaguacacuauagugugucuucagacacuccagaagagagcaucagauuuuguuauggaugguugugagccaccaugugguugcugggauuugaacucaggaccuuuggaagagcagucggugcucuuuaaccacugagccagcucaccagccccucuuuuuauaucuuuuaacauuuguuuuaugcaacugggggcucuaauauuugacccauaaguacuaacaaucguaccuuccucuuauuaauauguaguaucucuucuuaucacuucuaauuaguuccgguuugauuuccuuuguugauagaaggguaaccaccccugcugauuuacacauccauuuucucaguaauguguuucccaucuuuugauauuaaguuuuggaguauuuuuacuggcuaaguugcuuucuuagugacugcauauaguugguucuuguuuugguuugguuuuguuuguuucuugagucagggcaguccuagaacucacucuguagaccaggccggccucaaacacagaguucuaacugccccugacucccaaguguugggauuaaaggugagccacuacaccuggcugguccuuguuuuugaucuaguccaucagucuguauguccaucagucugucugauuucagugaugcuucggggccacuuacguuucagguuacuauaggaaggggcuuugcuguuuccuguaaguuuguuuggugguguucugucuuucugcauuacugauauuucuuuuccuucccugugucaguucugagagucugcugaguugcucuguugaacacagcuguuucuuucccaagucugguguguuaaucuguaaugaggccaccuuucaucuuccucuaaauucaagagcaagaugaggaugucccaucuccuguccccucuccuuuccccucuccuacagcaacuagacaagagaacaacauaaaagggaaaacaauaggaagggaagaagucacacucucccuauuuacagacaacacaauucuuuacuuaaaagcccccucugagucuacuggaaagagaacucuuggacucaauaaacacaguaaaguugcaagauacaaaaucaauuaaaaaauaguagccuuuauuuauacaaacaaugcgaucucagagaaagaaauuaggagaaauguucuauccagaauaacuccaaaaaaaucaaguauuuaggaauauaucuaaucaaagaugugaaagaugcuuacaaugaaaauuuaaagauaaugaaaaaggaaagcacagaagauucuagguggaagaaagacauuccauacucuuggauugggggaccucauuugugaaaauguccaacuaccaaacuuaacuuauaaacuuaaugcaaccucccagaauuccagcaucaacucaacagguuuagaaaaggcaacaugagaauuuguauggagucacagaagaccacggauagucacagcagcuguagggaaugaggacccuacuggagguuggacagugccugaaauugugcuauagagcuacagugacaaaggcagccuggugugcuguaaaaguaagcaggaagaccaguggagcagaauagaggacccagaaauaaacagcacgcuauuuuauuuuugacaaaaguggcaaaaacauauauuggggaaaaaaagccugucagugcacgcuacuggaaaaaguggcuauccaccugcaggauggaauuagauucuuucaucuucuacaaaaguccacccaaggugggccaaguaccuccacuuaaaacuugaaauacugaaucuucuggcagaaaacacaggggauacccuucaagauacugggguuggugagaacuuucugaacagaacaccaacagcacagggacaagccccaagugucagcagaugggacugcaggaaaauacaguuucuguacggggggugggggguggggggggggugggggggguggggggggguggggagacgguguggagagcagccaguccgcaggauggaagagaaccuuuaccgcuguccuagcuucucaucuguguugaggagacacaaugaccaaggcaacuuauaaaagaaagcauuugaugccuguauaguuggagagagugcaguccaugaccgucauggcaggaagcacgguggcaggcaggcaggcaggcaggcaggcaggcauggugcuagagcaguagcugagagcugagagcucaggcugacuuugaccccugaccuuccagugcugagauuucaggccugcaggauuucgaagcuuugaggugcugggaguugaaguagaucuucgggcacaugaggcaagcacucuacugacugaacuacacacccagccauuuuuucuguauuuuaaagucaucuuuaaaaaacaaaaagcaaaacaucugcacaggacuaauauuucuaaaaauuugagaugaucuagugugacaaagcaugcuuggaaacccugacuuuagaagcccugagguuaguguuuguugauucucuugaagacucccacuguggcccauuugaggcuaccaacaguuugaccagcuugcaaaaucugacaguuugguuuuuguaaaggagauuaauuuuucuuauuuuaguauguguguugcugcaccacugagugagcacaggagucccagcaugcacugcagcuacagcaucuccuggagccagagaucugcagugugagcucucaacaugggcugcagggaaccagucagguccuccacaagaacagcaaaugcuuguaaccacuaagcugucccuccagcccuaauuuuuuauuuuuauuuuuuauuuuuuuuguuuuucaagacaggguuucucuguauagcccaggcuauccuggaacucacucuguagaccaggcuggccucgaacucagaaauccgccugccucugccucccaaaugcugggauuaaaggugugcgccaccgcugcccagcacuccagcucuaauuuaaaguagcucuucuaagucaucacgagcagacuauccagcccaccacagugugugcacauguguguguucauguguauguguauacaugcgucuauaugugcacauauaugugugccuguguguacuugaauguauacauguauguaugugugugccuguguguacuugaauguauacauguauguaugugugugccuguguguacuugaauguaugcauguauguaugugugugccuguguguacuugaauguauacauguauguaugugugugccuguguguauauacacguguguaccguuuccuugcauuccauuccaugcagagacggaaguccucucagaccucuaacccugaucauuucuucggcuuggaggacagucucuggacuuuguuagggagcucugcugaugguaaauccaccaccagaaaaaucauuuagaaguaaguuugcuucacaucuucaucugagaagaguuuuauuuuacucuuaaucuuucuggcuaucaaauucuaacguggugauuuucugggaacaugugacaccacguggcugccugguaguguguguugucacguccuaauuccaggucuguaaccggucucuucugucuagauugugcuugucugcuugcuguugcugcucagccucagaaugcaacaugcgcagucauggauucuuccgcugccagugugugccagcgucuucuuugguccugagucaucucuggcuuuccucucugcuaauccaucccccacccccaccccaccccaccaugcgugauuccuccguacaugaaguuaaacccauacuugccuccuccagaucuuuuaacuucucuugcauuuucucuuuuucaguuuuuaauauuucauugagagggggagaacacauacgggucagaggaucuuuuuaguacucuccuucugcaacauugguucuuaggguugcgcucagcugccagggcuugcuucaaacaccuuuaccugcugagcccaccagccagcccucucuugaauuuucuaccauuuuuuccccuuuucucucaccuuuuuuuuuuuuccaagacaggguuucucuguguagcccuggcuguccuggaacucacucuguagaccaggcuggccuuguacucaaaaaucugccugccucugccucccgagugcugggauuaaaggugugcaccacuguggcuggcuuucuaccaucuggucucuuuguguugcagucugaauaauuucuuaccuguuuuccagacuaguaauucacucuguugcuuuguuauuuaaccuguguuaauuuaacaaacaaacucauauauguguacauaugguuauguauauuuacuccccaagaaacacucuuugguccuugagguccuuccauauaaacuccuguccccuggaaaauaucacgaggcuggcacucuagucacugcucagagggagagcacuuuuguaguacgcucccagcaucguaaacacacacacacacaagugcgagcacgcacacccuguacacgugcucuggcuugugucacugaacuccagucccagcccuugcggugacugcuccuguaagccucuuccuuuuuauaugugaauugcaucugcugccugucauaguggaaucuuugacacucagauuggcugcccuuccugcagagggcucugugccuccauccccagcacuuucucccuaaauaguugccaggaaaacuucaggacuuucuccagaugauguggacacggugggccauccagcagggcugcacaucuucaggguccuuuccuuucuuguucuaccccagggcucugcucccuguaaccuccaggggugaggaaggugccgguugggccugggaagauggcucaggaguuaagagcauuuccuggccuuguggaggacccagauuugauucccagaacccacagcagcucacaaccauguauaacagcagucccugcaaucugaugcccucuuauucucugcagacacugccaaguuuuuaaacaaaggggcauguuugugucuggccuguuucuauccugagaguguuagcccuuggagccccaguauggaaagagccucccauuggauccucaucuuugguugauauccuguccugucagguggcccaugcucuuaaacaauauuuacuuuuucauuguggauguggauguguacccaugugugugggugcucucagagaccagaagucauaaauucccuggggcuggagcuucaggcaauuaugagucgucucaagggguccucuguaaaagcaggacgcacuuacccacugagccaucuuucagcuuuuaagauuaaaccagugggcuauaguguucuucauguaauuuguuguuguuguuuuuuuuuuguuuuuguuuuuuguuuugggggggggggaguucgagacaggguuucucuguguagcccuggcuguccuggaacucacucuguagaccaggcuggccucgaacucagaaauccaccugccucugccucccgagugcugggauuaaaggcgugcgccaccacgccuggcuuucuucauguaauuuuaagucugaaauaaugacauuuuuaacuuuuacagucaucaaagcucaacgucaaugauaaaggcuauugagaggacucaaaagcaucguggcuuaugccuuuaaucccagcacucaagaggcagaggcuggcagaucucugaguucaaggacacccuggucuacagaaugaguuccagacuauccagggugccacggagaaaccuugucucaaaaaaaacaaaacaacaucaacaaaagauuaacugggucugggggucugggggaugacccagugguuagagcacuagccggucuuccagaggacccagauucucaucauucgcugacaugugcauucggcugcuguuccaguuagaacuagcuacacaagguggcuggcugaugcucacaguaaucagagcugugcaaagaucugaacacacacuaauucucaaggcucugugcucaggcucuuugugucaccggauuaggagggaccuucuuuauguuguuacuuugugugugugaguguuuucugcauguaugucugugcauacauacagaccuggugccugcagaggccagaagagggcaccagauuuucugggacuacaauuacagaugauucugagccauccuauggguucugaaaauugaacucagguccucugaaagaacagaaaauuucuagacuucugagccuucucuggggcauugucgugugugcauaugcgcaugugacuuuuuaaugggcucuugaaaggguagaaagaagccauaaaaggaaggugucaaaguucacagugggaagcacaccccgacacccccccccccagaccccagaccccgccugcuggagcugcagucugcccaaugcucccagggacaggguuggucuccacuuaggugaguaguuagaucuaguguuuuguuuuuaaauaaugcagcauccugaaggcacugccccaaaucuuacuuuuccuuacaaacccugcuucuuggcacucaggccccccaguaagugccaccucgguuuuucuucgguggcauggcacccucagaguaagguaccacagccuucuagcagcugccuugcugcugggcagugauguuuuccugaccauggauguuaauaaagggugcugccaucgguggcucugugcagccugguucuugcccugguaaccuccugggcugaguuuccagaaugggguuauaggauagaagggaaugacugucaguagauaggaaagaguuggccaauuucccuucaggaagcugcccaggucuauggaggugccugggugaggccagccaggaggagcccauuuaaaacagggccuagggccugagccugcugaagagaugaugggugguuggaccaucucuccccgcuugcuucuacagggugaugcugacagggacacugucugaccggcagccagcagagcuccaccuauuccggaauuacgaugcucccgaagccguucgagagccccgcugcaaccaaaacauuaaccugaagccaccgacucagccugcaggucagagcugagcgcgugugcugggggggagggcuggaggaaguugugggggauggagagucacagacaaggcacaggaugcccuccccgcccaugucacugcccuggccuuagguggcuaaggacaggugucauugaagccuguccacagugacacaccaccuuucaucaggauagcaagacccugcagcaaggccuuguggguccugacuccccuucuuccugugcucuccuacccagccugagaucugaagggauaggccuuaugucauuguccccuuccccaccccuagaccaacugguauggcgugcagcccggagcaguggggcagccccaaccuauuuccggcccaauggacgcuuccuggauggagggcugcuggccaacaaccccacacuggaugccaugacugaaauccaugaguacaaucaggacaugauccgcaaggugagagccuucucaggucauggccuggacaugaccacacacugcagaugagaacaguuuuggugugugccuucaccuauucaacacuccuggagggucugaugggcagaguccgugcuaggagaauuuugaggccccaugcaugcugaguacagagaagucugagaugaguggccagcggcugcuguuaguacaggcuguguaccugaugcuacccagccgggacacacccuugcccugcagagcuuacguuccuacuugaagacucuauacacacaacaguccugggcaugucaggucugagagcgcacccugcggaggcaggagggggagagucugugugaaaggguugagaacuggugaagggcuccugaguuuggaacuauccugaggccucugggugcaagacagugcagaggcagggagucaaggacaggcaguggcccucacccaagucgucagagcagggugacaaggcccacgugccaagggaggugaucugacccugccucagcuuuccaaucuucagcuagugacagugcuugucuugaugcccuggggacucagggggcuguugccugugccauacuuggaaggcaucugucuaggugugcauugcuggcuuccccaguccagucauggggaaccgagaugcaccuuugguagguagggugggcauccugaaggaguucuagcagccucagacauguccagucuaagugggagccuguuaaggaugagggcugggguucccaagugagggcgaaucccaucaaggucacccagcaaauuggcagcagagcuggucuaaggccaccccuagucagcucagccucagcaccuagucccugccguguggcccagcaggcccucuucugucccgggaagugguugugaugcccacuccagcucccacagggagcagcugcaggaccuggccaggauggaaccugggucugcuccugcugcuccugcugcuccugcugcuccugcugcuccugcugcuccugcuccugcugcugcugcugcuccugcugcuccugcuguuccugcugcugcugcugcuccugcugcuccugcugcuccugcugcuccugcugcuccugcugcugcugcugcuccugcugcuccugcugcugcugcugcuccugcugcuccugcugcuccugcugcuccugcugcugcuccuguuguuccugcuccugcuccugcuccuacucccucuccuacucccgcuccagggucuuaucugucccucacagcccucugcccagccucgguccuguucugacuccuaucccuaccugugggaaguccucucugaccacccuuucuugcucaucccagggccagggcaacaaggugaagaaacucuccauagucguuucucuggggacaggaaaguccccucaagugccuguaaccuguguagaugucuuucgucccagcaacccuugggaacuggccaaaacuguuuuuggagccaaggaacugggcaagauggucguggacugugugaguuggaauucuuccccggggccuccacuacuggccaaggucccccccacacugccauguauaccccugucagccagcuuugggagacaguccagccucggucucugggcugacagauccuacaguggaaccccagugcggguuucuaguauucuuugaccacagauuccuuacugcaugcagcuauauaaaaggccagaaugcaaauggacaaaaucuagaagagggagggaggggcagccucugucacagcccuaacucagcuacucagugauccuagauggacucugcacagcuaguccagccacuggggcccagagagggggacuuacacaaagucacucugcuaaugaaugccuaggacccagagcccagaggguggguaguagggcauuguagccuggucuuacugagacugcuucccaccagugcacagauccagaugggcgggcuguggaucgggcccgggccuggugcgagauggucggcauccaguacuucaggugagguucagggcucgccugacucuacccaggugagacccaccaacccucaugucaccgacagagguccgugccccaccaugacccaaugagacucagagacacacaccugccagccauugauguggucuuccguuccccagcccaaacuccuguucacauccaggcugguguggcuaauucugggugacccucugcuccuuucucccaacagacugaacccccagcuaggguccgacaucaugcuggacgaggucagugaugcagugcuggucaacgcccucugggagaccgaggucuacaucuaugagcaccgagaggaguuccagaagcuuguccagcugcugcugucucccugagcucccggggccugccagcacacugagggccaagcugggccuggcagcuccauguccaucugacacuaggacucagagcacaaaccgguucccacgaggcaccucuccugguccaucugcacuuuacuacucgaggcugaaagcccagaguuccccucagccccuuucccugacuaugaaggacaacugacuccaucaaggaccccacauaucagagaucaacacuacggugccaguggucccaggcucccuggccacugcugcucaccccuucugcccacccccugaugucagggacuagagaaaagggguuccacccuauccuaguggaauccaggcuaauggcauccagcgccauucgacuuugccccucgcaccugccagccucuccacccugccgccaccgcacuaggagcccuccuagcucccaaaggucaacccugugcaugugcucuucucuggaaggagaguggggaggggcucagggccaccucaacugugaaauaaacggguuuacacucaaguuca

SEQ ID NO: 7872 - RNA, 2465 nt, Mus musculus
ugcuggauacucugagacuuuuuauugucagugcaaagacccgagucagccccuugagugucuaguggagcaucauuauaaucuuacgguguguuuauuugguguuaguacagccccuuucagcagugacgagccacucuggcaccuucuccagugauguaccugcucggcucucagccauuuaaaaucguuaccuauuaaaaauauuuauugcuguauuuuaucuuuguauguguaugaauauuuugccugcacacaggucuguacaauauguacaugccuugugccuguagaagcgaugaguguauauuacacaugaucaugaguccagccguuucuacuuacgcuuuuguaauuuuugauggucuucucuacuuauuuauuuauuuauuuuuuagcuuuguuuuugggggacagagucuuacuguguagcuuuggcuguucuggaacuuacuauauagaccaggcuggccucaaaguuagagauccuccuauuucugcguacugagugcugggauucaaggcguguguuaccaugccuagguauuaauuuuuaauauucacuugugcaugugugugugugcgcgcgcaugagagagagagugcaagcaugccugcagaggcuggaagauggcaucagauucccuggacuuacaggcauuucugaucuccccuccaugggggggugccgggaacugaacucugacuuaauguguagucaaaacaacaacaaaacccaacucucucccucuugagugagugcuaaggagauagcccagucauucuggugugagguucugucccaacacucacuuauaaagagagcuggacacggaggccaaggcucuuccagggcuuuucucugcagcucccugcauuguccuugguuuacugggcuaagcuucuccccgagauucaugcucuuucugcuccguagagccaucguuguguuagcguuggcuucugugugacaagcagcugucacacuguggcuacccucugccauguugaccaccuccuugcaucugugcacacaucaguuucuccucucgugugccucacugccagcacugcuguguaacaaagcacccagaaccuagugaccuaaaacagcacugauucauguagccuaaaagucugugagcugugcggagcucugaggcaagggcucgcuucucugcagggcaccugcuggcgugcguugacugcacuucccucuucggaagucucccagccuggugguuuggcgcuaguacuugaguucauccagggcccaggcaucuccgccauugcuccaucucccuguggcguucuggccaggucccgauagagacgcagaaucuucuagugucuugaggccucugugaagacagugggaugucuguccuuugcuuguugaaaugauaaagcauuuagacagucaggucacagagcagagcaaucuagauccuggugacuuggugacaggcaugcgagggggcuugggacccuguuuuauagccuacacaugauaguaggugugcauugggguuuugucuuguuuucuaagagauuuauucaugggccagugagaugauucaguggguaaaggcucuuuccacccagcccagcggugugagcucagucucugauaccuacauuugcacauguauacauacaaauaaauaaauguaauaaaauauuuuucuaaaaaagauguguguguguguguguguguguguguguguaugugggaagacaguuuucuggaaucccuucuuuccuucaacugugugagcucuggggaugguaccugggucagcaagcaccuuuacccacugagccauuuugccugucuuacuuuuauuuuaccuuauuuucugaaacagguucucaaacuguugcccugaaacuuacugugaggucuagguuggucuuaaccucccagcaauccccagccugagcccucugaaucagggucauaggcauguccaucauacccagccuggacauuuagauggggguuuaauagggagaucgacccagaggagacccaggagagcuuguuugaaaacccguuuuggagaguuuguagacauuaaccuuuuaaauaagacguccgucuaguuucuucugcgucugacgcccucgcgaugguuuaugcuucuuccuuguuuuccuguauuucccucugccuauuuucugcaaacauuucuucucgaucaacuaguuuucuaaggcccuuaacuugagccuuuuaaagacagucucauguaccccaggcuggccucacacuugucuggauggcaguguccucauagcauggauucccucacacucuucugagagcucuauguugcugcccagcccccuaggagcagacacucagaagagcaggguguccacacuggcuuguuccuuuaguugcucuguugagaaccuuguccggcacagacaggcuggcuccauugacaaagccgggggag

SEQ ID NO: 7873 - RNA, 1092 nt, Mus musculus
guuaauuccauauuuuuauuugcaauuugguuugggagaaccuggcaacaucaaagcaggcucuucccgguuauauccuguggcuuuauugauuuucuuucuuauuaucuucauguguugccagaaacagaaaaguucagaguccgagccacccuggauuccuugaggucgaagggagccgggaacagccuccugcccuuuaucaacacgucagccaaacugcccucacgagaaacuuccgcccgcccgaggcauggcccccaucagccacgcagaauuggcuucagucagaagcccgaccgcccccuggcaacagaagcggcuuccauugggcaguuauagaagauggcggcgccugaccgcgugcgagguccacgcuuggggucggggccacagccugccugcggcaugggcucgguggauugguggagagccguagugucgucacgugggcggggcgcgucaguuugcggaaguaggagggcugagaagugcugaguaagccgaggugagugacggcgcggcgggggcggggccugacggcccuuucccaaaccuccuggugccccugucuugaaugucgucaccuggacccugcuuaggaccggccucgugucugcgacucugaggcauguccuccguuaacuccuaucuggccuccuugagugcucccggcuucuguccuuucauccccuggcguccccaacucccauccggugaccgcauucuucuccguugccgcccucaguuucccaacuuccaaaaucaacccuucucccaauucauugcccgacuuucacccuggacuguccacuguccccagcuccucucucugcgcuucugagugcuccugguuuucugccucauugcccgauuucccccacgccaccugcuuccugcguccgucccuuugugcccaaccccugagcccccauuucuaacucccugcuuaucuucucuugugccuccgguuuccauuugcucccccguguguuuuucccaguucucuagccuccaauccuggguucaccuccagcucccuccgaugaccuggaagcuggcgacuaggagccugugacccaggugacugug

SEQ ID NO: 7874 - RNA, 12459 nt, Mus musculus
uguggaugcagaagccuggcucccuguucuccuaggcugaggaugugggcgauggaucuagccacaugggguccucacugucauacaggucuacuggauuucuucauuaguugagcaccuacuauuugccaggcacagccucagcucucuagaagguaggaaaaggguguguggggggugggggaggguggugaacaggauuguguauuuucuagaauugagaacuugaguucagagguaaauuuuuugaacaccuuuuucuuauaacuuguguuuuccuuaaauucacuuauuuguuaugugucugugugugaauggacccauuccaccgcucuaaguacguagagaucagaggucagcuuucuggagucauugucuccuuccaccuuggaaguuguggggucugaacguuaggcaucagaguuuaguaacaagcaagcacaucgacccacagggaaagcgucccuggggcgaguggagguaggguugaagauauggagccgacaccacgugaagaccagggguaggcaauugcuguggcuucggaaauacaaaccuacgguucacagguacagagaaggcacuuaaaaccacgagacuggaugaggucauccggacaaaggauguagaucgacgagagaagaggccagacagugaacuguaaagcaaagcaaaugacaccuccacccacgccguucuccagaggugucacgugaaugcauccagaggacacagucccagcacggagaaccguggcggcucuggcugugggcuccuacagcggggucuacugggggcggcgccucacucgggcgugggcggggucucggcuccaggcggccgcucuggggcuugcuggcggcuggggcggugacgucacugcaugacuggguuuuuaugaaugaaaggaauccugugcgugaguaauuccgggaagcucgccuuacaacugcgcgcggcuccagcccccuucgccgccugccccauaacaaaacucggagcggcgcugcgcggagccggguuccuagugaacugcggucccgaucggagaggaguggggcucgagagcggccaaggaccgccaccgcgacagccgcgacaagcacgcacugagcgccgggccuggcggagagcgguaaggacgcgucagggacggggaccgagcuccagaagugugagcuccggguccugccugggcggcgcgugguccuccugccccuucggcgcccccuuaacaucagcucccggaggggccuccgaggggcuggcugggaggcggugcgcgggccccggaggaagccggggcgggggcgggggcggggcgugcacguacgugacucggugagaacagucccuggagccgcgcccagcaccuugugugcgcgguuuguuuacgucucccgguggcgugcgugcggcuguguucuuuggggagcguccugaguucugcgggcugcgugcacacgguguacuucgggguguguguuuguguguguggccgcacgcgcuccuuggagacugacacuagcccaguguaucuugaagugggugcgcaccaguguccacuggagcaaaugcggaauaaggacccgagcgaaggaaguggcccgaucgguggucacaccaggucuggaauuuuucucccgccccuuccacccuccgucauccucccccuuuccaccagccgggacugcccggucccuguugucucuggaguuuccccuggcuggagccaugugacaucaguguuuguuccucgcccagcgcgggugccugcagcuuagaauagagcagagguuagcgagccagucuucuccuggccaccugguggaucugggaaccuaguacaugggaguccuuccuuagccccaaguuuuccggcucaguauggacuguccaccccuggauugucccauucuuccagucucaggagaaacaggcaaggccagaaaguuugugacagauuggagaacacaaggcucccggacuauucuguuggcgacugugguuggucugggugucugaggcugcaccugcuggguccaggaggauggcaugaggcccacugucacacuccucagguuggacuccuuagacuggaccucuguguagaccgaucgguggucacaccaggucuggaauuuuucucccgccccuuccacccuccgucauccucccccuuuccacccuggaccccagggcuacuuaaauacugggccagcuggcacaccuggagucuacccaugcccagcaagaucagcagccagugcuaaccccugaucuuccugagggaaggguuaaugugggagaggagcgcugccugagaacaccuguucugggaacccccgugaucccacucaagacuuucccucuuacccccucccccacccgagggugcuggaguccgaggagguggcaacugaacuaguuaggggguggaaucagugauauuuuaacuuugagcccagugaguucugcuaccacugugaggauuccaggguccccaucugcaguaugauggcaggagagcucugcaagacgcucuggaagcugagaugcacagccuguuuuccaggggaaacagggaaagcagaggccaucccaaggaccggggcuggauagaauuggggguuagggguuugcagccaggcccacaggaaucauguggguccauccucaaaccucaucaggaaacaucucccaguaaagcugggggaucagaggugaggggacguggcuaacuggcucacugacagauggaaacuuagcauugaaagaugguuuucccuugagucuccaggggacacuuuuuuuguuuaacaagcauuuugucugcauguauauguuugcacuggguguguaccuggugccagcagaggucagaagaggguuuugggucccuuggaauuguaguuaccagucaugugguugcugggaaccaaaucugggucuucucuguaggaguguucuuaaccacugagccgucucuucaccuuauuuauuuuggaaaggaggacaaauuuauuugagcucauggugugaggggguauaugcucaccguggcaggaagcgugguggucagaccaguuugucuguggcuguggugguacggggcugcuggcccccaucucagugccccuggaagcugcugggccagauguuggggugaggcugauaggcagaugcagagauugccuucuaggaaacaaaguaaaagaaccaaagaaguagauacaguguagcagcugagauaggcgggaugaugcagaaagccaaguuugcuuaaguagcaacagggcuucuacuuagcuggccucaaucauggaagguuucgccgggggauguggcuagcaacuuggugacugauggugacucuggaacccggaggacaagggcuguauuuccucuuuggaccuucaaggcgcagcacaggaccuggcagacaguaggugcucccugcaucuguggcuaguugaagaaaugagcaaugggucuagguccuugaggucugugacacagguagaaagaggaccucggguccagggaagcagaaagcaagacugugggcuauugggggcuugaaccccgcccccaaugagcagguccuguagaguacaggggaguuccuucuucacacacacagagcccuuuugaccaauagucaauagaaaauccugucugcucauuuguugguuauuaggggaaaagaugcuaugagaauggagggaacauguuagcagccagaggcgccucugugcucuggggcagcugguagcuugagcucugugguuuugauuuuguuuguuuuuguuuuuucuucccccaaagguucuuuaaaacucauuuucugccgggcaugguggcgcacgccuuuaaucccagcacuugggaggcagaggcagaggcagguggauuucugaguucaaggccagccagggcuauacagagaaacccugucucgaaaaaccaacaacaacaaaaaaacccucacuuucuacguagauguuugcgccuuagugaauguaugcguaccaugagugcaggugccuguggaggccagagggugucaggucccugaaacuguagccgcaggcaggcaugauccccuugaaaugguaccgaggacagaauguagcucaucugcacaggcagcaaguguccuuugaccacuaagcgaucgauuuagcccgaucuuuguuuuuauuuuuuauuuauuuauuuugauauaaggucuuauguagccgagcuggcuuugaacuucugguguucauaccucugccuccuaagggccuugaucauggcauacgucgagaccacacucaaguugcccaaggucucaaaacaugccaaagucaaguuuguagguuugugucucuagugacuccuuugacgcuauuggagguaguggcggaggagggggaagcaauggugaggccacuguggucuuggucuggcugguaagaggaaguggcccuuagcugugcagguggaggagaaaggaggucagggcucauagacuggcugcuugugcucucaugcuucugccuccaggaggcccucccugguuuccuuuccuuuccucccaugccuccaaccugcuagcagcauuggauggagcucuaugcugggccagacucuaacacuguaaacucagacauugccauugcugggugguaccuuaggcucaggggagguugggcauguugggaaauccaggcccagagaaccaggagcugacaaccugaaagucacacgcugaguguguggguagcugaauggggcuggaacccaaggccgcugcuucccugcgugcugcuccucucucagccuugccccuucccgcagggaggaggcgccccggccgcacuggcugccaagacccaggcaaacacauuuuuuccccucuguccucagccagagaggagcccaugccagugggugggccgucugcaggaugucucggguguacagcaaggggccagagacagagacaggaaggccauggcccucggcggcggggcagccgucaucucccugagaaugagcucacaacugggucuccaaagaacacuaggaaccucagaccuggaguuggcccugcuggcuuccccaggaagaagaggagccuugagggcggggccccccgggucaggcagacugguggcagcgggcuguccuugccuuguguccuggaaaacuggggccugcugcuggaagccaaaagccaaaggugaugggaaaaucccccuucucauguugggacguucccucugagacugacugacugcugagcuaggacauuccugggcaaaugcgggccuccauggcuggcuaggaugcuacugaggagccugacacuagaacagggguggggggugggggugggggguggugggacagaggagggugggcagguccccagccuuccuagggccaagcacucauugucucuaaagagcauggcugugguuccaucucuuggaggccgggagcugaggaggaggacaggggacuggcuguguagagagggaguucaaggccuugagaagaaaacagggagguuuugaaagacuggggcuguuucaacucacuggaaacaggugacugguuagaacugucuggcccagccacccaagcccgacucugacuugaccuaagacuuuuuauacacuaaggcauuuuacacacugacuucauucuacaagcgggggugggggugggguggggaaccaggcucaggaaggacaggugacuggugaggagccaggcuaggcugccaagguucuggaacaggcacuguacuccaguacuccgcacccaguagguccuuaguuaaccucugcgggagagacccccuucuuccaccaagugucuugacgaagcaguuauccauacccccacccccacccagcuccacccaacccgcaaggaggccuggacgugcguuguccuuugcauguccugucccuaaccagccuaacccaggucaggcagcacaggcaaaguggcuuccucuacauagaggugaggagacagggugcagagaaggggcuguacagaaggguguacugugaggagcugucuggcucaguggaguuucaguccugggcucugcccuguguggcuguguccccucggucacccucucugggcacauuacuuggcaguguuaucagaaagacuaugaagaugaugguaggucaagaguuaguccugaagccagacagugguagccgcaugccuuuaauuccagcacuugggaggcagagguaguuggaucucugaguucaaggccagccuggucuacagaguucuaagacagccagggcuacacauugucuugagaagggacacacccaaccaguccugagauuuuuccugguguuaggauucuaccccauugcagauagguggcuauguggcuucuagcaaguaaugucccucucugggucacuaccuagggccuuuccuacaugcaguucugcaggugacccuugcuggcuaugcugguucccagagcuggcugcagcccugacagcuggucaggcuuagcaguuuuacuaaguucccagcuguuucuugucccuuuauuuauaugacaaguucucacuaaaacuguagaagaaacugucccauucuacagaugggauaguagagacccaucuacuaucuacuagagagagaagcucuccccagauugcacagccuggagaauacacagacaggacucugggcuugccuuccaaccugugccccuuucccuguuuccuacacccugauccgggccaaaggucacauggguggggucccggugcuugcuccaguucuccuggcacaugugacaucugcaggggcagaugguaaggaggaugaggaagcugccuagcaaguuagacucacaccuugcuucccuaagcuggucuuggaacucagcugagacacugacaagcugggugaccaugacagagacuccaaccaacccccaccgccccaucccuguucaccugcucccugucacuguugggcccuggcugggcaaccucaaacacccaaggcugacucaauugugugguguagggacagcagggaaauggauggugacaccacugagggagaaaggcugaagcaagaagggcuaggggacaguggucaccuagcaaacuuccuacccuggggacagagggugagcaggaaccugguggaccaacuggggaaaagcggagagguaucagaggauggcaguggucuggaggggagaaggcaagagugagagaugaagcgaaagagauucccagaggcagcaggcagaauggagggaggcaggcuaguggggccaguaggguagggcugggcacagggccugccuggagcccgggauggaugccuggacucugucuucuggcuaguagggauccauggggcccgcaggaagugucuaugugggcauugucaugucagauuuucuugguggacaggcaccacccucacccagcuccccaguguguggcucaggcaggggacuguuuaaagagaggccacugcaggcacagugacccacaccuguauccucagaugacugaggcaggaugaucagaaguucuaggcacuccuguaaagucaaguggacuccuucacccagaaucagcaccggaacccacaccugcccaagucccaaguucuucaagcuacauccaucaugagagacacaauggcuuuuuguucuguagagauggagucuugcuguauagcccagucuggccuugaacuugguauguagccaagggugaacuaaaaugcuucagccuccccaacccugggauuacaggguaugugggaggucaugcuggccugguggcucuuguuuagucuuugacuuguuuugauuguuugagauguaaagauggucucauggagcccaggcuggcuuugaauucacgaucucuaugaugauuggaaccuuugacccuucugaguguugggaucacugcuuugagccucaacucuccagcgggccccaaaaaacccugcuagcccuggggccacaguagccguuucggucaaaacugucuugaauggccaacuucccuuuccugcccagcuccuuccugcugacugagcugcuagaccccugaccugguaggaguucuuccucagaagccccagacgguccccaccuuggccugagucacacugagagucccacaguugucacaugagcaucuucucuagacagacacucuucucagcccuggggaaaccauagaggacucagcaagguuccugcaguugaagaggggacauccucacagggcagacagacacauggugcugcaugcaugugguaaagacucagugugugucagcacacagggugcaaguguguauggaggccagagguuggcucuugcaguccaugacugcuuguggucuuauauggguuagcuuggucuggggaaucuauuuuuuuaauuaauuaauuuauuuuuuauauauaugacgaguacccuguagcugucuucagauaccagaagaaggcgucagaucccauuacagaugguuuugagccaccaugugguugcugggaauugaacucaggaucucuggaagagcagucagugcucuuaaccgcugagcuaucuccccagcccgggaaucuauuuuuuaccccugucuggaauuacaaguggacaccacacauacccuguauuuauauagguuuugggggauccaaacucaggguuucccacuugcucuuuuaaauguacuuauuuauguauaggaguacacuguacuguaaagaugguugugagccaucaugugguugacccccgcucgcucuggccccacucgcucuagcccaaagauuuauuuauuauuauauguaaguacgcuguagcuaucuucagacacaccagaagagggcaucagaucauauuacagaugguugugagcuaccaugugguugcugggauuugaacucaggaccuucggaacagcagucagugcucuuaaccucugagccaucucuccagcccuuugaauauuuauuuguaugaguauuuugucugcauacaugucugugcauuguguguucuaucucuagugcagaaaaaaaaggaaaaugauuggagagauaacccaggcuggccucgaaguugcuaugaggccaacaguagccuuuaaguccuucuuggcccucuaccuccagggugcgggauacaggugugcaccacaccagcuucccuccaugaguuucuauccacuugucuccccagucccuguccauggcaaacuacagcuauucagaaaauggccacuaaaggaaugugaggcuccgaggcucauggggaaggcucuaggaccaaugggcuggcuuuaggcuaggggauagcugcuguucccucuagagcagguguucuuagccuaugggucuuguccccuuuggcgguuggaugacccuuucacaggggucaccuaucagguauccugcauaucaaauauuuauacuacaauucauuaacaguaacaaaauuacaguuaggaaguagcaaugaaaauaauuguaugguugggagucaccacacuaugaggaacuguuaacagguggcagcuuuagaaagguugcaagccacgcucuaggaccaugcugagcagugaugggcagacccagggagucugggacucccagaggcaggaggauagugaguuuaaguucagccuggauuacaugguaagaccaugucuuuaagacaaagaaggcaggugagauggcucuguggguaaaaggggcuugcagccaagcccaagggucugagauggauuccuuagaacccacagguggaaacugacuccugcauauuauccucugagcgccacacaacugucacagcgcuggugugccugacuaacgcacacauaaauguaaaaagaaguugaaacaaacccaaaaguugcaugcauacccuggccccaugugggaaaggagaguggaaggagaguucacauuuguugaguaccuaguguauacaggcacugacugaccuugguguggagaggcugcagugaaacgggaacuucgguggagaaggggauggggagggacagaccauccauuaggacaccucugaaaagguggcacugggcaaagaccuagauaaugagccauuauggggaacuggggcaauacagggagagcaagagcgaaggcuggaucguuggggucagcggagguugcuaucaauucugagauagaagccuugaaugccagguccggagauuggauuuuacucauguaaguaaaacaugaacacaccaaccaaggugacccugaacuucuuucucucccaggucuccagcccagaggucaucuucugcgaaaauggcuguggaucccuuaucuagcaaagcccugaaggugaggcugcuagcuccuuguagucucucucugcugcugcuccugguagagcaccgacaucccaauuccccuuuccuuccuggaagccccaaaggcgacucagcagcagaggcagguuacuuccuguugagcgcgcuucccccauugcaaggggcuuuccaggcuggguuucucagcuggguccaggacuugacgcgugguuaguuugagccuugggugaccuccuguaggcugaugcugguccugcuaacuuucaaggucuuggcucaaguccaguaaccgccgaaacggggagagugggggcgcaaugagaaggggggcgccaugggaaguggggcggcauccucaagcacgggccccgugccucuguuuccccauggcccucaggucaagcgcgaguugagcgagaacacgccgcaccugucggaugaagcgcugauggggcugucggugcgcgagcugaaccgcaaccugcgcgggcugucggcggaggaggugacgcggcugaagcagcggcgccgcacacucaagaaccgcggcuacgcggccagcugccgcgugaagcgcgugugccagaaggaggagcugcagaagcagaaguccgagcuggagcgcgagguggacaagcuggcgcgcgagaacgccgccaugcgccuggagcucgacgcgcugcgcggcaagugugaagcgcugcagggcuucgcgcgcuccguggccgccgcccgcgggcccgccgcacugguggcgcccgccagcgucaucaccaucgucaagucggcgccgggcccagccccugcugcugaccccgcccccugcuccuaguacccgcccccaccccaccacaccccucggaggccacucccuucuucaagugccugaguuccuucugcuucccauuccuuuccucugccacucguuguagugacuucacauuccuuuccugggcucugacucuugcaggcccccaaacugggaccugauggcccuggggaggggcaacuuugcuaaguuggggguggggggaggcguuaggguucuaaguuucccugggcugaaaguccggcucaaauugaaaaugaggucguguggccagaaggagagcugguggaagaggcuuuggauugugccagcaugcccuuccgacccucccaggacccaggacuagguguggccuugugagacuguccugcugggaagcagaccucccaacugugcuugagacuugggaaugccaggcuuucccaagcuaagagucuuuggaacggaucaauggagcucaguugacacauggggaagcugucaggcaaaacgaccuaaggccacugagcacggaauuguugagcugcaaacccaaguggggccuucuuacagcugccuuaaugaacauuccaagcguggcuuucacagggggaacaguaccccgggacugaauaacaugguaggagagccucccgggccugggagacagcugugugguggggaaagaagcugaaggagagagaaggugacacaaaggguugaggugaggagcuggccagccagagaaagauggauggagacgaccacugguagagagaggcaaacacuacaguccugaugcaggagaaugggguggguguggggugaccuggaguuacggcuuccacuuugguccagaguaucugugguggucugagggugcugaucacugucccccugggaaguccagcccuagcaccuucccaacacuguauacagcugacucuuccacacucuuauuuauugcacgaaucuaaguuauucucaccagccagaguccagcuccucuucccugggaaauacgugggcccugagcuggacuuauauuuuauaucuacaaauaaaucacauuuaaucuuauauuuagggagagcuggguggcaacaauagguuuuuuuuuuaaaaaaaaaaaaaaauuugcgcagcucccagaguuuauuuauuuucugacuucaagugagccaguuaucugccuugaguauuuuguagacuuucugaauaaagucaaguucucuuuuuccacaaga

SEQ ID NO: 7875 - RNA, 42888 nt, Mus musculus
agagauuucaauacaaucuauauuaucucauauauauauuucuuccugacuuuauuugcuugcuucugucacgcauuuaaaauaucacagagaccaaaauagagcggcuuucugguggaacgcauggcagucacaggacaaaauacaaaacuagggggcucugucuucucauacaucauacaauuuucaaguauuuuuuuuauguacaaagagcuacucuaucugaaaaaaaauuaaaaaauaaaugagacaagauaguuuaugcauccuaggaagaaagaaugggaagaaagaacggggcaguuggguacggauuccuguccccuguucccagggaccacuagcuuccugccacugaguucccccacagccucacccaucaugucacagggcaagugccaggguagguggggaccaguggagacaggaagcagcaacauacuuuggccuggaagauaaggagaagucucagaaacacacugguggaagcaaucccacggccgugccccaggagcucccaccugucugcugccucccuggguggcuugggagcagcuggccaggcccucuggguggggccgagcuggccucugggccguguggaaggaaggaaggaggcuaagaagguugcuaggaugugacagccccaugaggucccucccuauggaccccagggaaggaaccuguuuguuccagaggugaccaaggggagagcauccacugaaggcuacaagguagggcuccccaccacucuccaccucaagaggcuacuggagccaagaccaagugcugcuugaauucugcuuaccaggccccugccacccuaccucugagaucccagcccugggaggcagcucugggaugugcguguagagggagccagggagaggguggguggucccaaggaugcccaacccagcgcugcggaacccugagugccagcagcucaacgaggagugccuggagcagacgggaacuggggaggggcuuucauaugugacuaaggcacagaagagaugggccaggggccagauggagcagaccaccaggcccuguauggucaggggacccaggagggucugagaccaccccuaccuuggccccgcuguaugaccaucccuccagccucccucuggaagugaucuguaauguggagacugacuuuucccaugacccaggagggauaaaccccagggagaccagggccuagcaggagucuuugcuccauugaggaggugguggggaacccaagcccuggcacagucaggaaguauaagggagugugggggcucugcccccaacuaucaagaacuggacccaagugagagggcagugugggcuucuggcuguccucagcaggcagaguggccacagugaggacacccaaggauccagagccccacaugucaccaaagggcccauaggcacaaggcauccuuccuaagugggcccugaggcuccugggggcuggcucugguccuugcagcaugccagacaggccuagguugggagagggggaggguccacagagcauucacgucucuaccugcccagaaugugacaaaacucacacuggacaagggugaccagggagaagcgggcaaaggccuggggaaagaccaggcugggucuggguauugcacgguguagggugggcugggccugacagcucggcagauaucuuguuggggagggggcuuaggaugcagcuucuggccaacacacgguacaggaugagucgcagagaugugacagcuacagccgcuguccucugccccugccccagcuagugcagggcuggccagggagaaauauuccugaggccuguuccucuggaagugauaugcgaguuucugguccaauaaauaaaagggcagcagccaugcugugcugguugcucugcuccccagccuggcugggggcugggggaagcaccucuccuuccccuccagggcccacacuuagaacucaucaucagagcugagcagcagagucuucucauugucgcgugcaccacuaaggcugugggagcgggaaaggcugugcgugccgccacgccaggugggcccgggcuccagaguggacugcugcguguacugcugguaggcuggcgagaaguuguggauggcguccugcacaauaucguguggguucauggucucuuugaggcugcuggagaugcucuucaugggggcgcagcggccugaggggagggcggaggggggggcacaugaggccggagugggaggaggaagacuuggucagucccugccccuacuccugggacagaccccaccccagugcuccugggacaugaaagggacaggacaccaaggcugcugcugaccaggagagaccuggggagcugugaaggaagcuaggacaaaggggcagaacauagcacucagggaggagaagacagggcaggacgggaaagcugcaggcagucacuuggcccaccaagcucuagugcuaggcugugaccccuagccugggauggcugcugaaccaggucucagguacaguagcaggcuggccuguuggcugucccucccagagggcaggaacucgcuaccuugacuugcuucuaacucauccaccugugccccacagcaucaggguaggacuggggacacaguguaggccaccaagcccagcuggagcgaugagcucaacacugggcccaggccgugaaugggacucauacucucucagaaacacuacuaaaugccccuccuguuacuuuaggggcacuguguuccagaaccgagcagaguguacuucaaaaccagagaauggaacgaaggcagccaagcucugcaaaggcagcucucucagucaggugcucggggcucucaccuaggagugccagcuuggaggaguggguacacgcggggcuacaaaaaggcaugccagugacgggagcagacugacgugcaggacagacgugcagacagagcagagagcagaccuaccguaugggccguacgucagcacuacccgaggccaaacccagggcaaaugcagaggaaaggggcagggagaaaagccggagggauagagaagauaagagacagcugagugaaaagggccugcucgccccaggcccagugacgcccccacccauccccagacacccaggcugccccugaagggcagugcucgugcuaauaggggucacccugauggcaguggaaguuccaccccauaucugagggccccucuucccacuucuccuaggucugcuggagcuaugccuacagggagcucugugucuuacaaaacucacuccaauguauagugcuagaaaucaaggcucagagacgaucacagagaguguucaccccagccuaaucugagugccaugguuaggagaauggacaacagcccgcagcagcagcuuguccugggugggcuguuucuucuagggugggugcaucuauaggggagguccugccugagggaaguacagggaacagccaccaugccaccaguaaagugcuccugcagagccucuaagacacaacaccccucugugcaaacuaaccuggcuugcuucuagcagccuggcuaaccagguuuaagggauauggauaaaaguuaucggaucuuucccacuggggccuagcaggaagcgggguggggguggaccaacuagcaacucucggcagagcagggaugcccucaagcaccaggguggcggcuaaagcgccauugugucagggagcacaggccugcagaggcagcugaaggucacucccaaccgagaacagcaaaggggcugggcagggaguccugucuugugggucccuaagacuccccaugccaaccacagggacccauggugggcacugaggcuuggguaagggguuucuggccugcagccaugacguaaagcugacagcaacuagauggcggugggcagguacuuuagucaggaggccucccuuuccugucccugcugucucucaccggauggcagccucaggcauuccccucaggaacaagccuucuacacaccuggcccacugcuucuccagacacccgcacgggccaaucacagaggugcccagguuggcccuacccaccaagaucuuucuagggcuccuguggacaccagggcuaugggauacugccuuagcaacaaggauuagaggcgugaagggccagcggcgggcaugccuuugacccugcuuuucacagggaagugggguuucugugguuugcuccuugaagacagcucagcaggcagaagacaggucagagcagacgcuacucaguggaguuugcuagucucugucccuacuuuuuuuuuuuccucaaacucauaguaacccuccugccucagcuuccugaaugcugggauuauaagaauauaccuuucuauaccauuuguaggucucuaugcuaggaccuacaugggugaacugagcuucuacaagcuaacuaggggucccucuggauucugacagccccgcuacucugacaucuuuagcucaucuuucaguauacucaacccucacaagaugccggguggugggggucucuggaguuggccuccuaagacuggggucaugcccuggguaggaaccuggcucauaccuugagcguccagucucuugucagcguagaccuuguaggugaaggcaugccgcagggccaaggccgcgaagaacaucuccacacagaugaugaaguccugguagccggcagccacggugcccucacccacugacacucgcgcugaguugaucuuggggauggccccgcacuucucuaagauggccagcagcaugccuguauagggagagccacugucuggucacacgccagaucccuucccaugcccugcagucaugcagugccacccaaacagccacacaccccaggguacaauagggcucauuugcuccuggagacacugagaacaggaguuuccugcaagcuucaccccucccaagugcccagugaguuccaggccaggaucuuaaaggacagaacucuggcuggaacccacaguucuggaaacaugaaccgagugggagaugggaccaggguggaagcaggcacuggggcuaugagcaccaggugagagaaggccgaccuugccagaaggagaggaauaugacggacuugaccaugaagaacuugaggacagggcuguaggggcugagcagcucccuuguggcaaaguagaagaggaagagcgcauauagggccaggcugacggagauguuguagaugauggucacguagagguacccacuggugacacuguggggaggcauguguggcugggaccagcucugugagggcaagcugcccccuccuccacccugcccacaaccugcucccauaggucacagcugugcucuccaguaagguacaaugacccccuggagggaggggacaggggauggggacagagugggaauggagugcagaggugcugccagcaggccagccugccauuaccgcuucucccacucacauggaggcccugcucugaguccacuccuuauggaggacacuagagagaagcuggggcuaugcuggaggugacaagugucacagugggcaaacugaucuugguggacucaucugccuaggugggcugugguacagguuacaggcaagaucucagagcacagggucgaguguaaggugccuucacuaacccacaggugaaaagauguggcugguuuacauaguggggccuuuacaucagggucugaggacugcuucccagggcuccuuucagaaccugccuuagagcagccaccaccuucugagacucacccagggcccaugcaauuuagggagaccacagugggcugucaagguaggguacccauuuguaugccaauauuccacccacagaucccagggaggaccccugcuuacucaaagucuccgucccgguacuugccaaaggccuggaguauaacggugcugacggccaugaguggcuucaccacacagaacugcaggguggccuguuggggagacagaugaggcaggauaaguaggggugcuccgcuucagcaccugcucuggcagcugggccuaugcuggcugcuaggaaggaggaagcaacugccuagggggaggccaaauguguaaggagacaagaggaugcuggggauucaaagacuaggacccaggggaccaggagcagaagacaucucagagagagcucagaggaugagaggccuucaggaagauggcaaggccaggauccagccaaagggagcagcuccaagccaaucacacagacacacacacacagaguaaacaaacaaauaaacuaacgggagccuuucauucguauagaggcuugcucagggcagaaugugaacaaggaaagggggggggagcaggucaggauacagcagcagggagggaggugguucugggcaagaggcucgauaaggaacaccuggcccacacagggagcgcaaggaccuccaucaucuucuucuuuuuuuuuuuuuuuuccgagacaggguuucucuguguagcccuggcuauccuggaacucacucguagaccaggcuggccucgaacucagaaauccgucugccucugccuuccaagugcugggauuaaaggugugcgccaccaccgcccggccgggccuccaucuucucauccuccccagcugcuuccuugcccacacccuggccugggacagggauucuguggagcuggggucugaguaggcuggagaaagccuccaggaacagcaagugaggacaggacaccccuuuaauaugcaugcuccccaaaagguacaugggaauccaggccuggcugacuauccacuguggucucugaguggcagccaucgggcugaauguuaaauaccccguguccacagcacaucagaguuagccgcaguguccuccugccgaggcuaccuauucuacacacagucaggcuuuuucaaacuugcucaaaugcgggaggauacuaagccagcucugcaguuucuguaauccagugggguguccgugucacccgcagacucacacugaccucaaggccaucauccucagccagaagcccugagugaaggagaggcggcaggcacacggcauggccaguauggcucuggcuaggcccagaggcagaggcugaaagcagaaggacugcccgggaacacaucuccacugaggagcacggcacaggcagggcugugcgcugcuaucagaaagccccaacagaagcccugggcugcaaaccuucaccagaggcagugugcggaagggagaaaagcagggguucacaccaaggugcccagggagcugguggggcugcucccuguagggaacuuuuaucagcucagucacacacaaggaaacugaggcaggcagaugcagcaacggcgccuaagccaacaggcuccagaaccuuuguccagcuauaccaugggugggugucugagggccacagucuaggggagaagucaaaauuaugugucagccccagagcgggcagucuuuucuagagcucuguugaguugggggguuaggggucacugaccugagaaucccugcuccccucccuuccucugucaccuaacccccgccccuuaugucuccucauaggaacagaacccaggaaaacacacacacacacacacacacacacacacacgagggaagugcuuuuccaucacauuguagcccaggaauuuccccuuuuaacaaaugugccaaaagacucagacacugggcucugggccggaggacauccuggcccacccuguggugcuggaaugaagacaggacuguguaaacagggguggcgcaggggucgggcgccuccacaugcuccuucacuccugccuucaccgccacggugaaguucaacauugggggccccagaguccugggaggggaauggucuguaccugguggcggugaggccaacuguguucucuguucugcucuugagagcaaaccuuugaggacaaugucaugaucaaacgcggccaugagucacagcugggccuggacuggguggcugaacuacacaaacaaaggcuaggcaagccccacccuggaccagaacagcguuaaccccuuccggaccacuccacgggagagaccgugaggcucccucuaggagaggcucccucugggagaggcagaacugaagcucggacauguccacugccaggcuguugugcagguagccgugcuguggcccugagcccuguacagaggccaacaagagggacagacuguagugcccuuggcggggaggugagggugggggggaccuuucucucugacuaccuggccauguuggaggcuaacagaggccugcagaggccaagggcagucaugaagucuggguguggcaccccuagauacuaucucccuagaugagacagagcugugcuaaggacuacauccucugccucaucugcucccuucagucaccuccugagguaaguauugccaccuccauuuuauagaaggacaaacaagcuuagagagguuaaacaaacgaugaggucacacaggcagagaagcugcaaguccaacuguagccaggaaguggugaccaaggagaccagcagccaugacgcugugacuggaacgugggagagggcaggcgcugcgcagucuggucugcucggugucucucaugcagaaacccucuuggcccagaaacagggauggguuuuuaaauagaugguccagaacugugugcuuccugguucuugaacacaguaagacucugggccagcuucuccggccccaggcugccccugagacuuccaggauguucacugccagucucagcagaugacauuaacauggugucuccagaauagcuuggggacagcucaagggccuggagaccuccacagguauggcacaggucagcaugcaacacgaaucacccuccaggacaaaggucugaaccagggccccuugccugcucccaagcuggggcugucgcuggccacacaccuguuuacagaaccgcaggaauccgauggaguaggucuuuccccagaggcagcacgugccguacauacagcuggaccugggaaugacaaguagagagggcuggggccaggggcugggguggucugugugcccacccagggggugcguggguauggucuaugugucuacccagggugugggugaggcugggaguugcccacauggggcucaggaagcugucauacucacucaauggccuucccucugaucucagacaugauggcacucucucccccgagguacucauagcacaagcucaggaaguuauagaugacaaaggcugcgaaaagucagcagagcggucacucagaacagagcggcaagccaagggcugagcugcagugacacuuagcccugcagucgucugaugaccucugaccuuucaggauacagggcagcauagagcuggggugaagaaccacaugccccugggccagacuguccagcuguggaccauggcucuaccgauuaggagcuguguggcuuuaggccggguucucaagcucucugugccuguuuccucagcugugaacuggggacaauggccuccucagccugcuguggggcgaagagcagcaacuauaugaggcccugcugacagcugaauucccuggacaugcucccgugcgcucagugaguggugugacgcucacuccagagcacccugcagggaguugcugaguccuaccccaguacaagcugaaggccugggaccugcagccagcacugcagggaugaaggucaggggcuggauguggccucuggcucuccagcauuaucaccuauggcaaaggccagggcaggccacaggccuacgcucacacuggcucucacaggaccucccccuggcaggacagaaaaggaaccuuucuugaaauggauucucccagagaagccacaggacccaacaccacuuccccuugggaggacaugucgcccaccagagcuuacacccuucccuuucugugcagugugagccugggcugcugguccaccacagccauacccagcucugacugaaaggcucacucccgcugcgcuccacucucagcucaagacugucaccuuagcaaguacacagaacaaccagugcuguuucacugccaacaaucacuagugugucacuaauaaauucaucaauucucagagaaaggagacgagaacaaccuccucagacaugacugauugaucaaaucagguccccugacuaccuguuaaaauccacucccuuugguaguaaauauuuaaacuccuccugagguuucuacccaucccucucggauggacgaaagacacacacagccuuuauacuuacaauacacguuaaucaguacaauagcugggcagaagagacauaggugggguuuaggcuuugcggguuuggggucagaggaggaacgugaagggggagaagaggagggcaugaggaagaaguggccauggguuagaugagccagaagaacaugguucugagggcuggcugauugaaguuaugagcagcccagacgaaacacaguaaguaacucggauuaucgauagcaaaguagauucuaacaucgaggaggguaagcagcugcccagcucuugugcugcuuaaggcuuauuaaaacuauaaaggcuguguguguuuuuuuaucugggaagucaauaaccccgggccaggauuaaaguaauuucuacaacacuuuuccuaggaaaauauaggcucacacagaacagacccaacaauagcauuuacacaagaaugcaucuacacaggccggaaacagaaaagggaggcugacgugugaccaggaaugggugcaauucaggcaguaggcugccauccugcuacauucucaauguggcuccagaccuggucucuacgaaggcaauaucuaccacagccugcacgccaggucguguguuaggccagggacacauuagcaaucaugggacccacaguccagagggaagggauggucucaccuacuccugcccuggucugcuggauaucuagaacuuucuguuccauucuagauaccacaugucaagucacagacaagagaaugccaucaggaagggagaaugagggucacaaugaaaccuggaggcuuguccacacaguagacgggugccucaccaucucauggcagaucccacaaggacuucacuugacagaacggacacaccuuucucccuucuugcuuuucaggacaggggcucaucauggagcugaggcuggccccaaacuggcagagaucuuuugggcucugucucccaaacaugcugaauuacaggcacgugccagcacaccugauuuggaaaaauacuuucuagugaacauugucaugggagagggagaucugagcccccaguuggucaauagaaccaaguaucagaagcagaccccccagcagggacugugaucccacuagcccucgcucacuggcagcuucucuagccaguaacuaccuagccaggagguuacaguccacucaguguccuagcuauaguuccugcaaacaaaaagcuacaacauccagcucagggcuucagaagaaccugcucggaagugucccugcagcugugcccccggccaggaguuauacacucuucaauauacagcacugacuaccaucuacgacacaguagguaccuuguacagaacugaugguccccagugcaucuggcugcgccaagcucucuccucuguuaaacuugagcaccuuccgcuggucucggccucuccuacacagaaacucuguguugauuggagagaccaagcuaucuggggcauucggguaacugaggauagguuuggacaacugccaucuguggacuagaggacuuucugcuugguucaccaagccucagaacaucccuccccauuuuucaggggcacgugggcaaucgcuguacaguggaccaagccugguggacaggggaccugcccuguguaaaugugcccaauuccaagcugcucccuagcccuccucuggggugucuccucauccuuucccggcaccgcacaggcugcuucugacuccucuuccuucaggccucucucucccuuuacucagauccacugagcucuuauacuucuuguuugugagcuguggccaguggugcuguuacccaucaggguguccuacuggcagcaaaccggcuuaugacucucuuuuuaaguuacauucguguguguguguguguguguguguguguguguguauguguguguguguguguguguagaucugaagaguucgcagcagucaggccucaccuuucaucacauggauccuacagaggcauuccagacaucagccuugccagcaaacaucuuuacccauugaacugccucccuggcucccguccuaagcucuucguucauucacuguagccucucugucauaaaagaugguucauuuggggcuacgugucaagauucaguguaucuagaacacucuggggccaggugugacgucgcaaagccgugcaagggaggcugaggcacagggaucacggauuugaggccagccugggcuacacagugagaccucucucaacaacaagaaucugaacucugaaguggggugcgcuccccuccuucaccaggcccggcauaagucaaauccuggcugcaaagacccaggcaggcaggugccuggcgcuuugucaccauuggguccuccugggcagccccguuuucacacugcguaauggcugugcgaugcacacucgcccugguccugggggagggaagaacgugcuaaugauaagggagaaccugggguaagcugugaacgccacacaaacucuuguaacaaaauaugugguagggagcagaggacgcugcaucuccaacucuggccccccagucucucaggcucuuagcucaucccaagcccaucagacaccaaacccgcggcgaucagcucacaccccagccccguggucuaucccagcucggugugaaccacagcccucaucagaugggugcuguauggagccagggcauccuaggacaggcacccaguaucucugaaacucaguccuugccagguugcuaacuaaacaauaaaauuuaaacaauuaaauaauuguuuaaccuuaaagaaaaauaucaaagacacaaacaaggaaaggucucaggcccugagucggggguucacgcccacaaggccucccccggcacagugaccacuacucuaucuuuaguaagguuuuggaacuuugagguugaaagcaagaucuuaaaagccuaaaaaaauaugcaagcagcuaggcagggucagaauccagcugacucccuaaaggcagcaguaggagcagugagaagaagccugcaggacccagagaacaauuuccacccuugagguguagucccuuccgaaagaugucaaucacagagccauccacuaaagacacuucaggcuuccuuaccagcaucccaugggcagcuuucucaggagccugguagaagaugagccccaacuaacagagagaacaaaccacaaaugaaggagaaacagggacaggugacccacacagcacaggggaagccaacacaggucuaagaaugauugugacuggcaaccugggugacagcagagguggccuugaaagcuggcagugcugagugcagagagccuggucaaagcaaagccagugcuaacagauucacacagggccgccauucggaaagcgggacugguuauuuaaaacucgguuguaguggucagggauaagugagggauaagcacagaaaaccgagcaaaccccaaauuaagacaaguagcaaagcccagguuucuacacagaaaggacagagggcugcaagcaccgcccucaggaguggaggcaggagugcacgcacugcauaaggggcugcauaaggaccugccccaaaccaaaggaaaugaaaggaaaagaggagggggcagggagcgcagugcaaggcucagcucugggcagcauuuaaacgcacauucuaaacgcacaccuagagaaaacuguagucuaguuccccagcauggugaggauaagagacguguuuguaugugugccugugcgugcaugugugugugcuuuuuuagguauguuacaagagaucuaaggggaaauacagaagggauaggugagagugagggucaggugcugugcucuguuuguaaauguccugggagaugacaggccagagacaacagcguugcuaggagauggauggcagacuuccugagcuggugguggagcugguuggggcaggugggaggaacaaaggggcuucagaagugcugcuacucugggguguuguugagugaggaccgccugguagcuccccuccuguguccccauguacuacagguccuaucuucagggcccuuagacuacacaggacacacagacaccaacacacacacacacacacacacacacacacacacacacacacacacacaaacacagacaaggacacauaugcagcaagaaacaacuuucuguuucuaaaagaaccaggggagcagaugcugguccuggugacugggaagggaggagcuggcaccugcagggaggagcugguccaggugcccagauccucccuucccagccagaggcuccccagggguuuucugcuuucaggaauaucaagcacaguggaacaccugccuccccauauucucuccuggaaggaaccuuuuugagcacuggccaggaggacgguacuggggagucaacugcagccccacagaaggguugggcagggccccucauuccuccaacacacacacacacacacacacacacacacacacacacacacacggacuagauuggggauguauuuuugugccugcuuagccucuagaaaguccuggguuccauguccagcaccacauaaaaccaaguaugguaacauauaccuuuaaucccaacacuugggaggcagaggcaggaggauaucuguguucgaggucaaccuggucuacagaacaaguuucaggacagccagggagggcuacacagagaaaccauguuucaggggcacgggaguuugaggcuagggcuggagagauggcuaagcagcuaagagcaugggcugaucuuccagagcaucauccuggcuuucaguucacagagccuucuucuggccuccucaggcacuacauacacacggugcccagacauacauacacaccagcaaacauucauacacauaaaagguagacagagagucaaagaauauaggucacacugggcagugguggcucacgccuuuaaucccagcacuugggaggcagaggcaggcagauuucugaguucaaggccagccuggucuacagagugaguuccaggacagccagggcuauacagaggaacucugucgugaaaaacaaaaacaaaaacaaaaaaacaaaggcuauaagguuacaccucaaucccagaacuaaagagguagacauaggccgaucucuaugagcuccaggucagucagagauauagcaugagacacugauaccugcucccugcucuccccacuaaccaaaaagucugaggccagcccaggcuacaugagaucuucucucaaagggggaggggauagugcugucacgugccuggcucuguucccacggagugaagccuccucucagggcuguauccacugaaggaacagacagugcagggacaaggauaugacauuggugaagagacaagaugagggucagucccacucggggcuggaaaaucagaccacgccagcuccuaacaccgaggaacuaccuacugcugagcugggguggaggcugaugugucuccuaaagagguugugguaggggacacagaaauaagggggaaugugucagaaggcgcuaaggagggggugccaguccuuuccuuugaggcguaacagagcaucacagggggacacaugggcuugcaggccagcuguguaaauccucccccaauacccaugguuccuauccauagauggaucauuuagaaguugccaaccaggcuagagaagccagagaugagaaauaaacgaaucagagguagagcuccugccucgaggcaucugugaaggcgucuugggaucccccaaaccaaaccaugucuguaagcagagacuuggguuacauguggaugguuacccguccauuagcgacagauggacagccagguggggaagagggauccagaucuauccuugugagguugguccagaggcuccugagagacugaggaaugacgugccagccucagguccuagagaugaacgagggaugugcaccccccuggccccaaggcccccacuccccaaccuuccucccaagccccgcuccaaggugugcucacccucauagcagucucggacggugccgaaguacacguaguacuggucauuggugaagaagaggaggcugagccaggagucgaaggcguagaugggcacgaugaagaggaugcgcacgauguggcgcugcucauugggacggcuguagcagcgcagaugcauguagaucugagggagggcacuaagucagccaagucccacuacuaccacagcugccucccaccugccugucugcccucuuccuccugccugcuccaugggaagaggauggcuccugacaucugucucuacccuuccuugcucuaugggcugaugcaaguuacccacccugagccucaauccugcucuggaaaacuagaugacaaaccuuccaucgugagaguccaaucaaagugaccacauaaagccggugugacacuaucuacaggccaccuucagcuacaggggacaguagggccacaguguuguugaaguugcgguccucaaugugugcuccugucauucugccuccccaaagccaaguucccaaggucucacagcagcagcagcacugaguuagcugaagggcugaucaagggcgaguugaagccaccuggcuguggccacucugccuugucccuucacagaugcuagagagggugggguacucgagagccucccucuggaggaccuggacacacuuccaggcuguguggccauaguggugugcucacacuaugcccaauccgcugaacuaaggcagcacugacugcaauauccccagggaggcaggagaaggcagugcaacucuggggaagcagagcuaagggcgcagcccgacucucaugacaucacucuuggcccagcccaggccagcccugacuaaggaaaaggacaaaacauuuccauccgcugugagccaauuuccuuggccacuaauggaucugaaagagacugagaugcacggcagcuggugaggggcugccaggggccugagcagacucauccaacccucuacaugggaauccagcaagcuccuccuugggcacccaaccuccccugagggcgaaaggacaggaaacaggagaccugacuucucuuccugagcugccaccagcuccucagccaccucccucaggcucccaauaaugucuaacugcaaccguuccguggcuucggcugcauaugugcguggccagcagauucugagcaggucguagcagacaagcaucugugugucuccucacaaucccgaugcuccaguugcuacuggacuggaggugaauccaaagccaccaccugcuugcaggggagcuggggugcgggagagaaccccaggaagcagggcuuacgcuccuugccuggccggccugaagcauccuuuguggaacuagaaaccacuugggacacuaaggauguucccccaucacaccaagguaccugguggcaagugaugagcagagcuguccacacaaagaagccggagauggccugggcggcaguggucaucaggaacacagggugcuccauggcuguggggcugcccucggggguggcagagacgcuaggugaagcuguugugguugugggugacgcugggucuggggccagcgcggccccccucacugucaugguucccagcagcagcaggcucccugagaggaucucgugccgugagugacgggcuggccuagggaagaaacgggaauaagcgagcgagcgguggugugcugugaacaacccuuccaggucugcaucaugggccuagccaugccccugcucagcccuugcccuggcaucucugggccaauacacaauggccugugauguucugagaccuuugucaccucaaucuuccauaguaaguuaggaggccagaacauggcugggaagcaggguacagaagagugcugaccuacaacugcuaacaacagcuugaccacugcuacccugccagucccuaaguacuguugccacaagcuggaguccucacguggcacacggaacugucccaugggccucuuuucacucuccuauuuuuuuuucuuucaagauuuauuuauuuauuauauguaaguacacuguagcugcccucagacacuccagaagagggcgucagaucucauaacggagcaugcaugugguugcugggauuugaacuugggaccuucggaacagcagucagugcucucaaccacugagccaucucgccagccccuugucacccuccuuuagaggcuauguauagccuaggcaggccuugaguucaaauccucagugagugaggauaaaaggccugugcugcgcugaugugacagaauggcuuuucuugugguugcugcuguuugguuuuuguucuucugagacaggcuuucucuguguagcccuggcuguccuagaacucacucuuuagaccaggcuggccuugaacucucagaaauccgccugccucugccucccaagugcugggauuaaaggugugcuccaccacugucaggcuuggcaaagcuguuuuauugcuaugggaaucuaccugaagggccuggcuuuugagauuucucucagacuuccauaauggcuaacagucacucaauccuucgggucccagcugugcuaucugggacauaaaguuauggcuuaucuucaaauuucaaacuauaaaaccuaggacuucacacaugccaggaaaguacucuaucucugcccccgccccacccccaccucagagaaaucaucuucuaacucaauguaggaauccacuuucccaaaacccugcccagacacuuccccaaccggauacuccaggccauuucacaugcccuagcuauucucuaaggaacacagggucugcguucgguccacgggucucucuuccugccugcucagaggcaguaaguccccuauucucaucuuugaaucuccagcaccaaguccagcagccaagcgaucucuaaugcucagccucauuaccagcuuucgaucugcaucuccagagauggugagugaggugggccacacaagagcauggcagaacugaggaacgucaagggacuuuccggugggaaagcgaaaccaagggaagauggcaucucugaggaaacaaagccuuucuaugucuagacagagcuagggucccaucugaaauggagacgucauccucacgcagcccagaggagagcugcugacagguacccaccacaugucugaaaauuggggcaaggcugggccagagacuagagcuacuuuccaagaacaaagcuuuccaggagcaucagaaugcucuuaaggaguguggugccccagauugacagccacagugacagcauuaggaggggggucuuuggaaggucaggaggguagaguccucaugaaagggaucaguacccuggugugagaccccuucucuacaacuugaagacaaagaagaguugccuaugaaccagaaaugagccccacuggacagcguggucagugccuggaucucaacugcccagccucuagaacagugagaaacaggcugguuuccagcauucuguuauggcagccagaggaguccaacugcgccuucuacccaggcaucagagcccuacaagucucauccuccucagugcugccaccuacugacggcggucaguacuacccagccaucaggugaccuggaaggccaacugcccaaaccccagacugccagugacccacucugcaccagugcgcgcacagcugagaggggugaguggggagagagacggggggggggggggcuacucugcaccagugcacgcacggcugagaggggugaguggagugagagagagagagcgagggcacaucacagacacugggaagaagccugauugaagcuugaguccccagcuccaucaucagcccaggugaccaaccucacagucccuugcaaaccccaaagcugacauccaggccaggauguagugaccccucgucuuugugggguccagacaacucacaccuacccuaugguccagaccccaccuugcccggcuguccgcccgcacuccugcugggcucccacucacauccagccuccacaucuagcugucagaacaccgggacccaggcagagcccuuggauugcucucuuccacaucgacaaucccuaaccaccaacuaaaagacagauucaagacucaaaagcagagaaggaaucuaaauugggaaacugaaaaaaacggagaaggugucuguguaugagcacugguggcaagcucuggagagagacgccguggcagccuaauaauagcugcuguaggcauggcugccaaguugaaagcuagcgccugagacguuucuuuagaaagguuugcaccgugaaucaacgucuuugccugucaccccagaugaaaaggauaaacauggagugggcaaagagaccccuaaaucuccagcauuuccuccaaauauuaucuuauguuuguuuucuuuccccucauggcaacuuugaagugauauuaucuacaucuuggaaacagaauaaagaugugaaacuuggcuuccagcccccuaccaaaugauuugaagguuucuagaacauucucucagaucacaguuaaagcaauguccucacucugguccccucaaaaggcagguguaucagcuccuccacccagacccaaggcccacauggaggcugccgaccacaucugcaauccaguccacagcacccuaagcucugcaccugcucacaaugcgcacagagggcgaggggagcagauccugggacccacugcuuacaggugcacaggcgagaagaguacugggucccacuguccuauagcuacagacagaugucuuccugggagggagcacucaugacccagaucccagagcaaacagcccauuggcuugguggagcaccuggccccugcggcagggggaaccgcagcuggucuagcacccucuaauccgcauggucucuguggcuucccuuuuaaauacaguccacguuccucaagguggggaggaaacauacaagacgaggcuuagauuccaacugcucuagcagauuccaauucuuuuuuggggggaggggauaggggguucaucugugugcaugugugcuugugugugccugcaguuguuuuugagagucucucgcuggccuggggcuuuccaauucagcucccccuucuguuuuuaacguggguucuggaaacaaacuccaaaacucauucucggugguuagcacuuuaaccaagagcuguuuccccagcccauggcucccggucuuaguugagcaacugucaaaauucugccaaggguauggcagagggugguagggauccaguagggucacuucucugaggaaauguccugaagccucuggacccucaugaucuugggaagacacggccuugaccuugaggagcccaaagcuccacgcuccugcagcaccacacugcaauguggaggucacauccgaucacgcuacacagaggcgacugccugggggucaguguggucaggugucugaugggcaaggaucuaccagcagcaucuaaacccagaagagucugaacauacuaacuucaagcucugaaggugcugggugggauuccugccagaggaguucuacaguguuccagugcaacuacguccgagacgagaggguucuagucuacagaugucccaaggauaaaugggcuuacaauuagaagugacuauuuuaggacuugcaagaugcuuggguagaggcacuugcugccaagccugaugaccugaguucagucccuggaacucacauaaagguggaagcuaauccucugaucacuccucaaucaaucaaucaaucaaucucucuaaucucucucucuccaaaucuuucucucucucuuucuccaauuucucucucucucucucucucucucacacacacacacacacacacacacacacacacgcacacacauacacacacacacagaguaauaauagcaauuauuauaauaaauaaaauagcacuuuaaaugaaccugggcguaacugcaggaagucugacacagacggaacaugcgcacugcaaugaucgacagugcacuuacaacuaagccucgaggguggcaccugucaaaacaauugcagccuggauaaaggaggagaaagcaggagaugaagagaaagcaucuugcgggacaauacugaaggcuggcuguccucugcugaucuaagaugacuauuguuuaaaagacucugcugugaaagacauugguguaaaauguaaacaaccaccaauuaguuuguuuuugcuuuguccuauccuauucuuaugacuguggacuuguguucagaucaauauuauuuguaucacuucaugcuaaaccucaaacacaugcuuucugguggugguggugcugcugcugcugcugcugccagaguaugacuaggugacccuggcuggauuugaacucauagagccccaucugucacugcucugagaaaggagagaaaagagugaaauguuaauacugugagagcugcggcacuguggagugguggggugugucugcagcacaaaccugggcaacagucaaaaguucaacuguaccauccaaucugaagagagcacuggcuagguugauagcuggugugcacaucaucagacgauagagaagaaaaugaaaaccacagagagguauccccagaacuacacaaugagagacaguguugaugcaaaugcuggcaaggaggcagagaaacugaaccucacacacagcgcuacacuggcaugaagauaaagcagaacacugucaagccauuucuuaugcaaccaugcagcuugguguggcagcccagcccaguagucccagcccucaggaggcuggggcagguagauugcuugagcuuugguauucauaaucagugcaccggccagaacugucaaaauuugauaaaucuggaaucaccaggaagaugggauuuuuaagccaggcugaaggggauuggguuaauugauauggaaagacuugcccacucuaggugacaccauucccuaagcaggagaucugacuggucuaacuguggagaaagcagcuaaaaacaagcacacauguauucacuggcuucuuuugacugcuaaaauguugaccagcugcuucaagcucuagaugccuugacaucuuuaccuugauggacuagaaccaggaacucuugagcuauaauaagcccuuucucccuuaaaaagccugagaauagcccaaaugucugucaacaagcgaauauagaauaaaccacuacauccagaucuuaagacuauuucucagcauuaaaaaagagugucugccuggucauggugauaaacaucuuuaaucccagaguuugggaggcagaggccaguggaucucugaguuugaggccagacgggucuacaaggugaguuccaggacagccagagcuauagaauacaggcuaaacccugucuugaaagaaaaacaaaacaaaaacaaacaaacaaacaaacaaaaaaacaacaacccacagccccaacacuaagagaaagaaguccucucuguuaggcagagcuauucaagacucuuaaaacacucagccuauugcuagugcccuccagaaguggaaguuaagccccuauugcuaaagacaccauauaccucaaacacagggcccagaguucccgagcuggaacuggccugaaugcuuccucaagagcuagcuuccaggcauuauauacaagcucucaaaagaggauacaggggcugaaaagaucgcucagugguuaagagcacuggcugcuuuuccagaggucuugaguucaauucccagcaaccacagggugacucacagauccaucuguaacaggauuugaugcccucuucuggccugcagguguacaugcaauacagagagagcacucauacaguaaacaaacaaacaaacaaacaaacaaauuuauuaauuauaugaguacacuguagcuguauucagacacaccagaagagggcaccgggucccauuuuuuugguugugagacuccaugugguugcuaggaaaugaacucaggaccucuggaagaacagcuaguacucuuaaccacugaaccaucucuccagaccaaauaaauagaucuuagaaguggggaggggggacgugaccaacaauggucuuaccaggcuaugaugcccaggaaucaccacaacaaccagcacggcaccacaacccuacggauucgguaauggcacaaauacuguggcagugaccaacagcuuucuaacugaacuuaagaccugcucaaaaccagagacgucacacaguacuggaaaccuagccaaaagaaggaauuuuuuuuuuuuuaaaguagcaauacauacagcauugggcugccuggagagcauuaugcuuaaagucgccaaucccaaagucagaaaaugucugaguccguuuauagaacauuuucaacaugacagagcuauaaaggugcagcugaugaugaagagggcacaguuggcagagaccagggacagugagagggaguguggugcaggcagguuccuccagugacgagaagucaugaugaguccauagauccacaugaaaugagccaugcagaacuacacagacacgugcccucccggagguaacaauacagaaccgagugagccucucagcccgguccccacugcgcugcccucagggaaccacucugauguagucaaggaggaugucacccauggaaggagccugcaccuucuacaccaggucugaaccuccugugggucucaauuuguuucagaggguuuguuuuuguaucuggcuuuguuuucugcuuuuagauuuuuuuuuuaagauuguauuuuauguguaugaguauuuuaccugcauuaauguuaggugcaccacauguggaccuggugcucuuggagaccacaagagagugucaggugcucuggaagcacaguugccaccagaugguugugggcgcugagaaaugaaccugggucuucugcaagaggaacaagugcuaacuguugaguccucucccucgccuaaaauagaucuuuaaagucuacagcaugcagagaugcauacuggcuuguuacaaggguuaaaaaaauuaccauggugcuauaucuacacccccaucuccacugcccgaggcuggccuuaaauucuuguguccuguguucaagggcuccuccugugcuggggcagaggucaguugguagagugcuuaccuagcaugccugaagcccuagguuuggcucucagcaccccagagaauugaaaacaggguucaacaucaucuccugcuacaaagcaaguucaaggccagacugggcucuaugagauucuaucucaagaaggaagaaaaaaaaucuuccugagcagcaucucagagccuaagcccagcauccagcuuggggugcuuuuuaagggaagagagaaaggugagugaggucggucauacagaaacccaguguagggugagggagggacggcucgucagcacguaaggagccguccaucaucaaacuuccauaaugaaggcagaauaucaaaaccuccgccaaagcugagacccagugaccgagccaaggcccaaaggagagacugucucccuaucuugcagaaaagcaucugaguggcaaaacccgggaagggaaaacugaggcuggccucagugccaggcgcuuccguccuagacauuggaacuagcucuacacugccucuaugcaagcuuccuaggacugccuucaaaauguccucagaugccuuugugacauuccuucacaggacagugcugcuguuugaaaggcgcucccgaugacacccucagaaacaucaaucgaggaaggcucuaugcagggcuuugggaccaaaaacaguguuaucuggcaucaauugaaaaaaaaaaucucaaagauacuccaaagauacuaugaaauagaauuuuuuuuagcugauuaaaaauaaaaaauucagcaggguguaguggcgcacgccuuuaaucccagcacucaggaggcagaggcaggcggauuucugaguuugaggccagccuggucuacagcgugaguuccaggacagccagggcuacacagagaaacccugucucgaaaaaccaaaaaccaaaaaccaaacaaacaaacaaccaaacaaacaaauucccagugacucugaguguucugcaugcccauguuagagacucuggggcaaaugccuguuugguuuauaagaagcaucugacugacagaggcaauggaaauguaccagcuaauucugacagcuccuuuguacagucaguggcugagacggaucagugaguggaacacugacugugagccaaggcagaagcccuggccccugcuguggccugcgcugccacaggggcaugggcagggagcucuaucagggaaggcagggucgggccuuccagaugcucccuccacagcgccaaagcucgcccacccugaacacgccagccaaggaagccagaaggccugugcuaucaaugacuccaacuuuaaggcucaugacaucagcuugcccucugaccucuauguggaauggaucuuacagauaaaggguaacaggaagggugauuuugcaaaaucuuaccaguacaccaaaacccacacucaaaaguccugguguuuguuuaucuguguacaugugccguaagugugcaccaugugcacgugggcggagaccagacgaggcugucagguauccucugucgcucuuggccuuucucucuugggacaggucccuugcugaaccuggggcucacuauuuucuggcuagaaugacagcaagcuggguuaccgauaugcaaggccacaucuggcuuuuuauuuacaaugugcuggggagccaaacacagguccuuaugauugcaacagaaaggucucuacccacugagcuaucuuaaagcccuaguuugguuuuugcuuguuuuguuuuuagaccaggucuccucuccguccccagugcugggauuaaaaaguauggcaaguuuggggguucgacugcuauuaaagguguguaaucaauaguacagcuagccaacggccacugacgccuugucuuucugcagucucuguacuaacugaucccagcacagucccuuagccuccagcccccagccccaggcuucagaucaugcagacaguaaagccaagcacuugcuuggcuccccaguggcccaccugccuuaagugcugucaccccaccucccaccguuugccugacaacucugaagaggccaggucucaagcuggcacuuuguccccgacccugagucaggugguagagcuagagucugaaccuuaccgagcuggaccugaacaggugagcugguguuuaucuugggagcagagcaaaggcguguacuguccuguugccauggccucugaggcacaagguuagcaaccagaagugugcacacuuucaaaagguacaguguagggcuagaaacguggcuccguggguagaacuguugcuuagaacagcacccuaaguuccauuccuaguacuauauaaaccagaugugggggcucaugucuguaaucccauagaaggcuuagaaguuuaagacuagcguuggcuacacagugagcugaggccagccugggguguguaagauuguuucaacaaaauuaaaugcguaaguaaguaaauaaauagauuauaguacugcauauggucuggcauucacacaggggucuaggcaaccccccaaaccucccaugcauagcacucccauagagaaaaauguagcucacuugccucgguaaaaccuuuaaagguuauaauuagucucacaucaauucaggucagauuuuggcugcaaaaugagucugcugcugacuaaggaggaauuucugggguuucugcaagaucuggagucuccugugguggagaaggaacauggcuagggaggcuuugcaacacaaggacugacuuccacacuuacaacauuccccccaaacuacucagcacugacaggaguggacuccccagugaccaaggccucuggccuccugucugagccucaacagcagaagcccugucacccuacacgugugaggugagcacauaucugagugcccaggugcuucuccucuguccugaucguuaugguaacaagaccacuaacucucaccucaccaaaaacaucaccaccaccuugggccccacccacuccagcagaaccuggcagugcucagcucagcauuccuguuucccacauucucuagguccaugaugccaggcacagaguagggacaugggaagaggcaacugcgagcuacugagcaaugcagagccuggccuuguagccacccagcacgcucugugggcucugucaucuggacccuccgcacugcugacacuuugcggcuuggcuugagcaggaguguucugcuggaaggagguauggagagagcaaaggauggaagcuggauuacauccaccgucuucuagccugagaaggccacaccaaguagagcaauggacuauuacagggguggagaggcacagcaccaugaaggcaaguuuaugaaaacagacucugucaccagcugucacucaagcaaggggagagucacugucagaauaaggaaguucccugaguuagagacacucaccacaggugggcucacaccugauuucuccaugacaacacuguaaacuucuggaggucaaaguucauguuucagggcaccugcuuuggggacuggaauguucugcccuguccccuacugccuacacauggccaccuucugucagauccacagucuuuucucucacggccuuuuccacuaucaugcuaucuggcuggaugacagugacacgaggcuggaauguaucugcugaacacugauuuggggacaugggcauggcauggacaaugguguggagccagccugugcccuccugauguuucgguaggcuugugccaacaaggccucacucaggagcaguugaacaggccacuugugacagauacuaugcagcucauaaaggccuuggccacaugcaaaggagacuuaacuggucagagcacccagacagaugagugcucugggcagagacccuccgguggccaccaugacaaaggacagggcucauguugagccucaggccuguggcuaaugggaaagaaggaaacaagcuugggguaacccagcucucaaaacaggggguagccaauacacuaugcucuccaccuuacaccagagggucaagggaguggaaugugacccagaagggacuugagaacauggcaucggagggaagugggaaggcgagucuggaacacauuucaaccaggcccuaggaaaugaacugugucaaacccaggaacccacucaguaaacuuccccuccuccaacacacaccaugucugcagccuccucugggaagacaggccgcugucccucugugaggacagccuccucacacugcccuccccacacuguccccucacacugcccucccuacucugcccucccacucugcaauccucacacugcccuccccacacugccuggccuuucuucaaccuugagcccuggagccacgucaccaacaccugacuccaagcucugccacucuagcugugugucagagacaaauuaugcaaccucucucugcuuggcacaaagggcacacagccacgcccaagccagaggcgcuuccaggaaaaaacaagacucaaguacugcacgcugcugcugccaucacuauuacuggucucacacaaaugcauccucccaucacagagggguguggugggguaucacauucccaccagccgcugagcccaggcuggcccuacuucuggucucugauucucuuuaaucuugugggugugugcagugugcaugcuuguauaugguauauguguguaugauguuugugugugguauauacgggguauuuauguaauguguauggugugucuacgguauaugugugauagauauauauaugcauauguguauaugugaugugugugugaauaugcuauaugcaugcuugguguguguguguagcaugguauguauguguguacuauguguguguagccugguaugcauguguguacuguguguguguagccugguaugcauguguguacuguguguguguauacauuacacaugugcaagcaaagaccaggaggauauuggauauuacucugaggaaaggucgaguuccuguguuuggguuagagcuggcuggcagucagcaagcggcaacaguccuccugacucugagaugacuuaugcaugugagaccacagccagcuuguucagugagugacaggaucugaacucagguccucaugguggugcuuacaaaaagcacucuuaaccaccuagcccucccuccaaccucacuucaccccaaaccucuccccuuuuugagacaaggucucacuguagcugaagccagcuugaagucaggguaauccuccugccucagccugaguguuggguuuacaagcaugagccacaacacccagccagauuuucauucauuucauuucagagcagagcccugccaagcuguagccacggagggcacgccccaguguccauuggccccccucaggccaggcugcacuggcaacaggcaggcaggcacuccucuggaauguuguucuguuugucucauccccugggggaaguucauuuuuacaggccuccucccuucuccccauagggacucccuugaacacugcaucugggccuguagccugggaaugaggggcucuuagaccugggggguggagggcugcuuagcuugaccaaccuccaaguggcugccuuuggagggaagccggcccacaucagagacagacaucagcccacacgcuggcccuucuccagaagcgauuagaggaaagaguggcuggccagcagcugguagcuuugcuuggugagucuucugaaaaaggucacaugccucacgacaggacagagguccaccucucccacaauacuauucccaucaagacacacaugcccuccccccugccccgcauucccacuggagccugaagcagaggagaacuuauccaacccuggccuguuugugcuggggguaguauggagggggcggggggggggguaucagaagcagaggcagcaacaggggacucuaagcccuucaguuccuggggaucacuuaacccugccuugaauuaggcgauuuugcuuugggucucuuuggaguuuuguuguuguuuuaugauuucuaugauuguauguguguaaauguuugccugcauguuauauuuguguaccacaugcaagccuagugcccguggaggucaggagagggcaauagcucccuggaacuggaguuaggaugguuuucagcuaccaugugggugcuagaaguggaaccuggauccucugcaacaucagcaagugcucugaaucacugagccaucucuccagcucuguaguggggucuuuuggguuugucuguuggucucucuaagacagagucgccuugcuaacuuugaacucucuauguagacaaggccagccugucucuuaccccgagugcugggacucagagugugcaccaucaugcccagaguucaggguuuugguuuucaaauggaccagauugaccucugguuacucgguuaucuuccacacugaauacaaacagaucagcgugcggucuguagggcugagcuuuggagccucucuaacuacccagugucccaucuagcacugagcaagcacauggcugcagaacccugaaccccaaccuccccacugccuucugggagcuggcuuucuaaacaaagacuacuacaggugccuuccccugggugucagcacaagucucagugcaggguuuagauggccaaccccaaacaacaaacuucauucacaccuacagagcgaacaggcggcccguccuggugcacacccacaacagagugugcaaggggcucaagagcagaaaaggccacagcacagaugccuguccccacagggagggcuacacagugucaaaaucagccaguggauaccuccgcagcagugaaaaagaacaaaggacuauucuacaaagcuggauggucucacugacauggagaggagaagccaggcaccagacgcucaaaccaggcagaacgaaucccaggugccgagcugugagcauccuuaccugggacagcaaguaaccacaaggagucccagggaagagucaggugccugggacacagugcagaaagucccaagugauagcagcagggaauggccauggcuguaggaaggucagagggcagcagccaaggugcugggcgagggagcaaaggcguggaggugcagugucagggacgccaacagugcaaaagccagcuucuccagaaagcauggauccagagccaccacagaggggccugggacacccaggguguuagcugcccacagggaaagcccugaagguuucagaggaagcucacugcagggguuuaaaagugccaaagccagccaacagcaggggaggagcuagagguccucguuacuaaggaaccccaaaccugcucagacauucugugaaaaccaaguucacuggauggggucagggccuaagugaggccagcugucuuugaagggguggccuggacuggccgccuacacugggcaaguggggaguucaguuaauccuguuugauuuucuucaagggauauaacauucacguuucagccaucagaaguacaaggggagccaggccugguaacauucaggaagccgaagucagaagaugauugaaccuaggaguuuggagccagcucuaggcaggcuugggagucccuguucuuuugcaggugaaaaaggcacaaaggacaaucagcaagcaauggccagcacagugcacuccaccccagagaugucauggucccagcuucuuguggcugccuagggaccaucuacauaccggaacacuuccuucacuuuacagaggggcuucuggacacggcccccuccagucgcugcuuucacucagcgguuugucuacaacagcccugaccccucuauggccucugcugugacugcccauggccggacaggccaucauuucuuugugucucccuggacagagacauugagggugaguccagcucuuggcuauuacaaagcagcagcaauguccagccauguaaccaaucacucugcucacagaguaucaugccugcaggccaauuccucaugcagcuucuggagguucagaaaugcacacugcagacaagucaaggcggaggcggaguacgcuuaaguuguucaccuaggaacugaaucuuacuguuggcaauggcgcuuguggugggggaagaaauggcagaggaaagcugaguuuucaacaaaaagggcucuaggugaggaggugguacuggaccgagaucagacccaacucgcucaguguucugcccauccgugaacuagcucuccuuacgugcacauauggggagacucagggaugggggugcagcucagcagaagagcccuugccuagccguacauaagcuccagugacuguccccaucucggccacaaggaagaaugaaaaggcuagaccuagacugucagcccuccccagcuccagcucugaugcccugguggacauaaaugggucaccaagacacccagcuguaacugauguccuuggcugaaggcaccaguaugcaccaguaugcaggggagcaucaggugggcccaguagggaagagucggacagagauccaagggucucuaacuuccagucuagccuucccacaggaaagaaaagcaccguguaucacacucccugccacagcugugggacaucacagucaugcaaacacucacacuacaugacauucacccucccugcuccugguccaucacuaacuguuacauaacccaugugcccaacagccacccgaucuaagcaucacccuguagccagccagucauagaggaugggggcagucucagacaggaauccaaguguccucccugagaaugagggcagcugaggacagcaggacggggcuuccuucucuuccccaaaucaaacccagccacuagaaaguguggaugaaaggaaaggccuccuggccccagcugagugggggagaccucuucgagagggacucagacaguacacacacacacacacacacacacucugcucccacagaagcauccggcacuagagcagcugcuucacgaagcaguaauucagccuuugcaaguccagauugcuauguuccugcaaccuuaagccacaugugucggaauacucaugcaucacacaaugccuuccagggcguaaggcaggaccccaagccacucgagaagacucacucuaccccagggcuaugucaccuacuugugucccuggccucugugugcgcuccacauggacccacuaucugaagguccugccucccucuccaccuacugugaaccacacccacacaguuuugucucgagugccugucagcccaccccaggcaggagccccacagaucaaccagguccuucauuagaguuuucuacuucuggcaaggugugccaggcuuucccaagaggcugcgaucucucucagggagagcaacaugguggccacucagaucaggaagauccaaaaggccugcuuucuucugaggaccacaggcaauucacccuccgagccucagccucuccaucuacagaguaagaauucucagggccaaggccacugggaaguguagucugcaaagcccuacacagaucauauugaggacagaaugagaguaauuacauggcaauauuaauacuauaaaaacgaccacgcauuuuugccaacacucgucacugcgcaguguagacguccacacugagcgcugcugagccccucgcugcucacaggaugaacagagauggagaccagaggcuacagcaccuauggcagcgccuucagagcuuuucuaaaaaugaccacggacccuggagaacagcugugcucuguagaguggagguccucugccaugugccacaggacagagccucuccugauguagcuuguccauaagaagaaaaauagagguguaugucccucaggguggagaggcugugugaucugaaaaucccuuuuggggugacaaaugcaauuacuucaggagggaugggaagagagaggaacagccucucuugaagcuguuagaggugucaacaucuugggaugggcuguggacacccaggucaaggacccgauagucuuagcaagagaaacagucuucacaagaucucugcccagacuucaggcuguaaaagaaacagggguguguguacgcucuucuucacaaccuugagaccugccaaccuggcucucacccuggugaccagccuuucugaccuaggaacccacccagcacaggaagaugagcagaugcccaccgugagcuuagacacagcaagcggccugcucaaggccaucgcuccccccccccuuuuuuuuuugccaucccaggauagaggcaggggaccucauuucuccuacugaacuucaaacaaagcgccaggaccuucacucuucucgaccuguggccagccuaggcaaauacuugugacccacguucagugaacugugaaacccuguaaacuccuaccuagaacgaacaucaacucaacagcgacgucuucuucuauggggaagcauggagaagcugaaauggaguccgcccgcguagcccaggguggcuuugaucagcaggggcucuccacuagcaccggccacacagcuuaucuuuaugcggagcuucuccaagucagugcucagcccuucuugagggacuccaacacacugaagagccggaagugacucgggucaggcacaaaggcuuucugggugggaccuuccccucugguuuccagcucagagaaggaaaaggaggugucugcugggcuuccugccuucauacaagcucgagacuucccuugcccccuguaggcagacacugggcacugcuggccuccagugauacaaccucacucguaacagaccguccuguucuaagccgagcauggcagugcacaccugcacucaaaaguuguaggugggaagaucaggagcuccgagccagccugggcuacaucacaccuugccucaacaaacaucaaaccaggaauggugucuacaccuuuaauuccaguacuugggagauagagacagguagaucuuugugucugaggucagccuagucauguagagaguucuagaccagccagggauauacaaggagaccucgucuaaaguaaauaaauaaaacugucaaauaaaugaaaacuaaaucgcuggacagggugacacaguccuuuaaucccagcacucuggaggcagagacagagggccucaaugaguucaagcccggccugaucuauaugaugcauucuaggauagccaggacuacgcagagaccccaucucagaaaacaaaacaaacaaacaagcaaacauaaauaaaaucaaggaaacaaacaggacaaccccacaccugcacucagugccagcuccgugccaggcaguggaacacugcugacugcaggcaggaggaguccagcguguaugcugcuaucaagccacagcuagggccacgcgcaugaucacagcagcaucuaggaccgggagcuaaugcuuccaugacggcucaggcucaguccagcuccugagcacccccugcauguggcuuucuccucucuggggcuuugaagagcagaguuccaggaauggcugcugaggauacugccagcugcgggcuggagagacagggcucagugcuuaagaaagagcacgcgcgccuuuaaucccagcacucgggaggcagaggcaggcagauuucugaguucgaggucagccugguuuacaaagugaguuccaggacagccagggcuacagagaaagccugucucaaaaacccaaaaaaaaaaaaaaaaaagaaagaaaagaaagaacaaacacuggcugcucuugcagaggacccagauuuaauucccagcagccacauggcagcucacaauuaucuuuaacuccaguuccaggggaaccaaugccuucuucugaccucccuggguacgcuagacgcaugcaggcaugaggcaaaacucauacacacaaaauaaaaguuaauaaaucucuaaagaagaagaaacaaaugcugucagcaacuucucagugugcuguacaagccuccaccucgcaucucauagagcagggccagcccggaggaggagcgcggagaaaaccuaaacccagaggccuccgaguucccucccaccuaggagcucccacucugcuuccucccuuucuggucuccgggaggcagaaaucacguucaaugaacauggaugacaguccugcuacagaccgguuuguacggcugcacuggucugguccugcugcuggugucucucugccucgcuagaugcagcuccccacauuaggccugacagacuagacuccugaagaaauuaaacagccugcaagcaaacagcaaaagcuggugagaacaggaaagagagcuugguccgggaaguacuggccgcacaagucugaggaccugaguucgauucccagcaccugugugaaaggcguggcauguggaugcacacuuaagauuccagacuggaaagguagagacaggcaagucccuggggcucccugccagcuuaccucgccugagagccccagguccaagugagagaucuuguugcaaaacacaagguggaugagcaacauugcuacccaaggcuaacccuccagcucccaugcucauacugugcacuaacacaaaugcugugucaugauagcccuauaaugucuacgcugcuggcacuugcauucuacagaugaggcaaacugcagauccuauccuuccccagaccagccuugaacccauccuccugccucaaccuccaaaguaacaggaauacauaauguacaauaacaccaccagccuaauuuuaacuaucuaucuaucuaucuaucuauugcuuuauuguuugagagaaagucucaauauguaguccggccauccuggaccaggcuagccuagaacucacaaagcuccaucugccucugccuccagagugcugggauuaaaggcgugcgccaccaugccccggcuaccuuaauuuuaagaaccaugaauucuaccugguaagugaccuacccaaggacacaguacuaauaaaugcaaggauuugacuugcaauuccuaauucucuuuccaggccacagggacugcucagcacugcucagccacagcauacauguaguugauagaggacaacuuucaggagcugggucucuccuuccaccacaggcucuggggaucaaagcugggucaucagccuuacgcagaaagcgccucuacucacugagccaucucgcuggcccagauuccggaacccucagcugccuaugcucaagcacccacugggcuuucucccucaacucccaugcucacauccuacauacagcccgucagcccccgccagcugugcuucugcaagagucggcaaagaccccuaguggagcaugugcagucucauggccucuguccagagaagggaugacugccuaauuacucauacaggcaggccagcgagucacugcaccaaauccagccagccuggcaccuggcaaaguagagcaagaagucuucguggagcucaaaggaagaugaggcggcugcauccagcuugccuggcuccacuaccagcuacuggguccuucuaaccgcguucauagaacauggacagugggugacugaccauaccucccaagguaacaagagaagcuaagagcccaggagaccugggacaaucagggguucaauccuuaagaaaacaaguucagggcuggcucagccgcugacauuccacccuggcgugguagcaccauauaaacugggcacuuuaccuauauaauccuaggcauugggagguaaaggcaggagggucagaaguucaaggucacccucagccacauaguggauucaaguucugccgggaauacaugagaccuugucuccaauuaaaaaacaaacaaacaaacaaaaacagaacaaagaaguuucaguucaguggggccaaaugacagagagcagaagagaccagcaggaaagcagggccuggggcacaguaaccuucagccccgaauaugcaaaagaaaaacagagcagagacuaaagagacaccagggaccaaaggggcagcaaacaggaaggaggcaggucaucuuggaguuacaugccagaaugaaggaagcaagaugcagggugaugauacagccucacaacacagggugugugugucacuuccucucaaacauucaaaggcuuucuguugaccacaccgggaucacaccaaaacccuccgagagggagacaugacaggccuccacaucugcuuggggccccugcuacccuccucuccuccuccaugcuccaucucuaacuccaggaccaggaaggcacugagcauaccgaaggucagaguggaaaagccuggagauugaaccaacugaccugugauggggaagguggcagccccaccucaccggauaguggaggauaggaugggaacucaugaaagcacuuugaacugugccugacacaugguaagugcucaagaaacuuaccaggggagcuguuuuuccuacuguccucugggccccuucagagcccucucucccuaccccaaguagaacacugucucaaauguauuagucacgugcugggcuaccucagccaaccacagccuuucacaggggacaacccaggucucuggccucucuucccugauggccagcaaauucauggcacacaggagguauucagcaagcaccugcugcccccaaaaagaccucagccaagguccuggggcagaccccacauugagcucugagggccuagcuccaggcuucccaacacucacaucaaauccccagucucauucgcugcugcuacuuacuuucaaaacaagaaaggccugggcccugccuugccuagcagcuucuacuccagggagcacauggagagaaaugagcacagcgggacuggaaauagcaccgagccccucuuggggagaggccugggcaggccagcuggcaaacagaagcaaagccucaaaggcagggaguccuggagggccgaggacacggcucagcagcacacugccugcccagagugccugaggucccgauccagugcacaggaccaaaagaggggaaaaaaugggagagagcagccagccgacaggccugguccacagaacuaggacaagcugcccacugauccccucccacccggaagcucuucucuccucccuaguccaaccccaccacccugggagcaaucuacaaggcaucccccaggauuacacaaggacgcccaggucaccuauggcucuuaggggaguauuuagagccccaccacccacacuggccaguggggucgcuaucuauguccaccuccgcagcagacugggagccucuagaagaagguauuagauccuguuccucuguguucuacuccagggacaucagggagagcagugagccagcagggccgggagacagcccucagccgggcgcauaguagaugcucaguaaguuacaaggcaacuugggcaagacccagggaugaaggaugcuaccagagccuacuagucccacacugacaagggagucacuuaauccccaucccgucccaccccacccgccuugaccugcugccucaguuuccuaacccacaucuaugcccgauacauuauuggcacagcugcccugagaacaaacugggaaaauacacauggaaagcaagaagucucugaggaauguuagucacccagcuuuggcucgacugucccuuuguacugaagccuuuuuuuuucuuuuuccuuuuuuuuuuuuuuuuuuuuuuuuuuugcuggcuuguccaucccccccaccccccaccccccagcacugaauccaccuccauacuccucagucuuuugucuucuguuucuggaaucccugugauucuuuccaauucugauucugccccaagcaccugagagcucuucgaugccucgauccucacaucugugugcggggugagcaccagucuagcuucuggggcucccacacccaaggguuccaacuccggcccugcacagaacucucaagauacucagaugugccgagcccaagggcccaccaaacuuguugacacgaagagggaugcugcaaacagccugucaaaaaagccagaccguggagaccugcaccucccccugcugcugaugcuggugggguguguguguguguguguguguguguguguguuggcugagucugcagcacuugccuccagggcacagauugcuacuucucuccuuacauaaagcaccuggcagccagaugaauaauacauagaccuucaccucacacccagguaucaggcaggcagacaccugcuuugccccaccaaggccuccaaggagggagggaugagaugucccgccucauacaguccuccaagaaaggauacaaacuaaaaauccgagcccguuccccagacucccuagcuuugccacugccuggagcuccuuagccccaagcuaagcauccaagcaagguguccaagggcgugcccaggcaaacaggcaccacacacccaaaccaaucucuaggguuccuuugaacacccagcauccugggagccccagaucccuaucccccuucaaaucuacugaccugugugcaaagcgcgcgcacacccccauuuacgcauguaccgucucaagggccgaccaccgggccaggucaaagccacugcacugaggaccgacgucuccccgccccguucggucgugccaggcugcagcacacccaccgcggugcgcacagucccaucgguaagaggcugggccccgcgccgcccaccccgacucccccacgagcagguccgguuacacucagggccccgccacgcuggcgaagcgggcacacccacgggccgcuugggggccuccgagucccugccuccccgcgggaaguccccagaguggaguucuccccaaggugcagcccccgcccgguccccguucaucccgugcauccgccgcccggguaccucaggagcccauggcgcuggagacugcaggcggagcaggcggcgccgcagcccgguaucucggccgccgcuggcgcgucccgagccccgccggguaccgccgcgccgcgccugcgcacuaggaacgccgcuggcgggggcggggccggagcgcgccgcugaggucacucgccgagccuuaaaggggccgcgcgcugcgaagcaccacgcgcaaucucgggucaggagaauggugagguccucuugcaacucgcaaacgcaccgcgagagacccagggcccagguuuccuaguccagucccacccaccacaguccugggaugcacagucugacccgcgggauacagacugucccggacacucgcgagcuagcuugaguuucaauuc

SEQ ID NO: 7876 - RNA, 42888 nt, Mus musculus
gaauugaaacucaagcuagcucgcgaguguccgggacagucuguaucccgcgggucagacugugcaucccaggacuguggugggugggacuggacuaggaaaccugggcccugggucucucgcggugcguuugcgaguugcaagaggaccucaccauucuccugacccgagauugcgcguggugcuucgcagcgcgcggccccuuuaaggcucggcgagugaccucagcggcgcgcuccggccccgcccccgccagcggcguuccuagugcgcaggcgcggcgcggcgguacccggcggggcucgggacgcgccagcggcggccgagauaccgggcugcggcgccgccugcuccgccugcagucuccagcgccaugggcuccugagguacccgggcggcggaugcacgggaugaacggggaccgggcgggggcugcaccuuggggagaacuccacucuggggacuucccgcggggaggcagggacucggaggcccccaagcggcccgugggugugcccgcuucgccagcguggcggggcccugaguguaaccggaccugcucgugggggagucggggugggcggcgcggggcccagccucuuaccgaugggacugugcgcaccgcggugggugugcugcagccuggcacgaccgaacggggcggggagacgucgguccucagugcaguggcuuugaccuggcccgguggucggcccuugagacgguacaugcguaaaugggggugugcgcgcgcuuugcacacaggucaguagauuugaagggggauagggaucuggggcucccaggaugcuggguguucaaaggaacccuagagauugguuuggguguguggugccuguuugccugggcacgcccuuggacaccuugcuuggaugcuuagcuuggggcuaaggagcuccaggcaguggcaaagcuagggagucuggggaacgggcucggauuuuuaguuuguauccuuucuuggaggacuguaugaggcgggacaucucaucccucccuccuuggaggccuugguggggcaaagcaggugucugccugccugauaccugggugugaggugaaggucuauguauuauucaucuggcugccaggugcuuuauguaaggagagaaguagcaaucugugcccuggaggcaagugcugcagacucagccaacacacacacacacacacacacacacacacaccccaccagcaucagcagcagggggaggugcaggucuccacggucuggcuuuuuugacaggcuguuugcagcaucccucuucgugucaacaaguuuggugggcccuugggcucggcacaucugaguaucuugagaguucugugcagggccggaguuggaacccuugggugugggagccccagaagcuagacuggugcucaccccgcacacagaugugaggaucgaggcaucgaagagcucucaggugcuuggggcagaaucagaauuggaaagaaucacagggauuccagaaacagaagacaaaagacugaggaguauggagguggauucagugcugggggguggggggugggggggauggacaagccagcaaaaaaaaaaaaaaaaaaaaaaaaaaaggaaaaagaaaaaaaaaggcuucaguacaaagggacagucgagccaaagcugggugacuaacauuccucagagacuucuugcuuuccauguguauuuucccaguuuguucucagggcagcugugccaauaauguaucgggcauagauguggguuaggaaacugaggcagcaggucaaggcggguggggugggacgggauggggauuaagugacucccuugucagugugggacuaguaggcucugguagcauccuucaucccugggucuugcccaaguugccuuguaacuuacugagcaucuacuaugcgcccggcugagggcugucucccggcccugcuggcucacugcucucccugaugucccuggaguagaacacagaggaacaggaucuaauaccuucuucuagaggcucccagucugcugcggagguggacauagauagcgaccccacuggccagugugggugguggggcucuaaauacuccccuaagagccauaggugaccugggcguccuuguguaauccugggggaugccuuguagauugcucccaggguggugggguuggacuagggaggagagaagagcuuccgggugggaggggaucagugggcagcuuguccuaguucuguggaccaggccugucggcuggcugcucucucccauuuuuuccccucuuuugguccugugcacuggaucgggaccucaggcacucugggcaggcagugugcugcugagccguguccucggcccuccaggacucccugccuuugaggcuuugcuucuguuugccagcuggccugcccaggccucuccccaagaggggcucggugcuauuuccagucccgcugugcucauuucucuccaugugcucccuggaguagaagcugcuaggcaaggcagggcccaggccuuucuuguuuugaaaguaaguagcagcagcgaaugagacuggggauuugaugugaguguugggaagccuggagcuaggcccucagagcucaauguggggucugccccaggaccuuggcugaggucuuuuugggggcagcaggugcuugcugaauaccuccugugugccaugaauuugcuggccaucagggaagagaggccagagaccuggguuguccccugugaaaggcugugguuggcugagguagcccagcacgugacuaauacauuugagacaguguucuacuugggguagggagagagggcucugaaggggcccagaggacaguaggaaaaacagcuccccugguaaguuucuugagcacuuaccaugugucaggcacaguucaaagugcuuucaugaguucccauccuauccuccacuauccggugagguggggcugccaccuuccccaucacaggucaguugguucaaucuccaggcuuuuccacucugaccuucgguaugcucagugccuuccugguccuggaguuagagauggagcauggaggaggagaggaggguagcaggggccccaagcagauguggaggccugucaugucucccucucggaggguuuuggugugaucccgguguggucaacagaaagccuuugaauguuugagaggaagugacacacacacccuguguugugaggcuguaucaucacccugcaucuugcuuccuucauucuggcauguaacuccaagaugaccugccuccuuccuguuugcugccccuuuggucccuggugucucuuuagucucugcucuguuuuucuuuugcauauucggggcugaagguuacugugccccaggcccugcuuuccugcuggucucuucugcucucugucauuuggccccacugaacugaaacuucuuuguucuguuuuuguuuguuuguuuguuuuuuaauuggagacaaggucucauguauucccggcagaacuugaauccacuauguggcugagggugaccuugaacuucugacccuccugccuuuaccucccaaugccuaggauuauauagguaaagugcccaguuuauauggugcuaccacgccaggguggaaugucagcggcugagccagcccugaacuuguuuucuuaaggauugaaccccugauugucccaggucuccugggcucuuagcuucucuuguuaccuugggagguauggucagucacccacuguccauguucuaugaacgcgguuagaaggacccaguagcugguaguggagccaggcaagcuggaugcagccgccucaucuuccuuugagcuccacgaagacuucuugcucuacuuugccaggugccaggcuggcuggauuuggugcagugacucgcuggccugccuguaugaguaauuaggcagucaucccuucucuggacagaggccaugagacugcacaugcuccacuaggggucuuugccgacucuugcagaagcacagcuggcgggggcugacgggcuguauguaggaugugagcaugggaguugagggagaaagcccagugggugcuugagcauaggcagcugaggguuccggaaucugggccagcgagauggcucagugaguagaggcgcuuucugcguaaggcugaugacccagcuuugauccccagagccugugguggaaggagagacccagcuccugaaaguuguccucuaucaacuacauguaugcuguggcugagcagugcugagcagucccuguggccuggaaagagaauuaggaauugcaagucaaauccuugcauuuauuaguacuguguccuuggguaggucacuuaccagguagaauucaugguucuuaaaauuaagguagccggggcaugguggcgcacgccuuuaaucccagcacucuggaggcagaggcagauggagcuuugugaguucuaggcuagccugguccaggauggccggacuacauauugagacuuucucucaaacaauaaagcaauagauagauagauagauagauaguuaaaauuaggcuggugguguuauuguacauuauguauuccuguuacuuuggagguugaggcaggaggauggguucaaggcuggucuggggaaggauaggaucugcaguuugccucaucuguagaaugcaagugccagcagcguagacauuauagggcuaucaugacacagcauuuguguuagugcacaguaugagcaugggagcuggaggguuagccuuggguagcaauguugcucauccaccuuguguuuugcaacaagaucucucacuuggaccuggggcucucaggcgagguaagcuggcagggagccccagggacuugccugucucuaccuuuccagucuggaaucuuaagugugcauccacaugccacgccuuucacacaggugcugggaaucgaacucagguccucagacuugugcggccaguacuucccggaccaagcucucuuuccuguucucaccagcuuuugcuguuugcuugcaggcuguuuaauuucuucaggagucuagucugucaggccuaauguggggagcugcaucuagcgaggcagagagacaccagcagcaggaccagaccagugcagccguacaaaccggucuguagcaggacugucauccauguucauugaacgugauuucugccucccggagaccagaaagggaggaagcagagugggagcuccuaggugggagggaacucggaggccucuggguuuagguuuucuccgcgcuccuccuccgggcuggcccugcucuaugagaugcgagguggaggcuuguacagcacacugagaaguugcugacagcauuuguuucuucuucuuuagagauuuauuaacuuuuauuuuguguguaugaguuuugccucaugccugcaugcgucuagcguacccagggaggucagaagaaggcauugguuccccuggaacuggaguuaaagauaauugugagcugccauguggcugcugggaauuaaaucuggguccucugcaagagcagccaguguuuguucuuucuuuucuuucuuuuuuuuuuuuuuuuuuggguuuuugagacaggcuuucucuguagcccuggcuguccuggaacucacuuuguaaaccaggcugaccucgaacucagaaaucugccugccucugccucccgagugcugggauuaaaggcgcgcgugcucuuucuuaagcacugagcccugucucuccagcccgcagcuggcaguauccucagcagccauuccuggaacucugcucuucaaagccccagagaggagaaagccacaugcagggggugcucaggagcuggacugagccugagccgucauggaagcauuagcucccgguccuagaugcugcugugaucaugcgcguggcccuagcuguggcuugauagcagcauacacgcuggacuccuccugccugcagucagcaguguuccacugccuggcacggagcuggcacugagugcaggugugggguuguccuguuuguuuccuugauuuuauuuauguuugcuuguuuguuuguuuuguuuucugagauggggucucugcguaguccuggcuauccuagaaugcaucauauagaucaggccgggcuugaacucauugaggcccucugucucugccuccagagugcugggauuaaaggacugugucacccuguccagcgauuuaguuuucauuuauuugacaguuuuauuuauuuacuuuagacgaggucuccuuguauaucccuggcuggucuagaacucucuacaugacuaggcugaccucagacacaaagaucuaccugucucuaucucccaaguacuggaauuaaagguguagacaccauuccugguuugauguuuguugaggcaaggugugauguagcccaggcuggcucggagcuccugaucuucccaccuacaacuuuugagugcaggugugcacugccaugcucggcuuagaacaggacggucuguuacgagugagguuguaucacuggaggccagcagugcccagugucugccuacagggggcaagggaagucucgagcuuguaugaaggcaggaagcccagcagacaccuccuuuuccuucucugagcuggaaaccagaggggaaggucccacccagaaagccuuugugccugacccgagucacuuccggcucuucaguguguuggagucccucaagaagggcugagcacugacuuggagaagcuccgcauaaagauaagcuguguggccggugcuaguggagagccccugcugaucaaagccacccugggcuacgcgggcggacuccauuucagcuucuccaugcuuccccauagaagaagacgucgcuguugaguugauguucguucuagguaggaguuuacaggguuucacaguucacugaacgugggucacaaguauuugccuaggcuggccacaggucgagaagagugaagguccuggcgcuuuguuugaaguucaguaggagaaaugagguccccugccucuauccugggauggcaaaaaaaaaaggggggggggagcgauggccuugagcaggccgcuugcugugucuaagcucacggugggcaucugcucaucuuccugugcuggguggguuccuaggucagaaaggcuggucaccagggugagagccagguuggcaggucucaagguugugaagaagagcguacacacaccccuguuucuuuuacagccugaagucugggcagagaucuugugaagacuguuucucuugcuaagacuaucggguccuugaccuggguguccacagcccaucccaagauguugacaccucuaacagcuucaagagaggcuguuccucucucuucccaucccuccugaaguaauugcauuugucaccccaaaagggauuuucagaucacacagccucuccacccugagggacauacaccucuauuuuucuucuuauggacaagcuacaucaggagaggcucuguccuguggcacauggcagaggaccuccacucuacagagcacagcuguucuccaggguccguggucauuuuuagaaaagcucugaaggcgcugccauaggugcuguagccucuggucuccaucucuguucauccugugagcagcgaggggcucagcagcgcucaguguggacgucuacacugcgcagugacgaguguuggcaaaaaugcguggucguuuuuauaguauuaauauugccauguaauuacucucauucuguccucaauaugaucuguguagggcuuugcagacuacacuucccaguggccuuggcccugagaauucuuacucuguagauggagaggcugaggcucggagggugaauugccugugguccucagaagaaagcaggccuuuuggaucuuccugaucugaguggccaccauguugcucucccugagagagaucgcagccucuugggaaagccuggcacaccuugccagaaguagaaaacucuaaugaaggaccugguugaucuguggggcuccugccuggggugggcugacaggcacucgagacaaaacugugugggugugguucacaguagguggagagggaggcaggaccuucagauaguggguccauguggagcgcacacagaggccagggacacaaguaggugacauagcccugggguagagugagucuucucgaguggcuugggguccugccuuacgcccuggaaggcauugugugaugcaugaguauuccgacacauguggcuuaagguugcaggaacauagcaaucuggacuugcaaaggcugaauuacugcuucgugaagcagcugcucuagugccggaugcuucugugggagcagaguguguguguguguguguguguguacugucugagucccucucgaagaggucucccccacucagcuggggccaggaggccuuuccuuucauccacacuuucuaguggcuggguuugauuuggggaagagaaggaagccccguccugcuguccucagcugcccucauucucagggaggacacuuggauuccugucugagacugcccccauccucuaugacuggcuggcuacagggugaugcuuagaucggguggcuguugggcacauggguuauguaacaguuagugauggaccaggagcagggagggugaaugucauguagugugaguguuugcaugacugugaugucccacagcuguggcagggagugugauacacggugcuuuucuuuccugugggaaggcuagacuggaaguuagagacccuuggaucucuguccgacucuucccuacugggcccaccugaugcuccccugcauacuggugcauacuggugccuucagccaaggacaucaguuacagcugggugucuuggugacccauuuauguccaccagggcaucagagcuggagcuggggagggcugacagucuaggucuagccuuuucauucuuccuuguggccgagauggggacagucacuggagcuuauguacggcuaggcaagggcucuucugcugagcugcacccccaucccugagucuccccauaugugcacguaaggagagcuaguucacggaugggcagaacacugagcgaguugggucugaucucgguccaguaccaccuccucaccuagagcccuuuuuguugaaaacucagcuuuccucugccauuucuucccccaccacaagcgccauugccaacaguaagauucaguuccuaggugaacaacuuaagcguacuccgccuccgccuugacuugucugcagugugcauuucugaaccuccagaagcugcaugaggaauuggccugcaggcaugauacucugugagcagagugauugguuacauggcuggacauugcugcugcuuuguaauagccaagagcuggacucacccucaaugucucuguccagggagacacaaagaaaugauggccuguccggccaugggcagucacagcagaggccauagaggggucagggcuguuguagacaaaccgcugagugaaagcagcgacuggagggggccguguccagaagccccucuguaaagugaaggaaguguuccgguauguagauggucccuaggcagccacaagaagcugggaccaugacaucucugggguggagugcacugugcuggccauugcuugcugauuguccuuugugccuuuuucaccugcaaaagaacagggacucccaagccugccuagagcuggcuccaaacuccuagguucaaucaucuucugacuucggcuuccugaauguuaccaggccuggcuccccuuguacuucugauggcugaaacgugaauguuauaucccuugaagaaaaucaaacaggauuaacugaacuccccacuugcccaguguaggcggccaguccaggccaccccuucaaagacagcuggccucacuuaggcccugaccccauccagugaacuugguuuucacagaaugucugagcagguuugggguuccuuaguaacgaggaccucuagcuccuccccugcuguuggcuggcuuuggcacuuuuaaaccccugcagugagcuuccucugaaaccuucagggcuuucccugugggcagcuaacacccugggugucccaggccccucugugguggcucuggauccaugcuuucuggagaagcuggcuuuugcacuguuggcgucccugacacugcaccuccacgccuuugcucccucgcccagcaccuuggcugcugcccucugaccuuccuacagccauggccauucccugcugcuaucacuugggacuuucugcacugugucccaggcaccugacucuucccugggacuccuugugguuacuugcugucccagguaaggaugcucacagcucggcaccugggauucguucugccugguuugagcgucuggugccuggcuucuccucuccaugucagugagaccauccagcuuuguagaauaguccuuuguucuuuuucacugcugcggagguauccacuggcugauuuugacacuguguagcccucccuguggggacaggcaucugugcuguggccuuuucugcucuugagccccuugcacacucuguugugggugugcaccaggacgggccgccuguucgcucuguaggugugaaugaaguuuguuguuugggguuggccaucuaaacccugcacugagacuugugcugacacccaggggaaggcaccuguaguagucuuuguuuagaaagccagcucccagaaggcaguggggagguugggguucaggguucugcagccaugugcuugcucagugcuagaugggacacuggguaguuagagaggcuccaaagcucagcccuacagaccgcacgcugaucuguuuguauucaguguggaagauaaccgaguaaccagaggucaaucugguccauuugaaaaccaaaacccugaacucugggcaugauggugcacacucugagucccagcacucgggguaagagacaggcuggccuugucuacauagagaguucaaaguuagcaaggcgacucugucuuagagagaccaacagacaaacccaaaagaccccacuacagagcuggagagauggcucagugauucagagcacuugcugauguugcagaggauccagguuccacuucuagcacccacaugguagcugaaaaccauccuaacuccaguuccagggagcuauugcccucuccugaccuccacgggcacuaggcuugcaugugguacacaaauauaacaugcaggcaaacauuuacacacauacaaucauagaaaucauaaaacaacaacaaaacuccaaagagacccaaagcaaaaucgccuaauucaaggcaggguuaagugauccccaggaacugaagggcuuagaguccccuguugcugccucugcuucugauacccccccccccgcccccuccauacuacccccagcacaaacaggccaggguuggauaaguucuccucugcuucaggcuccagugggaaugcggggcaggggggagggcaugugugucuugaugggaauaguauugugggagagguggaccucuguccugucgugaggcaugugaccuuuuucagaagacucaccaagcaaagcuaccagcugcuggccagccacucuuuccucuaaucgcuucuggagaagggccagcgugugggcugaugucugucucugaugugggccggcuucccuccaaaggcagccacuuggagguuggucaagcuaagcagcccuccaccccccaggucuaagagccccucauucccaggcuacaggcccagaugcaguguucaagggagucccuauggggagaagggaggaggccuguaaaaaugaacuucccccaggggaugagacaaacagaacaacauuccagaggagugccugccugccuguugccagugcagccuggccugaggggggccaauggacacuggggcgugcccuccguggcuacagcuuggcagggcucugcucugaaaugaaaugaaugaaaaucuggcuggguguuguggcucaugcuuguaaacccaacacucaggcugaggcaggaggauuacccugacuucaagcuggcuucagcuacagugagaccuugucucaaaaaggggagagguuuggggugaagugagguuggagggagggcuaggugguuaagagugcuuuuuguaagcaccaccaugaggaccugaguucagauccugucacucacugaacaagcuggcuguggucucacaugcauaagucaucucagagucaggaggacuguugccgcuugcugacugccagccagcucuaacccaaacacaggaacucgaccuuuccucagaguaauauccaauauccuccuggucuuugcuugcacauguguaauguauacacacacacaguacacacaugcauaccaggcuacacacacacaguacacacaugcauaccaggcuacacacacauaguacacacauacauaccaugcuacacacacacaccaagcaugcauauagcauauucacacacacaucacauauacacauaugcauauauauaucuaucacacauauaccguagacacaccauacacauuacauaaauaccccguauauaccacacacaaacaucauacacacauauaccauauacaagcaugcacacugcacacacccacaagauuaaagagaaucagagaccagaaguagggccagccugggcucagcggcuggugggaaugugauaccccaccacaccccucugugaugggaggaugcauuugugugagaccaguaauagugauggcagcagcagcgugcaguacuugagucuuguuuuuuccuggaagcgccucuggcuugggcguggcugugugcccuuugugccaagcagagagagguugcauaauuugucucugacacacagcuagaguggcagagcuuggagucagguguuggugacguggcuccagggcucaagguugaagaaaggccaggcaguguggggagggcagugugaggauugcagagugggagggcagaguagggagggcagugugaggggacaguguggggagggcagugugaggaggcuguccucacagagggacagcggccugucuucccagaggaggcugcagacaugguguguguuggaggaggggaaguuuacugaguggguuccuggguuugacacaguucauuuccuagggccugguugaaauguguuccagacucgccuucccacuucccuccgaugccauguucucaagucccuucugggucacauuccacucccuugacccucugguguaagguggagagcauaguguauuggcuacccccuguuuugagagcuggguuaccccaagcuuguuuccuucuuucccauuagccacaggccugaggcucaacaugagcccuguccuuugucaugguggccaccggagggucucugcccagagcacucaucugucugggugcucugaccaguuaagucuccuuugcauguggccaaggccuuuaugagcugcauaguaucugucacaaguggccuguucaacugcuccugagugaggccuuguuggcacaagccuaccgaaacaucaggagggcacaggcuggcuccacaccauuguccaugccaugcccauguccccaaaucaguguucagcagauacauuccagccucgugucacugucauccagccagauagcaugauaguggaaaaggccgugagagaaaagacuguggaucugacagaagguggccauguguaggcaguaggggacagggcagaacauuccaguccccaaagcaggugcccugaaacaugaacuuugaccuccagaaguuuacaguguugucauggagaaaucaggugugagcccaccuguggugagugucucuaacucagggaacuuccuuauucugacagugacucuccccuugcuugagugacagcuggugacagagucuguuuucauaaacuugccuucauggugcugugccucuccaccccuguaauaguccauugcucuacuugguguggccuucucaggcuagaagacgguggauguaauccagcuuccauccuuugcucucuccauaccuccuuccagcagaacacuccugcucaagccaagccgcaaagugucagcagugcggaggguccagaugacagagcccacagagcgugcuggguggcuacaaggccaggcucugcauugcucaguagcucgcaguugccucuucccaugucccuacucugugccuggcaucauggaccuagagaaugugggaaacaggaaugcugagcugagcacugccagguucugcuggaguggguggggcccaaggugguggugauguuuuuggugaggugagaguuaguggucuuguuaccauaacgaucaggacagaggagaagcaccugggcacucagauaugugcucaccucacacguguagggugacagggcuucugcuguugaggcucagacaggaggccagaggccuuggucacuggggaguccacuccugucagugcugaguaguuuggggggaauguuguaaguguggaagucaguccuuguguugcaaagccucccuagccauguuccuucuccaccacaggagacuccagaucuugcagaaaccccagaaauuccuccuuagucagcagcagacucauuuugcagccaaaaucugaccugaauugaugugagacuaauuauaaccuuuaaagguuuuaccgaggcaagugagcuacauuuuucucuaugggagugcuaugcaugggagguuugggggguugccuagaccccugugugaaugccagaccauaugcaguacuauaaucuauuuauuuacuuacuuacgcauuuaauuuuguugaaacaaucuuacacaccccaggcuggccucagcucacuguguagccaacgcuagucuuaaacuucuaagccuucuaugggauuacagacaugagcccccacaucugguuuauauaguacuaggaauggaacuuagggugcuguucuaagcaacaguucuacccacggagccacguuucuagcccuacacuguaccuuuugaaagugugcacacuucugguugcuaaccuugugccucagaggccauggcaacaggacaguacacgccuuugcucugcucccaagauaaacaccagcucaccuguucagguccagcucgguaagguucagacucuagcucuaccaccugacucagggucggggacaaagugccagcuugagaccuggccucuucagaguugucaggcaaacggugggagguggggugacagcacuuaaggcaggugggccacuggggagccaagcaagugcuuggcuuuacugucugcaugaucugaagccuggggcugggggcuggaggcuaagggacugugcugggaucaguuaguacagagacugcagaaagacaaggcgucaguggccguuggcuagcuguacuauugauuacacaccuuuaauagcagucgaacccccaaacuugccauacuuuuuaaucccagcacuggggacggagaggagaccuggucuaaaaacaaaacaagcaaaaaccaaacuagggcuuuaagauagcucaguggguagagaccuuucuguugcaaucauaaggaccuguguuuggcuccccagcacauuguaaauaaaaagccagauguggccuugcauaucgguaacccagcuugcugucauucuagccagaaaauagugagccccagguucagcaagggaccugucccaagagagaaaggccaagagcgacagaggauaccugacagccucgucuggucuccgcccacgugcacauggugcacacuuacggcacauguacacagauaaacaaacaccaggacuuuugaguguggguuuugguguacugguaagauuuugcaaaaucacccuuccuguuacccuuuaucuguaagauccauuccacauagaggucagagggcaagcugaugucaugagccuuaaaguuggagucauugauagcacaggccuucuggcuuccuuggcuggcguguucagggugggcgagcuuuggcgcuguggagggagcaucuggaaggcccgacccugccuucccugauagagcucccugcccaugccccuguggcagcgcaggccacagcaggggccagggcuucugccuuggcucacagucaguguuccacucacugauccgucucagccacugacuguacaaaggagcugucagaauuagcugguacauuuccauugccucugucagucagaugcuucuuauaaaccaaacaggcauuugccccagagucucuaacaugggcaugcagaacacucagagucacugggaauuuguuuguuugguuguuuguuuguuugguuuuugguuuuugguuuuucgagacaggguuucucuguguagcccuggcuguccuggaacucacgcuguagaccaggcuggccucaaacucagaaauccgccugccucugccuccugagugcugggauuaaaggcgugcgccacuacacccugcugaauuuuuuauuuuuaaucagcuaaaaaaaauucuauuucauaguaucuuuggaguaucuuugagauuuuuuuuuucaauugaugccagauaacacuguuuuuggucccaaagcccugcauagagccuuccucgauugauguuucugagggugucaucgggagcgccuuucaaacagcagcacuguccugugaaggaaugucacaaaggcaucugaggacauuuugaaggcaguccuaggaagcuugcauagaggcaguguagagcuaguuccaaugucuaggacggaagcgccuggcacugaggccagccucaguuuucccuucccggguuuugccacucagaugcuuuucugcaagauagggagacagucucuccuuugggccuuggcucggucacugggucucagcuuuggcggagguuuugauauucugccuucauuauggaaguuugaugauggacggcuccuuacgugcugacgagccgucccucccucacccuacacuggguuucuguaugaccgaccucacucaccuuucucucuucccuuaaaaagcaccccaagcuggaugcugggcuuaggcucugagaugcugcucaggaagauuuuuuuucuuccuucuugagauagaaucucauagagcccagucuggccuugaacuugcuuuguagcaggagaugauguugaacccuguuuucaauucucuggggugcugagagccaaaccuagggcuucaggcaugcuagguaagcacucuaccaacugaccucugccccagcacaggaggagcccuugaacacaggacacaagaauuuaaggccagccucgggcaguggagauggggguguagauauagcaccaugguaauuuuuuuaacccuuguaacaagccaguaugcaucucugcaugcuguagacuuuaaagaucuauuuuaggcgagggagaggacucaacaguuagcacuuguuccucuugcagaagacccagguucauuucucagcgcccacaaccaucugguggcaacugugcuuccagagcaccugacacucucuuguggucuccaagagcaccagguccacauguggugcaccuaacauuaaugcagguaaaauacucauacacauaaaauacaaucuuaaaaaaaaaaucuaaaagcagaaaacaaagccagauacaaaaacaaacccucugaaacaaauugagacccacaggagguucagaccugguguagaaggugcaggcuccuuccaugggugacauccuccuugacuacaucagagugguucccugagggcagcgcaguggggaccgggcugagaggcucacucgguucuguauuguuaccuccgggagggcacgugucuguguaguucugcauggcucauuucauguggaucuauggacucaucaugacuucucgucacuggaggaaccugccugcaccacacucccucucacugucccuggucucugccaacugugcccucuucaucaucagcugcaccuuuauagcucugucauguugaaaauguucuauaaacggacucagacauuuucugacuuugggauuggcgacuuuaagcauaaugcucuccaggcagcccaaugcuguauguauugcuacuuuaaaaaaaaaaaaauuccuucuuuuggcuagguuuccaguacugugugacgucucugguuuugagcaggucuuaaguucaguuagaaagcuguuggucacugccacaguauuugugccauuaccgaauccguaggguuguggugccgugcugguuguuguggugauuccugggcaucauagccugguaagaccauuguuggucacguccccccuccccacuucuaagaucuauuuauuuggucuggagagaugguucagugguuaagaguacuagcuguucuuccagagguccugaguucauuuccuagcaaccacauggagucucacaaccaaaaaaaugggacccggugcccucuucuggugugucugaauacagcuacaguguacucauauaauuaauaaauuuguuuguuuguuuguuuguuuguuuacuguaugagugcucucucuguauugcauguacaccugcaggccagaagagggcaucaaauccuguuacagauggaucugugagucacccugugguugcugggaauugaacucaagaccucuggaaaagcagccagugcucuuaaccacugagcgaucuuuucagccccuguauccucuuuugagagcuuguauauaaugccuggaagcuagcucuugaggaagcauucaggccaguuccagcucgggaacucugggcccuguguuugagguauauggugucuuuagcaauaggggcuuaacuuccacuucuggagggcacuagcaauaggcugaguguuuuaagagucuugaauagcucugccuaacagagaggacuucuuucucuuaguguuggggcuguggguuguuguuuuuuuguuuguuuguuuguuuguuuuuguuuuguuuuucuuucaagacaggguuuagccuguauucuauagcucuggcuguccuggaacucaccuuguagacccgucuggccucaaacucagagauccacuggccucugccucccaaacucugggauuaaagauguuuaucaccaugaccaggcagacacucuuuuuuaaugcugagaaauagucuuaagaucuggauguagugguuuauucuauauucgcuuguugacagacauuugggcuauucucaggcuuuuuaagggagaaagggcuuauuauagcucaagaguuccugguucuaguccaucaagguaaagaugucaaggcaucuagagcuugaagcagcuggucaacauuuuagcagucaaaagaagccagugaauacaugugugcuuguuuuuagcugcuuucuccacaguuagaccagucagaucuccugcuuagggaauggugucaccuagagugggcaagucuuuccauaucaauuaacccaauccccuucagccuggcuuaaaaaucccaucuuccuggugauuccagauuuaucaaauuuugacaguucuggccggugcacugauuaugaauaccaaagcucaagcaaucuaccugccccagccuccugagggcugggacuacugggcugggcugccacaccaagcugcaugguugcauaagaaauggcuugacaguguucugcuuuaucuucaugccaguguagcgcugugugugagguucaguuucucugccuccuugccagcauuugcaucaacacugucucucauuguguaguucuggggauaccucucugugguuuucauuuucuucucuaucgucugaugaugugcacaccagcuaucaaccuagccagugcucucuucagauuggaugguacaguugaacuuuugacuguugcccagguuugugcugcagacacaccccaccacuccacagugccgcagcucucacaguauuaacauuucacucuuuucucuccuuucucagagcagugacagauggggcucuaugaguucaaauccagccagggucaccuagucauacucuggcagcagcagcagcagcagcaccaccaccaccagaaagcauguguuugagguuuagcaugaagugauacaaauaauauugaucugaacacaaguccacagucauaagaauaggauaggacaaagcaaaaacaaacuaauuggugguuguuuacauuuuacaccaaugucuuucacagcagagucuuuuaaacaauagucaucuuagaucagcagaggacagccagccuucaguauugucccgcaagaugcuuucucuucaucuccugcuuucuccuccuuuauccaggcugcaauuguuuugacaggugccacccucgaggcuuaguuguaagugcacugucgaucauugcagugcgcauguuccgucugugucagacuuccugcaguuacgcccagguucauuuaaagugcuauuuuauuuauuauaauaauugcuauuauuacucuguguguguguguaugugugugcgugugugugugugugugugugugugugugugugagagagagagagagagagagagaaauuggagaaagagagagagaaagauuuggagagagagagauuagagagauugauugauugauugauugaggagugaucagaggauuagcuuccaccuuuaugugaguuccagggacugaacucaggucaucaggcuuggcagcaagugccucuacccaagcaucuugcaaguccuaaaauagucacuucuaauuguaagcccauuuauccuugggacaucuguagacuagaacccucucgucucggacguaguugcacuggaacacuguagaacuccucuggcaggaaucccacccagcaccuucagagcuugaaguuaguauguucagacucuucuggguuuagaugcugcugguagauccuugcccaucagacaccugaccacacugacccccaggcagucgccucuguguagcgugaucggaugugaccuccacauugcaguguggugcugcaggagcguggagcuuugggcuccucaaggucaaggccgugucuucccaagaucaugaggguccagaggcuucaggacauuuccucagagaagugacccuacuggaucccuaccacccucugccauacccuuggcagaauuuugacaguugcucaacuaagaccgggagccaugggcuggggaaacagcucuugguuaaagugcuaaccaccgagaaugaguuuuggaguuuguuuccagaacccacguuaaaaacagaagggggagcugaauuggaaagccccaggccagcgagagacucucaaaaacaacugcaggcacacacaagcacacaugcacacagaugaacccccuauccccuccccccaaaaaagaauuggaaucugcuagagcaguuggaaucuaagccucgucuuguauguuuccuccccaccuugaggaacguggacuguauuuaaaagggaagccacagagaccaugcggauuagagggugcuagaccagcugcgguucccccugccgcaggggccaggugcuccaccaagccaaugggcuguuugcucugggaucugggucaugagugcucccucccaggaagacaucugucuguagcuauaggacagugggacccaguacucuucucgccugugcaccuguaagcagugggucccaggaucugcuccccucgcccucugugcgcauugugagcaggugcagagcuuagggugcuguggacuggauugcagauguggucggcagccuccaugugggccuugggucuggguggaggagcugauacaccugccuuuugaggggaccagagugaggacauugcuuuaacugugaucugagagaauguucuagaaaccuucaaaucauuugguagggggcuggaagccaaguuucacaucuuuauucuguuuccaagauguagauaauaucacuucaaaguugccaugaggggaaagaaaacaaacauaagauaauauuuggaggaaaugcuggagauuuaggggucucuuugcccacuccauguuuauccuuuucaucuggggugacaggcaaagacguugauucacggugcaaaccuuucuaaagaaacgucucaggcgcuagcuuucaacuuggcagccaugccuacagcagcuauuauuaggcugccacggcgucucucuccagagcuugccaccagugcucauacacagacaccuucuccguuuuuuucaguuucccaauuuagauuccuucucugcuuuugagucuugaaucugucuuuuaguuggugguuagggauugucgauguggaagagagcaauccaagggcucugccugggucccgguguucugacagcuagauguggaggcuggaugugagugggagcccagcaggagugcgggcggacagccgggcaagguggggucuggaccauaggguaggugugaguugucuggaccccacaaagacgaggggucacuacauccuggccuggaugucagcuuugggguuugcaagggacugugagguuggucaccugggcugaugauggagcuggggacucaagcuucaaucaggcuucuucccagugucugugaugugcccucgcucucucucucucacuccacucaccccucucagccgugcgugcacuggugcagaguagccccccccccccccgucucucuccccacucaccccucucagcugugcgcgcacuggugcagagugggucacuggcagucugggguuugggcaguuggccuuccaggucaccugauggcuggguaguacugaccgccgucaguagguggcagcacugaggaggaugagacuuguagggcucugaugccuggguagaaggcgcaguuggacuccucuggcugccauaacagaaugcuggaaaccagccuguuucucacuguucuagaggcugggcaguugagauccaggcacugaccacgcuguccaguggggcucauuucugguucauaggcaacucuucuuugucuucaaguuguagagaaggggucucacaccaggguacugaucccuuucaugaggacucuacccuccugaccuuccaaagaccccccuccuaaugcugucacuguggcugucaaucuggggcaccacacuccuuaagagcauucugaugcuccuggaaagcuuuguucuuggaaaguagcucuagucucuggcccagccuugccccaauuuucagacaugugguggguaccugucagcagcucuccucugggcugcgugaggaugacgucuccauuucagaugggacccuagcucugucuagacauagaaaggcuuuguuuccucagagaugccaucuucccuugguuucgcuuucccaccggaaagucccuugacguuccucaguucugccaugcucuuguguggcccaccucacucaccaucucuggagaugcagaucgaaagcugguaaugaggcugagcauuagagaucgcuuggcugcuggacuuggugcuggagauucaaagaugagaauaggggacuuacugccucugagcaggcaggaagagagacccguggaccgaacgcagacccuguguuccuuagagaauagcuagggcaugugaaauggccuggaguauccgguuggggaagugucugggcaggguuuugggaaaguggauuccuacauugaguuagaagaugauuucucugagguggggguggggcgggggcagagauagaguacuuuccuggcaugugugaaguccuagguuuuauaguuugaaauuugaagauaagccauaacuuuaugucccagauagcacagcugggacccgaaggauugagugacuguuagccauuauggaagucugagagaaaucucaaaagccaggcccuucagguagauucccauagcaauaaaacagcuuugccaagccugacagugguggagcacaccuuuaaucccagcacuugggaggcagaggcaggcggauuucugagaguucaaggccagccuggucuaaagagugaguucuaggacagccagggcuacacagagaaagccugucucagaagaacaaaaaccaaacagcagcaaccacaagaaaagccauucugucacaucagcgcagcacaggccuuuuauccucacucacugaggauuugaacucaaggccugccuaggcuauacauagccucuaaaggagggugacaaggggcuggcgagauggcucagugguugagagcacugacugcuguuccgaaggucccaaguucaaaucccagcaaccacaugcaugcuccguuaugagaucugacgcccucuucuggagugucugagggcagcuacaguguacuuacauauaauaaauaaauaaaucuugaaagaaaaaaaaauaggagagugaaaagaggcccaugggacaguuccgugugccacgugaggacuccagcuuguggcaacaguacuuagggacuggcaggguagcaguggucaagcuguuguuagcaguuguaggucagcacucuucuguacccugcuucccagccauguucuggccuccuaacuuacuauggaagauugaggugacaaaggucucagaacaucacaggccauuguguauuggcccagagaugccagggcaagggcugagcaggggcauggcuaggcccaugaugcagaccuggaaggguuguucacagcacaccaccgcucgcucgcuuauucccguuucuucccuaggccagcccgucacucacggcacgagauccucucagggagccugcugcugcugggaaccaugacagugaggggggccgcgcuggccccagacccagcgucacccacaaccacaacagcuucaccuagcgucucugccacccccgagggcagccccacagccauggagcacccuguguuccugaugaccacugccgcccaggccaucuccggcuucuuuguguggacagcucugcucaucacuugccaccagguaccuuggugugaugggggaacauccuuagugucccaagugguuucuaguuccacaaaggaugcuucaggccggccaggcaaggagcguaagcccugcuuccugggguucucucccgcaccccagcuccccugcaagcaggugguggcuuuggauucaccuccaguccaguagcaacuggagcaucgggauugugaggagacacacagaugcuugucugcuacgaccugcucagaaucugcuggccacgcacauaugcagccgaagccacggaacgguugcaguuagacauuauugggagccugagggagguggcugaggagcugguggcagcucaggaagagaagucaggucuccuguuuccuguccuuucgcccucaggggagguugggugcccaaggaggagcuugcuggauucccauguagaggguuggaugagucugcucaggccccuggcagccccucaccagcugccgugcaucucagucucuuucagauccauuaguggccaaggaaauuggcucacagcggauggaaauguuuuguccuuuuccuuagucagggcuggccugggcugggccaagagugaugucaugagagucgggcugcgcccuuagcucugcuuccccagaguugcacugccuucuccugccucccuggggauauugcagucagugcugccuuaguucagcggauugggcauagugugagcacaccacuauggccacacagccuggaaguguguccagguccuccagagggaggcucucgaguaccccacccucucuagcaucugugaagggacaaggcagaguggccacagccagguggcuucaacucgcccuugaucagcccuucagcuaacucagugcugcugcugcugugagaccuugggaacuuggcuuuggggaggcagaaugacaggagcacacauugaggaccgcaacuucaacaacacuguggcccuacuguccccuguagcugaagguggccuguagauagugucacaccggcuuuauguggucacuuugauuggacucucacgauggaagguuugucaucuaguuuuccagagcaggauugaggcucaggguggguaacuugcaucagcccauagagcaaggaaggguagagacagaugucaggagccauccucuucccauggagcaggcaggaggaagagggcagacaggcaggugggaggcagcugugguaguagugggacuuggcugacuuagugcccucccucagaucuacaugcaucugcgcugcuacagccgucccaaugagcagcgccacaucgugcgcauccucuucaucgugcccaucuacgccuucgacuccuggcucagccuccucuucuucaccaaugaccaguacuacguguacuucggcaccguccgagacugcuaugagggugagcacaccuuggagcggggcuugggaggaagguuggggagugggggccuuggggccaggggggugcacaucccucguucaucucuaggaccugaggcuggcacgucauuccucagucucucaggagccucuggaccaaccucacaaggauagaucuggaucccucuuccccaccuggcuguccaucugucgcuaauggacggguaaccauccacauguaacccaagucucugcuuacagacaugguuugguuugggggaucccaagacgccuucacagaugccucgaggcaggagcucuaccucugauucguuuauuucucaucucuggcuucucuagccugguuggcaacuucuaaaugauccaucuauggauaggaaccauggguauugggggaggauuuacacagcuggccugcaagcccaugugucccccugugaugcucuguuacgccucaaaggaaaggacuggcacccccuccuuagcgccuucugacacauucccccuuauuucuguguccccuaccacaaccucuuuaggagacacaucagccuccaccccagcucagcaguagguaguuccucgguguuaggagcuggcguggucugauuuuccagccccgagugggacugacccucaucuugucucuucaccaaugucauauccuugucccugcacugucuguuccuucaguggauacagcccugagaggaggcuucacuccgugggaacagagccaggcacgugacagcacuauccccucccccuuugagagaagaucucauguagccugggcuggccucagacuuuuugguuaguggggagagcagggagcagguaucagugucucaugcuauaucucugacugaccuggagcucauagagaucggccuaugucuaccucuuuaguucugggauugagguguaaccuuauagccuuuguuuuuuuguuuuuguuuuuguuuuucacgacagaguuccucuguauagcccuggcuguccuggaacucacucuguagaccaggcuggccuugaacucagaaaucugccugccucugccucccaagugcugggauuaaaggcgugagccaccacugcccagugugaccuauauucuuugacucucugucuaccuuuuauguguaugaauguuugcugguguguauguaugucugggcaccguguguauguagugccugaggaggccagaagaaggcucugugaacugaaagccaggaugaugcucuggaagaucagcccaugcucuuagcugcuuagccaucucuccagcccuagccucaaacucccgugccccugaaacaugguuucucuguguagcccucccuggcuguccugaaacuuguucuguagaccagguugaccucgaacacagauauccuccugccucugccucccaaguguugggauuaaagguauauguuaccauacuugguuuuauguggugcuggacauggaacccaggacuuucuagaggcuaagcaggcacaaaaauacauccccaaucuaguccguguguguguguguguguguguguguguguguguguguguguguuggaggaaugaggggcccugcccaacccuucuguggggcugcaguugacuccccaguaccguccuccuggccagugcucaaaaagguuccuuccaggagagaauauggggaggcagguguuccacugugcuugauauuccugaaagcagaaaaccccuggggagccucuggcugggaagggaggaucugggcaccuggaccagcuccucccugcaggugccagcuccucccuucccagucaccaggaccagcaucugcuccccugguucuuuuagaaacagaaaguuguuucuugcugcauauguguccuugucuguguuuguguguguguguguguguguguguguguguguguguguguguguguguuggugucuguguguccuguguagucuaagggcccugaagauaggaccuguaguacauggggacacaggaggggagcuaccaggcgguccucacucaacaacaccccagaguagcagcacuucugaagccccuuuguuccucccaccugccccaaccagcuccaccaccagcucaggaagucugccauccaucuccuagcaacgcuguugucucuggccugucaucucccaggacauuuacaaacagagcacagcaccugacccucacucucaccuaucccuucuguauuuccccuuagaucucuuguaacauaccuaaaaaagcacacacacaugcacgcacaggcacacauacaaacacgucucuuauccucaccaugcuggggaacuagacuacaguuuucucuaggugugcguuuagaaugugcguuuaaaugcugcccagagcugagccuugcacugcgcucccugcccccuccucuuuuccuuucauuuccuuugguuuggggcagguccuuaugcagccccuuaugcagugcgugcacuccugccuccacuccugagggcggugcuugcagcccucuguccuuucuguguagaaaccugggcuuugcuacuugucuuaauuugggguuugcucgguuuucugugcuuaucccucacuuaucccugaccacuacaaccgaguuuuaaauaaccagucccgcuuuccgaauggcggcccugugugaaucuguuagcacuggcuuugcuuugaccaggcucucugcacucagcacugccagcuuucaaggccaccucugcugucacccagguugccagucacaaucauucuuagaccuguguuggcuuccccugugcugugugggucaccugucccuguuucuccuucauuugugguuuguucucucuguuaguuggggcucaucuucuaccaggcuccugagaaagcugcccaugggaugcugguaaggaagccugaagugucuuuaguggauggcucugugauugacaucuuucggaagggacuacaccucaaggguggaaauuguucucuggguccugcaggcuucuucucacugcuccuacugcugccuuuagggagucagcuggauucugacccugccuagcugcuugcauauuuuuuuaggcuuuuaagaucuugcuuucaaccucaaaguuccaaaaccuuacuaaagauagaguaguggucacugugccgggggaggccuugugggcgugaacccccgacucagggccugagaccuuuccuuguuugugucuuugauauuuuucuuuaagguuaaacaauuauuuaauuguuuaaauuuuauuguuuaguuagcaaccuggcaaggacugaguuucagagauacugggugccuguccuaggaugcccuggcuccauacagcacccaucugaugagggcugugguucacaccgagcugggauagaccacggggcuggggugugagcugaucgccgcggguuuggugucugaugggcuugggaugagcuaagagccugagagacuggggggccagaguuggagaugcagcguccucugcucccuaccacauauuuuguuacaagaguuuguguggcguucacagcuuaccccagguucucccuuaucauuagcacguucuucccucccccaggaccagggcgagugugcaucgcacagccauuacgcagugugaaaacggggcugcccaggaggacccaauggugacaaagcgccaggcaccugccugccugggucuuugcagccaggauuugacuuaugccgggccuggugaaggaggggagcgcaccccacuucagaguucagauucuuguuguugagagaggucucacuguguagcccaggcuggccucaaauccgugaucccugugccucagccucccuugcacggcuuugcgacgucacaccuggccccagaguguucuagauacacugaaucuugacacguagccccaaaugaaccaucuuuuaugacagagaggcuacagugaaugaacgaagagcuuaggacgggagccagggaggcaguucaauggguaaagauguuugcuggcaaggcugaugucuggaaugccucuguaggauccaugugaugaaaggugaggccugacugcugcgaacucuucagaucuacacacacacacacacacacauacacacacacacacacacacacacacacacacacgaauguaacuuaaaaagagagucauaagccgguuugcugccaguaggacacccugauggguaacagcaccacuggccacagcucacaaacaagaaguauaagagcucaguggaucugaguaaagggagagagaggccugaaggaagaggagucagaagcagccugugcggugccgggaaaggaugaggagacaccccagaggagggcuagggagcagcuuggaauugggcacauuuacacagggcagguccccuguccaccaggcuugguccacuguacagcgauugcccacgugccccugaaaaauggggagggauguucugaggcuuggugaaccaagcagaaaguccucuaguccacagauggcaguuguccaaaccuauccucaguuacccgaaugccccagauagcuuggucucuccaaucaacacagaguuucuguguaggagaggccgagaccagcggaaggugcucaaguuuaacagaggagagagcuuggcgcagccagaugcacuggggaccaucaguucuguacaagguaccuacugugucguagaugguagucagugcuguauauugaagaguguauaacuccuggccgggggcacagcugcagggacacuuccgagcagguucuucugaagcccugagcuggauguuguagcuuuuuguuugcaggaacuauagcuaggacacugaguggacuguaaccuccuggcuagguaguuacuggcuagagaagcugccagugagcgagggcuagugggaucacagucccugcuggggggucugcuucugauacuugguucuauugaccaacugggggcucagaucucccucucccaugacaauguucacuagaaaguauuuuuccaaaucaggugugcuggcacgugccuguaauucagcauguuugggagacagagcccaaaagaucucugccaguuuggggccagccucagcuccaugaugagccccuguccugaaaagcaagaagggagaaagguguguccguucugucaagugaaguccuugugggaucugccaugagauggugaggcacccgucuacuguguggacaagccuccagguuucauugugacccucauucucccuuccugauggcauucucuugucugugacuugacaugugguaucuagaauggaacagaaaguucuagauauccagcagaccagggcaggaguaggugagaccaucccuucccucuggacugugggucccaugauugcuaaugugucccuggccuaacacacgaccuggcgugcaggcugugguagauauugccuucguagagaccaggucuggagccacauugagaauguagcaggauggcagccuacugccugaauugcacccauuccuggucacacgucagccucccuuuucuguuuccggccuguguagaugcauucuuguguaaaugcuauuguugggucuguucugugugagccuauauuuuccuaggaaaaguguuguagaaauuacuuuaauccuggcccgggguuauugacuucccagauaaaaaaacacacacagccuuuauaguuuuaauaagccuuaagcagcacaagagcugggcagcugcuuacccuccucgauguuagaaucuacuuugcuaucgauaauccgaguuacuuacuguguuucgucugggcugcucauaacuucaaucagccagcccucagaaccauguucuucuggcucaucuaacccauggccacuucuuccucaugcccuccucuucucccccuucacguuccuccucugaccccaaacccgcaaagccuaaaccccaccuaugucucuucugcccagcuauuguacugauuaacguguauuguaaguauaaaggcugugugugucuuucguccauccgagagggauggguagaaaccucaggaggaguuuaaauauuuacuaccaaagggaguggauuuuaacagguagucaggggaccugauuugaucaaucagucaugucugaggagguuguucucgucuccuuucucugagaauugaugaauuuauuagugacacacuagugauuguuggcagugaaacagcacugguuguucuguguacuugcuaaggugacagucuugagcugagaguggagcgcagcgggagugagccuuucagucagagcuggguauggcugugguggaccagcagcccaggcucacacugcacagaaagggaaggguguaagcucuggugggcgacauguccucccaaggggaagugguguuggguccuguggcuucucugggagaauccauuucaagaaagguuccuuuucuguccugccagggggagguccugugagagccagugugagcguaggccuguggccugcccuggccuuugccauaggugauaaugcuggagagccagaggccacauccagccccugaccuucaucccugcagugcuggcugcaggucccaggccuucagcuuguacugggguaggacucagcaacucccugcagggugcucuggagugagcgucacaccacucacugagcgcacgggagcauguccagggaauucagcugucagcagggccucauauaguugcugcucuucgccccacagcaggcugaggaggccauuguccccaguucacagcugaggaaacaggcacagagagcuugagaacccggccuaaagccacacagcuccuaaucgguagagccaugguccacagcuggacagucuggcccaggggcaugugguucuucaccccagcucuaugcugcccuguauccugaaaggucagaggucaucagacgacugcagggcuaagugucacugcagcucagcccuuggcuugccgcucuguucugagugaccgcucugcugacuuuucgcagccuuugucaucuauaacuuccugagcuugugcuaugaguaccucgggggagagagugccaucaugucugagaucagagggaaggccauugagugaguaugacagcuuccugagccccaugugggcaacucccagccucacccacacccuggguagacacauagaccauacccacgcacccccugggugggcacacagaccaccccagccccuggccccagcccucucuacuugucauucccagguccagcuguauguacggcacgugcugccucuggggaaagaccuacuccaucggauuccugcgguucuguaaacagguguguggccagcgacagccccagcuugggagcaggcaaggggcccugguucagaccuuuguccuggagggugauucguguugcaugcugaccugugccauaccuguggaggucuccaggcccuugagcuguccccaagcuauucuggagacaccauguuaaugucaucugcugagacuggcagugaacauccuggaagucucaggggcagccuggggccggagaagcuggcccagagucuuacuguguucaagaaccaggaagcacacaguucuggaccaucuauuuaaaaacccaucccuguuucugggccaagaggguuucugcaugagagacaccgagcagaccagacugcgcagcgccugcccucucccacguuccagucacagcgucauggcugcuggucuccuuggucaccacuuccuggcuacaguuggacuugcagcuucucugccugugugaccucaucguuuguuuaaccucucuaagcuuguuuguccuucuauaaaauggagguggcaauacuuaccucaggaggugacugaagggagcagaugaggcagaggauguaguccuuagcacagcucugucucaucuagggagauaguaucuaggggugccacacccagacuucaugacugcccuuggccucugcaggccucuguuagccuccaacauggccagguagucagagagaaaggucccccccacccucaccuccccgccaagggcacuacagucugucccucuuguuggccucuguacagggcucagggccacagcacggcuaccugcacaacagccuggcaguggacauguccgagcuucaguucugccucucccagagggagccucuccuagagggagccucacggucucucccguggagugguccggaagggguuaacgcuguucugguccaggguggggcuugccuagccuuuguuuguguaguucagccacccaguccaggcccagcugugacucauggccgcguuugaucaugacauuguccucaaagguuugcucucaagagcagaacagagaacacaguuggccucaccgccaccagguacagaccauuccccucccaggacucuggggcccccaauguugaacuucaccguggcggugaaggcaggagugaaggagcauguggaggcgcccgaccccugcgccaccccuguuuacacaguccugucuucauuccagcaccacagggugggccaggauguccuccggcccagagcccagugucugagucuuuuggcacauuuguuaaaaggggaaauuccugggcuacaaugugauggaaaagcacuucccucguguguguguguguguguguguguguguguguuuuccuggguucuguuccuaugaggagacauaaggggcggggguuaggugacagaggaagggaggggagcagggauucucaggucagugaccccuaaccccccaacucaacagagcucuagaaaagacugcccgcucuggggcugacacauaauuuugacuucuccccuagacuguggcccucagacacccacccaugguauagcuggacaaagguucuggagccuguuggcuuaggcgccguugcugcaucugccugccucaguuuccuugugugugacugagcugauaaaaguucccuacagggagcagccccaccagcucccugggcaccuuggugugaaccccugcuuuucucccuuccgcacacugccucuggugaagguuugcagcccagggcuucuguuggggcuuucugauagcagcgcacagcccugccugugccgugcuccucaguggagauguguucccgggcaguccuucugcuuucagccucugccucugggccuagccagagccauacuggccaugccgugugccugccgccucuccuucacucagggcuucuggcugaggaugauggccuugaggucagugugagucugcgggugacacggacaccccacuggauuacagaaacugcagagcuggcuuaguauccucccgcauuugagcaaguuugaaaaagccugacuguguguagaauagguagccucggcaggaggacacugcggcuaacucugaugugcuguggacacgggguauuuaacauucagcccgauggcugccacucagagaccacaguggauagucagccaggccuggauucccauguaccuuuuggggagcaugcauauuaaagggguguccuguccucacuugcuguuccuggaggcuuucuccagccuacucagaccccagcuccacagaaucccugucccaggccagggugugggcaaggaagcagcuggggaggaugagaagauggaggcccggccgggcggugguggcgcacaccuuuaaucccagcacuuggaaggcagaggcagacggauuucugaguucgaggccagccuggucuacgagugaguuccaggauagccagggcuacacagagaaacccugucucggaaaaaaaaaaaaaaaagaagaagaugauggagguccuugcgcucccugugugggccagguguuccuuaucgagccucuugcccagaaccaccucccucccugcugcuguauccugaccugcucccccccccuuuccuuguucacauucugcccugagcaagccucuauacgaaugaaaggcucccguuaguuuauuuguuuguuuacucugugugugugugucugugugauuggcuuggagcugcucccuuuggcuggauccuggccuugccaucuuccugaaggccucucauccucugagcucucucugagaugucuucugcuccugguccccuggguccuagucuuugaauccccagcauccucuugucuccuuacacauuuggccucccccuaggcaguugcuuccuccuuccuagcagccagcauaggcccagcugccagagcaggugcugaagcggagcaccccuacuuauccugccucaucugucuccccaacaggccacccugcaguucuguguggugaagccacucauggccgucagcaccguuauacuccaggccuuuggcaaguaccgggacggagacuuugaguaagcagggguccucccugggaucuguggguggaauauuggcauacaaauggguacccuaccuugacagcccacuguggucucccuaaauugcaugggcccugggugagucucagaaggugguggcugcucuaaggcagguucugaaaggagcccugggaagcaguccucagacccugauguaaaggccccacuauguaaaccagccacaucuuuucaccuguggguuagugaaggcaccuuacacucgacccugugcucugagaucuugccuguaaccuguaccacagcccaccuaggcagaugaguccaccaagaucaguuugcccacugugacacuugucaccuccagcauagccccagcuucucucuaguguccuccauaaggaguggacucagagcagggccuccaugugagugggagaagcgguaauggcaggcuggccugcuggcagcaccucugcacuccauucccacucuguccccauccccuguccccucccuccagggggucauuguaccuuacuggagagcacagcugugaccuaugggagcagguugugggcaggguggaggagggggcagcuugcccucacagagcuggucccagccacacaugccuccccacagugucaccaguggguaccucuacgugaccaucaucuacaacaucuccgucagccuggcccuauaugcgcucuuccucuucuacuuugccacaagggagcugcucagccccuacagcccuguccucaaguucuucauggucaaguccgucauauuccucuccuucuggcaaggucggccuucucucaccuggugcucauagccccagugccugcuuccacccuggucccaucucccacucgguucauguuuccagaacuguggguuccagccagaguucuguccuuuaagauccuggccuggaacucacugggcacuugggaggggugaagcuugcaggaaacuccuguucucagugucuccaggagcaaaugagcccuauuguacccugggguguguggcuguuuggguggcacugcaugacugcagggcaugggaagggaucuggcgugugaccagacaguggcucucccuauacaggcaugcugcuggccaucuuagagaagugcggggccauccccaagaucaacucagcgcgagugucagugggugagggcaccguggcugccggcuaccaggacuucaucaucuguguggagauguucuucgcggccuuggcccugcggcaugccuucaccuacaaggucuacgcugacaagagacuggacgcucaagguaugagccagguuccuacccagggcaugaccccagucuuaggaggccaacuccagagacccccaccacccggcaucuugugaggguugaguauacugaaagaugagcuaaagaugucagaguagcggggcugucagaauccagagggaccccuaguuagcuuguagaagcucaguucacccauguagguccuagcauagagaccuacaaaugguauagaaagguauauucuuauaaucccagcauucaggaagcugaggcaggaggguuacuaugaguuugaggaaaaaaaaaaaguagggacagagacuagcaaacuccacugaguagcgucugcucugaccugucuucugccugcugagcugucuucaaggagcaaaccacagaaaccccacuucccugugaaaagcagggucaaaggcaugcccgccgcuggcccuucacgccucuaauccuuguugcuaaggcaguaucccauagcccugguguccacaggagcccuagaaagaucuugguggguagggccaaccugggcaccucugugauuggcccgugcgggugucuggagaagcagugggccagguguguagaaggcuuguuccugaggggaaugccugaggcugccauccggugagagacagcagggacaggaaagggaggccuccugacuaaaguaccugcccaccgccaucuaguugcugucagcuuuacgucauggcugcaggccagaaaccccuuacccaagccucagugcccaccaugggucccugugguuggcauggggagucuuagggacccacaagacaggacucccugcccagccccuuugcuguucucgguugggagugaccuucagcugccucugcaggccugugcucccugacacaauggcgcuuuagccgccacccuggugcuugagggcaucccugcucugccgagaguugcuaguugguccacccccaccccgcuuccugcuaggccccagugggaaagauccgauaacuuuuauccauaucccuuaaaccugguuagccaggcugcuagaagcaagccagguuaguuugcacagagggguguugugucuuagaggcucugcaggagcacuuuacugguggcaugguggcuguucccuguacuucccucaggcaggaccuccccuauagaugcacccacccuagaagaaacagcccacccaggacaagcugcugcugcgggcuguuguccauucuccuaaccauggcacucagauuaggcuggggugaacacucucugugaucgucucugagccuugauuucuagcacuauacauuggagugaguuuuguaagacacagagcucccuguaggcauagcuccagcagaccuaggagaagugggaagaggggcccucagauaugggguggaacuuccacugccaucagggugaccccuauuagcacgagcacugcccuucaggggcagccugggugucuggggaugggugggggcgucacugggccuggggcgagcaggcccuuuucacucagcugucucuuaucuucucuaucccuccggcuuuucucccugccccuuuccucugcauuugcccuggguuuggccucggguagugcugacguacggcccauacgguaggucugcucucugcucugucugcacgucuguccugcacgucagucugcucccgucacuggcaugccuuuuuguagccccgcguguacccacuccuccaagcuggcacuccuaggugagagccccgagcaccugacugagagagcugccuuugcagagcuuggcugccuucguuccauucucugguuuugaaguacacucugcucgguucuggaacacagugccccuaaaguaacaggaggggcauuuaguaguguuucugagagaguaugagucccauucacggccugggcccaguguugagcucaucgcuccagcugggcuugguggccuacacuguguccccaguccuacccugaugcuguggggcacagguggaugaguuagaagcaagucaagguagcgaguuccugcccucugggagggacagccaacaggccagccugcuacuguaccugagaccugguucagcagccaucccaggcuaggggucacagccuagcacuagagcuuggugggccaagugacugccugcagcuuucccguccugcccugucuucuccucccugagugcuauguucugccccuuuguccuagcuuccuucacagcuccccaggucucuccuggucagcagcagccuugguguccugucccuuucaugucccaggagcacugggguggggucugucccaggaguaggggcagggacugaccaagucuuccuccucccacuccggccucaugugccccccccuccgcccuccccucaggccgcugcgcccccaugaagagcaucuccagcagccucaaagagaccaugaacccacacgauauugugcaggacgccauccacaacuucucgccagccuaccagcaguacacgcagcaguccacucuggagcccgggcccaccuggcguggcggcacgcacagccuuucccgcucccacagccuuaguggugcacgcgacaaugagaagacucugcugcucagcucugaugaugaguucuaagugugggcccuggaggggaaggagaggugcuucccccagcccccagccaggcuggggagcagagcaaccagcacagcauggcugcugcccuuuuauuuauuggaccagaaacucgcauaucacuuccagaggaacaggccucaggaauauuucucccuggccagcccugcacuagcuggggcaggggcagaggacagcggcuguagcugucacaucucugcgacucauccuguaccguguguuggccagaagcugcauccuaagcccccuccccaacaagauaucugccgagcugucaggcccagcccacccuacaccgugcaauacccagacccagccuggucuuuccccaggccuuugcccgcuucucccuggucacccuuguccagugugaguuuugucacauucugggcagguagagacgugaaugcucuguggacccucccccucucccaaccuaggccugucuggcaugcugcaaggaccagagccagcccccaggagccucagggcccacuuaggaaggaugccuugugccuaugggcccuuuggugacauguggggcucuggauccuuggguguccucacuguggccacucugccugcugaggacagccagaagcccacacugcccucucacuuggguccaguucuugauaguugggggcagagcccccacacucccuuauacuuccugacugugccagggcuuggguuccccaccaccuccucaauggagcaaagacuccugcuaggcccuggucucccugggguuuaucccuccugggucaugggaaaagucagucuccacauuacagaucacuuccagagggaggcuggagggauggucauacagcggggccaagguagggguggucucagacccuccuggguccccugaccauacagggccugguggucugcuccaucuggccccuggcccaucucuucugugccuuagucacauaugaaagccccuccccaguucccgucugcuccaggcacuccucguugagcugcuggcacucaggguuccgcagcgcuggguugggcauccuugggaccacccacccucucccuggcucccucuacacgcacaucccagagcugccucccagggcugggaucucagagguaggguggcaggggccugguaagcagaauucaagcagcacuuggucuuggcuccaguagccucuugagguggagagugguggggagcccuaccuuguagccuucaguggaugcucuccccuuggucaccucuggaacaaacagguuccuucccugggguccauagggagggaccucauggggcugucacauccuagcaaccuucuuagccuccuuccuuccuuccacacggcccagaggccagcucggccccacccagagggccuggccagcugcucccaagccacccagggaggcagcagacaggugggagcuccuggggcacggccgugggauugcuuccaccaguguguuucugagacuucuccuuaucuuccaggccaaaguauguugcugcuuccugucuccacugguccccaccuacccuggcacuugcccugugacaugaugggugaggcugugggggaacucaguggcaggaagcuaguggucccugggaacaggggacaggaauccguacccaacugccccguucuuucuucccauucuuucuuccuaggaugcauaaacuaucuugucucauuuauuuuuuaauuuuuuuucagauagaguagcucuuuguacauaaaaaaaauacuugaaaauuguaugauguaugagaagacagagcccccuaguuuuguauuuuguccugugacugccaugcguuccaccagaaagccgcucuauuuuggucucugugauauuuuaaaugcgugacagaagcaagcaaauaaagucaggaagaaauauauauaugagauaauauagauuguauugaaaucucu

SEQ ID NO: 7877 - RNA, 37722 nt, Mus musculus
agaggguaucuauaucacuuuguccuuuucuacuuuauuacuucaaauuaacaaccacaauaaagcucaaaaaaguccaauauuuacacaggaaaaaaguacaaaauuccccccaaaguucuucaguaauuuuuuuuucaguuuuuuaaauuacaaaguaauaaaaaguuuugcucuuuaauuaaaaaaaagaaagaaaggggaaaaaaagagguaaauaaauuaggaaauacacacacugagaaaacaaacaaaaauaauaauaauaauaauaauaaaaaaaccaacaaaacagguguuaaccaggaaggguaaauucaacacuuagcccugacccaggguccuacucagaagucaggccugggaagaggggugaccacaggugacucucaggaccagggaaguaaccgguaucucagagccgaugccaucugggagcagacuccaagaacuugccuaagaucaggaauggaaguuggggggggaggggugccacacacuggcaucuggggacaggugguggcaaggacucuaugcccugagggauguggaagucauuguccaccccaccuugacuuuaggaggaggggaacagaaacuuggccaggcaggcguggcaggccaccugcagcucugaaaaauacaagucagcagucucucagucagucucucagucagucucucagucucucucucucucucagucucucucucucucucucucucucucucucucucucucucaugcauacacacacacacucacagucacacaaggcaucauggccuccaucucaccgcacccucagggucucuguagagaggugacaggugugugugggggagaccaggaugcucagggaaggggauucugggaaagccccauacaacacuggucacugucaucacccaagggcugauggcgugugugucauccaaggcuccaugaaaucucuugggacuugucucugacuggccaaaccgcucccugacacaagcucuucaggcaccuccgauggcggcccggcacgugguggccgguggcgagaacagguggcuggcaugugacccaguguccuuagaggaguguuggcagccuucaggucgggagcagugggcaaggcaagggaacaagaauccucagugcuaacgaggucuugucuuuuugccauuggcaaaauaaaucaaagaaacaaaauccauugucgacuuugugcuggguuguggguuuugugguuuguuuguuuuucucuuuuuuguucaugugaacuguucuuucuuucuguccuuucucuuauuuguauuuaauuuuuuuuuuuuuaaagaaaaugcagugaagacacuaggagggaagaaaagacaacggucaggugccuggcugccucgguuuacccagccaaugcgcuccucugcucuggugggcugagcggccaucccagccccaugucuaucugaacugauuagccauuuguugggagaauuucugcagugugaagucugcuuaagaaaccacggugugaagcugcacgucucaaugggugggacacugccugcuaauauccauguucugcagggagcuuggguccccagccaauacuaccagaagagccuguggccccuuucccaaaccaggcuucuagguacugccccccaagccacagacagccgcaggcaguccaccccgaacuagcuuuggccagagggucuuuccuguguauaaacacaugaaggcccuucuacacucugguuccuuuuuggcucugcacauaucaucuuauauaacagccaaaaggaggagguaggcuaaagcccuggaaacccacauguggccaggagccuggucuuuccuaggaaucaaggggacagaagacccaaggacagaaaaaggguuuccccgaagugucccuguguaccgauucaggacugcuugugagaagugauagcuuggauggcagauuuuaaaaucuaaagcuuccuugaagagauuagaaggggagguuccugcuucugcgucacguuccccugcccuccagggcccucaguagacaccaguacucaccuaagcaaacacuggucuguggucgcucuccucauuucccaagauggucaaauggcacgcuugucuucaagagggggacagagaaauaugggggagucucaaggcagguccuuaagcagguggccacaaugauuccccaagucucauacacccccccccccaauggagcuccaucccucacagcaggcugcucagucugagggcagcugugugaucucaggucugaggcugccccuggcucuagagccgaaacacccccgcuuggaggccaaggcuggcucaauuccaggucugaguccaaggaaguucgucucccacaggcaggaucggguagaucuaccuuugccaagccccuuccucuacauucugaguccgaauauggccauuaagugggaugaccugacaagaccucucccuccucccgcuucaucccuugcuguugucagugcugaugggaacugccgagagucgcccacccagaccgcagugagugcuagcgcuuacugggcuguuauuucuuugagccucaguuucucccuucgcuuugcucaacacaagagggcuaauuagcuucagggugaucagaggcaggggaggaaaggugccacagggucagaccaacacaccaagaauaucuagguccacugugcccccgagaggccuggaagaguugacucaccugugaggcugcaagccgggagaccucuugccgcccagugaggucugaggaggagacauuggcaggggcaccucuguggagucucaugcucaccuuccucucucggucggcccgugagaucgcucugggagaaguauugccuggaaggaggggaggggagccaccuucaguacgggcauuaagcaacccccugacccccauaggcccagcccaaggcucaaggccccugcugaccaguuuguuggaugcgggaggcuggaguggaagccacaggcucggcugcacuucggagucgguuggcgguagccccuguaggugggccagggggcagggcucuggucgcggacccucgcaacugccccauccucucuucccguucgugcucccgucuuucccggucuacauccucgggauuccgggcugcacccuacaggaacaugagaggggauuccagucagcccagggagggugcuucauugcaacccagaccccugacaggacagagcagaagggagagcuguguggacagcucaaggaagucagcccaccuuucuccccauaccaagaaggccagaguuuacccucuaccacagugcacaaggaccaagccacccaacacccagaagagagagccgccauggcagagaaacagaaagagcucagccugucccgaaugguaucuccaggaugaccagggguaacucuuggcucguccaaccuggcuccccuguucucaacuaagcaggaagggcauacagaggcccaacuagcugacagacaggccauaaccagagaagaaggggccaauucagagccagcacugucccaaggucccccagcacccaaucacagggucaccuucccggggcucccagaccuggccauuacuccuauuaugaagugacagccaggggaccuaggggaccccauuaaugcauugccuggaagcccaggggaaaaggaagaagucuugauguuccagagagaaaagaggcccuuaggcaaagcuggagaagggaggugccuggagugcccccaggggccuaucuucuuaaguuacugccccaaguccaagaggaagggaggaaggaccggaaagauugcagcgugguugcagcuccuagcugaguuaccuagcugguccuggggccguccacagggaagggcagggggcugguggaaggggggccgcaucuguggaggagagagcuacaggcugaguggggaacccaccauaggccacggggcagggcucugcaaacccucaucucuccagguacuggcuaagaagcccugcugcucugaaaaacggggagggaguggcucaauuccgaaugaucccagaguucuaugggaagaagccaagccaggcaggcacauccccagcucacucaauggcuagugcucuuaccuccuaucuggggcccucucugagguagaaacgcugacuggucagagccuugugaccugccccgaguuacaaagcccauacagauguggugauaaaccuaccacugauccauuuccgucccucaaaaggacaugguuuagauaccuuaccuuggacaucccacucagaagccggggcucaggacucccugguugcccaggucagccaaaaacgcagcccaagcagagagaagcaagagcuaugggggcucacagccaacccugugguagccgugggaaacggaggcuugcugaggcuaagcaaagaguucacuuaggggugcagagccccaaacagggugucgcccugccauuaaugcuucaagcuuggcacagcaauagccagguggauagcuggggucucugcaguuccagcaggcucaggacggaccugacgccacgggcaucuacccaaugggauaagaugccuuaagaaacgcacaccagcgaguuuucauggccuuuauugcccacaagaaaacauagaagucagugccccaaguuacacaaaugucuggcuccaucuuagagaugucacuguacggagccuccuccugacuagaacaguggcuguguccucagagagaagcagcuggggauuccagucccuuggggguggaacacgggaggucauuccaaggucaaguggguccuuccggucuguuuguugcucaaggaguccugucugcagaguacugcuggacggcuucuauuugcagggcaggugggaaggccuggucuugggaugagagcugugaaaguuucugcuguguguucugcagauggucuuggcgaugaagcuggccacguggugacagggucacacaaagcggaggcaaaggcuguccagcuuugaacucuagagucuacuuccuccaaggaagacuccagggagggggggucacaguacuagugacugggcgagaaggguauaucuggccuugugugaaacuuugucaacuggccauucgcacaaggggcacugugaaggaagcaccuccugcagcuguccauagacccuccuggaggacaaauguucccaguugucaugcuggauguagcagucacuuguccuuucucagggaaagcuggugacuaagaagcaagcauccauuuccaaauacuuuagugaaugaaagucagcacuauguggccaggggcuaugacagagggauagaugcccaggucuagagaauacaaagucuguucuuugagcuucacugagaagggucaaagcccaucuccacauuagacuugaauaauuucuguagcacaugccuggugccccaggccugaacauccggucauaugaagagcuagcugcacgaccaggcccuuggccaacaugcucugcgcuagaaggagcuucgaugcccaccucucacuccagucccagacagaaaagccacagagguuuguccccaagguccccagccugugaggcuuccuuggagaacaggcucaggccacuguuugggcccacagagaagaagagccccaagucaauguacccuucuugguguccagaagacaaggccuaucuauguucguucuuaacacuggauggagcgggccaagggccgcucugugaaaagagagguacacguggguaaagagaaggaaguguuuuuaaugagcucagaaucaauacauaggccgauaauggggucuagauggagcaguguccugugguauggcaccaaccccucccuggcggucacuauuccuucuucaggcugauccuggcccuugggcagcugguuugcucuugaggauccuaugcagggccuuucgucauaaccuuuccacugggcagccaccucuuucgaacagggugucacccugccacuccgcaggaugcuuccuuaagcuugucagagagguggcugagacacccuggugguaucagaacuggggcccuggaguccagaccacaggccaauaucuuugagggggcaguuguuccaccuccuccuccaccggccuaucuggggguccuugggugcccaggggcgccgggcaccuggaaaggacagagagagcacagcugaggcuaagccuucaugcucgcuggcuaagucacacaucuacgaagggccaggccucggaagauccuuaccaguaagugggugaguaugcgggcccagcgcaaggccaagggcgggggcaggguggcgcaagagcuucguugucucggggcugagccuggcucgaggaagcccccuuuuccagaagagaugugaaacaagacauacaauuucacggauuccagcgcuugaggcaugauuggugaaugcuucucccuacccuaccuccccaucccaggaaccuuagaagagggagacagaacaacugccuaguaagacccaggguccuauaaccaggaacaaagaagccacucugacaggguccaggcuggccagggaggccucagaaagggccaccacuugggauacgcacaagaggaacaggagaauacagacagcuaucagggcugcagaggguccagccagggccauccauuugccacagguacacaagagagacuggagcccacaccagguccuuucccaccuggcaggagguggugccuccccagggcccugccccccauggcgacaugcccugucuaugccaagguggcuggagacgagggguucugggaccccugugacgucauucacaguguccagcucauaucucccauuuaaugggagccccgccccccaccaggucacucuggccuuaugagucagggccugcccuguccagucccccaagcccgccuuggccugccggugacucacgaauuugagcauguuccagucgaagacguagucguaggagaaacccugccggugaaagagauuucggaagagcuggcgcagguaggaguagucaggcuuaucaucgaaccgcagggagcggcagaaguugagguauguugagaacucggcuggugggucacaaggauagaagaggucgccgugaggguuacucuccuggcagccucagcagccacuaccauucuagguacccacugacccugcaacgggaucaaucuaagaggggcgggaugagaacugaacauaguccagcccacuuucaaguagaggugcuugccaccugucugaucgaacucucuggggucacagccaccaggacaauggccauaaauacaaaaggcuauucaagaaagucuggugggaugcaaagaccuccaucauaaccuaagcccaaaaaaagacagcuuccauuuccucaaaccacacgggcugagagcaaaccuucgggauaaggcaggagcuggggcuggggacaccugguauguaagagcuggauguggggguucaggcacccagcuccuaggcagagagaucccagugagagacugucugggguaaccccaucuacgcacggcccggucuugcccuuagaaggaaaugccauccccacaggcuacucacagggguagccuuugcagaggaccucgauuggcguugacaucuucuucucgcuaauccgcucguacuucugacgcuugguggcugcuuugaggcccugccagggcagggagcccagguugaaguacaugagcacauagcccaagcucucuaggucaucucgacggcuuugcucugcacaggucaggaggucaaggggccagucaggcugcguuucucaccaugccccacaccugcccucccccuccaugguacccacuggcuuccuguuauaacuagcacccacccuccuccuucuccuucucuggauugccccaggcagaacuuucucaugucuguuccagccaguuuuuccagcccaggugcuaugucacucaacaacugugugugggcaccgccgcccccuugccuggccugucucguguuuagggcucacacgauggcuggagucaaaagcaccuccagaauucauucagcugcaugcacugcaggggccguguuaaaccccugggcuugcguuuugcagacauacacgugagaaacugccacccacucaaggaaacggccaguaggccaaauacaccacucuguuuaugaagggguccauaugaaacaaguccaggccugggccagacagaguggagaaucuucucaaugagggucuccagaagagaaggacccuggggucuucaacucagguagggacauaggcccauccuggccaguggccacagcaugcgugcuccggcucaguucacucaccaaugcccagguggguguugauagaggcauagcgggcagugccggucagguucuuguuuucccgguagggaauaugcuggugugugcgggcaucgcgguacuucuuggccaggccgaagucaaugauguacaccagguugccuuucuuccccaggcccaugaggaaguugucgggcuucacaucccgguggaugaaguucuuggaguguauguacucgaugcggcugaucugagggagggaaggacacacagcaggucacgcaacacggagacggcaaauggccacguggcccuguucugcccaggaggaaagaccuagucucaguaugaaggguuucaagagguggcugggcuuucccaagcaaugaggacagacuucaaaggaguucacaaaacauggugugugugaagggcuggugagauggcucagagguuaagagcucagaggucaugaguucaaaucccagcaaccacaugguggcucacaaccauccguaaugagaaacaaauaaagaacuuaugggccagagcgagcugggcuggaacaagagggagaaagggaagggggaggagggaauaaauaaauaaaucuuaaaaacaaaaacaaaaaacauggugugagacaaagaguaagaccaagaaaggcagcuggguccuaagaaccccugccuggcucaaccgccacagaaugugggcagccacaugcaggacguggcgagagagggagcaugggaugggacucauugcuaucacccagcuuccaaacgccaccaaaagccaggcagacacucaccccgcucuccuuuaugggauuuuaaaauuauuauuauuauuauuauuauagugacugaucuccacacgcuuaaggccagugcgaagaacagaacgaaaucuggccgaagacaagagaauuuuuuaaagcucaaauuuaacaaucacgugugugacaugucuucuggccucaugucuccgcauggcuggaaaaucucaaggagaauuauggguuucacccacgagaaucugaccguucguucucuguaugaaugcauguguaugaaaaacucaugacagccauacaccaggacagaaagccuguggcgagaucugcacccuccacggcaggugcgaaauuuauuauguauuuguguucauaucugccuguggacgugggugccacggcaugcacgugaacucagucaguucucuccuucuaccacgugacaugguccuggggaucaaucucagaccaucaggccuggcgagaagcaaccucaccacugagccaccccgccagcccuccagcuuucuauagguuuugcauauguguguacggggcuauaugcauguguaaguuugggugauuuuuuuuuuuuuaauagcacugccaacugacggcagggccucuugaguaccaagugaguacccaucacugagccgcacccccugcucugcuuuuuaucuuugagacagagucuuaacuacgcaucucaggcuuccuccaaacuccuggcaagccuccagccuccugagcacuggaauuacugacaugagcuacuaugaccuaguucugauuuuagauuuuucauuguugguggugguuuuguuuuauuuuguguuuuuaaagauagggucuuacacuguacuccacacuggccuugagcuuucaguaauucuccugccucacucuccugagagcuggaguuacaggcgugagggcaccacguucagauucugguuuuauccuuuccuuuuccuuuuuuaaaugaaccaaguugaaguucauuaaaagagguuuuguggggcuggagagauggcucagcaguuaagagcacacauuucucuuccaggugaccugaguucaguucccagcacccacaucuuagcucacaacugccuguaacuuuugcucaggagauuugacaccuccagccuuaggaaacuucagcaaggacacacacuuauacauaauuacauuuuuuucuuuuggccuuuggauacaggguuucucuguguagcucuuggacuaauggucucaagcucagagauccacuugacuuugucucccaagugcugggcguuaaaaaugugagccaccacacaccacccaacuuuuuagauaaaucuuaaaaauaaggugagagaaacugaagaagacacccaguguugaacuuuguaccccaucccucucuacgcaagugcucucguguaugcaugagcacaaacacacauacacguacauacagucacacaaaugcaccaaagcagcuauuuuaacacaaauuuaagcaggauucuaacaggaguaggguggcucagggaaagggacuaugcuggcuagcuuuacgucagcuuaagagacugucaacugggaaaaugcuuucauaagaucaggcuauaggcaacccuguaggacauuuucuuaauuaacaauuugaugaggaagggccuaggcuauugugggcggggccauccugcgugggcggggccagcacagggcucaugauacuggguucuauaaaaaaaaaaaaacaugcagggcaagugagcagaaccccuccagguuccugacccaucuuccuuugaugaacagugauggaaguaaggaaaauuaacucuuuccucucugaguugcuuuuggucaugguguuuccucacagcaccaguaacccuaacuaaauuggggugugaacuccccgagggagaguggccugcuuuugccuuucugcaauagcuuuccucugugcaccaucaagggccauuguaccugacugacaacugcucuggcccaggcacccgacucaaugcucgugaugcgaugcaagccagauggcugaaacucaggggacucagucauuccccuugggucaggcaguaauaaccgugagggucggcagcugccagcuucccaggagggugacucgccagguaaggugguuuaaaugagcaaugucuuccugaagcucagacacuuaaacacuggguuucuaaugggcgacacuggagagguuauggauaggggcagccuugguggaggaagucuguaucuauguguguggguggggguggggugugggggguggcuuugagaacugaaugucuccccccacuuacagcuuccucucugcucccugccccuccaccagaccuuccccacuauuaugggcccccucucuggaacccucaguccaaaucaauaguuccuccauaagcugcuucuggucccaugcguuaucacaguaagagcaaagagagcagccuggaaucugcacucucuggguuccacaauggguccucagugucuccuggucccuggaacaggcccaagcuugggaggagggacucaggguugguaugcagggcccagcggcaucccgguugagagacuagagagucucacagggcagaagaagucaccugagaguccccugaacaacagcagggguggggacucaccaucuggucggccagcaacagcaccgucuugaggcugaacuuccgggaacagaaguugaagagguccuccaggcugggccccagcagcuccaugaccaucacguuauagucucccucagccccgcaccacuugauggacgggauccccacugggcccgagagagagacucggucagcgguggucacucccacgcauguucuccugcucuccacccggaccaccagccuccccccccccauuuuuugugccauccccacaccccagccuugggcuccuucccguccuucagucauugucccccccccccccccccccccgcucccagcaccaucccugccucaccuccgcccugcaucaucuuguagaacuugcucucgauguggagcuggggauguuucgucuucacacauucgagcuugauggcuacuuccucaccagaggcaauguuggcaccugcccgagucagaggagguaaaggacaagggucagucagucucaggggaccacgggugccuacccagucagcauuugagguugcuguaacucaggccugaggcuaucuggggaucaguagcucucaaugagacuggaaagaagccagggguugcuggucacagaggaagcagggagugugugggugggugggugggcacuccagaggcccccugagcgccuacggcaaguauauggaagggaaggagaugacacacccuaagaggcuuagaggccacaggucaggugcacccagacagacugacaccuguggggguucgaggauggaccaugaugcacugaaccuaauccuagcgacuggcgggucaguggguguguuggcucugaagggucacagagaagaauggucaggggcccacugggggcuguagggggcagggauaccccaugacaacugccaacugugggguagcgcaguaaggaaugggccuaauaaccaaucccucacucugccacaaaugcagccccagcauucgaccccaggguauuuucaagcucgagggagagagcauggagccagcucucuaggcgucugagucugggcaugaggggccugucugcaucucugcuuuccccccacccacucccaguuucucaccgcuggaagcaagauguucuaacucagaaauuacacacuccaaggccuggaucucagccuggggccguggcuccaggagucacaagagaaccugggcacugugcauaccugcaauccuaacauggagggagucgaagcaagagaacuuccugaguucaaggucaccuaaguuuacacaugaauuucaggccagccugggcuacauaaugauuucuagccuaggcuauagagugugacacuguuuggaagggaggaagaggaugggucagaaguagguucguugguugguuuuugguuuugcuuuuguuuuuaugauuuaguuauuucuauccuaugcccaauagugaucugccugcuuguuccuguuugugaggaugucagauauccuagaacugaagucacagacaggugcaagcugccuugugggugcugggaaccgaacccugguccuuuagaagaacagccagugcucuuaacuggugagccauuguagaagcugagagaacuguaguuccuagaggcuguguggaggagaggacagggugagggaggagagggacgaaaggcaaggcaagccagaggcuggaagcaggucuggaguugcagugggcugggggccagaggcaggagcugcucuuggaagugauggagguuugagacuuagcugaggagaggacggcauugcaauaagggccacacaacugcauaccugcugaguccucaccacguagcccaggcuggccuggaacuugcuaacauccugucucagauggagauaacuggccuccacucauaugucacacaccaaauaaaauguaaaaaugaacaaacccuucaagcaccuauguuaauauuuucugagagagagacagagacagagacagggagagagaaggguauaagagugucugugugggguguguguguguguguguguguguguguccgggugggggaggggagguguugcucaaggagauggcaagcuggcucagaagguaaaggugauugcugccaagccugaugaccugaguucaauacccagaagcuacacagaaggaaagaacuaccucaagaaguuguccucugaccuacacacacacacacacacacacacacacacacacacacaaacacaagcauacacacauacuaauaaggauaagggggaacaugucaaagguucccucuccuucaaaaacauucaugcuggccaaagcacaagaaauuagguugaaagaaaaacacacaauucuuaucacaggcaaacagcuaguggacaggaaagacccgacaggaaaugggauggaggacgugagcugacagcccccacaggggagagagcagccuccuccagacacaaaagacagacagacccugaagaugguuucgccgagcgcagccacaagucccacacugcuuacguuucucucaggccaggcuaaggccacugggcucuucucccugcacagcuagggaggugacuuuccacugcccggcucugaccagcaccucuaccuuaggagaugggucgacauuccuuaacuaucuuuuugccacguguggugguacacaccuccaacuccagccgaggugggcagagcucuguugagcuugaucugguccacauagcaaguuccaggccagccaaggccgcauacggagucuuuguguguuucgggggagcagcauauggauuugagcgcaggcgcccacagaggccagagcaucgcccuggauuucccugaagcuguagucacaggcagggugagucaccuaccauagguacugggaaccgagagcuaaacccaggcaaguccucugcaaaagcgguauaaacucauuuucuuuuuuauuuauuuuuguuguuauuuuucuuuuuuuguacagagauucucugugcagcccuggcuauucugaacucuuuguagaccaggauggccuccaacugcugggcuuaaagauauguaccaccaccuagcacuuuuuguuaaagcagggccucaccauguagccugccugaccuggaacuaaagagauucaccuaccucugccaucuguccagccccacuagccagcagccuugugugguguaagagccuggccgaggcuguccacugcagaacguuugcaguaaguaaaggcuugggagccacccacacguccgucuuucaggaccggcuaaauaaagacuagcugauccguaacagagcacaauggugcggggaggaggaagcucacucuggguagcgguggaagaucuccaaggcacaggaagcgaaaaggacaaagcccagacccguacucugcacucuuucagauggggaagcgucugugcugcagcugugugaggaacaggaacggcggccgccugggaaggcacgccacggacaccuuaucacgugucgcuuuuuacuggcgugcucuuguaaacuauguaaacuaugagacggguacuucgaaacuggguuauuguuuagauguccgugggguuguacaauccggcucacagacaauuugagaaaggcauccaccacauccucaaaggccuauucccuuuagcaacuguccccucuuccuucccccagccccuagugaccacaacuacuuucugcuauggucuugccuagucuggacaugucagugacauaaaagcacucguuaugugcucuucugcguucuuuuacuuacacuauccuaacguuugcaaaugugcuuugauuucugagcuaccuaaaagaaaaucagaucagaugacuaaauccagguagcaacuggggacugguuuacaaacuacuuuaaaauuucaaaguuugcuaggcagugaaggcacaugugugccuuuaaucccagcacuugggaggcagaggcaggcagauuucugaguucaaggcuagccuggucuacagaguaaguuccaggacagccagggcuauacagagaaacccugucucgaaaacaaauaaaacaaacaaacaaaaaaguuuauuauuacuauuauuagugugugugugugugugugugugugugugugugugugugugugcgcgcgcgcacacacaugcaccagagauguuggaaaguuuuccucaacuacucucugccucauuuuuuaagacagaggccagaaagauggcucagcugcucuuccagaagccccugguuugguucccagcacccauguggcagcucgcaaccaccggaaacuucaguucuaggagaucuaacacaagcacagcacacacacacacagugcauggcacacgggcaggcaagacacacccacacacaaaauaaagaguaaaucuuuggagacagggucucucacugaacuuggagcuuguccaaucagcuagacugacuggucagcaggccccaggggucccaucucugccucugcauccccaaugcugggauuacaaguuugaggcuccaggcccagcuucuuuuuuuuuaaaagcuaugugugagcagggcacaggcuugcccaggcacucagguuuguggggcaagcccuucauuuuccucccagcucccaugcuuugaacacaucgacaaucaucgauccaucuggggggcucauaggauauggcacaaaaaaggaccuagagugaccuggaguccugugguucccucccuugccaugggcaucaaaagcaggagaaugcagugagugugacugugacacuuauaaucccagcacuuuggaggcugagacuggaggacagugaguuugaagccaaucuggcuguauaccaugagccugucugcuauagagccaagcugcugauccuaccaucuccuagccaugggacaucgauggcggaggcgucaucgucauuguguguauauguacgugcacuuauguauacaucuauacagaagccagcguugaugcugggaguuuuccucaaucccucuccauuagagauggcucugaucuccuacuuuugaggccagaugacugcugcaaacugcuagcugagcuuagcuucuggggcuguucaugacagaggggagcucagcagaaccccagcgcacugcgagcaguccacugggagagccgacgagugaccugucccagccagagauggaaugaugugauguggugacggaguucucagucccugaccgcccuggcuuaucugagguucaacucuuucugaacuguccggggucugacaacauccuugaccucuacccacuggacgccaugggcgcaaccacccaccucauguugucauaaccagaaaugucuucagaacuugccaaaugcccucccagagacaaaagcccccccccccaaucaacaguguguaagaaaggcauggaggggacuuggaaaguaaaggaaagccuggguggccacagcagggugccacggccaggcagagggcagggaugaccccuagggucacugaugacucagcagacacagggagcagaggcggggcucuucauuccuuugaacugaggccacucugccaguguuacaggcagucucuauuugacacagggaaaacccaacacaaaggugggaugaccauaugccacacaacuucccaagccagcggccugggaccuaagugauuagucaaagccuucugacccccagacaagggccacugcuccgucuccacccacugccacaccagcuggcuuuuggcagucugauuacuaucuaucaggagguagccagccuuucucugacuuccccuaauccugccaagcacuaagaaaaggugcagugaggcuaagaggcuggccugggccagacagaacuggcuggagcagagccaggauuacaaccgucucccaacgccucugucgcuuccucccuuccaguucccaagcgcacuauuaacguaggcugcaggccacacugggucugcuagggucgucccgaagcucuguccaccuucuguggggggugacagagaaaagggcaaccacagaggcaaacggcaggugugggugccucgaggagggggugacauaugcaugggcuuggaagcuagaaagaauggccugcuucuuggcccacaguuccacacugcaccaaaauggaggagccgacugguccccaaaacaguguugaacauggagaaagugugaggcugguuggcuccagaugggucuagaaaccuagagaggagcuacagggagagagggagggggugagcagccccuuuggcuagcuguggccaccuaugcagaacagagacucgggaagggcugugcugagcccauccacccuagcaccaagagcagcagcaacuuugacauccauaucgaaagugaagucugugcaugguaacacacaccuuuaaucccagaacaggggaggcagagacaguuggaucucugaauucaaggccacccuggucuauagagugaguuccaggccagccaggacuacucagugagacccugucucaaacaaacuaaagaucaucucuauaaccacccgcucccuaccccugguaggguugaagcucagaggcucccuccauuugaacagaucuaaagagcucuugcaggaugcaccuuagacccuaaagggagggagacagagggacaggaaggugggcugaggggcucacaaccacuccacaaagcucucauuccaagacuuccucgaggucaguccuggaaagcuagauguggaagcccagccuggccccaccuguagaggccaucuggagucaggcccuggcccaacaccaugaugagaauguggccggcacucugaacaaagugugccagcgaggccggucacagagggaccuuccaucaccucuguucccacacaggcaaggcaagggguucacgcagggcgggcagcccuacucacaacgcuggggauggggaagucaaggcuggcagggaaccagagcuuccagccagcaaaaggaaagacccagggucaauucauuccagagcugacacaaacuggaguaaaucugcaccagggaauuagcaucauagagaccacagauaaacaggaaguccucccccuagggaggcagaccucaggaacaagggacacuggccucggugagugaccuugggcugugccucuccuucugcaagcuuucggaucccuucugcagaagaggggccagcacuggguguucuuucagacaggugccugagagaugcgcacacauucgcgcucacacacacacacacacacauuccuuacacuugugcuaggcucagauaaagagacaggauagcucagguaacuuaggagcacugagaagcagaaacuggcccacccaguucccaagucccuccucucuccuucccuaccacacagaggucuuuacaggcuacgacgcccccauuuccuugcuauuugcuucucaagccuucacuggauauccacuguggacaggccacauucugggcccccgggugggguugaggagcagacccaaaauuccuuacauuagcuccuacugaaaggaaugacaggacccagaggcacugugauuucuugaaacuuauucuuugaacaguuaucccacuacuuuacaaugacuuagccauuaacuccugggcuugagcaauccuccugccucagccucccgaguagcuccaucugcaggcacacaccaccacaccccauagagaaacagcaagcuguuuacagcacaccugacaccaaguacaaaacuacuucacggcuguuucauuuguguccugcaacagugcucgggucaucuggggacacagaugggggacacugaggucccagggcagcugcccgagauaaagucuagaauccagagaugucugucucccauuuucucuucuaccccuacucagugaggcuguggggcugaggcggccccaacuagagcaaucccuggcagccaccuuagccuucugccaucaguagaaagggacagccugggucacacaggaaauggggagcaccgagaacaggacacgggggcugccuugugggcgacaauguucagaaaggggcuuguagguaaaagcuaagaaggccucuguauccccuacccacugcccugaggcuugcuggacggcagaauucauacuugacaguggacaggggcucugagcaccagggaaaagaagcccuugaccgaacugauuaaugacuacagcguccugauaugucccuuuccucugcccagggcagaaugauucaucuucguucucuaaggaggaaaacaagagacagccaggcccuacuccugaggacacagggcagcaccaaggaugaccuaggaggcuugccaccacacaagcaacuccaagacucaaaacuccauccgugcaguuuaccaagcaaacucuccccuccaggcugacaacacucaaaauggcgcauggcuggccaggcuaggaaggcgacacuugagggggauggggggggggggugcugagaugccagcaaucugccuaaaaugacaucagggacacauccagggacagggagcucccagagcaaugagauccuuccucugucauuccaaaggaggcccaggcugcauuccagaaagccacaucuaagggagaggccuggacuuccggggagccuccccagggcuccaggacagccaaaacauuuucuauccaucaguauccuucugccaggacccaagggcuagggaugccaacccagccagggcuuucccaugccccauggagacccaggucagcggcagcuggaagccugcuaaauauaucuccucugcucuugcagccuccugagcccuggccugcccagcugugaaagaagacauuccccagaccaccugagcuuccuucuggauccgggaugacccuggaggcuuguaagccaugccaggcaaccagagcaaacuccugcucccagaucccagguucuccccuccuccucaucccagagccgccccaaagggccacagcuggaggccuagcuacuuacccagguagaugucuccaaaggagccacugccgaucuuucggcccaggcgauacuuauuucccacacgcaacuccaugcuucaaccuugcugcgggagaagcagaaacaggucagagacaggaccuccagcagcagagggcccagacccuuccuccaccagggcuggcaggcuccuccucccucccacugucugagaagcaaucuggcuucacuuagcucaagggcagucaggugucagguaguccucaugcccacacaccugggcacggccgaggcagguuuagaacaaguuucacuuaguucagaaaagaugggcucugagccaaggcccaggaagggaccgccaagcagacccgaugggcuacgaugggcuaaggcccuaaaucaaggacaaaggguaaacaacagggaagggccaugucuagugucuugugcucagcagugaaucuccacccauccuuagaggugaaaaggccaaaagucucuccaaaaugcuuuacacucugcauacaaucuggagacacuuaaaauaccccagggacguccuggaccccaggaaucugauagaaaugggaggaacgggguccacagaaauagaccauccugaaagcuauaauagcccgucagcaaguugcaaccuccaggauaaagggaagaacgucaaagagcuccuugguaccacgagacuccugaaaccacaggcugcccaccucuauccuugccucuggagggcuaagcuggccaguuccagcaggccucauaugagaggaccugauccccacugagagaggcaaggcaagguaccucccagggccucccaggcucuacccaggccacagagaaccacuucucaggucuuucugcacacacaucuuaugcggacucucagggagacuuccuugaagacuggaaguaagggcuuccugagacaggucccaucccugugggucuaagcugcauagccugcuccuuccucagaugagguggaggccccaagcccauggauaacaaggauuggaccauggcagggaucccucuguacuggccugguagagguuggguaccuguguuccaggucagcaaaacagaagacucaaugaaugggggcagguuugggcugcuggggaauggggaggcagggaauaguaaacuaugagacagggagacugguuccuuggugccucugcaugguuacacaugagcuggugugagggaacaagagggcacuccuuuggcagauagaugggaaccggagcccagaguggccuugcuaccauccccacagaagcuagccaaugguagaaaucucaccuaggaccaaacagggguccagcuggcccaccugguggccuccuacccagaacuuauuucacuccaggcuugagaaguaaaacccuucggugagacagugacugcuggcuugcuuggggguaaggggugcugacccuuucccugugccaagccugcccccagauaccaggccuggaaggaaaccaggagagauucacuggggcuccuccaucagccccagaagcgagagagccaagccaggagagacacccuagccuaguacuaaguccccgagagccaccacuguccuucuaccagccacaaggaaguggcugccgcugggugccagccaaacucugggcucucccaucaugggucuuugcccacauggcugaguugcccugauugccaagaacaggacugcauaucugcagaaaacccaccagccuggcaccacagguccacacaugguccagcuugcuaagggcacccgccaaggggaacaugggaguagaggcucacacuuaggaucccuacaggaaagggggggcuggcuguguacucacaaacaccccccccccccaaagccggguuuccacuaacgccgacucagagaccauacauggcaucugggaaagccacagguuaggaaaggaacauaaauauacugcauccuauauuacauaaauacccacgccagguuauauaaauaccagugcccucugucugggagucuuacauaaauacacugcacaugaccccccaagccccucuccacucacggcucucugcacaaucaccaacccugaaggacccuaccaacgccagggucuccccacccuggagaccagagcccuggagucuagcgugucccagcccuccuccacuuaaaagccccccuccaccgccaccccaagaaauugacuuuggggugggggcuccuucaggaaaucagaguagcuuuccaauucuucacucugucccuuacgggaggggugggggaggggaauaaacaaaguuaaaaaaagggggggguggccaugaggagucaagacuucucagcugguuagaaaaauuacaacuacaagcagcugggcacaugggcagucccgugucacccugccauacacacacaccuccugacacacacaccacccaccuuccacagggccaagacccuggucaaugaaucaguagaauaaaaacugaaggaaugcccuaaaccuaggaaaggcgucccaaacgcaaguauucauuggaacugcacccccuucucucucucucuagacccccuuuccaaagggaggcuaugcuaagaaauauguggggaaacucuggacaaaguagggggaggggguggccuaagucgcagcccugccucugaggcgcccaggcacccagcuuucacaggcuugaagcacaaggcugucucgcacaccgcaaugagaagccaagcgauaaauaacccccucccuucuucucgccacaaaggaaaacaaagccgguggcccgggugaccacgcaccccaucacuuaggacccccgcgcgcccccacccuacgcgagaacggccucggugacccggagcccaggacacagaggaggggccgaggccggcccggaacccgagcgcccccgggaccccagccaggccccugccgcaggucccccgccccaacccggggccgccucggugcacccggcggccugcgaagcgcccguccccuccgcguccccggccgcgccuuuguccucacgggcggcgcccccagcccugcgcggaugcgcguguccgccccgcgcucgcgcaaaaagaaaacacaaagaggcggagggaaccccgcuuccccggcccccgaugcucaccgcgccggggcggccgccggggcggaugccagaggauucgccgggccgcgggcgcgccagccucuccccggcccgcugcgcugcgcucggcccggccgggcucaggcuccgcgcuccgccgccucccgccgcccgcccccgccgccggcucgcgcgcucccuacccgcgcgcgcguccccgcgguucccauugagccccgggcccgcccgcugaugucaucccccgcccgccgccgccgccccggaggauuuaaagggcccgcagcccccggagagcguguucugacgcugccacccugggugaggggcacacaaaacuaagauuuccuauacucaggccuugcccuaucuccagccaaagcugcggggacccccgagagaaucagcugagacuccuggcacugcaaaagagauuuagggcucaguagccugaaggcuguagagaacacuggccaggggcuuugggaauaaagcauagggacugaggggcguggacaaggaccaaggauguguggucagagaaaacuccaggcagacacuuuucuuugcucuguccucugccguucagauccacugugacagucccucagauuccaacguaguuucacccauugagcccccugccccucaccaagaacucacacgugagucagggacccagaggugcucauucaacaaagucaucccccagacaaugccugaauguccuuaacugcaaacgaggaagaaggaccauagccuucccaggucaugggagaguuaaugaaggcuucccaccagcuuccagcuccaccauggaaggucccagcacaaggcuauuaaaaugauauuuacagugggucaugcaaagcuccaacuuaugacacaccuacauucucucucuacacacacacacaacuguuacuguggacauaguaccucugaucaccccggaagcacaucucagaaagagucacuucauaauaaccgcaucuucuccccgaggcugaggagauugcugggagaccuauagaccagguccuaucacagggcaggagggcaggauacuguggcccagagagggcaaaaggucugcccaggcccacacagcccagcaagauggccauguucaucugguggaccuggggaugccgaucagaagaccaggagaaugaggaggagcugccuccagaggccucugugaugguaaaccgggcaacuggcucucucugcccaggugguggacugagcauggcccgcuuggugcuuuuuggcuuugcguuugucaauugauucacaauuggcagguuuuguaugacaggcccgcauucucuccugaagccuuggccacgcagggcacaaauccucaccagaggcagcuggucuggacagcagucagccucaguggucagagcccaggccguggggccuuggcaagacugagcagaacacagcaagcaucaauguccuccuagcaauguuaccacccaaaccuuccaacaugggcccagcuuuccaaacguaggccuguucugcugcagcgccaggagaggcauucagcucauuuaacccucuccagugaggacagcagacagaguugauguucacucugugguuuccagaaagggaauuggagguaccucagcccucacgcggggguauggaucaagggugaaccugucuggagauggaacucagccagcgcugccuaaagccacucuccuccccuucuuggucaucgcagguccuuuggaacaaaucuuccgucuggaguccacugucccagcuucccuuccucauccugucaccugcccuccauuucaggacuugcagccucucccaggcccacacccuccagcuauagacucucugcuggguauccagggguagcuggucuuaaaaguccccaguucuaacacacacacacacacacacacacacacacacacacacacacaccaggccuucagaagaguacaggguggcuggaccuuccuagacucccucucccagaucuaccccccuuggaagguggcuccccacacagcugccuuuugccugagccucuuccuuccuacacccucaugaguccaagcugugagcccucuacagagcuuugcagcugagcucuaaggggaaacagccgugacgcaaaacccaguggaggagagggaggaaaggagggagccuucucccaaacagaaauccugccucauucuaacagccaagggcuccgccuucagcuccucgcaaagauccuccccuccaacuuccagcuuucaagcccagagguauagcuggauggcaucuuucccggggccacccuccgcugacccacaagaugcaggcagacaaacccagcucaccaggggccacaccagcuuuugacaguucugaguggucaggagcagauuccccccucccccacccccugcucauuucugagcuggacacuuguaccauuucuuacuuucauaccccuccggaccccugggcccucuagagcacuggccucggggcucaggcacagccuuagacacccagcacagugcggaugaguccaggucucuugacuauggacauucugacuuaccaaguguucagauugguccuaaaaaugaccuucccuugcaugucccuaccuaugauucucuugaugaucugggugcuucucuguuaugaccuccugcccuggcccuggcccuggccauucaauugccugguacacuuuccugagagccacauguucaccaugcucuucgggggguggggccccuccauucucaggccuucaagagaaggcuuuccugucuccugacuuaacaauccuaucgcuggccugccaagauggcugauugaugaaaaaaaaaccucaagaccugaguuggagccucagaacccauauuaagauaggacaagacuaauuucacaggguuguccucugaccucuacaugggcucuguggcaccaaugcagccccacccacauagcaucaaacaaaauuuaaagucaguuguauaaaauccauccgggaucccggacuccugcacucugucgcccacaaacacucagugcuauaacacacucuggguguguuuguuguuuaucuucugucucccacuuagaggacuucgguccaugaaaguggggaguugaugcuauuuuggccuccacugugcugugaauaucuauaauagugucuagcaccugguauguguuuaauaaauagcugauuggaaaaauggacagcaaagagguuucugccucccccccccccauucaaacaugaaugaagcagcgcuugcuauccccuguuaucaggcccuagcaacagaccacacugccgacucaugaaaugcacccaucccuagagcagagagugaccuaccagaaagcuuccucgcccaggcuugugagggacuaagcccuugguacccucuuucuagcuaugugcccagaguacacaugcccgcagaggccagaagagguauuggauccccuggcugaaguuccaggugacugugggcuucccacagaagccguugguaugagcucuuaacugcugccccugagccugacaaccugcuuccuaggacccgacugguggaaggagagagcugacuucagcaauguauccucucucugccugccauggcacgcgcacaauaaauaaacguaaauuuaaagcucuaacauggcucagcaggucaggaccaccagagccaugucuccagcccucauaaacauaaacauguugaaaugaaaaauaaguauuuuagacaguugugguagugaauaaauaccuuuaaucccagcacucuggaggcaaaggcagcugaaauugcuaaccucaaagccagccugaagucuauagagggaguuccaggacauccaggaaaaaaaaaaaacugucucaaaaaaccaauaacagcaacaacaacaacaauaguaauaauaaauauuuuaaaagucuggucucccagucagagaacuguggagugccagccagaggcucccuuccucuccuccacugacuuccaccccuucaggcugauguccaaggaggcuggggagcuggaaccaggaguccucgugacuuuaagaggcuggcuucugggcuugggugcaguaaagcuuggcuuucccagcaguucagaaacagagacaggagugaguuugaagccagccugaucuacacagcaagccccagaacaggcaggguuacauguggagacccugucucaaacaccaccaccaccaagagacuggagagauggggcagcaguuaagagcucauaccgacaacggcuucugugggaagcccauagucaccuguaacuucagccaggggauucaauaccucuucuggccuccgccggcauguguacucugggcacauaacagcccuacacacacacacacacacgccacacacacacacacacacacacacacacaacuaaaaauaaguucuuaaagcaacaacaacaacaaaagaaagaaggaagcuguguucaaaugcugagucuuucuaaccggacaguccuaggcaacuuccuuaaagccuccaggccccauuuguaaaaguguaguaugaugcagauccauaaauaggcuguguggggaacacaccuuugagccuaacacuugggaggcagaggcaggaagaucucugaguucgaggccagcuuggucuacagagugaguuccaggacaaccagggcuacacagagaaacccuguuucaaagacaaacaaagccacaaaaacaacuuuguucagaaggaggucugaguaggaagcaguuguagguaauuuuccugcucuuaggagaguugacuuaagucagggucuucuuuuuuuuuuguuuguuuguuuuguuuuaugagacagguuuucucuguguagcccuggcuguccuggaacucacuuuguagaccaggcuggccucaaacucagaaauccgccugccucugccucccgagugcugagauuaaaggcgugugccaccaugcccagguagucagggucucuuaaugaggguuccuuuaguacugugcgcuauaccggugaaguguaugucacucaccugugcuuggagaaguauucucccagggauuugccagccugguuccuagauguuccacaagguucucucuucucccucucccccuccccccucccccucuguguguguguguguguguguguguucuuccagucacggacaggcagaggaugggucuuucuucuagcaggcugcugguaaucccauaauaagccaaccagcucagaccccugacagcagcuccuccuucagagcuaggaggccuggcugcaggaggcauacguuugagucccaucuaaucucuggacuucaguguaaucuugcauuguucaagccucucucugggaggcaagcgagaugaccugccuagguuuucagucucccugcccugugcccugggguggggcuggaugggaaccuccucuguguuccagauccaggguuccauguuggggaauucccuggggauacaggagccugggcucggugggaagggcuugccuccugcuaccuccuacucacaagggagcccuucucucuuuucucuguccccacucugcugaauccugccaccagccucugcuuuuaccuggauacuccaguagccagauagacgcuaacaccuuguccucagcucccaauacaccuacugaugaaauccacauacacgcagccgaggaguaguggcacacgucuuugaucccagcacugagaagguagaggcgggggggggggggggggggaagcucugaguuuggggccagccuggucuacaugugaguuccaggacagccagagaaccccuaucucaaaccaccaccaccccaaaaugaaaaagaaauccauccacacuugcucagggccauggugaucuggcuccuagguaccuuaggccaaguuccacaccucaccuaaugguuucuguguacuucagagccuuugcucagagugaccugccccagacucuucaauggcugccuauacucauggcucaagucacuucuuuuuuguuuuguuuuguuucuuugguuuuucgagacaagaguuucucuguguagcccuggcucuccuggaacucacuuuguagaccaggcuggccucaaacucagaaaucugccuaucucugccucccaagugcugggauuaaaggugugcgccaccacgcccggcucucaaaucacuucuuaaagacuuuccuuucauccaccucugguacuguggaguugaaccuagggccaaacaaagcuauacucugaaccucuuuucaccuuuugucuugagauagagucccacuaaguugcccaggcuggccuugaauuuguaauccucuuugucucucuuugucucuugaguaccugggaauccaggccugcaucaauagggacuuuuuuuuaaaagauauauucacuuuaugugaaugagugucuugccugcauguaugugccuguaugguagugaaccaccauguggacacugaguacugaacccaggucuucggcaugaauaguaagugcuugacuguugagcucucucuccagcccccagccacauggucagucacaagugggcuucuucuccguccuuuacaagaaagccugcuuuauuuucuucacacuacugaggcagugggaaagacuguucuccauguccuugaacauaagcugcaagagagagaaaccuuggggcuggagagauggcucagccguacaugcagcucuucucagagcuuaguccagacagagcucagcucccagcguccgcgucggaugguucacaacugucucaacugucucuaacucuagcuccuggagaucugguaccucuggccuuugagggcacacuuauaugcauagaaguguguguguguguguguguguguguguguguguguucguacacacacuacccgguagcuuuucccuucucucgguggcucucugucagucugcugcacugggccagaagugagcaaaccuuaccaagcaguucugggauuccuuuaggccaucaguuucuagaggggccaggaguacucaccacaagaaacucuaacaucucccauauaccccaaaggcccuucacccuucccuuggcucagcccugccuccucaccuccccagcccucuaacccauacagagugaugccugccccuugcuuguaagguugucgcuguccaccugccuccuccucuucucucugggaagcgaggcucuccuuuccagggacucacaaccacuuauuaucuggggcuugggaugagaaugaagaaggauuucuccucuuccucagcuuggugacucauuggcucguguucuggccaugccacaugccuguccacaaacacuuccugaugccagcuccuuugagggaaccugagagguccacuccaaccugccuacccagacuugaagaucaaccacagggcucaucauauauaagaaagaugggcaaagaguagcaagagaacauucuagagaggacucacucucuugcucuguccccagggcaauccacgacacccacugucccacuagguuaguaccaccacugugcuacaccccagugcccagacuggucucaugguccuagacucaaggacaccucuccccaggcuccugaguguccaaacuguggauguaccaucauauccagcccuguuuacucuuaaccugcaagggagcacuguccaaauacagcucugacguguucccacagccagacugccccuuaaaccgugucuacagagaaucagagaauuggcagugugguaggagggagggagcucgcucaguggaagaagguaggauuuaagaggcagaggagguaggacucuggauaaacccagcaagcacacuacuucaaccauucuccacucccgggaagcaagagccacucucacacagauggucacacacuccaacaacuccaggacucugagggaagccucuacuagauugcugcucgggacaguuuugaaccuugugugcagaucgggguuggggaagagaggcagggagagugccagagguggcgugcaugggauagacaauaugccuggcugcccccuggacauuucucaggcauuugguuuaauucugcagcuguccucugaguggaaggacaaguucacgagagacaagagucccuacuuguguacagggagaaagucaaggcuuauggagcucaugagaaucucagugccuacauucagaaacugugaaagcccagggagcuuauauacccaucuuggagcaugcucugcuucuguuuccgugagguccccacucaaaagugcccucucgcuccaggacaccacaaguccacuccccagggaugcuggguggccacucagauagcuguguccuuugaguguggcacaugccuugaagcccaucucucagaaggcaaaaccagggaagaugagucccguaugagucccgagcaaaucuggucuauguaacuacauaguaagacgcuaucucaaaaacaaaaaauacaacaagaaccacacacacacaaacccuacaaaauuagcuguguccauggcugagccuuugcaccuagcaagaaccggugagcauagguagauagaaaaaccacaacucgagcucuuauucggcuuucagcuuggucuucuagauguuauguauuuacaugugcaugcagggacauguucccuugagugugcauucaaguggaggccaggggcugacacugcucuuccuccaucgccauccaccuuguuaguuuuaguaugucuuucuuuucucuucuuuucuucccaggcuggccuuacugccuccgcugagauccaucuccuuuuggacaccaccuuaccaucuuaauguugacacagugucugucagugaaccuagaauucuccgguuugucuagagcggcuggccagcacacucuaaggaucugccuucccggcacuggacacagagaugacagcagccgcgccugacuuuccccugugaguccuggggcuuaaacucagaccucacguucacaugacaaucaguucaccaacaaagccaucuccccagacuguaugcauucuauuguaauauuuauaauacauucaccaaccuggcagaacucauacacugugagcauauauauaaaaaauaucaacccugucucaaacaaaaacaacaacaacaaaauauauaucaaauucaugcucaagguacuuucaccgggcagacaaguaggccacaugcaugugcggacacaaauucuucacuggcuauuccaggucaugcugggagacugggauuaaaggaucauucuaaccuuaguuuccugucucagaaauagccuggcggugagaugaccccggggguaaaaagucugacucuuugagucccaucucugcaaggaaugaauuaacucuacaaguugucuucugaucuccacauauauguuguggcauucacacacauacacacauauuaaacaaacaaauguuuugaaaaccgcuacagagaaggcucagugguuaaaacacucacugcuccgacaaacggccagaguuugguucccagcaccuccauuaggcaguuggccaucacccaccaggcccaggaauccugaugcccucuuguggccucugccaguaucgggcauacauguagugcacaaacacacauguagguaaaacacucucccggaagaggcaaccagcauagaaagaggagcacgcugguacuagaugggcuggcuuuggauccuggcugugcucuggguuagcccacuauccugugccucaguuuccuaucuguaagaugacaaugucccuauucauggcacugcuuugaaugcuggauauccuccaugcuaaggcaccuguuuagcaacaccaagucccuggguucgauucccagcacaagaguaaacuucagauuggggauggaguucacgugguagguagggugcuugccagcaugcaggaaggucuggccucaagccccaauacuacauacaccaggcaugguagcacaggccugcauucccaacaugggaggaucagaauuucagcggcauccucagcucgagucaagcauggacuaagucucaaaaacuaaaaacccagcuuggcguugcuguaagggaugcugggaagugaccagaugaggcuggugcucuguugcucuuguguuauugucuguuucaggcagcacagcuaaaggcagugugggacucucaagcucaaacccuccucccaccuccaccucuccuaagugcugcgggcauuacagacgugcaucuccaagcucaacaggaggucugguucuccaccagaucaguggaaaagaaguaaaugggucucagaccuaaggcaggacuugauucugaguucuggacuucaugggcccucuagauauuaaaaauguggcuauagccaggaggugguggcgcacgccuuuaaucccagcacuugggaggcagaggcaggcagauuucugaguucaaggccagccuggucuacagagugaguuccaggacagccagggguauacagagaaacccugucucaaaaauaaaauaaaauaaaauaaauaaauaaaagaccuguggcuacaaaaugaaaccuauugucuguggauagagaggugacuguccuaacucucacaauagcagaacaugccuccuccagguauaaggggccuggcuaccuacuagcccgaggcauuacagaccagguggaaagggacaccggauggacugugagcccuaacugcaggcucccgacacuuaggugcuaucccagggcucccagccuuugcuccucaucuguggaagcacaguggagcagaucacaggaaagcucgaagucugggagggcagcugcagggcaggggaggggaagagggauguaacugcugcucacaggaagccacagcucccccaccccaguccucuauuacuuuacaucugaagccggcuaggaagcucagaaggggagaggcaggguggggugcacgacuagaaguugaccuagaguaggagguguagugaaaauccuggaguuuugauuucuuuuaaaaacagaaauaguauaagaacgcacuucuguuuuaaucccaggugugggguaaggggcugcuucagauuuuucacagcagcugacuaggauuugucccgugcucuagcagaggcaugguuuugccagcugcagguaguuucugcaauugugugacacucggaauucugggaacuuuuuagaggguauauaaaugcuagggccuggacaggcauggugggugguuguugaucauucagugugugugugugcaguuuguuaggagucaugcuccaagaggaaccaagaagaaauaagguucagaagucucuaccucucucuccccucuagccuucuuucuuuccuaucuagugauaggagguaagggggugggggauggaaaggcugggaaagguaacaauguaacaaagacuggcuacaaggaggccuggcuucuuaagcacugacagguaguggaaugugucugggagcugucagacccauuucacagagaaguagagacuccuguuugacucacccuugacccacucuuaucccagucuaucucugagauccugugugcgugcacacagcaggcugcauggaggucaggagucagcucucuccuccuaccaaguggauucuggaauguucaaccuugacaaugacuuauuuaccuuugcggccaucucacuggcacauacacacacacacacccgugccccgccccauguggaauuugauuuuuuuaaaaugauuuauuuauucuuauuuuauguguauugguguuuggccugcauguaugucuguacgagggugucagauccccuggaacuggaguuacagaguucaaagcugccaagugaguacuggaaauugaacguggguucucuggguuuacuggaagagcggccagugcucuuaaccacugagccagcucuccagccccacccuuggaucuguuuuuaagacaagaucucauguaucuuagacuggcuucaaacucaaaagauagcugagguugaccuugaacuuuugauccaguucugcgucacaucuggagugcuaggauuacaggguugagccaccacuggaggcuagagcugugcgagggacccagggcuuccuacaagcuaggcuagcacuugaucaacuuagccacuuccagccccccaccucaccucaccccugccuuuugacaggguuucucuguguagcccuggcuguccuggaacucacuuuguagaccaggcuggccuugaacucagaaaucugccugcuucugccuuccaagugcugggauuaaaggugugagccaccacugcccggcaccuuuuaaagacaagaacucauacagcccaugcuguagcagagaaucaccuugaauuccugauccuccggcccuuacuuccccagggcuggggucacaaacuugaaccacccugcccacgggaaucuugaacaaaccuuauccuccagugcugucugucacucagcccuccugcacccuccccuuuucuuccacucugaauuuuuucccuaggcucauaccaagaggcugacucuacaugccugguggucgcuggcccugccucugggacacugugucugcaucacagaaugugguccuacacuguccccccaaccccagggccuguccaucuguucaggaccagagaccuccauucugggagaccuucccccucagcaccuucucccaguccaaggcuccgaauguacaacugccuuucaacuccuuuaagccucacucacacaccuggcaaaguagcucucugucucacuccucagagcaagguggucuuucccaagauuccacuguccggaggggugggggugggguuagggcuccugaucucugcucuccaaaugcagauauuaccuucaucuccccucacuuccuuccucuaggguucagaacggcgcccaaucgcuggccaucccucauuuguaacacuacccagccauuaauaagagugauuacacacagauaccggggugaguaauagcagaagaugcuuauacaauguugagagaaaagcaagacauagaaacuguaaauacaguaugaggaaacgacgcccgaacaccucccccaccccacccccacccccccaacagcaaagaaagacugcgaggacauacacccaaauccuacaacaguucaguuugggucucaguaccaccgacgacgucgucccuaguuuccucgguucaacaaauauucauucaaguucacacuucuaaagacagcaucauauaaaccggucauaauguauuugugguuuaaguauuucagaccagcuccuuccggcuuaacuucccgagccucaaauaccuccaaaguucagguaagugugucuaagagaccagagaagaguuugggaucacaguuccuccagccaccagcacccggcuccuuccaggcucucccaagccuggccucugaguuucuccaguggggcuuaccugaugcagggaggucagccuccacucgaagacgcgcacaccugucacucuaggagaggacucgcuccccagcccuga

SEQ ID NO: 7878 - RNA, 11331 nt, Mus musculus
cgggagcgcgccagcaaggaggcgcggcaccggccuggggcaccgcgaggagcagggacggggacguggcagcgccccgcgcaacagaaaguucccugggaaguucugcgcgacacggcgcgggagcggcgggcgggaccaugaacguguuccgaauccucggggaccugagccaccuccuggcuaugaucuugcuccuggugaagaucuggagguccaagagcugcgccggugagcggcgcccggggcggggcgggaccggaccauggugaggacuuaggcucagagggaagccgggcgcgcgcgcuuccaaaaacuucagcgaaguuuuucgacaucagaggauccgggagauuaugagggagcguggcuucugucuccaugaagagcccuaccucacgcuucucgcccuauccuuaacugggcagcuggcaguaucacggcugcugggcgaggaguggagggggaccuuccccugggaggagaccauauuugaagucgccuuagucgucgagucuucauucucuccugccuuuuauuuccccagagagagccuuuuccugccagcuggugauaucagccuggcccagggauguggagcuggcucugaguggaaggcguuggaggggcucgcgauuugucuacaggucuagcggccuugcugggaugggaaauaucuggaggcuggguugaugauuucaguccccggguuaauaagaagcugcccauugucuuucagccaucuccguuccuagcguucccugccugucccaggcaugcaauugagugugagcucagacucuaccagagcuggggaggcagagagcagcugagggcuacguggacagagaggaugggcaggguaugugcucaagguacaggguacgguguugagaacacccgugcaaauacguagaagccacagggcauagggcauguccugggaaggacacaggaggaagaggaauccagaagguaggauggacuaauggugaaaggcuuuuuccggucacauucgggauccaggaugaaggaaaccaucgaagaaguaggagcagaggcagaggcucagcaggucucuugagacuccggaaauggagguugagagcauuuugagaugucaccugggaggcugaucaggagagggacuugguugaguauggaucagacacauuuuggauccaguggcucuggacugaauuagacguuaccggggguuuguaguagucaguugccugagagaucgucucucacggcccuucugcuugcugggccugugacuuugcuuuagagguccgggguaggauugggggagugcuuguuaccuccucccucauccugugagggacacugugcccugauaccccaaugcccugccuuagggagcugaccuacugagagaccagcagaaagcgacaggaggagcaaaucaguaugcguugcuguaggcgaaagaaaaauggcagcuggugccagccccaaaugccagagacacacuggccacugucccacuguccugcugaguuguguagccuggggcuucuguuucccuaucagucagagggacucacucacggugucucucuucuccugggcuucugguagggauaguguuuauguguuuauguguggagccacuauggguagaacccugagccuacaagguuaagaggacuggaggauauaguggccagguaucccccaugaagcugcugccuagacuguccuaauagggcaggugccucuuuggcaagggcuuggugaaggggcaacacagccagccccaccuggucuaggucgccuccccaucugugucacccccuauaggaguuccuuuauggccucgucugucucccugcuaggcucuacucagguccuaggucuuggucacauggcuccaaucacaugugcgggggaugggggggaggggaaacaggacuacuagugaggaaugugaggcccacacucgccugcagccgguaucugggcccaguguucuucagagugggagagaccuuaggagucuccuccaucauuaaaaaugucacucugacuggguagugguagcacgcuccauuaaucccagcacuugggaggcaaagggagguggaucuucuugaguucaaggccagccuggucuacagagagaguuucaggauagccagggcuacauagagaaacccugucucgaaaacauacaaacaagacaaaaacaaaaaaaccaucccaagacugcccgucacaaccagaagagugagacagggagugugggcacaggaaggcagagucacuacaggggucacaggaugcagacccuguguucacuuggaauagaaucuagacaaauugcuaggcuggaggggguguggcaagagccaggagggaggauggcccaggcagcagcugggacaaggcuuugggucuuuuaaggacauuuggaagucacauaaaagcuuuaagcagaauuuuguuuucaaauagcccuuggguuucuggauggagaauggaaaguggggguggggguggggccgcuggccagcaauuguugggcuaucugagaguagccgaguagagaagagagaggcuaaagaauacuggggcguggugacuggaggggugugagagagggagagaggcucaaggguggccaugaguuugcagagggaugaagggcuguuuaccaagaagggguggagaaggcuauucggagauagguuugucuuggaugacuuuuggggccuugugggauuguccugaaaaauggagcggacagaugaaugaacauacaggccaaaacuaagaggagccuuggaucuggaggcucucuggaguguguguauguuugugugugugcaugugugugugugcacacguguuagaagccaucagccacagggauggcugagauggcagagauacagaacagcaggcagcugggugauuuguggacaaagacagguagagccauagaaggggaggcacaaccgccugaugucacagaguccaggagagggaugcuaaggaugggaacguucugugagcagcucucgagagcaguagugaggucaguugaccuuggcuucagagacaccagcacugggacuggaaacguugggcguggcaagguguggccgaggcuagugugggcguggcaagguguggccgaagcuauugugggcguggcaaggaaggaagauaaaggaaguuccuggcccuuggagccaucuccuugaccugcaggagagccauaagaguacagggcccaggcagggggugaagcaggaacacuggggagccggagucaaggguauggaaccugugacgcuaagcaaguguucuugcccagggccacgccccagucucuccugcuccuuuuuuuuuuuuuuuuuuuuuuuuuuuuugagacugggcuccuuugccugggcugguuugccucugcauccugagugaugggauuaagcacugcaccaaugcacaaaggcccagcccuauccuugccuucuugugagaaccuuuauggccaccagguaugagcuggaugaaugagggcacaagggagcccucuggacgccgaagcucuuucacuaauaaaaccccugguuguagcggcacaagccugagaucucagcacgcagaaagagauggcagggaaauuaggauuucaagaccaguuuugcuacacggagaguucaaggccagccugggccacaugaggugcugucucaaauauacugaagaucuggcuguugagauggcucagugacauaagguacuugcuguuaaguuugagcuucugaauuuggcccaugugguacaaggaaggagccaucccaugaaaguuguccccugaccuucauacauggugugcacauacacacagauaccacaaacacauacuaaguaaggaaauaaauuuuauaaauaauuguuuaaaaaaauaacauuaagggcuggagagaugguucagcaguuaagagcacugacugcucuuccaaagguugugaguucuaaucccagcaaccacaugguggcucacaaccauccguaaugaggucugacgcccucuuuuagugugucugaagacagcuauguguacuuagauauaauaauaaauaaaucuuaaaaaaaagcauuaaaaguaacaagacucuaaaucagauacaggacuaaauaaagaguagaccaagaaacaccacagaccauggcuggagagauggcucagggguuaagagcgcugguuggucuuacagaggacccacaucaugucuuaacagcuguuuguagcuccuguuccagacacuuauauggguucuuauaugggaacauaugcuucauauauauucaugcaggcacuacacacacacaacauuuuuguuuguauuuugagauauguuacuacuauguggucauggcuggccuggagcugacagagaucaaccugacuggguacuuggauuaaagguugguacugcuacacccaccuaaaauaaauagcauuauauuauauuuauucauucauuccuuuuauguguauguguuuguaccugaguggucugugaaccacuugugugcaugacaguggguaucagaagagggcaucagauaucccaaaauuggaguuauuggcaguugugagccacugugugggugcugggaaccaaacugcagucuucuguaagaguaguaaauguucuuaacuacugagccauuucuccagcucaauagguucuuuuaaaaaagacagacagacagacagaccuuggaguugggcacugugguggcacagacuugcaaccucagcacugaggaggcagaggcagggagggcugcuaaaagcuggcggccagcaccuuuacuuugauugauuaauuaguuaguuaauuauaauuuugagaugugguuucacuggguagcccuggcuggccuugaacucaaaaggccuaccacugccuccuaagguaugugcuuccaugcccagcccaaagccagcauucuucuucuccuuuuuuuuuuuuuuuuuuuuuuuugguuuuucaagacaggguuucucuguauagucuuggcuguccuggaacucacuuuguagaccaggcuggccucgaacucagaaauccaccugucucugccucccaagugcugggauuaaaggcgugugccaccaccacccggcuccuuuuuuuuuuuuuaaagagauuuauuuauuauuuuuuguaugugaguacacuguagcuguaaagaugguugugagccuucaugugguuguuggaaauugaauuuaggaccucugcuugcucacucccuguucgcucccgcccaaagauuuauucauuauuauacauaaguacacuguagcuguuuucagacacacuagauaagggugucagauuucauuaugggugguugugauccaccauguguuugcugggauuugaacucaggaccaucagaagagcagucagugaucuuacccugcugagccaucucaccagcccagccagcauuauucuuuucguuuauuuguuugguugguuuguuuuuaaagaguguuucccuguauagccuuagcuguccuggaacucacucuguagacuauacuggccuggaacucauagagaucuuccugcugcugcuuccagaguacugagauuaaaggagugugccaccauaccugggaagccagcccauucuauauagccaguuccaggccagucguucagcaagaccccgucucaaaagaaaagaaacaguguagagaccaagacagcaugugugacaaguccuggcaccugugucaugcacuccugcacauacaugagcucuggccagaggucuguguucucaggcaucuuuucugcauguaccauuugguguuuauuacuuacuuauggcaauguugggacugaacccagggccucucauaugcuggcaagugcucggucacugaguugcaccccuaauucuuguauugcaaugaauaaauauaggcauaaccuuuauaaguagaaaaaggugcauuuugaaaacagagcgcugcuggccgaucucuaacucucucugccugcuugucucccuggugaaucagcagcuggagucaguucucccacaguggaguucugggguugccacuggagcucuggggguggcacacagaacagccucaacacccccauccaggcgacucacaccaccuccgcauccuccacagagacgcaccaagguggcgcacgcaaggugacagggaacauaguguucgaaucuuuauuuguagacagaucauagcucaacaagaggcacagggacuccagugacugagggcagggcagggcagggcagggauagccgcuccuggcuggccacccugaaggcuauguucucaugauucccuuguucacccugcacaggcaucucuggaaagagccagauucuuuucgcuuuggucuuuaccaccagguaccuggaccucuucucgaacuucaucuccaucuacaacacagugaugaagguaaacgcauggggaucccuggugugcuggcaaguugaggccagggcuggagcuggcucgccugccuugcugcccacggccuuucaggaacgggucucuguacuuuuugcucaggaccaccaugguacuuguacuucacucagagagguggcugggagauucaucaaggucacagguuuaagugugaggcaaguaacaugcaugauacacucaugucuucucagcacuggagaagcagagaggcaagagaaucgcuucaaguucaaggccaaccugguuccagggcuacacagugacacggugucucaaaagacucccacuaacaacacacacacauagacacacacacacacaugcacacacgcacgcacgcacagugacauaaacacuggcgcccuaccauggacugaauauuuccuaauaauuaacgaucacacagaaugguuaaacaauaaacaaaucagauguuuuuuuccuggacccugggcauuuagugaacugcauuggccauacaccugugcaauguguguccugcucugcugugcccggcacuuggagacauucaagacucauggauccuauaccuucagggcagaacaucauaagcaaaugaguauauuagucauggaauggcuaagccaaauccuaaaaucuuacuuuaaucccagcacugugaggcagaggcagguggaucucugaguuugaggccaaccuggucuacagauugaguuccaggacagcuaaggcuacacagagaaauucagucucaaccaaccuccccucaugccccgccccccaaaaauauuucaagagaugauacagcacaucaaaagucucagagacauccuuugggguuccagguagcucaucaguggaagagguaagaggauguugucuccugcgaagcagcuguacacagugugaaucuauuauuaucuauuuauuucauguaugugaauauacugucgcugucuucagacauaccagaagagggcaucggaucccauuacagaugguugugagccaccauguggaugcuggaaauugaacucaggaccucuagaagagcagcacucagugcucuuaaccacugauccaucucuccagcccccagucagugcucuuaaccucugagccaccucuccagaccauuggcuggggugggggugggagagucuuaaaaucaccauuagaauuacaggaggcuggcccauuuaccugcuuaguucauuucucugcagacccagccuugcugugacuggaugagauguugucuguaauggaauagaaauguggucgucacuccuuguguucccucugucacuaaucugugcugaguaaggacucacaggaggguccugcccaugaauccucuugugacagagacagacugacagaucuucacagagcaugugacaccaugcuacaggguguggugacagcauucgucucucauccuagugaagugugagugagcucucugugccaguguaguuuagugccacccaacaguauuggcacagccugggaaguuguuagaaaagcaaauuccaaggcugcccagaccuaccaaaaaaauaaaacaaaacaaaacaaaacaacaaaaaaccccccaaaaacaaacaaacaaaaaaacccuugggauggcaucagagaagcuacucaugugacucuaaugcaaaccuccaacucgugacucuaggggccccagaaacaucaugcauacacgcacacacgcacacaagcaugcacacuuccucacacaugcacacgugugcacacacacagaggcaggguggccuguuggggacaauagcaugauagcccuuagaauuacagauauggucuaguacgaguguuaaaugaugucauagacguccgugucucccuaggugguuuuccuccucugugccuaugucacaguguacaugaucuauuggaaguuccggaaaacguuugacauugaaaaugacacauuccggcuggaguuccuccugguccccgugacuggccuuuccuuucuggugaacuacaguuacacgccgauggaggugggucuuagucccaaggcaggacugccucccagcacccuuuucggccaucugggcauuucuaccaugagccuuugcucaccguucacagcacucaccuccaccccaccgugaaggggcucaucuagucauaguccugaaguucccaaaggcuccaaguuaaacaggugguaacccuccuccaguugacaccuuguguccccaagaguaccaaggcugagucagcagcgggccugagcuuugaaaggcuaucaucucuggagguucuaugccgauauuuauuggcuguuccuugucaccuuaucuuaaaugucacuuacacacuaugcagucugucaaaacuauguuucauggacaaauuugcacuguugugaaacaagcaggcauuacauaccugaguuuguauuucuguaagugauggacagguuuaacuacuaaaguucagggcuggggacacuaugggcagagugcccucuggccuuuuuuucuauucccaacagcaaaaagccauaaauacaaguucuuaaaccuauuguggcaaaacauucuggggucuuauuccuuccuagggagauaaguuugcucaaagcaacauugguacccuguaaaaugauugugugucaaacuauucucuucagcaaacguucacuacaugaguccucuaaagcaaaggacuuccagccuuucuauuguuguucugacagguccucuggaccuucuccaucuaucuggagucaguggcuauccugccacagcucuucaugaucagcaagaccggagaggcugagaccaucaccacucacuaccuguucuuccuggggcucuaucggcuccucuaucuggccaacuggaucaggcgguaccagacagagaacuucuaugaccagaucucaguagugucuggaguuguucaaaccaucuuuuacugugacuucuucuacuuguaugugaccaaagguaggcacugguccugugucacggugcuugcuugcuuucucucucuuucuuucaagacaggguuucucuguauagcccuggcuguccuggaacucagaaaucugccugccucugccuccugagugcuggucacugugcacucuuaugucugguacuuguauaaguuugaauagguuuagccuccguaaacauaccuguuugaauguuuggcccacagguagugacacuauuaggcauguccuuuauagaauagguaugcccuuguuggaggaaauguagcacuguguagagccaggcguugaaggcuggggcagguaucuacugaaggcaacauaugcuuugaaucagugucugauacacgguagaguuucuccuauaacuaggauccauggguccaggaaucaagggguggagaagggaguaguuccauuuaguaacccacuaggaaaauguuugcuuccuguuuucgauuggccuacaaguuuugauuccagagggaggagugcuccugccaggagaaagccguuucauguguuuguccgggaguuuugaacacuaggaguccuccaaggccucccaacagugucacucccugagggccagacuuacuccaacuggucugaggcagagccaagguucaucccucuggagcuuauuuggaucuggggaggcacagaccaauagcaaucagcaacgugcacagacaggaaaacugaggacuucugacaaacuugguugggaaaaccucaaucuccaaaagccccgaagcagcuguuagcaguaguagaccuugaaacgcaaggaaacuaaguucacacagaaccccagggaucuagguuaugggguuuguuauugugucaccaugcccagcagccaccaugcagagacuaaucagggcaguuuaaaaacaggguugggauggauagacacaggcuaugggaauggaguagacauacucaucuaaaaugauguaagaacaccaguaaccaaaguggggggaaacagcauaaaccccacgggugacccgcaacaaguaacaagggaggcaaaggcaggcgaucuccaguucaaggccagcuaaaguggagggaggggggcaggaauucuucuuuaaguacaacacauaguaaaauuuuaucuuuuuuuccuuaguccuuaaaggaaagaaauuaagccucccggugccaguuugaagagaagggccaccccuauggcagcuaaagcaaaccauccggaucacugcuucaugacuucaagccaagacuugggacuucauguuagagugacuggugugaauuugagcaaagcaccaucuugggauaaacggcagcaccucccuaauccaccauggauagaaugggauaccuagcccaucugcccaaggauggugcccuacaagugccaagugaagagaagcaguagauaccuccgugaguggcucaacuccuugcuuccuuaggacuauacaacucaugcccagggcugggaagauccauucagagaaccucccuaggucagcgugcugaacucgagccacauguccaccuggccugcaagcuguaagcaguccaaauaaccagcucugccaagugcuuaggacugcuuagcucacuuguuagcugagauggacaccauggccacuguguaaauccauucugugcuaagaaccaccaauguagccuuccccucccagccugaggugcuaaauagaaugccuaauacacucacccugcuuaauguuuucacugcuuggaggaaaacauuaagaguacacuuaaacucuuuuuaaguuuuaauguaauaaaaaauucacaccuuuau

SEQ ID NO: 7879 - RNA, 1522 nt, Mus musculus
gugaggcggggcggggcggggguuaacuccaugagcacuucuucaagcuucacuaaugcuccgcagucacucgcacugaguggccauggacacagagcacgcugaguuacugcacuggaugcacggaagcgugcuuuccaagcagcaagcacuggggcuucagaggcuaacagcugggaguacuucuggaggggcucgauaagggguggacacggugcaaaaguucuucaugcuagaaggguguccugugugugcacagcugacugaaggccaccuaagagcaagccuagaaucggguuucuccagcccaggcugcccugagguuacuggugcacugccacaauauuaucuugcugucuuuauagacgaugcuguagcaggguaagaaaugcaaaguuauauguuuggccccuggccugggagaacaugugguuuggaaagcccuaugccauggccugaaacuccacucacuaacugggagagucagcaggcucaucuagaguggcuucgggccaauggagauuugccucagccauguacugagugaucugcaguugauaucaaagcuucuguuaaaaaacaaaaugaaauaaauucaauacuuuuaguucaacaguguguaguuuaaacaaaaaaagaaaaaaaaagaaaaagaaaaaaaagaaaaaagcaaaauaaaaaauaucccaguggaaagggaacaguggucaccucaagaugacuauuaggaacuaugggagucaaagaacuuaccugaagggaucauuuaagagaccaucgcuccacagaagugaaaaaaggccuggugacucagcugaaaauagcaccccugucugagguagaagccuucacuuuccaggaucuuggaggaccuuggucagaauucugccauuugugguggguuuucucccuccuuuugauuuuuacaaggcagcaaacaaaggggcccaaaacaagcacugauguugaguaacaagaaacagacucaggcaccuucccucucccucacuugaaugagggagggugggaugaagagucuaaguuauucuaaugguagccaauugauuuuaaaauaugcaaaaggacagaacaaauuuuuaauugucuaggcaagaugcacaaagaagcuaccagcacauagcaagccuguuuuaaaaaccaccauuacugaaagcuuuuuauguaaauugcuuucaggcuucugccuccucucccaggccccgguucuaagggcacagacccagagaugaccucggaaggaagagacaacuucccaccauggcugcaggucacucacuaccucaaggaggaguaaaauugaauggauaaaaaggcuccaucacugcugaacucauuucaauacuuaucaucucuauguuaaauugcacagggaaacuugguacuucucaccuuacucagcaggaaauuaaacacaucaauaaugguucccucccaacagaaaucaccccagcucucuaaaacaagacccugcuauuuaacguagguugcccucaaacaaaug

SEQ ID NO: 7880 - RNA, 8894 nt, Mus musculus
cggcgccggccaaucgcggucgcggcgguugacgcggccugggcagauccuugcagaaagcugcaggcuagcucgggauuccggcuucgcagacagguaccucugggagcggcgggcggauauccgugccaguaguggugggugggaugcccggguaccccuggagaagcgggcaggcuggaccguggcaugcuccgcgggcaccucuugcgacggagacucggagaugguguuuugaccccauccuuugaaggucuucuccuaacccguacagaacucuuuggguuuugugacccgugagacuggcuggcucuuaacuuuuucgagacaccuuucccuuugagaauccagugaaaaccaaagaugcuuccuuccuuuauuuuuugucagaaugaagagaauguauuuuauagccugaugcaaacuaaagcuucgcacaguaagugcauuucccuguaaagggggacaauuugaucuacuucucagggucauggugagcaucaaaugucccaacaguuuguaaacaugaaagcacucuuaaccuacgagcugcaggcuguuaucauucgugauuauaaauaagggacgucacuggccggagaaauggaucagagucucagagaacugguugcuguugcagagaacugggauucgauucccagcucacaaacgccaguaacucuaguuguagaaucugcagacacaaggcacgaccaugguaucccaggcaaaacacucagacacauuaaaaacaacagcaaacaaagccuuugaggcccuugggggaugauaaaacguuggacuccccagagggugagcaacaggguugguugggaaccaagugcaaaccuuuaauuuucuuggcccauagucuucuaugagagagcuucccuaaagaacccuaggauaccuugaacgguguguguauguguguguguuuaaaaaaaaaaaucugugaaggggacuagagaaaaggcucagugaauguggguacuugcugcucaagugugagaccauggauucaaguccccaacaucucaguuaaaagccuaccacaagccggcgcgugguggcacacgccuuuaaucccagcacucgggaggcagaggcaggcggauuucugaguucgaggccagccuggucuacaaagugaaguuccaggacagccagggcuacacagagaaacccuaucucgaaaaaccaaaaaaaaaaaaaaaaaaaaagccugcuacaagcucggaccccugcaaugcuaacacuguugguggcggagacaggauugcuugugcucgcuggccgccagucuagcuccagguucagugagagaccccaucuaaagggaaugcaacaggacaccugacguccccccuccagacuccgaaucugcacacaaauauuaauaaaguggauacacacacacacaccuaccugcacauaugcaugcauucagcacauaaacacauaauuggaaaaaaaaauguaccaugaagccuugugguuuuaugacuucucucuacuuguuuuauuuaaaaagcugaccucuuccccgagccuaagugauguuacugauuuuaugagcauugcaggacguugugcugugacuaaagcuagugugccggugagugucgugauacuuaucgagacugugauaaguaccgcucugcauccgggagugaaauccgggugucgcuucauggcuuuaggaugccauccaggcugaaguucccguacuuggugauguucuuacuggccaacgggaaugguagaaauuuccucccuggcuccacacugugaugcuggcgaggccaacucgugacagaguugccugagguuagcaucacugugaagccacacaaacuuugguuccaaugcccguucccaccaaagaccuuggcuuuccaaauggggugacuaggagaggcaugucgaggggcaguugugagugaaauggguuuaugcaaaggccuuagccuauacugccuggcacauaagaagcacccagcacauggaagcuccuuccagaacuauuaggaccucaagccuucuuuugcuguucuguauaaauggauaacucuucccaguagguacugcgguaauuggcaaucaucaagguguaagauguucuaauggauagagaacagugaaaugaggucgcugaucuguuugacuuuaggagacggaagugcugguguuuucucgcugggucaggaaggagaaggaagugcuggcguuuccucacugaguuagggaugccucucuuuggcagcauauucagcccaaagaagaccccuccucggaagucggccucucucuccaaccuacauucugugagugcagacuggguggcgggaguggucucuggguggagaggugacucugugggaaggcauccucgggguuuauauuauuagucaagacugaauuccugcaugggaacuacuacuggaguuuauucaagaaccuacuaugacaggcagccuccuugugauagggucccagguggugguauccagucuggcuugcauuuuaguucagauaauucauuucagucauguuuaaagaucaaauccaagcuggguguagcgguauaccucuacucucagcaaucaagagguagaggcugggggaucucugugaguucagggcuagccuggucuauagaguuccagggcauccaggguucagagagagacucugucuccaaaaguaaaauaaaauaaggucaaguucggggccuugagagauggcucagccaaaaaggguacuuguugcucuugcagaggaccuggguuggguucccagcccggacaaggauggcucacaaccaucuguagcuacugucccaggggauccaccgcccucugcuggccucuacuggcacugcacuuacaagguucacaacauacaugauggcagagcacuccuacacauagaagaaaaauaaauccgcaguuguuuugagaauggagucucuguguaacccuggcuguccuggaacuugcuauguagaccaagauggcuucaaacucacagagaucugccuguuccugccucgggaguguugggauuaaugguguacacccacauacacugccccccccaaaaaaaaaaaucaaguuuauuucggagauucacaaaagauguugacuugucaccguuagugacacuugaaaggauaauaacaguucugaaagaggggguccaaaaacaucuggggccaugacagcacugggacaaagguaacuuuccaaaggcaacauggagccccccugaaugcagggccugcgcuuagaaaauacauaauaaagccauuccuaguuaugagauguagauacacacagguccauuccuagcuaugagauguagauacacacagguccacgcacacaggccuuucagcaucugugaccacaaaucugguccuucguucccaccauauuccugcccuuacaucugggugcuacugcugugucuuucacaccaagagaugauagacccucgucucuuugucccuuucccacgugacauuugugcagaugagccaagucuuuacaagucuguggguuagguagcaagcaucaccccagcucuaaaggccaugaguccauugccucuaguccccaguuaggaucaugacggcagccccucuaaggccagggauaaacagugugggauccuaguucuccaugccuuggacuucaagccuccuuccagacaccgacgacagagaugcacuugguacucucacugggacaacccuuguccuuaaaggcagcagcgugcuucuaacgcuacugucugagagugacuggaagcucacccucccugcaguauuugcaggacaucacaggcaagugcugggauaaggaaacacaaaacauggugcacagaguccuuuuaagauguguguauuuauuaugugugcagcauucugccaucaggucagaagaaggcaccagaccucaucauagaugagugugagccaccaugugguggcuggauaugaacucaggaccuuuggaagagcugccagugcuuuuagccucugagccaucucucuaucccccagggggcucaacagcauccuguuauuccaggacaguggcucagguccugaggaaggcacauaagguaccucauagccgugucuucugugcaccuuuugcuugggccacccauccuuacaagagccuguaaggcuaugccugcugcucuaugccuguugcuuugccugcccagaggcaucuucucuagucaucaauuucauagcagccaauugauaacuuuguguauccaccaaccuuuuaggugcugaguaaggaaaagagggaccuggcuuggugguacaggucuauaauuccagcugcuugggaggcugagccaggauuacaaguucaaggccagccgggacaccacaagacccucugaaaauugauaguauauuuaaaaaaggaguuucuggagaaggaggagaugagucaggggagggaugugagggccuaaguuuaauccccagaacacuuuuaaaaucugggcgugggcugaaaagacagcucagugguuaauagcacuugcaguucuugaagaggacgcaggucagauucccagcaccgacuuggugcuucacaaccauccaugacuccaggaccaggaaccuagugucuccugagcuccacagacaccggacaugcaugcgguguacacacacacacacacacacacacacacacacagacaccggacaugcaugcgguguacacacacacacacacacacacacacacacacacucacacacacacacacacacacacacacucacacacacacauacacacacacacacaaaccuaauuuuaaaaaaaucuaauaaaauaaaacucuggguacuguggcacaugaguggggggcagugcauaggaagaagacaccaggcugaggacaagaggcucuugggacucacuggccggccagccagccacccuacuucaugagcuucaagacagugaaagccccucaccauaggugcugaagaaggggccgggugggggcggggugacugggaagaaggugguuacuauggaaaaugcagaggggagggaaaaagagacccuaccuauagcgcaacccuaccuacagcacgccuuuguuugaaaauaucaucaugagagcuaauaccuauaugcugacuucuuuauuguuguggggggcagaguugagacagggucucuccauguagcccuagaugucccgcuccuucaucuguagauugaacugaccuugaacucacggagaucgacuugccucugccuccugaguauuggggcuagagauguguggcgaccauuccuagccugaaauuguuuucaaacuguagauaguaccugaggaaugacagccgagcuuguccucuggccuccacacauguguguaaacauucaccugcacacacaugaacacuuauguacacacacacacacacacacacacacacacacaguaagagauauauguccguggaaguauauucaagucccaagguucaagccccagaaacagaaacagaaaaaaaaaagaggaggcgaggggccagggagaaccaaaucccagcaucuguugcguggguagacauuuuaacaaggagagugauguggaaagagaguugucacuuuaaauagggugcucaagggaguccuaaccaagcaaaggacauuuuagcauacacuugaaggaguucgucccugucuuuuucuaucucuuucuauccacacaugcacacacacacacacacacgcacacaugcacgccugccugcccgugucaagcuggucacgucuccucucaggguuggaggauucccucuggcagagcuggccaugcuccuaucugaaugcacaggagucaggccugacuugaggaguguuugaugaguucugucaaagaauacagaaaugagacugcaggacauuagacaaguccuaccaggaacuguuaggauuuugugcuuccauauuaagcaaaggacaacuugcaaguuucuuugaauuauaaauauacacugaagaggaggagaaugaauuaaaaccaaguaugauuacauauguaaaaauguauggugggauucucugaacugucaaguaguuguaaaaaaaaauacucaauuuaugaagggacaguggcacacgccuuuaauccccacacuugggaggcagaucucugugcguuugaggcuggucugguccacauagugacagccaggauagccagggcugcauagugagacccugccucaaaaaaaaaaaaaaaaaaugugucucuaaaggugcuaaggccuggugggaggagagcugcccguguuguugggucuacaacuggugggaaaagcuggggcgucaucucuccuucugauguaucucuuguucuuugguuuccuggugucuuaccacaguuagaucggucaacgcgggaacuggagcuggggcucgacuauggaacuccuaccaugaaccuggcggggcagagccugaaguuugaaaacggccaguggguggcaggugaguggcccuucuggauguuuugucagucaggcuggcagaaggaagacuccuuucauuccuguuuuguguccucuagacuccgugauuaguggggguguggaccggagggaaacucagcgccugcgcaaacgaaaccaacaguuagaagaagaaaacaaucuccugcggcugaaaguggacauucugcuggacauggugagggagaaauccccagggaugccuagguuucuccuuuagggaaguccuaccuugagucuagccauccaacugauuuccccagggccuacuuacugggucuguuuccuggguauccacacacaaauguaaaagccaaccuugccaccaaaggcuggagcagggauauauuacaguacccacaauccccgugcccgugguaaggguacuccuuuaguccaagcagggucugauagccacacagaagaggucuagacagcagagaggggcucuccgacgaugcccaggauaguggcaagaauggagauuggacgaaggcaucccagguggugagggugucugcucgaguuugggggcauccugccucagaucagcugaaucagugaccagugcaaaccuucgaagggcacauaccaaauuaaugucggucuccugugucugcugggccuggcagugcgugugcagggggggacaggcgugagggagcuggugggcagcuucuuugccccaccggcuacccacucugugaccucaucacuccagcaagacaacuggcaucagaguagcaccuuccucuuggaccuaauaacaagagaaacacacugagagcagagaccgccugccuuccugcccucccucugucuucauguucagugucugcccccuucuacuguaaacccuagucaaaagauaaugaugaggaaaggagaaguauuuuuagaacaucccaucccccucccccauuuuuuuuuuuuuugguagcauuguucgcuaagugccauuacacgagacuagacagcgcagauuuauaaucucugaacugcagcguacccagcguguguguuucuguccuucacacaugguaugccaugcagcuguguagaugugcuagaggcacgaggaggagcaaucccucugucugccaaggcuuagcugggugaggacugguaguuuuccuuggugcacagccgcugcgcacgucugcagcggggccuggccguagcuuucuuuguaacaauccaaugcucuuacuuccagcuuucagaaaccacugcugagucccaccuaaaggacaaagagcuggaugaacugaagguuaccaaccgcaggaggaagugaagagagccuggcagcacucgcuaggggacuggaaagagcccagugaccaggggaggaggaugcggcagagcccuuugauuucccgucagauuagcagacuaggggagagcauuaacaggcccuggcucccuugggcaggggauagggaggagacacaggauggaagaacccaaggugccaggccagggccauagccaagcaagcaccccagguccacccagggugucaaucuaaaacauaccccaggaaggccuagaaauaaugagccuuggaugcugucggcaagugacagcauguaacugccugugucucagaaucaccauauucagacagcuggcagcucaccucuugacacuggugucugggguuuggcacuccucccagagagcaccucgcgugagggugcccaguaaguggcucuggguugucugcaccccagcccccggaacccccagccguaaucucucugccuuuaaagagcccucauccucaaauccacagccucuucuggcaucagcuucccagcagcaagcuccagccuuccacagcacacuguaauuuacucuuuuuuuuauuaaacgguguucaauaaucucuguguagcaaaaauagaucaacaucaaccaaaaaaaaaaaauguagcuuccucaagaaguaaccagacccuggguucaaaguugguguugcuccacaaaaagacaggaguuuuaggacugggagaacggcaccuugaagagggaaccacccuggaagagaaauggugacuuccuguuccacuuccucuguuuuccugcguccuugagguaguacuggugcccacuagccagucaagaagugacaggugggggcuggugagauggcucaguggguaagagcaccugacugcucuuccaaaggucuggaguucaaaucccagcaaccacaugguggcucacaaccaucuguaacaagaucugaugcccucuucuggugugucugaagacagcuacaguguacuuacauauaauaaauaaauaaaucuua

SEQ ID NO: 7881 - RNA, 2541 nt, Mus musculus
ugauaacaagcucuauuugcaaaccuccucuuucucaagacuauaaggcaaacauacagaaaacagguuauaaauacaguauagucugcauauccagagucuggccugcacuuucuguggagggagucuugaauuugaggcaauaaucacuacuauguucaauaauaaauguucucuuuccuuuuuggaaacuucacuaaacaggaauuggugacuccugcccuuaauccuagcaccuggaaagcagagguaggcaggucugaguucucagccagcucuagucuacaaauuaaguuccaggauagccaaggcuacacaaagaaacagucuugaaaaaaaaaaaaaaauaaaacaaacaaaaaacauaccacacacacaaggaaaagaagagaaagcuuuuugaggucagacuggucuaugaaaugagguugaaacagaugcuggcugaagccagaggaaauuuggcaggcaguguuccuggcuuucuaaaacaaccuaggugugaaauacuaccacaaacacagcaauaacacuuucaguucgaguucuuuuaauauuuaaauacaaaaagugagcgcugacuucuuuuuuauacauaagcaggucuaagagccaaacucugcagaggaaaugagugccugcucugcccagucccccucuggcuaaagcuacagccagccucccuucucucugggauuccuggugacuucuguacucagguauaaugaauuuugucagugccacggugcuuacauguccuagacauuuccauuaaaaaaaaguccuuauggucagggguacuuacuucuuucccacaaugggcauguaagaacuuccuuaggagcaguuuauuagagaguaggcuaaccuuccacauggcuguacuccagcauuggagugagaacaggaagaaguaagugagggacuucauuauguagggcacagguguaccuggggucucuccaugagaaacagagaaaguucccacuauguucaaauagauccaugugccaagguuaaaaaaaagaauaaaaaguuccaacaaucagcaguucaaacacaaaugaauuucaaaguucucccacaaggacaaauaccgaaggaagaaucuacaucuuuccaggaaguggagguagagccccuggcauuccuccugacagcccuguguuaggcccuaaaaguaucuggaaaagaaaaaaaaaaaaaaaaagacuguuaagauacugcauaguuccagucgucggucccuucugucacacaugaggggcaggcaaauucuacacugccaaguaccugaaaguacagggaccugcucccacuugggguuaagugccaaucuccuggggcucugcgguuggcccaccgccaagaagaacaugugcucaccugccguugcugcaguugcugcuguugcuccaucugcaacuuuucugucucaaagacaacgggaagaaccaggaucaugaaggaaguggucccaauccacaaagcugcccuggaaaaucugcagagggaaagaguggaugaggcgucaugaaaaggaaagccggcacuccggcuaggaccgaaccuggaacaggacgugcaguaccgcccucgaucuucuaaaagcguacccuaccaauuccuugcccccagaguccuggcagaggcaagaggagcaguaauuaccuagcgauacagugcauucuuauaagccucguauauacguaaccuuagucucauaacgaccccgccagguuaagaacucccuucuggggcuggugagauggcucaguggguuagagcacccgacugcucuuccgaaggugcagaguucaaaucccagcaaccacaugguggcucacaaccauccguaacaagaucugacccccucuucuggagugucugaagacagcuacaauguacuuacauauaauaaauaaauaaauaaaucuuuaaaaaaaaaaaaagaacucccuucugcagaagaccaaccacacucgggguaugacaaugaauccaaggucacucaaacucugcucugcgacucccgaggcccgcuguccuuugacagcacccgucacccguccaugcccgcucccgguggcucuccgucggcccuuuuaccuguacaucuucugagccacgaagagcgagaggucaaagguggcuccggcggcugaccggacccucucgggaaacaucuccgucagaccccagagucucuccgacagggucucgucuagcugugguggaggaggcgugggucgucggugaagcggcagcagcaccgcaaccgccgagccccgggccuggcccuuccgugccgcgcggagaagccgcccucucggcucgcggcguccacgccccaaccgcccgcccucgccccgcuccccgccagcccuagcaccucgucgucgucgucuucuuccagcuccuccucggcuuucucugccucggcuuucgggaguaauuccucgggggacagaggcuccccagcgccggcugcagcgacggcggcggccauggcuguaggacaccggaagcggaagagagcag

SEQ ID NO: 7882 - RNA, 3263 nt, Mus musculus
ugcaaacauuuagugagucucugauaugcaucugggacuauaaugggucuuaacauucucuucuaauuuuuuuauuuuuuuuaauuugcgagacagggcuucucuguguagcccuggcuguccuggaacucacucuguagaccaggcuggccucgaacucagaaauccaccugccucugccucccaagugcugggauuaaaggcacgcaccaccacugcccagcucucuucuaauuuuugcaacacaucugcauuuucuugaugagaugcuggagaagugagagguuaagaaaguuuccuaaggucacagacccuuuuaauggcaacaguuggaagggaagcccagucccucccuuggcaucaguuucuuuagugauguuugacacuuucuaaacaccaguaacaucuuauaguuacuuucuuauuuuccacaaugccaaguaaguggugagaucuucauuucugccuaccuucucaacaccgcagaagaugcuacuuaaagaugcccuuccauauugcaugaauacaagagguggcuccacucguaaguggcaaggcugagggucaugccuauuuuuuuuuuuaauuauaacaaggcagggugugggaaggcgacgagugccacgguguacgaaucaguucucuccuucacuaggugaguccuggggaucgaacugagguugucaaacuuaggaggcaagccccuuuaccugcugagccaucuugucggucccaucuuuuuauuuuauuuggguggacacggaaagaggacgcuccucggacaucauucucgccgacugagcaacuacuuucuguuuacuuuccagagaccaggaagagaaacggcugccaccccuuagacuggcuaccugucuucgugaguaucccgcccccugcccaagccaccuugacacuugguccuccgggaugcuccuagaagaggaagacccugcgucucagggaccccccuccuggggagggcgggcugauccacacggggacagggacacagggcgcgcggcccgagucgggaaccccguuccacguggcggagccaaguggcagcgaucgaggcgggagcgggaagcgcgggaggccggguggacgcugcccggugcggagagugggcccgggcccggcagguucgggagagcggcaggugggcgggcugcaucccuucagcgcucccgugagccgugccacuggacagccggcugcccgccgucgccucggagaccguccggccccuccgcguaccccuggccccgccgccgccucccgggccuaccuugcuggugagguccagcuccggcucgccguugagcgccucgccguccucgcugcagucagaaucgaagccgccauggagucgggccgcggccgcggcggcccgagccgcccccggagagcuaggcucgggggcgaacaucgaggccggcaccggcgagucgaccggggagcgacuccgcuccgccgccaucuuuaagaacuuaagcuaauucgcagccggccgcccgcccucccucccuggcucauuuaacuaauuuaugcucggccccgccccuucuuguuagaauaauuuaugcgcggcuuccccgccucccgagacugucacguaucucuagcggagacacagaagacccagucucucauuuaccaaucgucgcagcucucucaaauacuuuaaugaauaauuaaugagaccaaaacccuaacaacaaacgucguaguggucgggagccuuggucccaccucuaguggggccaacacagcgugcacgcuaccugccuggauccuucccgccaacgggagcgaagcagagguuugacugacuugacaacaauccaaugaaaagaggcauccauucuuuacuccccaccucacuuuccagaggcggggccagccuccaaaucauacugcaaaacagucccgccuggagccucucaaaaugauggacaagggcgggacccaaucuuguccucccuaagucccgcgcgucuggccgccgcauacccagauaguaaacugugaaaugagccuggcacuccgaaugauugaaggcaguugcugcaacacuguguccggcgugcuggcaugcgcaaggcaauuuuuauaguagaaucgaugcuauguauuccaggagugguaauauuacagccgccagaccaagacaauuaauuaaaugcugaccucagggaguuccauucaugacuccucggagagcaacugagugaacagaaagauguugacagcccaaacucuagcguaaauccccucacguuuuuggugaacagcugagccacaggucuaggaucugucaagguaguuucuuguggcuuauuuuucaguugccacuuguggaaagucccaguccaaaaaaaaaaaaaaaaacccgccguucguguaccugaaauucccguuucaaaugucugaaaaauuuagacuauuaggugaguucuguuuuuuaccaagaucuaauuaugcuggcuggaccuggccacuccuccugguaauagauuaaaaaaaagagcagccgccugaggaaguacgagaaauuuagggauuggaccacaggauguauauaguaaguaaggaaaaggguacaauauagccgucaccuaauucggggagagucuuguccucauuuuuaacguacuaccaagucugugagcagaugcugcuggaaaccugaccuuaaugguuuuuuacugagauuuguuuuuauuuuguaugaaugguguguguguguguguguguguguguguguguguguguaugucugugugccaccuuugugcagggccuguagagucuaaauggggcaccggaacccuuuuggacuagagucgcagacgauuguuagccuccauuaggguacugggaauccaacccaggucuucugaaacucugagcuauaucuccagacccagagauucggacuccuaaagugagaggcagucuuguggaccguaacccuauaucuguggauucugacaguauccccaaguauuaagaauucaacuggagguugcucacugcuuggcugggggugaucagaggugacaguuguauuaauucuauugcuucgauugcuauuuagcauuguauggccagaaaaaguucaguuucagaauacauugcuaucuggcuggggggaaagacuguccuucucacuauaggacuuugccuagaaaggauauauauucugaauacuugcuuuucgaauugaauguuuuggagaauaaauauaaaaaguaacaguu

SEQ ID NO: 7883 - RNA, 18469 nt, Mus musculus
cacauacacacucggccacgcgcgcaccgcccugccccacucgcgcagcgcgguccucugccggccgcauuguccgcucaccgaccccgcgccgucccgcgucuccgcuccgcgcgcguuucagccccagccccgggcccggcccggcccagugcgcggcgccgcccgggggacuccgacgcgggaagaaccacgcaagguaaagaagggauugggcccgccuccccacggccccgcgcccgccugacccgggucgccguccggccaaagcgcgggccugcgccucccuguccggccaggccgggccacuccagccccugcgcgacgcacgccccgggacacucgcgggccggcgcccugacgcaucgcggucacggggagggcgcuguccccaggcgggacuuccccagcagccuccggggaggagggcagccaagacccagccgccccaaaccggaccagggcugugccacaggccgaguccuggcacuggaaguucucagccugcgccaccgcugccugucacaguuaugggguacgggggagggcccuuuuagcucaguuccaaaacagccaaacccaaccaaaacaaaacaaagccagcgcgcuccggggugugacuuagagccaggacagagggugagcgccuggagcacuuuuuugugucccaggggaaauggaguggaaaugucacguauaauauuccccaggauaggggaaucuucgggaccaaggcucugcaguaggaaaguauguuuuauuugaggguuuuguaacuaauggcgggauggaggagugucuaucucagcggcuccccacgguagaccuuugucaucuuguguaaucuggauggccgcuguggcaaacuauuuugugacaacaggaugaauaugaaagauaaagauaagguccacaccgcucugggagugcugggagguggcacacggggcaguguucggugccccaccucuccaccuacucagaacguuuagauucuugcaacagcggcgugggcacuguauaaacauguuacacucuuuuccccccuggcaaaggcuucaugugcuacagcggggcagggguuaagagguggagcauaugggcaucuggagcugucagguggggguggcagucauggggggaacuaccuuauaaggacuggaauacaacccaggaccaaggcaacuuccugcuuuggcuacuaccacuuggucccuuuaccaacaccagucgaagagagugagagaugccagaugggcaucccaccugggaagaugccaguuagcccagacaggaggcuacuugucuuucuagcuggaugaaccugaccuucugguuucuguggucuggguuuggguguuucccaccaugcgaggucacuauccaccaggaauagcagaaacaauacuaagucacaaguaccaggaacucauuuuggauggguuugggaucuaaaguuuuguaauccugcuagcccaggcucggugagauuccuggguugauauucugagauuugaagcugggucccgugccugaaagauuuguuuaucuucacuuguuguuuucaccuuggucuucuuaucaguuucacuccaccccauguggugacuguaacuguucuauaggcuagacugacugcaagaccacacaacagcuccaccuccugccuuacuucuguuaacaaauauugguuguguaacugcuauguaaccacgcaguuuacagccauguuccaagugcaugcuauauggagcuguaacacuccccaaacaaacaacuugcaaaccuucugauggaaugcaaauguccaggcccugcagccugucaggucugagcagagagaccuggcucucaccugcaggcuagcauuccagguucuucccuguagaugggugaugauggccgccuuccuugugcuggggucauuaaugaguaggaaaggaauuagguagcuaguagucauuuaucauugucauugucacaucaaggugucacagcacagugugcugaggggcugcagaauauggugggaaggguuuccgcacgggauguagcaaaccagagauugugacuaaaaagaaggaaaagguggguucuagagagaugcucagagguuaagaacacuggcugcucuaucaggggacccagguucaauucccagcacccacauguuggcucauaacugucuauaacucuaccaggggaucuaacaucuucacacagacauacacacaggaaaaacacauaaaaacaaauccuuaaaaaaaggaagggaacgucugcccguggaagggagccaugcauaugagaccggacggcuagagagaauaaagcacuggcuggggguggggagggagcagugccugucaaauguccgucccugcugcaccucagaggucaggcaaggcccgauucugccucccacagaauucagugccaagaaggguuaagacaugcaaccuauaaauuaggaaaccuugagaaaaaagcuacggaagaagcccccggaguccuaaguaaaucccaagacaggagguagacaggggugaggggagaugcccucaaucacagggcugcuuugccuuagugcauagggcaucuauucccucccccaggacagcccccacaccuuauacguugcccugucucccccaagucuuucuuuaggagagugucccuacccugccccaucaugucgagacgaagccagcgccucacucgcuacucucaggaugauaacgauggcggcagcagcagcaguggugcgagcuccguggcaggaagccagggcaccguguuuaaagacaguccucucagguaagagcagagcaggcagcccucuuucuuuugcugcugcuguggauggaggcaagauacucagucaagaggguugauucugucugucuucacuccuguaaggacggcaggagccaggaugcugccuucucugcccacugugagcaggggccacccagccuccgguuuagugaacaggaaguggggagaagcaguuacacacaaaagccaggcaggaaacgacagaguugucguaagcugggcucacagcaaccgguugacuguggacagguguggugguccagccaccuuccccaggcccacacgucacaucucaucaugucacuggccaguggcucgggucaacgugccuugucauccugccucccugcagccgugugccccugaggcucuagcuaggugugggaggccagaucagguuuguccagauuuucaguuagguuacaggaacuccaagucccccuaggaagcaugggaaauuggcuuugaaguuagaagccugaguuggaugcugucucugucucuaacugacggguuugcucaucccuggugagauucagcgauggauacugggagcagggaaacaccugcgcuggaaguaguuggguuguuggacgccuucccacacaaaacgaggucacgaggguuauuggcuuccccuuccuggcugggcucacccuccugccucuccccucacggcugucccacaggacuuugaagaggaaauccagcaacaugaagcaccuguccccagcuccacagcugggccccuccucugacucccacaccuccuacuacagcgagucugugguucgagaguccuacaucggcagcccccgggcugugucccucgccaggagugcccuccuggaugaccaccuacacagugagcccuacuggagugaguaccccaggguucacucccaagaccugcuccccaaaguccuccccucucaguguccccgaggucccucagaggaugaucccugaaugccccucagcuccaggcccgccagggcggggccugugggaucucaguggagccccugucuccugccaggcggggaccuucgggggaggaggaggagaggaacaggugguucugagagcagcaaggccaaugggcucaccgcggagagcaaggccucagaagacuuuuucggaucuuccucaggcuauucuucagaggaugaccuugcagguagguacugcuuugugggcucuagggcgaugggggacauagggcaaggggcacccugacagugugacaucucaugucacaugucaugggccauggacaguuacagcuucccugagagagcuggggauagaguuucagugguagggaacuugccuauggaacaugcggccuugggaguguguguuugugucugugcgugucucugugugugugcauguguguguaugugugugcauguguguauaugugugugugcaugugcgcgcacgugugugugugugucugugugagugugugucugugugugaguguguguauguuucgcgcguauaugugugugcauaugugugugugcgcgugagcguguguguauauaugugugugucuguguguaugugcaugugugcgugcgugugugugugugugugugugugugugugcauaccuuauugggugucucuacaucaaagcucucccuucuggcccaagaugucccucaccuaguacugugugugucugaaggauccucccucacuggucugugagugacccagaaccacaccacuguguuuuaggcacuucugucuggggcccaaacaugguuaauacccagccauuucuggucuauguccgagcaacucccuaaagauuguugcaccccaaggcagagggaaaauaaaaugucaaggccuggggacuuaguucaggaggcacagugcuaaagcaagcccggguccuagguucaauccccagcaucaggaaaaagacauugggaacuucccaucuccucacuucacaaacauuccuggaucuacugugugcugggccagucugacacuugggcagaggaugaguggacuuagcucaaggagaaaucaggugccacgccugcggcucgaagcagucagugcuauuaaggaacuacgcuuguauuccuccccuucccggcaggcuacacggacucagaccagcacagcucgggguccagguuaaggagugcagcaucucgggccggcuccuuugucuggacucuggucacuuuuccaggugcgugcuggcugugagcuagacaacucccuuacuguggcugugauugggcacccgggcuacagaaucagggaaggccugcagugggauaaucccugagagccaagggcagugggaacccccuagcagguuugagcaggagccaccucagaacaggcugaguuauauuugacugggcagguagacuuggaaagaggucaccauggagugggacaaagggggcugggcaaggguugggcaagggagcacacagaggggcaaggggcaauuugcuaaauaugaccgagucuuaggcuuaauggccauuuuucaggccgccucuuuggucuucucuacugguggauuggcaccaccugguaccgccugacaacugcugccucccuccuggaugucuucguccuaaccaggugagugacacuccagccuugaugaagaaccagaaagaccugguaccacagggcuuaacagagcaucuaggcuugacuguggcccaccauuccuuauuccuugaagguuccccaggcuacaucgagccuuuggcgcaggcaggcuuucccuccuaguugauaccuucuagcagugcucuggaacacagguucuugcuucaccuagauccuuccuaagaacaaccagacccuuccaauccucagagaaaggguggcuucgcucccacuggcaaacugugaggcacuaacccucacaguuucucagaaguccugccucugucuuagacucgugacaggcuacauucuagagguuccugcccaugaucagaagucacgaagagacugaggaugcuguggggucauuccccaaguucccaaaccagcaggacagagguuaaggacuguguccccugggcagagaaaaaaggcuagaccaggaggggaucagggcaccucuaccacauccaugucgaaagccugagcuacauggagaguccgggucagccugggcuaccuaucaaacccuguuucaaaacccaguguguguauauauauauauauauauauauauauauauauacacacacacacauacauauauaauguauacacacacacauacauacacacacacauauauauauacacauacacacacauuauauauauauauauauauauauauauauauauauauauuugaggugguguggcuggaggcuuagcucagcacuuuccagcacuuccacaggaccccuguucaauucccagcacccacauaguggcucacaacauaauguaacuuaaguuucagggacucugaaaguaccugcacucaucugcacaugugugcacgcgcgcgcgcacacacacacacacacacacuuaaaauaaguuuuaaaguucauagaaccaaaauuucccgaugacucuuaggaccuacaaguaccauucucguggccugcucagucucagucccaugggaagcccagggguacauguuguaacucuaguucagaauuccagaaaagucugaagggacugagugcagagcagaggcccaggucccacugacgucugccuucugucuguucuccugagguccaggcacuucucgcugaaccugaagaguuuucugugguuccuucugcucuugcuacuccugacuggucugaccuacggugagcagggguggaagagagggaagcuagaggcagggguagggugaggcagaguuggagcuaauggugauugagcgggccaugcagagcccugggccugccuuuccuacuuccccagucccauccccaaguccucuacugacucaggcugcccugucugacagugucagggcugagggaggugccucaucuccugaucuugcucuugcuaguacagggagcuucugggaggaacacgcccccggaccgccgcuuucuggguagcgagcaagaacuccgagcuauuauuaggagcagcuauuuucucucuauuccaaaucaggacagucuguguggcuggauuguuuuuacaagaucaagugaaaccuuuggcugccuuuaggcuaggagcagccagaagggcgcugguugagaccguaagggcuacuuacccacagcucugcccuguugugccugccacaggaccuucuugucuuugucuuguguauuccguuucucauuggacaauuuaacuggguuucugguuucaugugaauuggcuguguagaccuaggcucacuuuaaacgacugcagccacaaugcuuuguuagugugguuuuuuuuuagagacuugguuugguuuuauagucuuguaccucuccuuuuuuuuuucuuccuguuuuugagauggguuccuguaacucugucugucuggaacucacucugaacaccaagguggccucaaagucacaggucugccugccucugucuccugagugcugggauuaaaggugugugccaccaucaucuggcuucuuuuauuaauaaagagggcaggacauuuuuccaaaugucgguuuccuuuuuguuucccguuacaagaacaacuuguuccuacucaguggaaacugggcaucacccuuaaaguaacauuaccuuauuacucauggcagugcaguguuuauccugcuagcccuuucccagguauuaaacacagcucagucuguaccaauuccuugugguugauagagaugaugucacagucagagcauguggagauucaaggcgagagggcccagaccugaucagggaguguguggucauguuccaguugggacuucaggucuaguggcuuguguauguucccuuuccugcccugcucauagccgagaaguaagaggcaacugugaaauuaggcgcuguuucucuaccgcugcagucuugggccccgacccugggccccaagugggugcuguguucucugugaugcccagccauggagccagagagagcuaagcccacacacaaaugccacuugagccagcuaacccuucuggacagggcagucaacgcuaguuguugucaaagcucccaagggacuguucacugaacugugagggcguccauccaggccugggcuccaccccugagaaucuguaacugguaaaggaaggugcuuucuccuaaguauaacugucugcggaaugaguggggacacaggagcgaggugugagcaugaaggagcugggaggccaugggcugucacuuccaccucugguagagcaagacucacaaugugugacauaggcugugaccaagaagauucuaaggacucucucccugugccuaggugcuuggcauuuuuaccccuuagggcugcagacauugcaacccgcuguggucuccuggugggcagcaaaagagagcaggaagcagccagaggugugggaauccagagacgccucccagcacuuccaggugaggcugagggugcugaggguggggagcucuccagccuggcuuugcagguuggagaagucacacaaaacucacacaaagccacaaaacaacaacacccuuccugggcuguuggaggucaugggggagcuaacuugccucuaaaggcgacucaacaacccaaaaguuauguacauccucagaaagcagaaggaagggcuggcaaacggccuuguugcuuuccaaugugauuucuccauacugccaaggcuuccguguguaacauccugaccagguaccucccaccccucccccaacucacacuguggcuuaagacuucaaguauauaguagucugugagucuggaggaaccaguaggcccuugugggcuaugccaggacagucugugcuaguugcuuagugggccagcuggcccagucccucacagggacaacuaacugccccugccugaucuuuguucucccaucgagcuagccuggguuugcucccauagguguuuucuagaaggggaaaccacccaggugaguugggacuuggggaagcaaauggcaggaccagagcggguucgaggagggggaggcaaagagccugcuaggucacucugcagaggcuguagucaugggcaugggacaguagccagggucuuagauuagggcaggucuagggugugcucuucagggcacagucgagggugacauguggacguagaaccagacuguaauagaaacacagguuaccugacacucugucccccggcuggggugcuggcacagcgcacagccugcuugcugugcgguuaugagaccugaguucauaucaccaguacgacuagcacaggcuugugacccuggugcugggaugguggggugcagucagguggaucuccagggcuugcuugcugucuagucagucuagcugaaaugcugagccccagguuaaaugacucaaaauauaaggugggagcugggugugguggcgcaaccuuugaucccagcacuccagaggcagaggcaggcggauuucugaguucaaggccagccuggucuacaaacugaguuccaggacauccagggcuacacagagaaacccugucuugaaaaacaaaaaacaaaaaacaaaacaaaacaaaaauauauaugguagggagccauagagggagacaucuaaugccaaccucuggcuuccccuugugcaaacacaagcaaguauaccugcacauacaugugcacacauacauauauacaugugcauacauacauacauacaugugcacacacacauacaugugcaugcacacacaccuacauacaugugcacauacacacauugcacacauacaugugcacacauacauacauacauacaugugcacacauacaugcaugugcacacagguguuggaaguuaagaucugguucuuccucucagucccaugcgccuagaaauaggacucagacucaaaauauuuacaaagaccuuggucauauagcuaggucuucucuuacuggaucauaacuaaaauaacccaauuacuuuuaaccuacauucugccauguggcugguuaccugugcuuggguaccaugcaucuuaucuccucacaucuucccccagucaaucuccugcaccuggccuauuccagaauucuuucuccuuccagaugucccacauucuauuuccugccuaagccauaggccauagccuuuuuaauugacaggugacgcauccauacaauccacaagauacuaucuguacacacaugcuuacaccacauacaagaacauggcacacacacaaaccuauuggucuuagcagggcaugguggcucacaccuguaguccuggcacuugggaggauacggcaggagaaucacauauuugcagccugggcuacauaguaaacugcaggagagucuggacugagugagauccuuuuucaaugaaacaacccccacccucccaaacucuuaguucucuagugaagugaacuucgccuguaucagcugaauuaagcuugccacauauuaaauauguucuagcacaguaugaucuuauuucuuaaaauuauggcauauucugucaucugcaaauuccuuuuaaaacugacuccugaagagaugggggcaauucaguccugggccaccuuucaugugacaaggggaagcaaggccagcagagcacagccaggaucugcuugugggcagacucagugaagacgcugcuuggagaugugaugguggggcgggcugggcgggcugggaaugggagccugugcuugcugccuugggaguugugcaagcauguuuaaaagagaaugccuacaacccaagaccucugccccaaaguccuuugcccuuuaaaggacaguugguagauuguguuuuguaauuucccuuggcaaagauuuuguuguuuggccaacaguuguccucauauucaugacauacuaucaggugcaccguucguuagcucugaauggcuguuacuacagcuucucuagggcauucguuuaaaugaggaaaaugcaaaccuuuuaaaccguuuccucuuugguauaauuaucuauggaagagaaaagcaggugaaagccaaaagcugccucccccaccuuauacagcucaugggggggcuuccuagcugggccccugugaccauccuacagauucacaacauuuuccuggccagucccugugcucacacucccucucccagcuguguuucccuccacguggggaucugauggugacaacauguugaggggggcuggaggugggggagcccuccugcaaugcaugcccaggaucuccugccagaugcugcagcuaccagccaugucccagcugguuuugcccuguuuguguuucccuagagagacuuucacuaccacuggcuguccuggaacucccucuguagaacaggcuggccuugaacucauaaagacccacuugcucugccucccgagugcugggauuaacagccugugucacuaugcccagcugcccuaucccagcuguuccaguggccauacucgggaagccuguggugugcugcccugggcccaugcucugucuuuccucuggcccaccaggcugagcaucgcauacucgggaagccuguggugugcugcccugggcccaugcucugucuuuccuccggcccaccaggcugagcagcgcauacucgggaagccuguggugugcugcccugggcccaugcucugucuuuccucuggcccaccaggcugagcagcgcauacucgggaagccuguggugugcugcccugggcccaugcucugucuuuccucuggcccaccaggcugagcagcgcauacucuggaagccuguggugugcugcccugggcccaugcucugucuuuccuccggcccaccaggcugagcagcgcauacucgggaagccuguggugugcugcccugggcccaugcucugucuuuccucuggcccaccaggcugagcagcacauacucgggaagccuguggugugcugcccugggcccaugcucugucuuuccucuggcccaccaggcugagcagcgcauacucgggaagccuguggugugcugcccugggcccaugcucugucuuuccggcccaccaggcugagcagcgcauacucgggaagccuguggugugcugcccugggcccaugcucugucuuuccucuggcccaccaggcugagcagcgcauacucgggaagccuguggugugcugcccugggcccaugcucugucuuuccggcccaccaggcugagcagcgcguucucucccggguucacucucuggagcggcgucuggaagcccuugcugcagacuuuuccuccaacuggcagaaggaggccauacggcuggaacgccuggagcugcggcagggggcugcuggccauggaggaggcaguagccugagccaugaagaugcccugucucuccuagaaggguuggugagccgccgcgaggcuacccugaaggaggacuugcgcagggacacaguggcucauauccaggugggagaacauuguugccuggaggugggguggcacauuucauaaaggcaaugccauagaaaacccugacagucaugugggauguaggaggccccauggggcccgggggagaugguagugugucacuuagggccauuugccaggugcccugucaagaugaagaugauccgucuuccauggugagagacgugucaggcacaggugguauuccuuguauuucagagccuuguagauaagaccaggagcugaaacucccggaaaaaacccuagaaggaacccaguuagaccaugucuagucacaaguauuccgagggcagcugucaaacccucuuggugugguggugcacaccuuuaaucccaacacuucacuuagguagaagcagggagaucucugaguucaaggccagccuugucuacagagggaguucugggauagucauaacuauauagagagaugcugccucaaaagaaaacaagaagaagaagaagaaaaaaaaaacacccaaaacaaccaguccucauaucugguaggaagaauuggcuacccugagggcagagcaucaccaagacucggaagaucucuucaagaagaucguccaggccucucaggucagugggcuaggcaugcagcccugcacugggaucucacccaauuacaucuguccuugguucuaccauggauacugcugggauguugaguagaggggggugggauagucucaugccuucucuggggccugaacuugccuuggacagacgguccacagugaccccgggaugugcauggugcaaggguggugucugugcugaguguguugugcucagugaacauaaccuaggugggaaugagucugauaagggcugagacucacaggacuuccccugcuuugaucuuugcugaaagcgcuggggcacccguucaaggucgugguuaagcaaacacucccauguagaacucucagacuucucugaacucaucuuggcuuauucuugcccuuucuugcugcucuuaggaguccgaagcccgaguccagcagcugaagacagaauggaaaagguaauggcagccaccuggccauggccugcucugccaccccguuaggguucugccugguugacugagacuuagcuuaggauccugccuauggccucuacgguacaaggcagguugguaaggccuuggggaggcagggacaggcacggcagugaaacuggagccugugggcuggucuuuucuguaugccuucugcucuuaugaccuagaugugaaggcauggcaggcuguggcauugugaacugugcuguccaagccuacagagaaucaggucagaauuagcugugagacaggcaaacccaagcuccugggcuguguucuacugccagacuccaagggcagcccuggcacuucacacacagugaugggcuuccagcuuaugacaggagucagucaggggucccucauccuuccucaguguggccuuaccuugcuucccuccaucuggaacuagcaugacccaggaggccuuccaggagagcucugugaaggagcugggacggcuggaagcccagcuggccagccugcggcaggagcuggcugcccugacucugaagcagaacucgguggcagaugaagugggccugcugccacagaagauccaggcugccagggcugaugugagcgggaaguacccagagcccuacuaaucaccuccccucugagaccaccugccugggagggggcaucugucagcuggagcagcgucuuuggccuguuguucuagaggcgcaugcauggcugaucugaugcaggccuaggcucuuggggaaaaugcuuuccaaucccagucucuguucccuggagaguuccuagccucuaacaccucucucaggggcuccagccuucccuuccagcucugcuuccuccuccagugacagcccacccacccugucauagcugccccugccauuagugcaagcuucugagugacacugccuuugucuguagguggaaucccaguucccugacuggaucaggcaguuccuucuuggagacaggggugcgcgcagcgggcuccugcagagagaugagaugcacgcucagcugcaggagcuggagaacaagauccuuaccaagauggcugagaugcagggcaagucagccagggaggccgcagcgucccugggacagauacugcagaaagaaggcauaguuggggugacagaggagguaagggaugacuguucccccaacacgcugccucuccccuggaagucucacacugccagcucuucauguguguuaggacaugauagacccuccuggcuggagguucagguguagauucugggcucagugugugugggugguggaaugaacaaagccugcuuggguacuacuggugccaguucagcagggccaguucauggauaugcacgcaguaccugguaugccccaaucacaucccaugucugccuggggcauguuuuagcaggugcaccggaucgucaagcaggcccugcagcgcuacagugaggacaggauuggaaugguggauuacgcccuggaaucaggaggugugugugccuucaccaauucaccguauccugguccuuacacuggcgaggccccaggucugccaggcagcacagugcuaagcacacaaggcuugacaccagcacaaacuagacucccauccaaggcaaggguggcugagggaagccaugagccagaguggaccccuggcugggaauggcucugugagacuagguuagagcuaaggggugggccugaggaacuuguucccaugcucucuaaggcaggcaguagcagucucuucccuggccgccuuuuuaguccuggaaccacuaccugaguagugggccaacccacuuugagauuuaaaaucguucuuuccugugacaggagccaguguuaucagcacccgcugcucugagacuuaugagaccaagacggcacuccucagccucuuuggcaucccccugugguaccacucccagucaccucgggucauucugcaggugggcacucuaaacacagugggggaugcccgucucagucagccacagauggauuagaggcccuguucugacaugccucccacccccuccagccagaugugcacccaggcaacugcugggccuuccaggggccccagggcuuugcagugguccgccucucugcucgaauccgaccuacagccguuaccuuagagcacgugcccaaggccuugucacccaacagcacuaucuccagugcucccaaggacuucgccaucuuugugaguaccugaucuucagugggcuauguggggucuuugcugagagucacacugagguggcucuggcagugagagguuuaaaagagagccagggagagaccaugauguacgagggaggugguccucccugacuccucccugucugcuuuucuguagggcuucgaugaagaccugcagcaggaagggacacuucuuggcacguuugccuacgaccaggauggggagcccauccagaccuucuauuuccagguacagggcugugugcuugugggauggugccucacacucccagucaacaguagacaucuucuaggauccaguauuugcacuacccggcagaggaaucagggaugggccuaucuuccuacccugccuuacuucaggguauaggguggagaugacccucuccugucagugacacagauggcagcauccagagcuuucugaucaggggcuccgccgaagugaguuuuauuaaggaaggguugugacaaggaagugacugcgaaggguguucaagaugaucaaugugcagagagcuagggccucagggagggcacaugggugucagauguccuaguccucuuagaggcagauucuggagcuaggaauauaggucaguucauuuuaauucauuuuguuuaacuuuauuuuguguguauguguauuuugcugguauauaugucugugugucaucuguguacugguguccuaagaggccagaagagggcuuuggaucccuuagaaccagagugacagacaauuacaaguugccccaugugaaugccaggaauugaaccuggauuacauggaagagcagccagugcucuuaacugagccaggucuucaguccuauaacacgauagcuuuaagcagagcauacaggcuagacacuugagaaaaaagcaaacaagcuuccuaugaccauucuaugcacugauaaugcuaaccaugacuggggaugaauucuuagaugaacuacaauucacauauggcccaagggcugccucacugaggguggugacccuuaggaaccccaaaguccccaagggccuuuggccuggaaacucuguuccaggaaacagaaacuuuagaaauucagcuuuuuguuuuugucaugagcuccggggcaggagaccucuggcugcuggacugguucccugccccaccccuucuguugcugagguguuaaagcacucugugacucugaacccccucucuucucccuaggccucuaagauggccacauaccaaguuguggagcuucggauccugaccaacuggggccacccugaguacacguguaucuaccgcuuccgggugcacggagagccugcccacuagucuucugagaucuugggccuguugcuagccacgugggaagcucaucuuucccagcaucuacccugcucugaaaauaggugcccagcaccccaccgcugccugcacaugcuucuuagcgcugacuuccaggagcaagagugaagaggcagcacguagaacucccugcauaagccaagccaccaggcuccuaugccucucuuagucuucccccuagagcuaggcgccuaccagguguauauauguagcauacuuugggggacugcgaucagaagugagguggagggacuggcaccgguuaacuccugguaggugccaaagccaugggcauaccaagccagagccccagggauaagcuggggggucuuguggccuuuaggacagugcuuagcacugugcagcugggacugucccuggcaagugccugguaaaggacaccgaggcugcugagcucuuccagcauggaggguaccauggcccguaggagccugggguuccuagcaaacgggaggaaaccagcuccugugugccucugacgacuguugucugugccaaccuaagagauucccagugcugggaccacugcuuuuuuuccugauguggggugagggucuauucuguuucccauuccugcugcauccugccugugccccacagcaagcuuuccaccccccagggaggacccagcccuggcuuuggggcuauucugcaggguugucuagaggaguggggagaugacuuuggggguucuccugauucagugccaauagccacaguguggcucaagauacagguagaggggcuacacuagcccaccccauuuagagugguccugucuacucuacagcaacucucuugggcucucagcucuugcuuacacugcuuccuuucuggccucuaugguggcaguuagaugggggcugggagagagggagggagggagggagggagggaaggagggagggagacauuaacuuguguggagaggaggaagaggcuuuuagacucaacggcuggcccugcuguauuauauauagaauucucaaggucuguuuuuuguuguuuuguuuuuguuuuuaacugaaaaagccacaggcuugauuucuagccccauucugaggggcaccagcuguuacccaguuucuaguuccuggcucuugaggggcuugguccugccugcucuauggaaggggccaagaggagcugcaaggcagcccgguuaguguucgggugaaauggcaaguuguacagcccccucgggcuuguuuugugcucuccugucacaaaugcugcacuguugauucuuucaaaacaaaacgaaacaaaccucuccagucucuaauuuaugccuaugcaaaaaauaaaggaugcccaggaucau

SEQ ID NO: 7884 - RNA, 2227 nt, Mus musculus
ccugcucacagugggcagagaaggcagcauccuggcuccugccguccuuacaggagugaagacagacagaaucaacccucuugacugaguaucuugccuccauccacagcagcagcaaaagaaagagggcugccugcucugcucuuaccugagaggacugucuuuaaacacggugcccuggcuuccugccacggagcucgcaccacugcugcugcugccgccaucguuaucauccugagaguagcgagugaggcgcuggcuucgucucgacaugauggggcaggguagggacacucuccuaaagaaagacuugggggagacagggcaacguauaaggugugggggcuguccugggggagggaauagaugcccuaugcacuaaggcaaagcagcccugugauugagggcaucuccccucaccccugucuaccuccugucuugggauuuacuuaggacuccgggggcuucuuccguagcuuuuuucucaagguuuccuaauuuauagguugcaugucuuaacccuucuuggcacugaauucugugggaggcagaaucgggccuugccugaccucugaggugcagcagggacggacauuugacaggcacugcucccuccccacccccagccagugcuuuauucucucuagccguccggucucauaugcauggcucccuuccacgggcagacguucccuuccuuuuuuuaaggauuuguuuuuauguguuuuuccuguguguaugucugugugaagauguuagauccccugguagaguuauagacaguuaugagccaacaugugggugcugggaauugaaccuggguccccugauagagcagccaguguucuuaaccucugagcaucucucuagaacccaccuuuuccuucuuuuuagucacaaucucugguuugcuacaucccgugcggaaacccuucccaccauauucugcagccccucagcacacugugcugugacaccuugaugugacaaugacaaugauaaaugacuacuagcuaccuaauuccuuuccuacucauuaaugaccccagcacaaggaaggcggccaucaucacccaucuacagggaagaaccuggaaugcuagccugcaggugagagccaggucucucugcucagaccugacaggcugcagggccuggacauuugcauuccaucagaagguuugcaaguuguuuguuuggggaguguuacagcuccauauagcaugcacuuggaacauggcuguaaacugcgugguuacauagcaguuacacaaccaauauuuguuaacagaaguaaggcaggagguggagcuguuguguggucuugcagucagucuagccuauagaacaguuacagucaccacaugggguggagugaaacugauaagaagaccaaggugaaaacaacaagugaagauaaacaaaucuuucaggcacgggacccagcuucaaaucucagaauaucaacccaggaaucucaccgagccugggcuagcaggauuacaaaacuuuagaucccaaacccauccaaaaugaguuccugguacuugugacuuaguauuguuucugcuauuccugguggauagugaccucgcauggugggaaacacccaaacccagaccacagaaaccagaaggucagguucauccagcuagaaagacaaguagccuccugucugggcuaacuggcaucuucccaggugggaugcccaucuggcaucucucacucucuucgacugguguugguaaagggaccaagugguaguagccaaagcaggaaguugccuugguccuggguuguauuccaguccuuauaagguaguuccccccaugacugccacccccaccugacagcuccagaugcccauaugcuccaccucuuaaccccugccccgcuguagcacaugaagccuuugccaggggggaaaagaguguaacauguuuauacagugcccacgccgcuguugcaagaaucuaaacguucugaguagguggagagguggggcaccgaacacugccccgugugccaccucccagcacucccagagcgguguggaccuuaucuuuaucuuucauauucauccuguugucacaaaauaguuugccacagcggccauccagauuacacaagaugacaaaggucuaccguggggagccgcugagauagacacuccuccaucccgccauuaguuacaaaacccucaaauaaaacauacuuuccuacugca

SEQ ID NO: 7885 - RNA, 16401 nt, Mus musculus
cuaaguuuaguuuuuggucguuuuaauuguaaaaaccaagacguuuauauaaauaagaccgcuguguaaaauaugauucacccuucuacuaaaacccuucuucccacacucaaaaagaaucuagaaaagccagcaagguaagaaguacaaaucgcaugcggucccugaugaagucccuggcaggccagguuucccugcuaacggggccucacggugagaucacuccuggcccaggugucucaccgggagcucagcaacacuuugacaagucgcucuacaccaccgcaccagccucggccacgcagcaguucugguggaaggggugugaaagguucauguggcccgagcugggagaaggggacaggaagacugugugauccucgggccaaugccagggcugugaauggcugguccaguaagauguggugggcuguucagucccgggucaggcuggggaaggggagagggaacuccuuccccagugaaaaggagagccuugcccugugucucaugagaggagucuccggcugauuccacauggccacuaacaacaagggcaggagauacuucccagcaguccuuggggcagaagggcuuugaggcugcugggauggaaggugggaccaguccauuucaaggagaagaaucccgugcuucacccucucaccugccacaccccaccccucaugcacacagagaugccuguccacagcucagagcuuggagacaaccacggggagccugggcauggagaggucaccaaguggacacucugggugcggcucaggaaacugguacacaaggacaaaagaaaagacuugacucuccuugagagagccaggcucugccuaggggagccuggggagcccccccccagcccagaggacaggcgggagagcugcagggaugggggucaggagcacuuccacacacacacggccaggguccccccgaaguacagguacaggagguucuucaccucgugggugaucucaaacccaaaccccucgccgaucaccacaugccaggaggagccgaacuucuuguccauugucuccuugaucaucuuugcagcacucuggaagggagagggugccgaucagggauagugacaggcacaugccagcuccuacaccagaaagggaagcguggcacugagcucuaggcagaaacaggcugcugcccuggccugaugucggucugccugcaagaucaccacagacgugucuacacaggucccuccugcaggggaacagcacccagacaccugucaggcaggugaaggugauggcuugaggaaggcugggcugagggcuggcugugucacucuggguuccagaucagcaccaacacccucccgcaacugcgaacccagagaaaagggccccaaggccucagaaacuccccagucugcaauggcucuccauucccaugcaggcucuucccgaaagcguccuucagcgugaaggggcuggagccccugagcauucauuguguccccaccaccucaauagcucaggaaagagguaccccgcucccccagccuacagacuagggcguuggguucagagccgacacagccgaggaggcuguagaggggacguggccacaccaccacccucuuucucaccauggccucauaaguggcacugcuguguugagacccguggccacagucccaggaccucgagcaauaccuguuguggagcugggacuccgcccuuucugaauggauggaugaaucauggauaaugccuggcaggccucugcucagggcugggauggagcccaagaagaagcccuagccaacagcccacuugaagaguccugggcagaggugauauggagacccuacuggccucccuccuucaggggcuagguguggcccuugguacccuggcuagaaccgcccucuucucucacucgccuuccagaauagggaccaccucuaaacaaggcucuagcuuuguuccagcaggacuguggaccuggcuacaggagccauccuaacacacacaggguccccagaggcacgaggggccaccugcacugaugccaauaccucauuguuguuggagaauuucucacaggcugugacacacagcuccauggucuccacgcgcaucuccucuggcauguccgagugcuagagacagggcagggggacaaacagagagaggcuuagcugggaccuggccuuccuggacagccucucaguuuuaagcuuacgguauggacacuagguggcuucccuggcucagccuugggcaagugauuuauuccuggcuggggccuacagcugggguggaccaggcaugauggcaaugagcuacaggcucugaagccugugcuucucugccagggacaugugugggagggagccccacuagaggaagcgggcucucuuucagagucagaagggaugaccgagccauuccuggggcccugcuccccucugcuccuuggcucuucuuucucaggcagugugccagguuccucuuccucccauauggaggcugggccuguuuucauccucagccaagccuuuccuccacacagcuguaccuugcaggggucugggugggggucauccccuccuugcgcucuggucccacugcccagguaaaccucgcuccuuggcuuucuugcccuggcauccagauuccauccuuagugagcaccuuggccagggccagccucacaccuccaccacagggcaugacuacugcaccucagucccugggcaaugggcggccuuagcacuuuccucugaauucacucuccuaagaacagcgagugauuuucuaaugacgugacacccuacaccuguccccucacugcuccuuggaccucaggacagaagccacauucuucaccauauuccucaaguggcugccagccaggccuacacaggcugaccccaccucacaucugccacuccucagaucagcaauguuggugacaacaaacuugucccacucagccuccucugcugguugcuccuuugagggacagauggcuccucggguccuugcaaggccugccaccuaacuugaugagggucacugaucugacuucuuccaggcacuggccucuguaccagcucaguuucucuuuacagcacauauugcccgccaucuaucugcccuguuggucaccaucucuacagcaccuagaccacgcuuggcauacagcagggagccucaacauagcuggugauugaauggauggaugaaagaaugaaucacugugaugguuaauguuugggguggagccaggccagcagagcccuggucuccucacugcaaguuccacccaccugcaggcagugaggcccgguggccacuucccucccuccucaggcuuacccugaccagggggaaggucugcagccguuuauagucagccuccucuuucuucccuucagucucucccaugauccucccagcgugcccucaggaggagaguagggcuuucaggaggugcugggcccaacaguuacagcgccccacgggcucgggaagcaggccuugccaacuuggcaggagcagaaaaugucuuuccccaaggggugcugcagaaaacaggaaaagcaggagggaagaguuggcuucaaaaaccacacauuacaaauuagaaaugucucagugacaaucugacaccuccccaucucaacgccucugccuccuuucccaaauggccagcaugucugcagacggagggugagucaacccgagaugcugcaagaacacacugucauugucaagacagauacuaacugugggccaggcccaggauggagcugagagcuaccaauuagcaaggacaguuucugagugucaaugacagccugucugguuugaaggaagccaaauacacaggugaucacugacaauuggggccugucacaaagugagggguccuuucugaaggacccugcucugcagaauaggaacaguguggugguggccuucuuggcacaccaggugccuugacagcccugccuccccuccccaggcuauuagguccugucucucuagcugguccaggagcuggaaggcccgggugcuggcaccaguucagccaaugagcagcagcacagccuggggcaaaggagaguccaugccaaguggacucaccagugacuggggccacacccauggcagggaacucaaugagacagggcgugugaagcaggcaccugggugucaggcaggcaguggcuguucccauccuuuggccaccagaggacucaaugagaguucuagaccuucccucaugccccacccaagacaggguuuccagacucuuucuagacucaaggcccucccuaccagaccugggcaucugaugauaggcagggcuuuucagagucagcuggacugcagcuuaaaugagcuuccggccugcaaaagucaggaacaauuucauuauucuagaaugaaaucaaagggcuuccucucucgggguccugaugugcaugcgugcaaaacacugcaaugacgaaccauccucggcaguucacagaggacaaucgagacuauacaucacagcagcuugucugaaagcuagaucucauuagauuccaccacaaagccacugaacuccaagaugcccagcaugguaaccaagagguauagacacaaauuuuaugacagcggcuguccaagcuggcuuggaacuuuugaacucaaaugauccuccuacuucagucuucaaauagcugggaauacagacacaggccuggagagcaggugacaugggcuagcugucacaugucagcccagucccagcacucggucuuugugcagugcucaauguugacugccugaggucacucagcucaggaggagcuacuggcuacagcguuacccugaacagcucccucucuucaugcacucgagcacauggguccuugcugcacaugugaccgugaguguggcucagaugaccugcagugauuuaagugcuccaccuccuuccccgagccugcgguccugggcugcgauuuggccugguagagcacuggguacucucuccggcuacacuauacucuuaauucacaccucucugaugcugccgccacuguuguuccucccucccccccccccgcccccccacugguggauacccuugagcaaggcucagagcuuggcauggacuccaccauuccacgacacugguguuuucugacuucacagggcacagauggcucccuucaucuuccaacucugggcauuuguacaaguuggguuuuagcagguuuuguuugucucuacauaggagcuggcuguuuaccaagcacaagcucacugcaguuucuggucaaauuucuuguuccacgaaauccagugggccacucgucucugcuaaccagcauuaaagccugucugccaucuugagcucccagcuuuaguaacgccacuucacuggcuccggagccacccucaugcggcacugcacggggugccagggcucuccacuuuguuuaccucugaaaaucccaaguggaagcaacuuaaagugggggagcagcugcucagcaucuuccacuuacauguuucaacucaaguugauucauccucaaaacuaagaaaggcugccaggcaggggacgggcgggcgguggguggagggagacgacacagaacccaucaugccuauggccucaaagagacucuauggaggcucacaggacuccaggggugcuacuagagcccauucuucaggaaaauccccagcacaguucuagggagcaacagcauggcgaggcgaaugcuaagucagaccauuuaugccuaggggcuguggguauagcaaaguacuugcuuacgaggcgagaggcucugaguucaauccccaaugcugcaaaauagauauauaagccacgggccaguaauagaugccgguucuauaagagaauggaguucugcccacuuccuuggcuuuggaggcccgaacaagggacugcagccaggccuggguuucuccuuggagguggcugauacaagccuccugugaauggugugaaacacccgcuguucugcaguucuggccgcucugcccucuagggcgauccuuccuccagccaggacucagccaacaucauucaaccaaauaugcuauggaccgugacucaugaacacacauagcuuuuccuaaucacugcauagacuccuggcaauccaaacggguaagacuuacagaggaagagggguuguuagagaugacgcgcuuccacacagaaaggaagagagauucuuaugacccuguauucuggugcagcuccaguucuucagccacgauuagcacacccugccgaacggaugcuucccaaaauagcacaacugggguuuuaauaaccuuaucaaucucccgugugaaugagcacacgccugagagaggcugcgucagaccagaccacauuuuaauaaugaaagugugccacagucaggguaccaaaaguucaacugcaugccaccugguccaugguggaaccugcucuccccacaggaauccuuuaguguuccauggaaccccacccaggacguauacacagggcugccccauagccuugucaaagccagugcaccugucuggaagguccugguucuuugugacacugaccuuaaaucacuauuagucacucuguuucugaguauuugaggagaaucuuuaagagagaggacauggucucuggaaaguaaagccaaaaguaucugucaacuguaugugcauguaugugugugucguucaugugcauauguguuaacacuuaaugcuuggaacauucuuggccuuuaggcuuauaaccacuacauaaccaagacacuacgggacccuuuuagagugugucugguaguguuggcugaaccaaagucagguucagcaggugggucucaauucacaucaguucugauucugacagcuacucaucugcauguggggacugagcaggcgcuaccucacaggaaggaucagcagcuguugcuggggugacaggaaggggaccuuugccaucuaucuucccaggagccaaccauacaguagcauuuggcccagcagacugcuacuuccucauucccacugagggucagccucugcuuucgcacuggagggaaagucaggaggccaccagugaagccuggugggccgauggaggcaguggcauggcuacauuccacuucaccuucgcauuugcugcuucacuucaacaacacaagagcuccccggggaacuggcauccgacucucaggccucuaagggaagggagaacacggcaggcagcugagcucaccgagcuuugguagcugacccgagagugcacagccauuugugggccaggaucugaguccagauccagccuccugacuacaccuucagugaaauaacuccaauauuggcaucugccaggucagccaccuauuguaccugccucccaccucuaccaacaggggguggguucugcgaccaccacagucagcagaguaacaaacgggagggaaaggaaguuugcuucaauaugacuaaguagcugcuguugguucaaacuccuagagucugaccuagaguaguuuauuuuaggcauauuuaacaauagcacagcauggugaaaauguucuugguggugauuaacucaaucccaugcauacaauaaagcucaaggcaugacugcaucaguccuuuguaagguacaugugacauuuuccauaaagaugguucuguaguuugacaagcucaugauuagggucuuggggaagagccagugugauccagcuacacagauaggacaacaauccccaggcuauuagccuugucugcuuccagccuucugggcaggauaccagguuauacauuccuuccuuuaaagaaguaaccuuguuuguuuaauacuccagguucccuuugcuuaucuguaaccacaaggaccucucuggugcccacaucucccccuuuuuaacauuuuaaggagaaaaugguggcuauaauagaggccacauuugaaugccuugccugcauagcuagucuauuauagacaagcauauuaauuauaaggcuagcuacagaggaccaagggaaggggaaagccaucccaaccaugcuggccauucaaaaaucacuugagagauguugcuuaucgcuuuaugcagaacauuaauuuagccacugauaguaugagaacaaucuggcacauuaaagcaaugcaugcuccaaguaaaucuuggcgacuaugcuugagcaacagcuacucuacagcagcucuuugcaaaacuggcuucuccaggccucccacaugcccauacgagggacaugcaucgggucccuuggucaucacguaacugccuuuucugacaugcucacccucugccucuacaaacaaaugagaacaaagcuaacaagaugaggaaaaggguccagggacaccaacagucaggucaggagaggauaaggguuacccaggucaggccagagugaggcgcaaagccagggcugccgggcugccauucuccaaccugacuguaagaacgucagauuucuguuaucuagcugggugugguggcacaagccuguaaucucagcacuccgaggccagccuggccuauaugguaggucucagaccaaacaaggcaacagacugagagccuaccuuccccaaacccuucccgauugguuuuuccaaggcaggcuuucucugaguagcccugacucuucugguacuugcucuguagaccaggcugcccucagacucacagagaucugccucugucuccagagugcuggaauuaaagguguacaccaccaacaucuggcaugacaccuugucuuaaaaaauguuucuuaaaguaaaaagaaggaaggauggaaggagggcaggcaugcaaaggcaaucagacauaggcaggcaaggauagguagggauaggcagggauaggcaggcaaggauaggcaggcagggauaggcaggcagggauaggcaagcagacacagggaggcuggccagccaucaugugcuguaaaccagagaaagguugacaguaaggaggggguaacuucagccuuuaaaaaaaguuaccuuucuacauauacaaaagcugucuuguuagcuuuuaaaaaggucuuuacuuuuucucaaucacacugaggccaagggaaaacuucguuaugcuuugaucauggagagugaggaagaagagaagggaaggaaggggaggaggggugggauuagaagagacaucuguugacucguugagcuaggcgacucaacauuuucuuuguccaacaccucgugcuaaacgacagugacucacaccguacacccccauggacaugcccaaauuuggaugcguucccaaaccuuuuuguaggagacaaguguaauaaaaaguaauaaccauggcagccgugggcucugcacaagagcagcugcuuacggcacgguuuacgcaggcucccgccccacuucuucuacacucagcagaacagauuugaacgaaaggaaugaaaggugacgauaucacaggaucaaacugcacggagcacugauuuauuuccuaggaaaccgcugacaacugcuaagcagcagucacaccuuacaagugaucacauucucaccacgugucccgaguccggaccauaccccgcagcucggggaugcagucuccuuuacuaucccggaaugaguauuccaguggcaggcacauggcaggaguccaaaagauauccaaaauguaguuaaaggauauuucagcagccuccugagaggggagaggaccauucaaagccauccaauaaugcuaacuacugcagcugggauggcucggccugguuugccgcacaaccaugagggcuugaguucggauccccagcauccacacagacggcuggguguagagcuggaaagauggcuccccggguaaaagugcuugcugcggaagucagacaccugccuucaacccccagaacccaugugaaaggagagacccagcuccaaaaaguuccccuuugaccuccacgugcacacugggggagcaugggcaugcucgcacccccucuuucucucaugcaugagugcacacaaccagaguguuugggugcugugcuaugugccuguaauccuagagcuggggacacagggacaggaggauccuggggcuuguuggccagccaguagagucaauuagugagugacagguuugaagagaaacccugucuaacaaaaccauaagguggugagugauugagaaaaauagcagucacccaucuuugaccuccacacagauguccagacacaugugcaggcacuccuacacauagaacauguaaacacacacacaauuuuuagaaacauguauuuacuuaacacugaucuucagccagagcccaggagaaggauucuacacacaggcucucaaaaauucaucaccccccaaaaccugucagacagacacaaucucuucucccugugucaguuaccacugaggagcacacggccugagccuagcaaagugacuuuccauccagcugagacacggagggccacagccccacaccaaguguacacgauuucaagaccacgcuuuugacaacuccacuauaacuaagcaagaggcaacguagaugaaaacugacccaggaguugugguuuguggcagaaaggcccugucauaugggcauaggaggagacuccggacugagaagcaaugcaguggacccaagagaaaguucaaggcuucccaggacugggagaaagaacacaauugagaaaggaggggggaaaaaaagcuggggguggguuguggaaguguagagagcccuaaaacccaggcauaaaaacuuggauucuacuggaugcucacagucagcuauuggauggaucaugggauccccaauggaggagcuagagaaaguacccaaggagcuaaaggggucugcaauccuauagguggaacaacaauaugaacuaaccaguacccccagagcucgugucucuagcugcauauguaucagaagauggccuagucggccaucauuggaaagagaggcccauuggucuugcaaacuuuauuugcuucaguacuggggaacgccaggaccaagaagugggaguggguggguaggggaguggcgggggaggguaugggggacuuuugggauagcauuggaaauguaaaugaagaaaauacuuaauaaaaaaauuuaaaaaaaaaacaaccuuggauucuguuuuugcucucacauaacacaggguggcuuugaacucacugaaccacugagcuccugaugaccuugaacuugugauacugcugacacagccaagcccuuggguugcaagcaucacgaccuugccuggcuucuuggagcuuucaggguggcuggcagcacagagguuggggaguuggauugacagggauggcagccaggaagcuacagcgaucagcccagaaaacaggccuaagaggccagaauggucucaggaauggggagggugugauaccccacggagagagaaucaagguaacuugauaacuuucucagagggaugagccuaccagagcauggaagaaaccagguagaacagauaggcaggccagcuugaugcuagcagcuggcaaaaugcaaauggagacauuuagucaggaggaaaagauggcagagucauggaugguuggaaaagggaagcuaugaauccucguaucacuguaccaaccucuuucaguuuccucacuccuguaccccaagaauuccuagccacaggggaagagcagagccagacagcaggccugagguucaucugcagacaguggcuacugagugggauacugcgcaggaaagcacugggcucuucccaggagggaaagugugaggucauaacagacaaaaagaagaaauuaggggguggaggucaguuuauaaagugcuugcuacaaaaguaugaagaccagaguuuucuaucccagcacccguguaaagggcugggugaggcggccaugccugugagcccagcauuggagaggcagcugagaggauggauccuuggaagcucauuagccaugaagcccaguggugagcuccuggcaucaaagagggagacccugucucagacaauaagguggagagugauugugaaagacaccgaauguugacuuccagccuccacauguaacugcacacacaggaacgcacauacacacagaaaaaagacaagugagcaaguaccgucuacacuggacuggacccuuuguacuucauuugccaaaggagaugaacuucagacuauuggcuuuauagaugcacugacuggugcccagagagaucuuagguaguucuuaccaaugggaauccaacuuaaguuugccaaauucuuugcauuacauaaaagguuaggagaacacacauccuaaggggcguugacaguuaagucccacaacaucaugcuaggacgucagaguccaaaaggccuuugcgaccauucaacccaauuucgacuuuauagaugggaagacugagugccccccgucgggcaauagucagccuagaaucccagaguaucgccaaaucuccaaaccaagugaucugggacgaggcgauuuagaccaccagucagcagcgagguggugcggggacaaagugcagugggagucaaaacagggaggaugcgagggcauggagcuaaacaggacccaagaugagugaggaggagcggccugcaaaguggugcuggugcgcaaugucacugccaagcuccguggucuccuacgugggacaaggggagguccugggccgggaaccgcgggcuggggaccuagguggggccuagcguugggccaggccuuguccgccccgcgcauccucccgcccucccucagggccagcccuccccgccgcgcugcccuccgcacuccgcgcccucaccugcucccgcgggggccggagccgaggccacagccagcgcacccccgccaggguugucaaggagcgagccagagugucuuagcaaccaucacggaagucccgucccgucaccggacguugacagcaauaucacuuauuauugguguagagaagugccaauuaauuccgaaggggccuaggaggccggagcuuacgcgaggggcguggcuuaaagaccgaggagguggggcuucgcucauagucgucuuaagccugccggagcagcugcggacaggcagaaguagucuuuguagaggaacaaacuucuuaaagcuguauugcccugggaguuuucgacaucgaaaaugacaaaugcaguuuguuggugucgugacgcugaucugcuauuuuacgacgaccgcaggagccugauaaccaccagaacuuagguaguguuuuaguccuuuacagugagugacugucucauugauucgcaacacagugcuuacuguuaacagcauccgugaucccgucugggccaauguguagaacuagagagacugaaggaaagaaucaaggcauaaccucagagaaggaauccagaucuuucccuugugcaaacccuccaggguugcuuugucccaggggcugggagacaccuguaccaucagaugcaguugucuggaaccugcuucugauucuuggaaagaaaugaccaaagaguguuagagccucuugcugaggggaaggugaagaagaagaauggaucaguggaaugccccauaaucuaaacauuuauucuaugcguaucaugcaaucauuaaugaagccccacuagcuggugauucugcggaaggcacaguucagaagguauagagccaugagaagaaauggaaucguuuccgcgugcuucuauagcagagacuggcaggguacuggcucuuuuuaagugggacaacgaggcgggaagagcccaagaugaccagaaugcuaaugggagcgggacagcgguagcuccaagaggccugggugcagggucaacguaguaggagugcagggucaacauaguaggucaaguagaggggaagacaaagaaagaagcagggcagaagaaagagagguuugaaacacaaguggccccuggugugaggugagauagagucauugguugcuggagagcuuuggggagagugguaacaaggucugaucugggacaguggauuaaccuagcuugaguguacagacccagaacacacacauugggcuugguuugagacuuggcagcaggaauucagcucagcacacgacaguuccuagcuagccucccuggaaaguucugacugucuguggcgaaucuuacucagccuucaaauuuccuuaauccucuuuuccaacuuucuccaggagaugaagggcagccuuugagggggaugacgcucucacuucugucacuuacacaaacgacucccccaaagggguccuuguuugccauccucucuuucucgccucccauucauucucccgcccaccacaaucuggcuuccacucccacgauguuucugaaauucccucucuugugguuaccagugaccuucugaggagcaacagcaauuguuagaccaucuuccuucccugcuggcagcaccaaccgcagaaaccuucacacaguucucuaucacagagguaguaccuauagaucuuucugcagugcagauuccaggaucuccugcaacggaauggaggaucauaggguguuuuucugcaggcuaccuugugggagcuacuggguaacaggguaaccuggcucucuugugucccccagaccucuaauucauuuuuggcucccaucuugggcucuugcuuugguccuuaauauuacuguguuuuucugacaagugguuauuguuuccauaggaaaugucagccaagggcuuaugguuugcacauuugcuuuccagcugauaacacuguugcaggugguggaaccuuugggacaucagaccuagcugguaggcagcuaaggaacaugccuugaagguuacagcccugcccuguccugcccugcuuccugccuuccucucggcuacuggagccaccaagacacaggagccacauccugguugacaugauuccccucucuauuauaaugacacuaccucuggauuuuaaaccgaaagaaacuuuuuuucuuuuuuugagacagggcuuuccuguguaucccaggcuguucugaaacuuagaccaggcuggucuccagcucaaagaucugccugccucugccuccuaaaugcugggcuuaaacgcauuugccacaaugccuggcuacauugucuuugcuuaaauugcuucuaccagauacuuugucagauggacaaaaacaggaauaccuccucucuguuugcuugcauucccauccagugggguacuuacuggaacuguaggugggaaguggguacucuggaaauguccccuucuuccagggaguggcgcucuugauuugugccuugcugaggaaugcugcuuuaccacugucccuuuggggcucuaaggcccgcagcucccuuaauccuuguccuuuuagauuagcaguucucaaccagugggucacgaccccuuacagggaucaccuacgucuaugggaaaacacauuacaauuuguaacaauagcaagauugcaguuaugauguagcaaugaaaauaaugcuauacuugggguaucucaacagcaggaggcacuguauugaagcauugggaagauugaggaugacugagcuagguccugauugcuuugaucuuuuauuccccagguuaggucucuuguugugcacggaggcucagaugucccauagcauccuggcugucucuaccagaguggcccacaagcuuuuccaaguaguguguuuccagccuguucuccccagauuucccaucuggguaaaugacugcacucaucacuuaggugccuguagcacacaccaagcugucaccuuuauacuuucuccacccuagccuacuccagccagugacugggccucuaguccucaguccugccuccucacaggacugucccagcacagcaauacaacuggagccagugucauagaaacuacuuccuucccgggcugccaucuuuagcucuacccuucccuaguccuccauugcagucagcaagcuccuucccaaacccacgucauuuccuuguuaacagcuccuuccuguuggcccagaaugcaccaugagaucaagugacugccccaggucggaagucagggcucgccuuccuccugcuucaagccccuagcuguacaaaguaggagaaacccaacccuucaaggcucuuccucagcugaaggcugcuucucacugaucucucugcucccgggccccugcguucuuuucuggcucuuuauucucuugcucuacucccaugagccuauaaacucuugggaugaggaugcuaggcaaacauaagucccuuggguucucaccucucuguguguugcugaaaccu

SEQ ID NO: 7886 - RNA, 16401 nt, Mus musculus
agguuucagcaacacacagagaggugagaacccaagggacuuauguuugccuagcauccucaucccaagaguuuauaggcucaugggaguagagcaagagaauaaagagccagaaaagaacgcaggggcccgggagcagagagaucagugagaagcagccuucagcugaggaagagccuugaaggguuggguuucuccuacuuuguacagcuaggggcuugaagcaggaggaaggcgagcccugacuuccgaccuggggcagucacuugaucucauggugcauucugggccaacaggaaggagcuguuaacaaggaaaugacguggguuugggaaggagcuugcugacugcaauggaggacuagggaaggguagagcuaaagauggcagcccgggaaggaaguaguuucuaugacacuggcuccaguuguauugcugugcugggacaguccugugaggaggcaggacugaggacuagaggcccagucacuggcuggaguaggcuaggguggagaaaguauaaaggugacagcuuggugugugcuacaggcaccuaagugaugagugcagucauuuacccagaugggaaaucuggggagaacaggcuggaaacacacuacuuggaaaagcuugugggccacucugguagagacagccaggaugcuaugggacaucugagccuccgugcacaacaagagaccuaaccuggggaauaaaagaucaaagcaaucaggaccuagcucagucauccucaaucuucccaaugcuucaauacagugccuccugcuguugagauaccccaaguauagcauuauuuucauugcuacaucauaacugcaaucuugcuauuguuacaaauuguaauguguuuucccauagacguaggugaucccuguaaggggucgugacccacugguugagaacugcuaaucuaaaaggacaaggauuaagggagcugcgggccuuagagccccaaagggacagugguaaagcagcauuccucagcaaggcacaaaucaagagcgccacucccuggaagaaggggacauuuccagaguacccacuucccaccuacaguuccaguaaguaccccacuggaugggaaugcaagcaaacagagaggagguauuccuguuuuuguccaucugacaaaguaucugguagaagcaauuuaagcaaagacaauguagccaggcauuguggcaaaugcguuuaagcccagcauuuaggaggcagaggcaggcagaucuuugagcuggagaccagccuggucuaaguuucagaacagccugggauacacaggaaagcccugucucaaaaaaagaaaaaaaguuucuuucgguuuaaaauccagagguagugucauuauaauagagaggggaaucaugucaaccaggauguggcuccugugucuugguggcuccaguagccgagaggaaggcaggaagcagggcaggacagggcagggcuguaaccuucaaggcauguuccuuagcugccuaccagcuaggucugaugucccaaagguuccaccaccugcaacaguguuaucagcuggaaagcaaaugugcaaaccauaagcccuuggcugacauuuccuauggaaacaauaaccacuugucagaaaaacacaguaauauuaaggaccaaagcaagagcccaagaugggagccaaaaaugaauuagaggucugggggacacaagagagccagguuacccuguuacccaguagcucccacaagguagccugcagaaaaacacccuaugauccuccauuccguugcaggagauccuggaaucugcacugcagaaagaucuauagguacuaccucugugauagagaacugugugaagguuucugcgguuggugcugccagcagggaaggaagauggucuaacaauugcuguugcuccucagaaggucacugguaaccacaagagagggaauuucagaaacaucgugggaguggaagccagauuguggugggcgggagaaugaaugggaggcgagaaagagaggauggcaaacaaggaccccuuugggggagucguuuguguaagugacagaagugagagcgucaucccccucaaaggcugcccuucaucuccuggagaaaguuggaaaagaggauuaaggaaauuugaaggcugaguaagauucgccacagacagucagaacuuuccagggaggcuagcuaggaacugucgugugcugagcugaauuccugcugccaagucucaaaccaagcccaauguguguguucugggucuguacacucaagcuagguuaauccacugucccagaucagaccuuguuaccacucuccccaaagcucuccagcaaccaaugacucuaucucaccucacaccaggggccacuuguguuucaaaccucucuuucuucugcccugcuucuuucuuugucuuccccucuacuugaccuacuauguugacccugcacuccuacuacguugacccugcacccaggccucuuggagcuaccgcugucccgcucccauuagcauucuggucaucuugggcucuucccgccucguugucccacuuaaaaagagccaguacccugccagucucugcuauagaagcacgcggaaacgauuccauuucuucucauggcucuauaccuucugaacugugccuuccgcagaaucaccagcuaguggggcuucauuaaugauugcaugauacgcauagaauaaauguuuagauuauggggcauuccacugauccauucuucuucuucaccuuccccucagcaagaggcucuaacacucuuuggucauuucuuuccaagaaucagaagcagguuccagacaacugcaucugaugguacaggugucucccagccccugggacaaagcaacccuggaggguuugcacaagggaaagaucuggauuccuucucugagguuaugccuugauucuuuccuucagucucucuaguucuacacauuggcccagacgggaucacggaugcuguuaacaguaagcacuguguugcgaaucaaugagacagucacucacuguaaaggacuaaaacacuaccuaaguucuggugguuaucaggcuccugcggucgucguaaaauagcagaucagcgucacgacaccaacaaacugcauuugucauuuucgaugucgaaaacucccagggcaauacagcuuuaagaaguuuguuccucuacaaagacuacuucugccuguccgcagcugcuccggcaggcuuaagacgacuaugagcgaagccccaccuccucggucuuuaagccacgccccucgcguaagcuccggccuccuaggccccuucggaauuaauuggcacuucucuacaccaauaauaagugauauugcugucaacguccggugacgggacgggacuuccgugaugguugcuaagacacucuggcucgcuccuugacaacccuggcgggggugcgcuggcuguggccucggcuccggcccccgcgggagcaggugagggcgcggagugcggagggcagcgcggcggggagggcuggcccugagggagggcgggaggaugcgcggggcggacaaggccuggcccaacgcuaggccccaccuagguccccagcccgcgguucccggcccaggaccuccccuugucccacguaggagaccacggagcuuggcagugacauugcgcaccagcaccacuuugcaggccgcuccuccucacucaucuuggguccuguuuagcuccaugcccucgcauccucccuguuuugacucccacugcacuuuguccccgcaccaccucgcugcugacugguggucuaaaucgccucgucccagaucacuugguuuggagauuuggcgauacucugggauucuaggcugacuauugcccgacggggggcacucagucuucccaucuauaaagucgaaauuggguugaauggucgcaaaggccuuuuggacucugacguccuagcaugauguugugggacuuaacugucaacgccccuuaggauguguguucuccuaaccuuuuauguaaugcaaagaauuuggcaaacuuaaguuggauucccauugguaagaacuaccuaagaucucucugggcaccagucagugcaucuauaaagccaauagucugaaguucaucuccuuuggcaaaugaaguacaaaggguccaguccaguguagacgguacuugcucacuugucuuuuuucuguguguaugugcguuccugugugugcaguuacauguggaggcuggaagucaacauucggugucuuucacaaucacucuccaccuuauugucugagacagggucucccucuuugaugccaggagcucaccacugggcuucauggcuaaugagcuuccaaggauccauccucucagcugccucuccaaugcugggcucacaggcauggccgccucacccagcccuuuacacgggugcugggauagaaaacucuggucuucauacuuuuguagcaagcacuuuauaaacugaccuccacccccuaauuucuucuuuuugucuguuaugaccucacacuuucccuccugggaagagcccagugcuuuccugcgcaguaucccacucaguagccacugucugcagaugaaccucaggccugcugucuggcucugcucuuccccuguggcuaggaauucuugggguacaggagugaggaaacugaaagagguugguacagugauacgaggauucauagcuucccuuuuccaaccauccaugacucugccaucuuuuccuccugacuaaaugucuccauuugcauuuugccagcugcuagcaucaagcuggccugccuaucuguucuaccugguuucuuccaugcucugguaggcucaucccucugagaaaguuaucaaguuaccuugauucucucuccgugggguaucacacccuccccauuccugagaccauucuggccucuuaggccuguuuucugggcugaucgcuguagcuuccuggcugccaucccugucaauccaacuccccaaccucugugcugccagccacccugaaagcuccaagaagccaggcaaggucgugaugcuugcaacccaagggcuuggcugugucagcaguaucacaaguucaaggucaucaggagcucagugguucagugaguucaaagccacccuguguuaugugagagcaaaaacagaauccaagguuguuuuuuuuuuaaauuuuuuuauuaaguauuuucuucauuuacauuuccaaugcuaucccaaaagucccccauacccucccccgccacuccccuacccacccacucccacuucuugguccuggcguuccccaguacugaagcaaauaaaguuugcaagaccaaugggccucucuuuccaaugauggccgacuaggccaucuucugauacauaugcagcuagagacacgagcucuggggguacugguuaguucauauuguuguuccaccuauaggauugcagaccccuuuagcuccuuggguacuuucucuagcuccuccauuggggaucccaugauccauccaauagcugacugugagcauccaguagaauccaaguuuuuaugccuggguuuuagggcucucuacacuuccacaacccacccccagcuuuuuuuccccccuccuuucucaauuguguucuuucucccaguccugggaagccuugaacuuucucuuggguccacugcauugcuucucaguccggagucuccuccuaugcccauaugacagggccuuucugccacaaaccacaacuccugggucaguuuucaucuacguugccucuugcuuaguuauaguggaguugucaaaagcguggucuugaaaucguguacacuugguguggggcuguggcccuccgugucucagcuggauggaaagucacuuugcuaggcucaggccgugugcuccucagugguaacugacacagggagaagagauugugucugucugacagguuuuggggggugaugaauuuuugagagccuguguguagaauccuucuccugggcucuggcugaagaucaguguuaaguaaauacauguuucuaaaaauuguguguguguuuacauguucuauguguaggagugccugcacaugugucuggacaucuguguggaggucaaagaugggugacugcuauuuuucucaaucacucaccaccuuaugguuuuguuagacaggguuucucuucaaaccugucacucacuaauugacucuacuggcuggccaacaagccccaggauccuccugucccuguguccccagcucuaggauuacaggcacauagcacagcacccaaacacucugguugugugcacucaugcaugagagaaagagggggugcgagcaugcccaugcucccccagugugcacguggaggucaaaggggaacuuuuuggagcugggucucuccuuucacauggguucuggggguugaaggcaggugucugacuuccgcagcaagcacuuuuacccggggagccaucuuuccagcucuacacccagccgucuguguggaugcuggggauccgaacucaagcccucaugguugugcggcaaaccaggccgagccaucccagcugcaguaguuagcauuauuggauggcuuugaaugguccucuccccucucaggaggcugcugaaauauccuuuaacuacauuuuggauaucuuuuggacuccugccaugugccugccacuggaauacucauuccgggauaguaaaggagacugcauccccgagcugcgggguaugguccggacucgggacacguggugagaaugugaucacuuguaaggugugacugcugcuuagcaguugucagcgguuuccuaggaaauaaaucagugcuccgugcaguuugauccugugauaucgucaccuuucauuccuuucguucaaaucuguucugcugaguguagaagaaguggggcgggagccugcguaaaccgugccguaagcagcugcucuugugcagagcccacggcugccaugguuauuacuuuuuauuacacuugucuccuacaaaaagguuugggaacgcauccaaauuugggcauguccauggggguguacggugugagucacugucguuuagcacgagguguuggacaaagaaaauguugagucgccuagcucaacgagucaacagaugucucuucuaaucccaccccuccuccccuuccuucccuucucuucuuccucacucuccaugaucaaagcauaacgaaguuuucccuuggccucagugugauugagaaaaaguaaagaccuuuuuaaaagcuaacaagacagcuuuuguauauguagaaagguaacuuuuuuuaaaggcugaaguuacccccuccuuacugucaaccuuucucugguuuacagcacaugauggcuggccagccucccugugucugcuugccuaucccugccugccuaucccugccugccuauccuugccugccuaucccugccuaucccuaccuauccuugccugccuaugucugauugccuuugcaugccugcccuccuuccauccuuccuucuuuuuacuuuaagaaacauuuuuuaagacaaggugucaugccagauguuggugguguacaccuuuaauuccagcacucuggagacagaggcagaucucugugagucugagggcagccuggucuacagagcaaguaccagaagagucagggcuacucagagaaagccugccuuggaaaaaccaaucgggaaggguuuggggaagguaggcucucagucuguugccuuguuuggucugagaccuaccauauaggccaggcuggccucggagugcugagauuacaggcuugugccaccacacccagcuagauaacagaaaucugacguucuuacagucagguuggagaauggcagcccggcagcccuggcuuugcgccucacucuggccugaccuggguaacccuuauccucuccugaccugacuguuggugucccuggacccuuuuccucaucuuguuagcuuuguucucauuuguuuguagaggcagagggugagcaugucagaaaaggcaguuacgugaugaccaagggacccgaugcaugucccucguaugggcaugugggaggccuggagaagccaguuuugcaaagagcugcuguagaguagcuguugcucaagcauagucgccaagauuuacuuggagcaugcauugcuuuaaugugccagauuguucucauacuaucaguggcuaaauuaauguucugcauaaagcgauaagcaacaucucucaagugauuuuugaauggccagcaugguugggauggcuuuccccuucccuugguccucuguagcuagccuuauaauuaauaugcuugucuauaauagacuagcuaugcaggcaaggcauucaaauguggccucuauuauagccaccauuuucuccuuaaaauguuaaaaagggggagaugugggcaccagagagguccuugugguuacagauaagcaaagggaaccuggaguauuaaacaaacaagguuacuucuuuaaaggaaggaauguauaaccugguauccugcccagaaggcuggaagcagacaaggcuaauagccuggggauuguuguccuaucuguguagcuggaucacacuggcucuuccccaagacccuaaucaugagcuugucaaacuacagaaccaucuuuauggaaaaugucacauguaccuuacaaaggacugaugcagucaugccuugagcuuuauuguaugcaugggauugaguuaaucaccaccaagaacauuuucaccaugcugugcuauuguuaaauaugccuaaaauaaacuacucuaggucagacucuaggaguuugaaccaacagcagcuacuuagucauauugaagcaaacuuccuuucccucccguuuguuacucugcugacugugguggucgcagaacccacccccuguugguagaggugggaggcagguacaauagguggcugaccuggcagaugccaauauuggaguuauuucacugaagguguagucaggaggcuggaucuggacucagauccuggcccacaaauggcugugcacucucgggucagcuaccaaagcucggugagcucagcugccugccguguucucccuucccuuagaggccugagagucggaugccaguuccccggggagcucuuguguuguugaagugaagcagcaaaugcgaaggugaaguggaauguagccaugccacugccuccaucggcccaccaggcuucacugguggccuccugacuuucccuccagugcgaaagcagaggcugacccucagugggaaugaggaaguagcagucugcugggccaaaugcuacuguaugguuggcuccugggaagauagauggcaaagguccccuuccugucaccccagcaacagcugcugauccuuccugugagguagcgccugcucaguccccacaugcagaugaguagcugucagaaucagaacugaugugaauugagacccaccugcugaaccugacuuugguucagccaacacuaccagacacacucuaaaagggucccguagugucuugguuauguagugguuauaagccuaaaggccaagaauguuccaagcauuaaguguuaacacauaugcacaugaacgacacacacauacaugcacauacaguugacagauacuuuuggcuuuacuuuccagagaccauguccucucucuuaaagauucuccucaaauacucagaaacagagugacuaauagugauuuaaggucagugucacaaagaaccaggaccuuccagacaggugcacuggcuuugacaaggcuauggggcagcccuguguauacguccugggugggguuccauggaacacuaaaggauuccuguggggagagcagguuccaccauggaccagguggcaugcaguugaacuuuugguacccugacuguggcacacuuucauuauuaaaauguggucuggucugacgcagccucucucaggcgugugcucauucacacgggagauugauaagguuauuaaaaccccaguugugcuauuuugggaagcauccguucggcagggugugcuaaucguggcugaagaacuggagcugcaccagaauacagggucauaagaaucucucuuccuuucuguguggaagcgcgucaucucuaacaaccccucuuccucuguaagucuuacccguuuggauugccaggagucuaugcagugauuaggaaaagcuauguguguucaugagucacgguccauagcauauuugguugaaugauguuggcugaguccuggcuggaggaaggaucgcccuagagggcagagcggccagaacugcagaacagcggguguuucacaccauucacaggaggcuuguaucagccaccuccaaggagaaacccaggccuggcugcagucccuuguucgggccuccaaagccaaggaagugggcagaacuccauucucuuauagaaccggcaucuauuacuggcccguggcuuauauaucuauuuugcagcauuggggauugaacucagagccucucgccucguaagcaaguacuuugcuauacccacagccccuaggcauaaauggucugacuuagcauucgccucgccaugcuguugcucccuagaacugugcuggggauuuuccugaagaaugggcucuaguagcaccccuggaguccugugagccuccauagagucucuuugaggccauaggcaugauggguucugugucgucucccuccacccaccgcccgcccguccccugccuggcagccuuucuuaguuuugaggaugaaucaacuugaguugaaacauguaaguggaagaugcugagcagcugcucccccacuuuaaguugcuuccacuugggauuuucagagguaaacaaaguggagagcccuggcaccccgugcagugccgcaugaggguggcuccggagccagugaaguggcguuacuaaagcugggagcucaagauggcagacaggcuuuaaugcugguuagcagagacgaguggcccacuggauuucguggaacaagaaauuugaccagaaacugcagugagcuugugcuugguaaacagccagcuccuauguagagacaaacaaaaccugcuaaaacccaacuuguacaaaugcccagaguuggaagaugaagggagccaucugugcccugugaagucagaaaacaccagugucguggaaugguggaguccaugccaagcucugagccuugcucaaggguauccaccagugggggggcgggggggggggagggaggaacaacaguggcggcagcaucagagaggugugaauuaagaguauaguguagccggagagaguacccagugcucuaccaggccaaaucgcagcccaggaccgcaggcucggggaaggagguggagcacuuaaaucacugcaggucaucugagccacacucacggucacaugugcagcaaggacccaugugcucgagugcaugaagagagggagcuguucaggguaacgcuguagccaguagcuccuccugagcugagugaccucaggcagucaacauugagcacugcacaaagaccgagugcugggacugggcugacaugugacagcuagcccaugucaccugcucuccaggccugugucuguauucccagcuauuugaagacugaaguaggaggaucauuugaguucaaaaguuccaagccagcuuggacagccgcugucauaaaauuugugucuauaccucuugguuaccaugcugggcaucuuggaguucaguggcuuugugguggaaucuaaugagaucuagcuuucagacaagcugcugugauguauagucucgauuguccucugugaacugccgaggaugguucgucauugcaguguuuugcacgcaugcacaucaggaccccgagagaggaagcccuuugauuucauucuagaauaaugaaauuguuccugacuuuugcaggccggaagcucauuuaagcugcaguccagcugacucugaaaagcccugccuaucaucagaugcccaggucugguagggagggccuugagucuagaaagagucuggaaacccugucuuggguggggcaugagggaaggucuagaacucucauugaguccucugguggccaaaggaugggaacagccacugccugccugacacccaggugccugcuucacacgcccugucucauugaguucccugccauggguguggccccagucacuggugaguccacuuggcauggacucuccuuugccccaggcugugcugcugcucauuggcugaacuggugccagcacccgggccuuccagcuccuggaccagcuagagagacaggaccuaauagccuggggaggggaggcagggcugucaaggcaccuggugugccaagaaggccaccaccacacuguuccuauucugcagagcaggguccuucagaaaggaccccucacuuugugacaggccccaauugucagugaucaccuguguauuuggcuuccuucaaaccagacaggcugucauugacacucagaaacuguccuugcuaauugguagcucucagcuccauccugggccuggcccacaguuaguaucugucuugacaaugacaguguguucuugcagcaucucggguugacucacccuccgucugcagacaugcuggccauuugggaaaggaggcagaggcguugagauggggaggugucagauugucacugagacauuucuaauuuguaaugugugguuuuugaagccaacucuucccuccugcuuuuccuguuuucugcagcaccccuuggggaaagacauuuucugcuccugccaaguuggcaaggccugcuucccgagcccguggggcgcuguaacuguugggcccagcaccuccugaaagcccuacucuccuccugagggcacgcugggaggaucaugggagagacugaagggaagaaagaggaggcugacuauaaacggcugcagaccuucccccuggucaggguaagccugaggagggagggaaguggccaccgggccucacugccugcagguggguggaacuugcagugaggagaccagggcucugcuggccuggcuccaccccaaacauuaaccaucacagugauucauucuuucauccauccauucaaucaccagcuauguugaggcucccugcuguaugccaagcguggucuaggugcuguagagauggugaccaacagggcagauagauggcgggcaauaugugcuguaaagagaaacugagcugguacagaggccagugccuggaagaagucagaucagugacccucaucaaguuagguggcaggccuugcaaggacccgaggagccaucugucccucaaaggagcaaccagcagaggaggcugagugggacaaguuuguugucaccaacauugcugaucugaggaguggcagaugugagguggggucagccuguguaggccuggcuggcagccacuugaggaauauggugaagaauguggcuucuguccugagguccaaggagcagugaggggacagguguagggugucacgucauuagaaaaucacucgcuguucuuaggagagugaauucagaggaaagugcuaaggccgcccauugcccagggacugaggugcaguagucaugcccugugguggaggugugaggcuggcccuggccaaggugcucacuaaggauggaaucuggaugccagggcaagaaagccaaggagcgagguuuaccugggcagugggaccagagcgcaaggaggggaugacccccacccagaccccugcaagguacagcuguguggaggaaaggcuuggcugaggaugaaaacaggcccagccuccauaugggaggaagaggaaccuggcacacugccugagaaagaagagccaaggagcagaggggagcagggccccaggaauggcucggucaucccuucugacucugaaagagagcccgcuuccucuaguggggcucccucccacacaugucccuggcagagaagcacaggcuucagagccuguagcucauugccaucaugccugguccaccccagcuguaggccccagccaggaauaaaucacuugcccaaggcugagccagggaagccaccuaguguccauaccguaagcuuaaaacugagaggcuguccaggaaggccaggucccagcuaagccucucucuguuugucccccugcccugucucuagcacucggacaugccagaggagaugcgcguggagaccauggagcugugugucacagccugugagaaauucuccaacaacaaugagguauuggcaucagugcagguggccccucgugccucuggggacccuguguguguuaggauggcuccuguagccagguccacaguccugcuggaacaaagcuagagccuuguuuagagguggucccuauucuggaaggcgagugagagaagagggcgguucuagccaggguaccaagggccacaccuagccccugaaggagggaggccaguagggucuccauaucaccucugcccaggacucuucaagugggcuguuggcuagggcuucuucuugggcuccaucccagcccugagcagaggccugccaggcauuauccaugauucauccauccauucagaaagggcggagucccagcuccacaacagguauugcucgagguccugggacuguggccacgggucucaacacagcagugccacuuaugaggccauggugagaaagaggguggugguguggccacguccccucuacagccuccucggcugugucggcucugaacccaacgcccuagucuguaggcugggggagcgggguaccucuuuccugagcuauugaggugguggggacacaaugaaugcucaggggcuccagccccuucacgcugaaggacgcuuucgggaagagccugcaugggaauggagagccauugcagacuggggaguuucugaggccuuggggcccuuuucucuggguucgcaguugcgggaggguguuggugcugaucuggaacccagagugacacagccagcccucagcccagccuuccucaagccaucaccuucaccugccugacaggugucugggugcuguuccccugcaggagggaccuguguagacacgucuguggugaucuugcaggcagaccgacaucaggccagggcagcagccuguuucugccuagagcucagugccacgcuucccuuucugguguaggagcuggcaugugccugucacuaucccugaucggcacccucucccuuccagagugcugcaaagaugaucaaggagacaauggacaagaaguucggcuccuccuggcauguggugaucggcgagggguuuggguuugagaucacccacgaggugaagaaccuccuguaccuguacuucggggggacccuggccguguguguguggaagugcuccugacccccaucccugcagcucucccgccuguccucugggcugggggggggcuccccaggcuccccuaggcagagccuggcucucucaaggagagucaagucuuuucuuuuguccuuguguaccaguuuccugagccgcacccagaguguccacuuggugaccucuccaugcccaggcuccccgugguugucuccaagcucugagcuguggacaggcaucucugugugcaugaggggugggguguggcaggugagagggugaagcacgggauucuucuccuugaaauggacuggucccaccuuccaucccagcagccucaaagcccuucugccccaaggacugcugggaaguaucuccugcccuuguuguuaguggccauguggaaucagccggagacuccucucaugagacacagggcaaggcucuccuuuucacuggggaaggaguucccucuccccuuccccagccugacccgggacugaacagcccaccacaucuuacuggaccagccauucacagcccuggcauuggcccgaggaucacacagucuuccuguccccuucucccagcucgggccacaugaaccuuucacaccccuuccaccagaacugcugcguggccgaggcuggugcggugguguagagcgacuugucaaaguguugcugagcucccggugagacaccugggccaggagugaucucaccgugaggccccguuagcagggaaaccuggccugccagggacuucaucagggaccgcaugcgauuuguacuucuuaccuugcuggcuuuucuagauucuuuuugagugugggaagaaggguuuuaguagaagggugaaucauauuuuacacagcggucuuauuuauauaaacgucuugguuuuuacaauuaaaacgaccaaaaacuaaacuuag

SEQ ID NO: 7887 - RNA, 3357 nt, Mus musculus
gggccaaaugauggggcgggaggggguacauccagagauauuuuuuucuguuaagaagcuggaacgcccaugcaucaaucuaaaaaugggcucuaaagaggcagugucaacauuaucagucaccaaaaaucagucagguccccugaaagagcagucagagcucuucacugcugggccaucuccccaggcccuuguuuuuaaaacagaaucccaaauguuggauugaccaaugaaaacucaggagccaaaugccaaagugaaagccggccagcucagagaggcagagaaagcagccagcugaccuuccccaguuccccuucuccacacugucuuaaaaacccuuccaacugaaugucccucccuucuacuuccugugugucucucuaucugcccuccugacuuccucucacucucucugguuuuuuuccuguguucacucucuuuuaacugguugcuuggcuggccucuugaccugucuuugacuuuauuuaacucuuguuucccggaaagcucuuggauuaaaggugugugcuagggcugagucacaccacaacaagaaacaauuuuuuucuaguucacaaucucuggguucacaauguaaucaaauauccuucgacaccuggaauacagagccaggaccucaaugcgugggugucaggauccaugugaaguuugucauuuggcugguugguugguuuugcauagccaggagcucaaugauuuucaucagaauggagagaauaguggguguaagagaaagaucuucuacuaaguccucagaauaagguuagcuuucaguccuaccuguggagagggugggaagacuaacaggcaugguccacuaugucucaagaauaugcuagaauuuuuauuuacuccuuauggaagauuuauuacagauuucucuaccaagaaucaagcucaauaugcggguggagagauggcuuguagacgacccagguucaauucuuagcacccacaggguggaucauaacugucuguaauucuaguucugaaagacaauaccuucuugcagcacuuauggucaaaaagaagaaaaaaaaaaaaaaagucagguccaagccaggcaugggggugcaugucuguugucucagcaccugggaggcagacgcaagaagaucaggaauucauggucacaugugaugacacagcaaguuucaagggagggagggagggagagaagaaaggaggaaagaaagaaaaaaagagagaaagaaagagcucauggauaugaaccagugaguuuggggucugauacucaaacccaggucuccgucaucucuaaggucacauugucaccagugccuugcuauagacacuugcaaaaguggacccagggccugaaaaacuccuuggucagugucuagaaguaaaaaaugucagaaagaaggucacacaggcagggucuauuuuuaaucuggauguggagccagaaucucccgggcuaaggucaucgaggaggaagaggauccgcucuuaccccugcagggcccagaguucugcccugucucagagcuuacucacaucagguuucaggcagcaugugcaaugaaugacugccaacaacagaagucaucaggaaagccaauaaagaugucacagaucuggcaagaacaagaaauagcucaggugcgguacucggaggccaagggcaggcguuccuucaggucauggaugaaucagccuggcagccacucauccuucgacugggaucaaagguacagccagcgcacacucagaggaugccuucaaaggaugcguacuaauuaaagcauuuacggagccaguauccacucuggugggcuaagcacgcuccucugcuauuugggacggcaguguugccuuccacgcuagccacgccaaucagauuccuucuugaggagacgcucacaggaugguagguagcccugguucucuuagcucaucagagggaccuagaaggucauuggagaccugaggacacaaucugcggcaggaauagaguuccucuggaaauggagaaaacugccuuagcaggaaauagauugaagaaacugaaagaauaaagaggagcugccucggugggugccacagaccaggcucagucgggccccccucaauccaugggaaucagggucucggacagaugggcauagaguuggcgaaaauggggugacaaacagccaggacacaagagagugugaugaaucugaauguaauuugucaaaucgagcaucaaacuguuuuauacagaagaaaauagggaaguuaggugacacaucggcaagguacaaugagguuaccggaugcuuaaugacucuaacacaaaacagaggaacgcaaacacaaagacuggaaagaacugggcaauaaaacaacagagacaaagucagcucuaucuaaggucagcuauagucauagaagccaggugugaggucuuuacacucccagggcaagggcuuucacgcccaagucucuaauuagggaguuccgcucuagcuaaccaucucaugaauaaugcaauacucuaaaaccaccgcccgaucuacuuccuaaaccauuguaaauuccuguauaugggagcaacuuggcuuuuauucuaagugauaguguggggggacuuucuacuaauaaguaauguagucugccauacauaacuauaauaagaauucuaaacuuacauugcuaagcuugcccugagauuucuaacucuauuuaguagauaguaaugucugauuucuuucacuaucucucuuacaauacuagaggcaauucugaaugucacugaaucggcaacauucuuacugaauuccaagcccagggucagcucaaggacuaccuagggcauugaugaaggccaggaagcaaaguucgauuuugcuuagguauuuggcaagucauugcuuggaggcaccuauaacaaaacaauacugaaaggaagcacacagauccauucccaaggacaaaauuggagcauacgugcuaugggaugccacaguuccaggauacuaaguuuccgugaaacucuuugucucaggacugcauccaggcuuuuggccugucaugugugucacuacuggaguggauguagcagguggggaagcacuaacaccuggagaguuggcccucacaucuggaugcuugcugagcacugccuucuggaaaugaaagacagaucaguagauauuaauuugaaaaacuguguguguucaagggaugguuguuaugagguccuugaagguuucccucaacacaaaucuucaccauucauucacacacagaucauccauuuguaguuuuaauuguuuauuuuauaugaguauaucguagcugucuucagucauaccagaagagggc

SEQ ID NO: 7888 - RNA, 34527 nt, Mus musculus
cggcucugcggcccgcgcgugcgcagaagggcagcagugcgcgccgacuaggaggcagcugcuagccugaccugccgaggugcugagguggccgcgagacaggugagcggugcgcgagucuccgagucuccgggccggcgagggggacgcucaccugccucuugaguggaggccgcgggguacgggcugaggggaaggcggcggggaaggcgccgccucaggcgggggcggcgagccgccgcggcguggcugcucccacggcgacccgggacgcgcgugacagugacagacccacccccuccggcggcucccggcgacccggaggaacugcgccugacgcagcggcgggcgucucggcagguggcaacucucccucagagccgacuuagcuguuccccuggaagacucggguucagugccuaggccgaguguuagcagcggggaaacugaggcggacguguaggcaggggucgccucgugugcuuccgguuagagguccugaaauuacccugagauuuaggugugggucccgacugcuuucauagggcaguaauaggaaauacagaugcuuuaaaguuuccuugucagugacagauugugccgugucuucccgucucaugaugcauaggaaauuuaugaugggcuaugguggguuuguuuuuguuuuuguuuagguuuuuguugguguugguggugaguuuuuagagaugacaggggaguggguauuaucugucugucugucugucugucugucuauccgguuccuuaaaagaaaucuuucuagguaaauucauguuuguagcccaggcuggccucagacuccgagcucugccugcuucugcuuuccaagugccgaacugaaggugugcgcucucaagccuccaaauucacaucuucaaccggacuacuuuucaguuucaucuuuuuuucuuuguagcuuuucugacugugcuggugacugaguuuucaggcacgcacaguuccugguucuuuucccccuuaagcccucuguuagccuccagcuuucuucugacuccaagcauuaaugaucaguuucccauacucuguuccccgugaccuaugugugugcugcugcugcugcuacuguuguuguugauuauuccauauggaacccagggccucccuccacuacugagcuguccccaaauccuuaauguagcuucuucaucauuaucucaucuugguuuuuugguugauugguugauugguuuuaaacuuuuaaaauuuaauuuuuuuaaauguguguguguucaugagugcaugaccugcaaaggucagaagauggcuuuagauccccaggaguuagaacagcggugagauuguuauggguucugagaaccaaauuugacuucucugcuagagcaguauucauucuuaaccguagagcuauggcuccaccccugauuguugcugguguuguuugucccuggcuagcccgaagcuuucuguguagacuaggcuggucuucagugaucuuucuguuucucugacucguagauguugggauuaaagcaugugucaacacauccaacucccuguccuuuuuaaccacagauauguguggucuaugguagaggggagguguuuuggcugguguauaugaccccuggaucaacauuaauuuaauaagacuguggggaguccuggauguggcuuggguacagugcugguugacaaaaguaaaccuuuuguuuaguuccuagcaagaagaagguugugagcaaguaguugccaccacauaaaaauguguucacccucuuucuuugugaauuugggaacuugucacauugacagacggaugaacugggguagcaugucauggaagugagggaaguucugagaaagagacugaggagaacucugcuguugcagggcugucuuccugugccuggagggacugcaagagcauccugcuggcucagagucagacaaaauguucucuguuuguguuuucuccuuauuucuucuuuguucucaaugaagauauggcagaagcccaaaaccuuguagauuuggugacuuaacauaagauucaucagcguguucuccagacucugccuguuauucagcggguaacagcaguaauuuuccauagcagccauucaugggcucagacugucauaaggaagugggacuagcacaaagggugguacacagaagaaauaaagauccuguuugucauugcauauaacacaaacucggacaggaaauccguacaggacagcuaggugggagaaguuagacacaggaguguggcuucuauuugcaguaauauuguugaaucucuuuucccuaauaaacacuguaaccauggcagucaacuguagguuaauuuuguuuuacauauguguaaauaagguuuagagguuaagugauuuuucauagaaacacugugacacagccaucaucuaguuaacucuaucuaguucuaaaaccccauuuuucccucucucccauaguuucucccccuuucccauaaugcuugcugagaagccuagaacccagcaucuuccugccucuccuuuccaagugcugagauacaaaugcguaccaccaguccucuuuuugacaguguuuuguauuguccugucagcaaguauauucaaaguauuggagauguggcuuaauuuccuucuauguacaaggcucuguguucaauaccagcucugcaaaacaacaaaagcaaguauauuuauguuuuuccucauucuuguuuccacucuuuccuuuuaauguagugcuuggagucaaaccuagggacucucauaugguaggcaagcucuaccauugaguuauauucucaggguaagcuucccauuuuccuuuuuuggagacgacacggucucuuuuauauagcacuggcugcccugaaacuugaucuguagaucaggccggccuggaacucauagagcuuugccugccuuugccuccccagugcugggaucaaaggugugcaccgccacaccaggcucauuuucuuccuauauuuguccuuaaaaagcagauuccaggccuggggauguagcuuaguuuguagguugguugucuaguaugaaugaagcccuguauuugaucuuuagcaucauauauggugcuacagauauggugguaucugccuguaaucccaguggaggcaggggaucaggcauucagagucauccuuagcuauauagauaguucaaggucauccagggauacauaaauuugucucaaagucgagguucagacucucccccugucuuuuauuuacuucuuaguguaauacuaagcuuucaccuucaugaacuucauugaguauucaugaauaucauggauaucuacuguguaucccacccucuguaagcuuuacccugagacuuuagggaaagaaguuggaaauuguuaguauuguauguuaaaugcuuauaucauagucuuuagucuugggaauuggggaaaggcgcuggaccacuaacagagagaaauaauuccuugcucuagcaauucuauuagccugcaugugugguucuguacuuugaggaagaaucgugcucccaucccccuccagcgagaagugauaugguugaaagauaaagugcaggcucuggagucugacagacuaggaccugagccacaaaugcgucuuugugauaccagcuuuuaguguaagcucuuggaaaguagggccuuugucuuauucaccaccuuaccucucuagaucaacaguaggugagugauaacuuggaggcuuaaaugcuuuaugggauuguugugcucaacaugguagagaugagugcuaguaguagcauaugacuaaauggugaggcuacauuuucugugccccuuaccuuaugugcuauuuugacaacucuguuuuuugaauuuuacauauauaauaagucauuccucuuuugaaaauguaggcucauugccuuaugaucaccauucacaaaugaagcauucacuucuuuuuaguaggcauaguuaacuguuaucugugucuucuaacauuguaucucucuucugguuauacucauauucuucucucucucucuaucucuucccccccccccccccccgaaacaggguuccucucuguguaguccuggcucuccuggaacucacucuguagacaagacuagccuuaaaccuuaaacucggauaugugcuugucucugccuccugaguguuggggaguaaaggcaugugcaacaaccacuugaacuuuucuuccuuuuuuuuuuuuaagauuuauuuauuauauucaaguacacuguagcugucuucagaugcaccagaagaaggcgucagaucucauuacgggugguugugagccaccaugugguugcugggauuugaacucaggaccuucggaagagcagucggugcucuuaaccacugagccaucucuccagcccuuuuucuuuuuguuauuuuuuuuuuuuguuuuuuguuuuuguuuuguuuuuugaggccaggucuccauauaacucuagcuggccuggaacuugccauguagaccaggguggcuucaaacucacagagauucauugccucugccucuuuuuuuuuuuuuaaagauuuauuuauuuauuauuauauguaaguacacuguagcugucuucagacaccccagaagagggcaucagauuuuguuacggaugguugugagccaccaugugguugcugggauuugaacuuuggaccuuuggaagagcagucggcgcucuuuaaccacugagccaucucuccagccccugccucugccucuuaagugcugggguuaaaggcaauguguuuuugcauccagcucuauauuuucugcauuuuaaagcauuuguguuguauaguguguauuugugagguucuguuuguuugcgacagggucccuuguagccuaggcuggccucaaaguaacuguacagcuaagagugauauugaaagguaaucuuccugccuuugucuucuagugcagaaaucacagguguaugucacuguggcuggcucuauuuacgugugauguguugcuguuuguuuuagauguggucuuguuauauagcccaggcuggccuugaacucgagauccuccugcuuuugccuccugggacuaggacuacaggugugugccauccuugagacgagcuuuauauuugugguuuucucuaacgauguggguuuuagguuagcuucuuuugauccuugguuagcuuucauuagauggauucucaauaggaucaacaugaaaacugaaaucgaaagcacuaauuaauuaccagaaguccauucuuaaaacaggagauggcccaugcuuguauccccagcuaccauggaggcugaggcagaagauugaacccagaaaauuucaggccagccugggcaacauaggggcgaugaucccaucucaauaauaaaaauaacucuuagaaaaggcauggcuuccaauuaggguuuaaaugaaaacaccuuuuuuccuuaacaaaaugacaugggcauucccauccuucccuagcugugcagucagccuucagcuaacauucuaaagacaggacacggcaggccauuucccacuucuuauguuugaguuccauugguaaauauccuuaacuugugugacuugagaauaagguuaaaguccagcacuacuuuaucccuacucuuucuguuucucuuccuucuccuuuuugaggcagucucaucugagguucugacacccucaacauugcuguacagggcgggugaacuggcuuggcaggugcaggcuugaugagcugaguuugguuccauguaaagaagacaacugaguuguccuuuuaccuccacaggggcaugugcuaugcugugcuuauagacaggugccaccaugccuggcuuuauccugguuuuucauugguagcaaacucuugcucuucuccaagaucuuuugccugguguucucucucugucucucucucucucugucccucccucccucccucccugccuucuuccucuuccugccuucuuccucuuccuccuuuuuuuuuuuuuuuuuuuuuuuuuuugagacagguuuucucuguguagcccugguuguccuggaacucagucuguagaccaggauagccuggaacucacagaggucugccugccucugccucugccucugccucugccucugccucugccucugccucugccucugccucugccucugccucugccucugccucugccucugcgccucucugccucugcgccucucugccucugcgccucucugccucugcgccucucugccucugcgccucucugccucugcgccucucugccucugcgccucucugccucugcgccucucugccucugcgccucucugccucucugccucucugccucucugccucucucucugccucucugccucucugccucucugccucucugccucucugccucucugccucucugccucucugccucucugccucucugccucucugccucucucucugccucucugccucucugccucucucucugccucucugccucucugccucucugccucucugccucucugccucucugccucucugccucucugccucucugcgccucugccucugccucucugccucucugccucucugccucucugccucugccucugccucucugccucugccgggauuaaaggcgugugccaccacugccuggcuuacuugauauuccuuaacagagugacuucugcucugucguuuacauauggauaacucaucugcuguggucuguguuagcuccuuggucuguuuaccauucuuuggggucuucacuuauuaagucaacaaauguuuuuuccgucuuucccggguucuucaugguaggcugugcagcucacacauguauugccagcacuuuacuaggaaaccgaggcagacugcuauaaauuugaggcuacccuggcuacaauaugagacuuuaaguuuuuaaaauuauaauucuuuauguguauggguguuuugucuacauguaugucuauguaccaaguguggcgaguuugguaugcucagagagcaggagaggguaucuauccccuggaacugaaauuauauacagacaguuaugagcuacuauguaggugcugggaauuggaccuagguccucuggaagaauagucaguacuucuuuucuuuuauuuuucuuuucuuuccuuuucuuuggaaaaguuuuuuuuuuguuuuguuuuuaagauuuauuuauucaaguauuuuauguauaugagugcucuguauuuaaguaaauauguaaauguacuuacauaaauauaaaucagaagacggaaucagaucccauuauagaugguuguaaacgguuggcaggagcugaacucaggaccucuggaagauuaaccacuaaucugucucuucggucuuucuuucuuucuuucuuccuuucuuucuuucuuucuuucuuucuuucuuucuuucuuucuuucuuucuaagauuuauuuauuuguuuuauauuacacuuucuucagacacaccagaagaggguaucagagcccauuacagaugguugugagccaccaugugguuucugggauuugaacucaggaccucuggaagagcagucagugcucuuaaccgcugagccaucucuccagcccuauauuuuuuuuaaauuaaaaaaaauguauuuugcauguauagauauuuugucugucuguauguuuauauaccaugacuccuguggaacugcacuuacagauagauaguuaugagccccacaugagugcugggaguuaaacucagcuccucuggaagaacaguuaguacuuuuuuguuuuguuuuguuuuuucgagacaggguuucucugugcagaccuggagcucacucuauggaccaggcuggccucgaacucagaaauccaccugccucugccucccaagugcugggauuaaaggcaugugccaccaccacccggcuucaguuaguacucuuaaccucugagccaucuccccagccccgacugugaaauucuaucucuccccuaccucguccuuacaaguuucuuacaugucuuggguguugauguuggcugccaucuggaccuuacccuauaugauuggccuagaaugcgaccuuuccaugacuuuaccuaagucauggugugguagauguguauaagaguuaacaucucauggaaauuggugaaagugcaugguguuuuuuauaauaaaaccuugggugccacaucauguuaguucugcaguauucucuagguugaaauagucacagaauuuuccuucaugucaagaggagggaacuuaaaaacucuaccgcucagugaggaggacugucauugucauauguuaagaagaugugggauaggggcuggagagauggcucaaugguuaagagcacugacugcuuuccagagguccggaguucaguucccagcaaccacaugguggcucauaaccaucuguaaugggaucugaugcccucuucuggcaugcagguguacguagagcacccaaauauauaaaauaaauacaucuuaaaaaaaaaagaagaagaugugggauaggcauguaucaguccaucuuuagaaaauaggguuucuauuggucaugguggcgcaugccuuuaaucacagcacucaggaggcagaggcaggugggucucugugaguuccagguuggccucaucuacaaagagaguuccaggacagccagagaaacccugucuuggaaaaaaaagaaaaccacccacacaaaggaaauagaguuuccaugucaaauauaugguagaauuuuguugugguguuuaggguuaaagugaggguuuugggcauagugccagaggugguaaauauguuuucacuuauucugcagguuagcguuagguacuuuucuauccuaauuuuaaugauaggagagcugagguuagacaagaguuguggcacaagccuuuaaucccagaauuugggaagcagaggcaagugaaguucugugaggacagcuagggccacaugacccugucucaaugcccgccccccaaauaaagaaaauagagguuaugagcgauuguuuugccuaaagggcucacagcuaagugacagaacauaucauuaaacccaggcuucuuauuuccacugcuccauguuuaaauaagguaaauauggauuucuuuaucuaaucuucaaaauaugcauguggaugcuucauuaaauacaacaguuagcuaauuuagugucuggggaacccugaauuuaaguuugacaugcugaaggauuuaaccugaacagaguuucagucuacuagaaaagguauacagcuagcuaaauagacuguggaguuuuuguuaguuuguuuuaagauuuauuuauuuauuuaauauaugugaauacacuguagcugucuuuagacacaccagaagagggcauggggucccauuacagguggcugugagccaccaugugauugcugggaauugaacucaggcccucuggaagaggaguaguguucuuaacugcugagccaucucuccagcaccuagacugugguuuguguuuggcauuaugugaguauaaggagauguugaaaggaagcaucacagaaaugguauuuagagcugaguacuaaaaaauggaaaaaaaguggaaaugagaggcagccuucuaagcagaagaaaccuaagagcugaugcaggcagggcugacaagagggcucauugauuaagagacuuucucuucuuguagagggccaggguuugauuuccagcacucaaguuauggcuuauaacuguaacuccaacuacagggaaugugauacucucuuuagaucucguugggcguugggcacuaggcacacacauaguauacagacagacaugcagggaaagcccucauacacauaaauuaaaaaaaaaaaacugaugcaaaauggauuauagguacuugauuccaggccugagacacagguaguagaaggagaaauauuuucuacaaguuguccucugacuuccauguugauugggcacaaaauaaguaaaagggggcgaggcuaaggauuaggaagaugauucaguggguaaaguacuugcugcacaaguaugaggaacaagauugggaccuuuagcacucagguggcauauauguguaaccccccagcauuuggggugcagagacagaucccuggggcuugauggcuagccaguucagcgaaagguaagcuucagugacaggcucugucucaaaaacauaaggcuagagagguggcucagcaauuaagagcacuauuuuuuuaaagauuuauuuauuauuauuaguacacuguagcugucuucagacacaccagaagagggcaucagaucucauuacggaugguugugagccaccaugugguugcugggauuugaacucaggaccuucagaagagcagucagugcucuuaaccgcugagccaucuuuccagccccaagagcaccuuuuguucuuccagaggaucuaaguuuguguccccagcacuugccuguuaacuccagcuccaggggcucugauauccucuucugggcacuaugguacccauauacauguguuauagauacacucauauagacacacacacacacuaaugaaaaugaggcagagaagggacugaauaucccaaaaucgaccucuggcugaaguggguugggagcauaugugcuguugggagcugugcuucugggcugcuaaucugaucauagugccuccuccccuuaguuccccacacugggggguggaacuuguaaucucaugcuugcugggcaugugcucugccauuggucucuauuuccaagguuuuccuuuuuuucuuuuuuguuuucuuguuuguuuuugacuuuuuuauuuugagacuauucaguaguccaaauuagccuugaacuugcccuguagcccaggcauccuugaaagugucauuguccuaccucagccuccugaguaacugggagugcaggacugugcugcuggcagacugaugaucuauucuucauuugaauagaagacagucuggaggcacaaaagccuguuaggagcuaugcacgguggaccaggaacaugguagugaagguauggacuaaggccuugggaacaggauguuagagguguucuagcugcaaaaaugguaaacuuuccagguaacucagugugggaguaaaagaaacauaagaccugaaaauuaccuuaaaccuuaaaaucuaaauaucuuagaagaaaaugggauauuaagaaggaaucacguggugaugggcuaaaaacagaugcauugugagauacccaaagaaaaguuagaaauagcaguguggccuguggggugagaugaucuguagcucaguaggacagugaugacuaagucuugccuuuugggggguugggguagagucucacuauggauuucugugaguuugagguccaccuggucuauauaaugauuacaggacagcuagggcuccugcuuccugcccuguuugaauuccugcccuggcuuccuucagugauguauuaugacauggaaguguaagaaguaaacccucuccuucccaaguugcuuuggucauggugguucgucacagcaauaguaacccuaauuaagacagugguuaagagccaaagaugaccuuggauuucugaucuuucugcccccaccucuagaguacugggguuauuaccagcuuauagacuguuucuuugugguaaugggaccauacaguaucagacccccugucuuacuauaaauuuaaaauaaagguuucucaguggacuuuucccuagucagucaucaaggaacuuuauuuuccucaaaaacucccagcuguuuuguagggcucucugaauguugacuuucagguaggcaacacauuucauuuucacuccccuagugguagaauauagauggacuaugcagguaccuugcuuucgcgacccucauuaccagcuggauacuaucaagcuguaauauuaggggagugauccuuggagggacucgaagucuucagagaccugaugcuugugagcugagcaaguccucacaggaggacugcauuucucucgacuacugagcaggaaguggcagccugcuccuuggcaugcugcuccaagggagguuccucuuugccugguuuguguuugcccacuguguguucuguauuacacuaccacaccucucuggccugaaagaacauucuaucccugcacaaaggaaauauugacuuaaggaagggacaguggcccaguugcaaaccuguaggagcaggagcuggagggaaaugagugaggagguuguucugcucuucugcgggugcugguuaugggaggcucuacugagaagugggggauuaccucaggugucuacacugagggaugugggaggugauggaauggaauaaucauguuuucaacaagggucagugggguguuugggagagcagcaguucuagaagguuagcaggaauggucccuuuaucaaggcuuuauuaagcacugugcucugagaggauggaaacaggcuccaguaccuggggaaauauacuacggcagaugcaacagugcauguugagagccagguagguagcagggccauuagaucauccaguauaagucaagucaacaaauuuacacacacacacacacacacacagacacacacacacacaucucgccccuugacaggauuucucuacauugcucuggcuuuccuaaaacucacuauguagaccaggcuggcuucagcugacacugugugcuagaauugaagguguaugcuaccaugacuggcaauuuaacuuuuuuguuuguuuguuuuuugaagaaaagcaaaaaaauuucaagucaaggaggacaagcagaggucuucccaagaugauugguaaugauguugaugacaggagauauuggcuuuuuuuuuuuuuagcaucagguuauaagaaaaauuaguuucagccaggcaugguggcauacacucgggggucagaggcagguagaucugugugaguucaaagcuagccugguccacagacagaguuccaggacagccagggguacacagagaaaccuugucuuggaaaaccaagggggaaaaaaaaggaaagaaaaaagcagcuccaaaaggcuagggagguuguggggagacagaucggugcuucugcgucuguuacacaggcucuggggaugaagcucaggccuggugcuuacgcugagcugcucuacugauuagcgcuacuucccaagccuugccuucugauaguuuaaauuuucuauuaguuuuguuuuauuauuuuauuaaagauuuauucauuuauuuauguuaguacacuguugcucucuucaaacacaccaaaagagggcaucagauuccauuacagaugguugugagcuaccaugugcuugcugggaauugaacucucuccagccccuuuauuuuauuuuuaaaauaagauuuuagagacaggcgguggugguggcgcaugccuuuaaucccagcacucgggaggcagaggcaggcagauuacugaguucgaggccagccuggucuacaaagugaguuccaggacagccagggcuacgcagagaaacccugucucggaaaaaaaacaaaaacaaaacaacaacaacaggggcuguugagauggcucauuggguaagagcacccgacuguucuucugaaggucuggaguucaaaucccagcaaccacaugguggcucacaaccauccguaaugugauuugacucccucuucuggagugucugaagacagcuacaguguacuuacauauaauaauaaauaaaucuguuuuuuuguauauaaaaaaaaacccaacaacaacaaaaagauuuuagggggcuagagagauggcucagugguuaagagcacugacugcucuuccagagguccugaguucaauucccaguaaucacaugguggcucacaaccaucuguaaugagauccaaugcccucuucugucugaagacagcuacaguguacucauacacauaaaauaaauaaaucuuaaaaaagaaaaaagauuuuauuguuggcuauaguaaugcacaccuuuaguuccagcacucagaaggcagaagcaggugcaucuuugugaguucaaggccagccugauaucaaauagaguuccaggacagccagugcuauacagaguaacacugucucaaaaauuuuuguuuuaauuuucuauguaugaauuuuuuaucugcuuguaugucuaugugccuugugcauaucuugugucgucagagauccaagaaggcauuggauucccuggaacagaaguuuacagaugguugugagcuaccauguggguucgggaaucaaaccagguucucuagaaaagcagccaguacucuucaacaguugaagcauccaaucccugguuuuauuuuuugaaaccauuauuauuguagcucaggcuggccucgaguuuacuacauagcccuaaauagccucagacucuugguccuccuuccuuccuuagccuccgcaguguuaggauuauagaccugugucuguauaugcuagcugaaucagacuggagggauagcucgcucagguguuuucucugcaagcauaaggacccacguucaagucgccggcacccacguaaaaugcccagcaaaacuaugcaccuacaacccuugcuggggaagcaugacaggagggucucuggccuuugcuucccagcuacucuugcugaauuggugagcuccaggguuagagggacccuauuucaaaaaaaggaggagggaagugaugagcucgcgcuggcugcucuuccagaggaucuggauucaauuccuaguacucacaugguggcucagaaccgucuaacaccuguaccaggguaguaucugguacaacucuucuggccucugaagguaccaccguaugcacaugauauauagacacauguacaggcaaaauacucacguacauaaaacuaaaccuuaaaaagcgaaaagcaauagagaaaaauacuuggcauugacauagacaugugugugucccugacagacacaugcagauacuacacacauacacacacacacacauacacacacacacacacacacaucaaaaagauacaagaguauuaaguaaaauuguaccuaccgcccaguuuaccuugccuucuauuuuaugugagaugaauacccuauuuacaugcuuuuauauuguuuguuuugaauagggucucucugcauaacuuuggcuguccuaggaacucacuaggaccaggauggccucaacugacagaguuguugccucugccucugccucccuaguacugggauuaaaagugugcacugcuacgccugguuuuaaucuagcucugcuuguuacuguuuuuggcauggagaaagccugcagugaaugguagcuauuaaguaugucuggacagguugguuaggaacauagaggaacacugugcuggcuaguuuuuaugucaccuugacacaagcuagagucaucugagaggagagaacuucaaaugccuacauaagauuaggcuguaagcaaguuuguagggcauauuuuuuuuuuuuuccauuuucuuaauuagugauacgggagguuccuucccauuguaggugggugccaccuccaggcuggugguccuagauuuuacaacaggcugaccaagccauaaagaggcaagaagcagcacuccuccauggccugagcaucagcuucugccuccagauuccugccuugacuuccuucagugaugaacuguuuccuggaacuguaagggaaauaaacccccuucuuccucaaguuguuuuuggucacagugcuucauaacccgaauggaaaccugcauuaagacaagcaaucacaagcugaggcagagggaaagaagcuaaugguugagcauugaagaaggaauaagcagaugaaaguaguguaagcagggagccaaggcauaggagcugaggagagaaugcugcacauuaggagcuacuagguuauugcccuccaggcaacaccugcccuacaucagaucugaaucagguacuggcuguagggcagacauguauauuaccagcacgcaguuggaaguauuaggagcaccugccaaugacugagucuuucaagagaaggaggcagaugagcacaggagucagaaaguguuuguuagaggccccaucugaguuagaauuugaaagacuguccaguggggauuugagacuccuaggucuguguuuuccuucccaagcccagcagaagcagcaccagagaagugauguccgcacucagcagucugaaaucugcuggucaagauauccuuggucaagggacugaagagauggcucggaggaauauuuuucauuuuuuuauuucauuuuguauauguaucucuguguagugcacacauguguguaugcaugugcagguaugcauguguggaggcccaaaguggacaucaggucuccuugauuauuauuuccaccuuacauauugagacaccuuaaugaaugcaagugaaauuucucacagugauggccacaggucagcuugaucuagauuccucauugagacucccuucccagguaauccuagauugugucaaguugacaauuaaaacuaaucaucacagcauuuucucacuguguuguaauuauaauaaaaaugcaggugucgaucaccaaguugucuugcuucaaggggcagcauauuaaucuuuaauaucaacagugcugcuaacccagucuugaauuccaguaaugucucuaacacagaagcagauuuaaaauacaaguucuuggggcuggugagauggcucaguggguaagagcacccgacugcucuuccgaaggucugaaguucaaaucccagcaaccacaugguggcucacaaccacccguaaugagaucugaugcccucuucugggguaucugaagacaacuacaguguacuuacauauaauaaauaaauaaaucuuuaaaaaaauaaaauaaaauaaaauacaaguucucuccuaagaaagauauguguugcugggcgugguggcacacaccuuuaaucccagcacuugggaggcagaggcaggugaauuucugaguucgaggccagccuggucuacagagugaguuccaggacagccagggcuacacagagaaacccugucucgaaaaaccaaagaaaaaaaaaaagaaagacgcauguuaauuucauuuguuuugucucucacucugaagccccugccccugacuccgaaugcugacauuacagucauuacagucgugcaccaucacaccuuguuuaugugugcuggagacggagcccuggcaagcccugagcuacaucccagaccuuaacuucuuuuaaaaaauaugcauauuuauuuuuucuauguaugugggugggugaaagcauauggaaaucagaggaugacuuucuuuuuuuguuuuuccagacaggguuucacuguguagcccuggcuguccuagauuucacucuguagaccaggcuggccuggaacccagagauccugccugccacugccucuggagcggagaggugugcacuaccacugcccagccaggggaucauucuccugccaugugggucuugaggauugucaggcuuggcggcaagugccuuuagugcugagccaucuugucagcccuuaauuucuuuuuaaaauguuuucaaguuucaauguuuuaaaaaaaaaucaacaaauuguucuuuacagugguuuuuauugcagaaauugccauugguauuuaaauuuccacugggagaugaauauaucagugauuuauugacuguaugaacaguauauaacaugcugauaauguuuaguagagaaaguuuguuuuguaguuuugaaacaagguuauauggcucaggcugaccucaaaacugguacucuguagccaggauuagccuagcacuccuaauucucuugccucuaccucccaaguacugugauuucacaagugugugccaccacaugugguuuaagaugucugugaucucaauguguucauauaugaaauaaagcugagcauguaagagaggaaagucaggguuggguagggaguauacucucugucagaguuccuacuuaacauauacagugcccuacauuugauccuggcaucucuuccuuuaaaaaaaaaguagggguggauggaaagugugaucugaucagagggcaucagguccccuggaacuggaauuacacaacagauaguugcgcagccauguggguccuugguccccucuguaacaacagcaaggacuggaggccaugugaauguugggacuugaacccagguccccuugaagagcagccagugcucuuaaucacugagccauuucuccagcccccagggcaagaauuauuguguguugcucuagugugcuauuaaaagguuaaagacucucagcauggugguagacaucuuuuaucccaguacuuaggcagcagagggagguggaucuuuguguuugaggucagcguagacuacauaguaagcuccuccagaugagccaaugccacaucaugagacgcugucucaaaaaacaaaacaaaacccaaccaaacaaaaauucaaaggauaccagaauuucucugucacacauaaugaacccagugguuguuuauaaucuagagacuuuuguuuacuuauuuuuuuuuccuuuccaaccagggauuuuuuuucccccuuuuggucuuuauuagauauuuucuuuauuuacauuuuaaaugcuaucccaaaaguucccuauacccuccccccgcccugcuccccuccccacccacuguuuacuuauuuuuaugacaaggucucuuggcuguguagccaguugucuugccuccucccauaucuuaccagagagcuuauuugucuaguagcuguaguuugaguuuuucacuuauguuuacaucuuacuguguuguuaguggauaagaugguccucugggcauuuacacagagcucaggagacagggaagcauugugaaaaauaaguuugaaaauggcgucuuuuccccuaggcguguauuucgcagauggcuaugcuuugcucaucucuuggguaagcaucuuuuuuuccuguaggcugauuuuaugccuuuugcuuuugaaaaaguauuucauuucagcaugaugggagucaucugcagcccaugugaaagcugggguaccuggggauuauguccagccuuuacagaauaagccuggggcuugucagcucuaguuccaaggcauuuuccauuuguucauuuuccauugguuacuuagacuguugggguuggggccuuccuacaauaacuugaaaaguaacugcuguaccguuuagcaguuuaagaagcucauuuuucccagguugcuaagaugucaaauucaagcugugcuguguuaguaaaguguuaccuacaacugagagggaaggggaucccucacaguuacagacagcuauuugcacuuuaucuccccaccacacacacuuuuucuccacuugguuuugcauaaagauuaaauccccaaagaaggaaauuugagguggcaaguaguaaguagccuugucaccagaggaaaaaaaaggcuuaaagaccugcaccuguccuauuccaguguaauuaguaaauuguaauuauuucuaauuauaguacauauaguauaacauuagcccuaauuaguuaaauaauuacuuuggagauagggucuuccuaugaaguccuggcuggaacuugaugugcaggccaggcuggccucaaacuuguggagaucuaccugcuucugccuccugaguguggggauuaaagcccuguaccaccacacugaguauuaaauuuuaauuauuaucuggggcugcagagauaucucagugguugagagcacuuguugaggacccagauucaacucccagcauccuauaugauugcuuacaacgaucugaaacuccagugccagagacccugaccccuucugaucuccuuaggcaucagagacacauacaaugcacauacauauguacaggcaaauacccauacacauaaaaguauagaucuuuaaacauuuuaaaauuuuaaguaauugucuuauguguauggguguuuugccaaauucauaucuuuguacuauguacaugaagcauccucaaaggccagaagagggcauuggauuuccugggauuggaguuacaagccgcugugagccaccaugugagugccgggaauugaaccuggguccucuggaaaguuagcaagaguucuuaaguguuuuugaguguuacuggcacaguuucaggccagacaugauggcacaugccuuuaaucccugcauggggagaaacaggcagaucucugugaggucaagguuagucuaaucuacauagcaaacuucaggaccagcagggcuauguagagacccugucucaaauuuaaaaaaaaaaaaaaaaaaaaagaguuucagauuuuccaauuggggauacuacuuagauuuucuaaauucugaaaaagugugaaaccucaaggaguuguagucccaaguacuuccaaagaaaguaccauaaaggauuaaaaucaagcuguacauaguggcuauaucuauagucccagcguuugaagcugagauggaaaagguggaaaaggaucacuugaauccacaaguuuaagaccagccugggcaacagaggccagauauuaaaacauaaaaacacaacaaaaccaagaucaauauauggccuucuuggccugaucaccuuuuuguuuauuuugagccaggaucccauuauauagacaggcugaucuuaaauuugcaauucccugcuucugcucccugaaugcucauauuauaggugugggcccuaugccugaccuaauuccuccuucccuccuucucuccucccucauauaggucuagucaucucucucucccucuccaucuccuucucccccucucucuccuccucccccuuucucuccuucucucucuuucucucuucucucuuucucuuuccucucucuuucucucuccuucucuuccucuuuccuucucucucuguguuuuguuuuucagagucaggguuucucuguauagcucuggcugucucuggaacucacuuuguagaccaagcuggccuugaacucaaagagaucugccugccucugcuuccugagcgcugggauuaaagauguacuccaccaugccugucccuaaaauuuuuguuauuuguuuguuuuugagacaggguuucucuguguagcccuggcuguccuggaacucacucuggauggccucgaacucagaaauucgccugccucugccuccaaagugcugggauuaaaggcgugugccaccauaccuggcaaaacuuuuuuuuuuuuuaauaaaaauaaacuguaaugaaagguuuuguaaaguaaaaaaauaaaagcuugguguugccaguaugauguauaauggauuuaaccuuucagagaugauuaggugugcaugccuuuaauuccagaacuugggaggcagaggcaggaggauuucuguaaguucaaggcuagccuggucuacaaagugaauuccaggacauaauauacagagaaacccugucucaaagcaaaacuuuuguguaugaguguuuuugcaugcguguauguaugccuggugcccgaggaggucagcugaagacauuggaucuccuggaacugcaguugcagauggcugugagccaccauguagguuuuagaagcaucucuagugucuauacuaguuuccuccuuccuuuuagccuuucucagacuuucccagcccugagccacucucaccaguuuaucuguuaucuguagcuuucagagucaccucaucucuuuacagaaaaaaaaaguggucuuuaggcucuuaggugccaccaaaaaucaauguuuuugccuauauugguucagccuuuaugcuuccuggaagaugucuggagaaagccacuuguguggcaguaacucugcugccuugucagggauauaugucccuucaguccaugucaggagaccacaggaagugaacgguaccucugcaccugcauacaguggcaacauuugugggaaaaugugggauugguaaacuaggaagggacacacagcaucagaacuggcucucuuaagcuuguacauuuaauuguuacaauuucuucugagcaacucagaaguggcugcaucaauuaagguuuucuaagguuucuuuuaaaaagacuacaagagggcagccauagaccagguauuuguggagacuaacuguuuaggcuaggucugucaguucugggugcuuucagggaaauuuccauagcaaccagaagcugaaaaaccugccugcccagcucagcagugucacaucugggagacuuaaggucaacccuaaguauauguguccuuaagugcaacaugaaugaaauagcaaucgaggcucucagccuguaaaaauguguacaccaucugaucgauucucagugcuugcacccacaacaucuccuacccugggcauggccuuucagucuccauugauuucugggcaccuggagauauuguucaguccuaccagauuuugcuugauggcuguucagaaucuguggauuucuuugcugucugagaacagaggucaaaagccugucuucagggugagcagggugaggugcccuuggcaucugcuguugcuuccucccacucuuccccccacugcauccuaggcucugagcucacuggccccucccugcaucuggauccucccucagugaagucaggccuugaucucuagccuggcuuuggcccuugcucagaccucagcucucaaaggcucuuuugauacagaauuagucccaucuuacuuugucucuuaucuaauuuucuacuacacugcaacagccugaccuuauccacgguugugcugccuggcucugugcucagucauuguuugcugagugacagugaguaggaggcuggugagaggggaacugcuguugagaacucucuuccagccccuucugcccuccagcagaugucgguuccuccucuuuaaacaaccucuuuuccuccauguuuuugcuccauauuuuaucuccuccuuucccucuuccuuuuucuuuuucugacagggucuuauuauguagccauggcuggccuggaacucauaaagauccaccugccucuguugggauuaaaggcauguacuacccugccuaguugauuucuccuuuuuuuuuuuuguuuuguuuuuuuuuuuuuuuuuuuuuuuuuuuuuuuuauuuauuuauuauauguaaguacacuguagcugucuucagacgcaccagaagagggcaucagaucucauuacgggugguugugagccaccaugugguugcugggauuugaacuucggaccuucggaagagcagucgggugcucuuaccuacugagccaucucaccagccccuuuuuguuuuuuuuuguuuuuuuuugagacaggauuucucuguguagcccuggcuggaacucacucuguagaccaggcuggccucaaacucagaaauccaccugccccugccuucugagugcugggauuaaaggcaugugccaccacucccagcugauuucuccauauucuugcuaacauuuuuuuaaagaaaaaaaucaaaauuauguauaugugucuuuguaugucuguguacauguaaaugccuuuggguccagaagaagugauuggaucgccuggagcugcaguuacuggcaguugugaacugccugauaggagugcauuuaauucagguccucugaaagaggcucguagcugcugagccaucgcuccagccccuccuuuuuaaaaaauguuuucugagacaaggucucauguggccuaggauuugucuucauccucgugcugggauuacagguguacacugccacauuuagucacaugcaguguuggggacgcagacugaagaguuugaugugugcgagcgaggagagcacucugguguuuguuugugugagcccucauggcuguggaguagcaugccuucacaguuuagaucuccuuugugguugaugauaacccagucacuuucacccgcuauuggccauuucccucucuuauuugagaaauguauguucaaacaucuuuuaaauuuauuuuguguguaugucugucucugcaucacauaugugcagugcccucagaggcuggaagagggcauuagcuccagagcuagagguacaaccugccgagagcugcgggguuggugcuggaaacugaacccaagcucuggaagaacagccaguucucuuaaccacugagccaucucucuagcccugcuuaacuauuuuuaaauugggcuuuuugugucuuuacuguucagucuuuuuacuguugagucuuuaaaaacaaacaaacaggacagaaaagaagugacaagacacugacaaugaugagagaaauuuguauuuguuuguagaaugggaauaugguauauaaaggcuguucagccagcaccaccacuaccauaccaccaacaauacaaaacagaacaaugaaaacccaauccgggggcuggugagauggcucaguggguaagagcacccgacugcucuuccgaagguccagaguucaaaucccagcaaccacaugguggcucacaaccaucaguaaggagaucugacucccucuucuggagugucugaagacagcuacaauguacuuacauaugauaaauaaaucuuuaaaaaaaaaaaauaucuucgaggaggggagugguaugagaugagugaccucuccuuugcuuuccuaacagggcugaugaagccucaggacagucagagaagccaaugaugaccgcuugugccuagaccuaugaaguccugccgucguccacagcacaugaugucaggugggagcaaggccugcauacucaccaggagcccguaguggagcugacuugugauuucauaaccagccuuccacugaggcagagccucagcaccucacaagucuuagggcagcccgggcugugaggccuuuucucagaaaacaacccaaaccaccggagagacucugcuagaugaaagaagugggaaagagggaggagaggcuugggcuuuggggcuuugggguuggugaccgaugcugucuucucuguuaagucucuagcuuccugcuccucuggccuguuaauccucccacuguggcggaggaggaggcaaagaaucuguguuuauguguuggacgugcuguugguuuuccacaguguucauuuuuccgcuguucaccagccuccuuggcccacucuguacacccagucuuuuucaugcugauucccuuggauaagggaggcauaucucacuucaauggggccuccacauuuucauucauucauucauucauucauucauucauuuauucauucacuuucugaaauaggaucuuacuauguauuccuggcuggcuuggaaugagaacuuacuaccuagaccgggcuggccucaaacucaaauucgugugccucugcugggauuaaaggugucugcugcuaucaugccugguguuucugcuuuucuugaucauucuuaucuuuggucuuuguaggaaaccacacgccuucugccaguggcccuuucucugcccugacuccaagcauauggccccaggagauccuggcaaaauacucacagguacaacaguuagcauagccaggaccagccugccaugccacuaugccuuucaugaagagauuuaccuuugcagguauucugggaauggaugacccacucaguguucucacaggucaugacucaguacuugagauaacaucguaguuucuugggcuugugggaaucagucauuagcuaggaggaagauuaacuggagacacgggaggacugaaugacuagucagcccuuguaggugaaugacagccagagaaggcaucacagaaggguagccuuucucaggguggguucuagcagucagcauguggaacugcuuuacaguagaggacuagacaagccuucuuccuuacucugauucuagaaagaagaauccucagagcagccagagcucugcuaugaugaguuugguuuccguguggacaaggaagguaagauggagcccauugugugugagcuugcugauguccuugggaaaauucuggccccaugucuugcuuuccucugcaugugacuucugaggucuaagcggugucaccucaggaguuagggacagaauauaucugagggugauguaaguuuauggaaacuucuaaguuuuuuguuucguuguuucaagacagacuuucucuguguagcccuggcauuccuggaaguggcuuuguagaccaggcuggccuugaacucacagagaucugccugcuucugccucccaagagcugggauuaaagacauuauucucuaccacauuuggcuuuuuguuuuguuuuuaacuacugaucuuuuuuuuagauacauuuuuuuuuaaagauuuauuuauuauuauaucuaaguacacuauagcugucucuucagacacaccagaagagggcgucagaucuuauuaaagaugguugugagccaccaugugguugcugagauuugaacucaugaccuuuggaagagcagucagugcucuuacccacugagccaucucuccagcccuuuuuuuagauacauuuuauugaucuuuacaaaacaaucaguuauuuauauugcagagaaguuaaacagugcagaagggaugaggauuaaaaaaaaaaugaagagagugcuccaggacagucaggacuacacagagaaacccccucuuggaggggggacaaacaaacaaaccuguagucccaugcuaugaggaagcugcugcugugugaggggcucuuuuccugacacugaaaucgcacccgugacaccaggagcauuugcuauguuacuuaagaugcuuuaaaaaacacauuuuuggggcuggugagauggcucaguggguaagagcaccugacugcucuucugaaggucugaaguucaaaucccagcaaccacaugguggcucacaaccaccuguaaugagaucugaugcccucuucuggugcgucugaagacagcuacaguguacuuacauauaacaaacaaacaaacaaauaaauaaaucuaaaaaacacauuuuuaauggcugcauaguaucauauuacaucagauuuacugauguuuuguagccuuuuuuuuuuuuuuuucuuuuuuaaaacagggccuuuguacagaguccuggcuguccuggaacucacuaugcagaccaggcuggccuugaacucacagagauccaucugccucugccucugcugggaguguguguuaccauuguuggcguagccguuucucuauaagagcgccugacuaggugcuuauugugaagagcguuugccagcacugacagccuguccucaggaagagcaggggcaguuccuuagcugaagcacucaacucggguuucuaacucaggcauuaguuuuccucggucuuuuaauuugcaagaagauggaaguuaaaugucgagguugagagggacacagaggacuuucgaggaugauggaagucaacccucgucgauaggucaccagcuuuagggcugagaguucacaacgguacagaacagggccuugacauuuguuuauugacagccaucgagaugcacacuuaggacuugggcauuuucucuguguaguguugacaaguugagguuuuuaggacuagcuuggacaagagcuuggcuuaggaugagcgccgacgaggcuuugugguuaagacucaccacacagauuguuugcuggccacaggcuuugucgucaucuguuccccgggguucaugaggcugugguaccuugugcuuucucccauuuauguucccaaagauggucuugaccacacaguucccauucugguggagagagaggcagaaauagagcaugcugggggcaagaauggaggaucauuccauggauagaaaaggggggugaacuaguuacacauagggaguuaagugaggcuccucacaugggaagacuggagacucaguggagaggagaggaguauaacgggaagagcagugacgggcagagguuccaaggagcaaauggguuuccugggagaaguggaguggagguggagggaguaagaaggaaggggugaugugaggauggagccuaggaagccuucgguuuggagccugagauggggguggggagcaaugagacauuucugacaguaacaugaucugacauguccuacacacacaaaguagauauaauuaaaaagaaaaaagaaaaaaaaugggguccaggaaccugauugcuauagauugaauuugauauuuaaacuacaaggaaggcucuucauaccuucagagccucuggaggauggcucagguuucugggucaggcugcuuugagaagagggucugcuuggcucucccuugccacuaagcagacgguguagcuagagcuuccaggaggcuuccagcagggggucuauuucagaggagccaccuggccucuacgacagcuccaagcaaacucaucagggcagacuggacugcuguggggagcguggagugaggaacacgcuuccuucccuucucuguucucuugguggaagguucugagccuggaugcagccagaugacaggcucaccccugguggaggaccccccgcagaggcuacguuggcaggcucaccuggaguucacccauaaccaugauguuggggaucucaccugggacaagauugcagucucccucccccgcucugagaaacuccguucccuagugcuggcuggcaucccacauggcaugaggccacagguaagauggccauagagacaaggagcucccagggggcugacagugcccuggucugucacaagagaaaccaugcuacauggcuucuccuuccaguuguggaugcggcucucuggggcgcugcagaagaagaagaacucugaguuguccuaccgugagauuauaaagaacagcuccaacgaugagaccaucgcugccaaacagguaacauggggcagccagccagucaggaggaagugcugggcagagccugugugcucuggcaggagggagaggucaccucugagacugccccuugucggucuccuuggcaggguagguagcccuuuuacucaggaguguggccuagaguacacuugcuccuuuccagguccuugggggcugcaaggagaguaaucuaaaggucccagugugggggaaggacauggagauggccccacaugaggaagagcaggaaauuuuaaauauagaucugggcgcugaaguaggaggcaggcagcagguccucaauaauggcacacaucauccagaaggcauccuccuccuccaggaacagcaggagacaggcagccaccuagccagagaggggagcauggggcuccuacccagacucaugugaaucagaaaaggggcucccaguggcuagugugggcucaauuuuauacuugauggggucuaacccuggagaagggaggguuagccuuggccuggacuauuacagaaucccuauuccugggacggaagcaagccacccacagcuucucuaccuuauugcaugggcaucagucuacaguugcaucaaacaaggucucuuggggugguauggggaucugacagaucgaaaaggaccugcuccguaccaugcccagcaacgccugcuuugccaaugugaacagcaucgguguuccccgccugcgcagaguccuccgagcacuggccuggcucuacccagagauuggcuacugccagggcacaggcauggugagcaaccugggaggcaacugguauaccagggucuucuccaggccucuucugaggcauguuucccuaaggugcuguaagggugggaggccgggauugaccugggaguccucaaggagggccaugggaucuuuuuuuuucccccuaggggcccucucaaccagccugaagaggugugccgaguaucuauccuagaauagagccccuuuucugauucacaugagucuggguaggagccccaugcuccccucucugacuagguggcugcuugucuccugcuguuccuggaggaggaggaugccuucuggaugaugugugccauuauugaggaccugcugccugccuccuacuucagcacuacccugcugggaguccagacugaccagcggguccugcgccaccugauuguccaguaccugccucgcuuagacaaacuguugcaggagcacgacauuggugagaccuggcugccuucuuccccaagguucagggaucccaagauggugguaccaccucugagcuccaagguuucgaggcagcggaggcucauguggcuuacguugcuuuuguccuuuugcauucugaucccuucccaucccuucccuucucuuccccuccccuccccucugcugcuuuuugggagcuggcccguacuugcccaggcugauccuacaggugucuuuggugucuguuggcagagcugucucuuaucacgcugcacugguuccucacggccuucgccagcguggugcacaucagacugcugcugcgcaucugggaccuguuuuucuacgagggcucccugguguuguuccagacuacgcugggcaugcugcgccuuaaggugcuugcagagucuccuguccacuggucagggcuaccuggcuucuagacagaacaggagagcauguaccuaauaugguagcccuggugucacccucuggggacacacugcaguaguccagucuucaucauagcguugccugagagaagccuugagugugggugugcagggggaacuuccugggcaugccaaagggcacagguuucuaggagggugccagggccacgcuccuuacucucccacucccaggaggaagagcugauacagucugagaacucagcuuccaucuucaacacgcugucagacauuccugcacagauggaugacgcagagcugcugcugggggaggccaugaggcuggcuggcucccucacugauguggccguggagacccagcgucgcaagcaccuggccuaccuuauugcagaccaaggccaaacccuggggacgggcaccaccacuaaccucucucaggugggcccugucuuugccaaaucacggaguucucagacugagggggugugaggaacagacugucucucccaugcaucugccugcaaacgcccaguuagagcaucagacggccacuaaggggugcuguaggcuuccuugguaacaugcauuccugaacucugaacuggguaguuuaagccugagcugaagauacgccuugaugugagagucagcuucagccauuagaaaugcccaggcuuagugagccacaagcacguuagugucuccccuuuuugaguggcuacuuugcccacugaccugccguccucuccacagguuguacggcgcaggacgcagcggaggaagucugguaucacuucccugcuuuuuggugagcccaagugugggugggugcuggcucuucuggggcugggcagaaccagcuacugcgugcauccuagcgggaguggagauucggcaggaccuguuacuaugccagugugccccccccccccccaggagaggacgaccuagaagcucucaaggcaaagaacaucaagcaaacagagcugguagccgaccuucgcgaagccauuuugcguguggcacgccacuuccagugcacagaccccaagaacuguagugugguaagugucaggcuccccucaacuuggggcucuccuuccccagcccacucuuggcacugaggcuccuccuccacugugugggccuuuccuuucugccaggagcugaccccagacuacagcauggagagccaccagcgggaccaugagaacuacguggcaugcuuacgcagccaccggcgccgggccaaggcccugcuggacuuugagcggcacgaugaugaugagcuaggcuuccgcaaaaaugacaucaucacgguguguggggggccuagcgugcacacuuccugcugccuccuccccaccuucccuguagagcugauguugaauaagcuugaucucagcccggcggguacugaggacgccugcuuugggaaggcccugagcccuggcccguucucuucugcagaucauuucccagaaggaugagcacugcugggugggugagcugaacggccugagaggugagggcuuuugugugcugcaggcuggcaaggaaggccuuugcucuaccuaggccuacagccgcagaccccgagccuccgagggugcugggcuuuucuucccucuuggucuucuuggcaugccuguccugcuugaagguucugggugauuugggagcccuuuguccuugguccuuggggagaagggcugggacagcuucugcugcuccccacauagcugcuuccccccacaggcugguuuccagccaaguuuguggagguccuggaugagcgaagcaaagagguaagaauguggagcugcucuuuguugcagccuagugugagaccauccuacccugugacagcugccagggugacaggggguggcuggcugcaggugucaggcuagcgcuucucaaauguucucuccaucaguacuccauugcgggggacgacucugugacagaaggaguaacagaccucgugcgaggaacccucugcccagcccucaaggcccuguuugaacacggauugaagaagccauccuugcuuggaggggcuugucaccccuggcuguuuaucgaggaggugaucacaauugguccccgugccuucucaguccugcagggccacuugcucaccucagucccuuccuggguuccugcaggaggcagaaggaguguuguagggcaguggcgugcgcucacccaucccuguccucauguugucuugucuaccacaggcagcgggccgugaagucgaaagagacuuugauucuguguacucccgccuggugcucuguaagacauacagguacauacguacugccuguguuacccaccaauguccagcauggcaaccagugacggcacucuuguucuugcaggcuggacgaagauggcaaaguccugaccccugaagagcugcuguaccggguaagcugcuugccagcauucuuaaacucucucuggccagccacuuggcacuuaagugacaguguccccuccucaggcagugcagucugugaaugugacccaugaugcagcacacgcacaaauggaugucaagcuccgcucacuuaucugcguggggcuaaaguaaguguagaggagagggaccgucaggggcuaucccauagggcagaaccacugugcgagggaagccccuagagcuuuccauagauggugcucaggagcuccugggaaugggguugcaaguuggggguccuccaggccuagccucauccuccuugccuguucucagugaacagguccuacaccuguggcuggagguucucugcuccagccugcccacuguggagaagugguaccagcccugguccuuccugcgaagcccuggcuggguccagaucaagugugagcuccggugagugggcagcucugcagggcuuagaacuuggugguaaaggaagcuagcagguuggcagaagaguccagcaugaccagagacuguucuuuggucccuaguguccucugcugcuuugccuucagccucucccaggacugggagcucccugcuaggagagaggugaguauguggcuugguuggucccuggcauuggauuugccaggagggcugugguguguagucugggcugaagaagugaccugugugguugcagggugguuccugcccgugacuggggcuguucugugcacaggaggaaaagcagccccugaaggagggugugcaggacaugcuggugaagcaccaucucuucagcugggacauagauggaugaugcuccuuccagcugcucuguggcugccaggcccgcccaucauagacugccuggaaggcucccuucaacagaaggcagagcccuggccagccucgagccucccucaggcuaggagguucagggaaagacacucuccagagcuuacucaggacccaugaucagugucugggccuccccaguucaggcuaccacggcugucaaaagcauacagugguggccagcccagcugcuuuccuuaacaugguccugaggagugccagccauaugguauacuauacuaaccaaaaaccuugggaagaggcggggacauuauuguaaauaaaccuuuuacuagagcaagccucccaucuuuuguugagccaagcccugaguuccacaaaagcuaccccuccugaaauggucugacucccaggcccuugcucaguguuuauuucaaguacgucugaugcaauuagggccacuguguggccucuagaugccagcauggaauagacccaggaccccagccaaacuucucaauucugauggaucaaauacaacagacuggcaaguca

SEQ ID NO: 7889 - RNA, 1431 nt, Mus musculus
uuuuuuuuucuuuuuuaaaacagggccuuuguacagaguccuggcuguccuggaacucacuaugcagaccaggcuggccuugaacucacagagauccaucugccucugccucugcugggaguguguguuaccauuguuggcguagccguuucucuauaagagcgccugacuaggugcuuauugugaagagcguuugccagcacugacagccuguccucaggaagagcaggggcaguuccuuagcugaagcacucaacucggguuucuaacucaggcauuaguuuuccucggucuuuuaauuugcaagaagauggaaguuaaaugucgagguugagagggacacagaggacuuucgaggaugauggaagucaacccucgucgauaggucaccagcuuuagggcugagaguucacaacgguacagaacagggccuugacauuuguuuauugacagccaucgagaugcacacuuaggacuugggcauuuucucuguguaguguugacaaguugagguuuuuaggacuagcuuggacaagagcuuggcuuaggaugagcgccgacgaggcuuugugguuaagacucaccacacagauuguuugcuggccacaggcuuugucgucaucuguuccccgggguucaugaggcugugguaccuugugcuuucucccauuuauguucccaaagauggucuugaccacacaguucccauucugguggagagagaggcagaaauagagcaugcugggggcaagaauggaggaucauuccauggauagaaaaggggggugaacuaguuacacauagggaguuaagugaggcuccucacaugggaagacuggagacucaguggagaggagaggaguauaacgggaagagcagugacgggcagagguuccaaggagcaaauggguuuccugggagaaguggaguggagguggagggaguaagaaggaaggggugaugugaggauggagccuaggaagccuucgguuuggagccugagauggggguggggagcaaugagacauuucugacaguaacaugaucugacauguccuacacacacaaaguagauauaauuaaaaagaaaaaagaaaaaaaaugggguccaggaaccugauugcuauagauugaauuugauauuuaaacuacaaggaaggcucuucauaccuucagagccucuggaggauggcucagguuucugggucaggcugcuuugagaagagggucugcuuggcucucccuugccacuaagcagacgguguagcuagagcuuccaggaggcuuccagcagggggucuauuucagaggagccaccuggccucuacgacagcuccaagcaaacucaucagggcagacuggacugcuguggggagcguggagugaggaacacgcuuccuucccuucucuguucucuugguggaagguucu

SEQ ID NO: 7890 - RNA, 2282 nt, Mus musculus
agggggacccugcccgaacucucacucaccgccucguucgccuccuggcccgggcuccgcggcucgccccacuccggugccagccgcucacguauccucccgagccucuaguaccagucagacugcaccaaguuagggagagguccgcgcaagccgagggagcguggcgagcgggaacgaggggguggggagggugggacggucguucuugccgccggggacaccgcagacacgaccgccgccggcuccacucagccacggaagcugcgggcccucccaccacuccgggucccgccuccgcacccuccccccuacccgccugggagcgacagccguaucgaccaaucagaaaccuagcgccguuagggcuagcccgauuuagggggcguucgccgaaggaagaggaacgagggaggcuaguacggcggcgcgacuucugugacugacaucauagcgcagccaaucgguaacugagagaugacuucaucgcugaaggaagucuggaacuggcggagcggccgccaagaggugggaggaggucggcgaugagccggggggcggagucugggucuuaaagaaaccguaacacaucugaucacccugucaaagggugaccgcggagcuagcuaccuaggguucggugcccagccuggagguuuaaugcaaaaauccugcagucuucaucuugguccuuccuccugucuuugcuccgccgggacucccaagucgauuauuucacauucgcauuucccgaaaggacacaauaaaugccgcucuggccuggagcccugaacucugucaugucccugcccuuccguggccaagcgcuuuuuuucucugagucgguucuccuccgguaaaaggacugacaccuaccugccuagacuguugagauuauuuaucaacagcggaagcgcuugcagcuggagggaaagaguugaaugaacccagauuuuauccggggccucacugcacuaaaugaaucugggcggcucuuccaacuuuaaaauucuaaacugcugguguguagccuaaaaguguguguaugucuguguguguguggguguguggguguaugugugggagagagagagagagcauaacugcauaaauccaacauuuaaagagacuuaucuacuaaagcggugagacuaguuaaagcccacccggucaaguugcuaagagccacuauggaggccccuuuucuggaacaccaccccuuccccccaacaaagggggagagcgcugaaaaggagaaauaauucggacuuggugccuuaguguuuccgaaacacuuucccuugggagauauaaacaaccgucuaucuccuccuuuuaggccaccauccacuggauaaacugaaguaugauugccccagaguccaacguggaaaaccagugaguuuauugggcuugcuaagaaaucauggcuggcccccaaagcagcgagaccaccaaaaaguugcaccccagcauggaugaugauguccccauagcugcguagaugacauacacaguucaguuaaacuuccauaaucuacacaacucuagccaagucacaagaccucaagcagcuagggcaaaauugaggacuugagagauuccucuccccaaugagcggggggauguuggaggagguaacugggauccagcaaggauucagagaagcccccccuaaguccuuccgucaaugcaggaacaucuacagucaacaagcccagucuugaggggcucuugcaagauagcugugcuuuugcaaggacagagcugcuggacacaaggaaaaagaaagaagguucuggagaacagaguccccagugugagagcaaggguuaacacuguagaagcagaaacccucaggggcauccugacagacaugggaagccacagugacuggaaggagguaacgcauguuacaucucugagugaguuacucuguauggcuuccguucucccccggaaaucucccagacuucucagugguguguggcucuguugggauaggagaaggagcugcaacucucucuauccacugcaguaagccagcccggcccugaguaauucccaguuauucaucuguaagucagcuucaaguuccguaccaugugucucaucacagaaccuuggagguagcccagauccuguggccucuuagucacaccuucccucccaagauuaaaaaaaaaaaaaaagaaagaaagaaaaaaaaaaaccacaaaagcccuaauaaaauuauauguucaauaacuauauaugcuauauaaauaaaaacuuaaaaugaa

SEQ ID NO: 7891 - RNA, 3499 nt, Mus musculus
ugagccuagcugcuggcucugcaggcagucaggaguaggagccgcagccgggaccgaagagguuaacaugcaucugccuccgaauguuaaugugucuaggugaugucagugggagcugggaaggagggaguggggcgagcaguugggcucagaggcagcagaggcugccaggcgguagaggaagacccuuuucuggacugcggggcucaagcuccggacaaggcgguggagggcgcuggaggcugccgcagccugcguggguggacgggcgcuccacuccagggagcaggcgaccugcaccggcugcauggaucugcaagccucguugcuguccacuggccccaaugccagcaacaucuccgauggccaggauaauuucacauuggcgggugagucgaguuggaguccucccuccuccgggauggguguggaaaaugggaagguuucaccucccaagccaaacugccugggaaacuuuaucuuacaguucuuggugauaagaucugcagucggcuuugccugaagaggaagaggagaggaggggacaccagcuaggacagaaggggcagggaggaauagagauggggcagaggcacauuuagaaacaacaaggguuggugacaagacgugaggcaggcuugaggggaaagcuugcugaugagucccaaauaugcuuugcaggggggggggggggggaaucaaggcuggagaagcaagcaagcaagacagcaagacagcgggcggguaguaugugggagccagcagaagcgcuuugauucaccgcuauccugggcucaauccucuggccucgcacuggggaaauggggucugagugguccuugcugucuucuggcaaaggcugcugggagcaaaagacuucacagggcgugagaggauuaacuuuucuggugaauuaagcuucuugacauuugcagaacgucaaugccuuaaaauucuagcucugaaggagaagggaaugaaggggaaagagggaagguugguguggagaaauucccaagcuucugggguguaacacagcuccagucccuacccuauugggaaagcccagacucaggagacaugguccaaggaaaucccugacagaaaaccgggagagggcagggcuguggagccugaaacacaccccacacccauggugacagucacuucucacauaugccuaggaaccuaucugaaaccuuuggccaucucucucugaaaagaugaggcugcaaauacacacacacacacacacacacacacacacacacacacacacacacacacacacacacacacaaauguccuucaagccuuuuugacaagguuuucugguggaucccggggauaugaaguuguucucagcagauaucugggagucuugacuccuggcccucugaguaaauggaugaagcgaagaagaaugggguccucugaguaacagguggaucuagaaaauccuauaggagucaccagggcacgguggaggaggguaagguacagaacuaacaauagcccgagaaggggaaacagcaggagaugauuccagagacguagugaccccaagcugcaagggaaagcaugaggggccagcaggaaggccgacauggcagguugucagcuucuagaucggaaggcgggucacacuugcucuuucuauccucagggccaccuccucgcacaaggagugucuccuacaucaacaucaucaugccuucaguguuugguaccaucugucuccugggcauugugggaaacuccacagucauuuuugccguggugaagaaauccaagcugcacuggugcagcaacgucccugacaucuucaucaucaaccucucugugguggaucugcuuuuccugcugggcaugccuuucaugauccaccagcucauggguaauggugucuggcacuuuggggaaaccaugugcacccucaucacagccauggacgccaacagucaguucaccagcaccuacauccugacugcuauggccauugaccgcuacuuggccaccguccaucccaucuccuccaccaaguuccggaagcccuccauggccacccuggugaucugccuccugugggcucucucguucauuagcaucacuccuguguggcucuaugccaggcuuauccccuucccagggggugcugugggcuguggcauccgccuaccaaacccagauacugaucuuuacugguucacucuguaucaguuuuuccuggccuucgcccuuccguuuguggucaucacugcugcguacgugaaaauacuacagcgcaugacgucuucgguggccccagccucucaacgcagcauccggcuucggacaaagagggugacccgcacagccauugccaucugucuggucuucuuugugugcugggcgcccuacuacgugcugcagcugacccaguuguccaucagccgcccgacccucacauucgucuaccuguacaaugcggcuaucagcuugggcuaugccaacagcugccucaaucccuuuguguacauaguacucugugagaccuuucgaaaacgcuuggugcugucggugaagcccgcggcccaggggcagcuucgcacggucagcaaugcucagacagcugacgaggagaggacagaaagcaaaggcaccugacaaucccccccggucaccuccaagucaggucaccgcaucaaaccguggggagagauacugagauaaacccggggcuacccugggaggaugcagaagcuggaggcugggggcuuguagcaaaccacauuccacggggcccacaaauugcuagggaggcuugcagccagguuugggggggaagccucagacugcagggauccccuugacagaauagaagcggagcaagaaggaaagggugguuugacugguucucggggucuguaucuguuggcucgcauauaucuuucucucaagggaagaagguggaggugccuagcuggguuccuuuaaaacuaggcagggcuaggaucugagcagcuagggcucuacugugagacugggcaagccgagcguucccucccaucucucauugguguugauagaaggcagucuuucucccaagcugguggaucuccugaagcacgcugccugggcuccagcauccugugcggauuucacguucucuuuaggggaugcauguugacacuggggugugggcucugagcccacaggaguuuaaaaaaccaaaagagcucagagugucgagagagauccaaucaccgagaaugacaaggcaaccugggguggauguggaucuugaaacuaauaaaaagggguuuucacagugacagcgacauucucuucauagggcacagcugucagucuauggcugauccagagcgagcauccaugaauucugcaugugcaggggucacucuaauaccugauauguuggcaucaucuuugugcuugagccuuccacucccaaaugggaaugaaauaaaggcaaauucccacccacgucauucuggag

SEQ ID NO: 7892 - RNA, 1376 nt, Mus musculus
ugguaguguacaccuucaaucccagcaacagagaggcagagauaagcagaucuuugugaguuuaagggaaagccuugucuccuuagcaagacccaccccagcuagggcuacaaaguugaaaccauauuucaaaagcaagacaaagaaacaaaaaaccccaccuacucuuacauaguauuaaacaaauaucaucuaaaaacucugucauuaaccaaaacacaggaaagugguguucaaauguuguaugaucauaaugagucuagacagucaauuagugauuccuuuuguuggacuucuucuucuucugccccucuuugugcuucuucuuuuuccuccuaccaccuucuuuaaauccugcugagaaaauggaagguuccuucuuguuggugacccaagauguuccuuguucauuguuguccaccagaguauauugaguuguauuugaggagcuguaggaauuuggugaguaauuguugaacgacugucuucuccaguuacauuugucuguaaaaugcucuucauuugccacacuauuuacaagaaaggauaucaacucacugucaucuucagcuucucuuucuugacgguucucaaaagcuuucuuuguauuaauauuucuuccauuaauaacuuugccugaagguguaauggguauauaguugcccauuccagaaucaucaagugccagggaagagaaugacguaaggcccucaugccccaaugaaacauaagaugaauacccugugucguaagaggagagcccggaaagcgcuggguggucauaggcgcgggagacgugggacccugcgccucugccucugcuuccacuggggcuucuugaacuguuuaaaaggcccucgagggaguccucaaagagguggaaugaaaacggaucccuuucaccaaaaauuuccuuaaagacaucgucugccuuccggaaugugaagcgguacucacgcucaucgucgagauggcuugcaccucugccgucuaauccuuccuugccguauuugucauaaaugucccguuucucaacauuugauaacacuucauaugccucggcgacuucuuugaauuuucgcuccgcuuccucuuuauuuucuggauuuuuaucaggaugccauuuaagugcuacuuuacgauaagcucuuuuaaugucuucuggugacgcauaucucugcacuccuagaacuucauaauaguccaccauagcuugacaguuuuaaaaacaaacacccuugaucgugagcacuguguuuucguugcaacucaggcucuguugcugguggcaguggcagaagugacugcaaauaggcauauuuuuacauugaagguaauguuaguacugugggugagccacugcuaaaagacuugag

SEQ ID NO: 7893 - RNA, 2436 nt, Mus musculus
gucuuucccuuguguggggccuccagacaaggcuggcaguuccagucggcauggagaggugaguuuuggggcccagggaguuagaacuagauggcuagagagggucaguuaucugcuugugccucugagaggccagcuauggagccacgggauccuccuguaccugagguuccccagagguggccccuaaaccaaccccagagguagcugugccugugcauccuguggggguagugcuuuguagccuuaugaagugggaucuguggcaguccucuucgcccugaaccuuuuuccucuucaguuaucagccuaauaggccuccuuccuacccugacccucaagccagaaucuagagaaggccgucagcgcugagaaaggggugacuucugggacuaaaaggagacaaagccagacaguaacaauccugggagcaacuacagggagguccgugggaucagggaaggcagcucagaacuuaccugcgacccaagcauauaccagggggagcugagugaauucgcugcugcucgguuugaacaguggugccacucaagguguguguuggagaaucuagacauucuucuugaggcaccaggaauuugggacuuuucacucacagggacagcgagacacuagggagguuucuggaaaauucccucuggcuguuggguggaacaggggugggaagaggccaggagagccaugguggcaacaaucaucccuaagaagaaaugggcaaguggcuggaguugcaagguggagagauggacagguaggugggugcaucaauaaauagacaugagaccuaccuugccaccucccccguaguacauaacucaggcccucaguuccccugucacaggccagucagcuguguggacucagguaacacgaggacaaaggggaagcaggcacagaggcuugggcugccugcuuuaccgagacagcaucucucaggcucuucagcaucuggaccuccuaguccacccuaaaaccugggcuaggucugggccuucccuccugcugccaaaccagggcugauaacagaagcuccucuucccuccccccauaugacgugagggaagagaaccaagccguagcacuuuccugugcccagagaaugaaggccugaguccggagugggcuguccugggucagggguucagugcccacuagcauugguguuccccauggacagcagcacucugucuguuucucucugucucucucucucccccgccccuuccucccuucucucccaggccccagagcuccaucugggucuuuaugcuguugcuguucaugguguugcuccagagcccagccuggcacguagcugcccagcgaugcccacagaccugugucugcgacaacucaagacggcauguuaccugccggcaccagaaccucaccgaggugccaaacaccaucccugaggucaggagagggaaaauccuggcauggguuggcaguguggcaagaaagaguggcaggagccugggcuacaccaauggcucuaccacuggcuggcugguuccugcuucuugagccuggguuaucuaggucugaaugggaagaaaaauaaccagugagggccaaauccaaugacacacacaccuuuaaccccaggacucaggaggcagaggcaggcaggucucugaguucaagaccagccuggucuacagagugagguccaagcuaaccagacccagguuuacaacaaauagcaacaacaaaaauaaacuaaacaagccaauagcaguauaauuuauuuaaaauccuuuucguguggcugagauaccuagaugaccugcaaauaauaauguauuugugucagguccuggggugaacuggggcggggggugucuggauaagaaacuuuuuugcccggugguguuaugaacuaauggguaaguaaggcaagaagaaacggaucacaguaagggcugcucuguggcuaaagagacucggaaagaugauggggagaggccaaggcucgagugcccauguggcucauucucccuuccccucuccuguccccagcugacccagaggcuggaccuccagggcaauauacugaagguccucccugcagcggccuuccaggaccugccccaccucacgcaucuggaccugcggaacugucagguggagaugguggccgagggugccuuccguggccugggucgccugcuccuccucaaccuggcuuccaaccgccugagcacccugccccaggaggcgcuggacgggcugggcucgcugaggcgccuggagcuggaggggaacauguuggaggagcugcgcccggggaccuucggcgcccugggcucgcugaccacucucaacuuggcccacaacgcccuggucuaccugcccgccauggccuuccaggggcugcugcgcacccgcuggcugcagcugucucacaaugcg

SEQ ID NO: 7894 - RNA, 51424 nt, Mus musculus
ggguggaaaaacaaaacagaggucgguccagcauccgcccagaaaugcagaacugcuagaaggaaaucccagaaaaggaagagcaguuuuaaaagaaaaucaaggugaauuccaggcaucccuccacugggaaggggggcuugccgacuccccccucccccccaggugcgcagcccgcgccgcccaccccgggcgcgacuaaagcgaggaggagcugcgcucucuaggacccgaggagggagagcugcagggagacggagccuccagcgggugcugccgcgagcggccggccgagggggcuggaaaugaaaguaaagcgcuccggagccacauggaccgagcugcccgggcggcggcgccgggagcaggaugcggccgcccguaauuaaauagcauuuacucuuauuauuacuaauaauaauaacguaaucauaccucuagucauagcauaccauuuaucgggcucggcgcaggcccgcggggagcgcagcccggccgaggugagugcuuuggcgcggcggagccccgcggggcagaggccgggccaccgcguccccggcggcgcgcaagguuggggcgcgcgaggcuggggcgcccgggcagggccgggcagggccgcgcgcggaggaggcgcgggaagccccggccaggccaccuggaaaggcggcuuugcaagaauaaagcaauagcaccuccauuaccacgaacuggguuuuucuggggggaggaaucugucugcagauucccguaccccugccccaaaguuucaaaguuauuguguggccgggcaccugccgccugggagauuggggcugcacugcagcccccaggggaugccuugggauuuuucuuccgugguguggggcaaucucccuugcgucuggagguuugggugugcgcgcggauguuuugcggaucccacugcaaggaggugguccgaggcuggcaguuagggucccccuuuccuuuuguauucgcuuugaauccgcagugccuagagguagaggggccgcggcgagggccggggacaauggccggcugaugggucgccccagucgguuaccgcggccacgcgaguccggggauccggggccugcgggcccagcccugggggagggggcggcaggaaaggggggcgcggucugggucugcugagcaggagggcauuuccggucguggcauccgucacugggcucagaggccuccugggugggcaguaaccaggcaggggauucacggggacugcuggggacugggauuguggcgauugaggggcgcccuggcagggcugggggcccuggggaagcagagucgaccccgccgccacugcccucagcggacacaaggucccuucugcgauccauaacucuuuuucuuucuaucuuagaaacccucagguucagguguuuguaaaguuccuggguugaggguccuucgcagagacaaagccucccucccccccacaccgcaggagugggaacguguagaaagaguucauucuugacagaauaggguggccggggugccaacagugccuugauggagaagacugggggcuggaggggcugaaggggcuggggcuucaagugggggaacuggggaacagcugcaaagugaugggggauugcggguuuuuuugucgucccccccccccccgguuguuagccaggacuuaggugcauggacacaagaaucagaacccccaacuucuuuccauuuuccggagugccugcaguucauccaguuugauggaaauaacagaaugcagauccuugaauuuuuacacaaaugcgauaauuauaguacauuuagcagcuauguuggacaugaaauuccggcagaaucuuucccucuacuaccaagacuucccccaccgcagauacaaccauauccucccugaugucuuucguacuucuuuuucccaucgaagucugcugcaagcuagccgcgaugcuaggccccaaccugggugaagcagguucuagaagggguuuguguguguguguguguccugagcuggacauauguggguucuucugccggucauggcaguuaaaccagguagacauuuagccauccuuguuuuccagacuagagaauuggguaucuugcuggaaauuuauacaagagagcuaggcuuccuaacuaguuaucugauuccaaagcgccauuugcaggaggagaucucaggaugagagagugacuuuaugguucugagguugccauaacgucuucuuaaugguuggugugagcuauaaccaacuuagguaggacaguucaaaaugugccuuguugaauuuuauuuauuuauuuauuuauuuauuuauuuauuuauuuauggcuguugaguucaaugggaugagcuugucucuugggucuucuguaugggacaguccacucaccaguggguuugaggcauuuaaaaugauaauaugugucuauguauguguaauauguguaugugcaugugcccucgugguaggucugauacacaccuccagcacuuaggaguuagaggcaagagaauugugacuuccaggccaaguuggucuacauagugagaccuuauggguuuuuuuguuuguuuguuuguuuguuuuguuuuguuucauuuuuuuaguuuuuucaacauaggguuuuccuggguaguauuggcuguucuggaacuccauuuguagaccaggcugacuucgaacucagagguccaccugcuacaccugacuugaaaccuugucuuaaaagaaaaaaaggggggcguggggggaggugacucagugguuaaguauguuugcagaggaccuggguucauucccagagcccaugccaugcagcucacagcugccugucaugucagcuccagaggaucccaugcccuuccugcugcuaccuguauuugcucuccagugcacauaaccacauagacauaaauggaaaauaaagcucuaacuaggcaugauccacaccuucauccuagcacuugagaggcagacacagagacaggcagaucucugaguuugaggccagccuggucuacagaguuaaguuccaggacauccagggcuacacagagaaacugucucaaaacaaaacacacgaaacaaccaaaccccuccaaaaaaaaaaaggaaaggaaaaaagaaagacgaaaguauguguguauauauggugcuuagugcuuuuuuaaguucguuuauaacaaaaugccuuuuacauaugugagcucaucuguccaucguagcaguuaugucaaguagacuuuuucauuucuuuuuuuuucuuuuucuuuuuuuuuaauauacugggcuggagagaaggcuuggagguuaagaauauugcugcucuuccagaguagagguucgcuucacagcaguccuuaacuccacuuucaggggaucuaaaaucucuucuggccucugaagguaccaggcacacaacaugguacacaaauauauaugcaagcaaaacaaccacauacacaaaauuuaaacaaauaaaaauuuuauacccaugcacuuacagggagggagugugcaugugucauggcauguguauggcgaucggaacuggccggaguccauucucucuuacugugugagucccaggggucaaacucagguugucaggguugguggcaagcacucuuccccaccgaaccaucuugccugucgugguguaggcguuuccuaaucuuccuuuuauagaugaagaauguaaggcuagaauuggaaauguccacaggacuccugaguaguuuccccgucucugaaucuucauucuuucccagaguccugugcaaacuagcaaguggaaagucccucugguaagcuucugugagguaggucugagucugagcuccuuguagucuggcuggaacuagaaagggaaguucaguaagaaaacgggcuggacgagcagugguggcacacgucuuuaaucccagcacuugggaggcagaggcaggcggauuucugaguucgaggccagccuggucuacagagugaguuccaggacagccagggcuacacagagaaacccugucucaaaaaaugaacaguuggacagugguagagacggacacgguacucucuucuggggaaccugugcucgcacacagguguggccauccucacacacguacauaucugcacacacacaauuagucuuuuaaaacugaaaucaagaauuuaggaagaaaaaaaaagaguucuauaguuaguguacuaagaggaggcaagauggcaccuggaaauguugaggaauguuuccugaaggagguagagcuugggaugaaagaguggggcgcucagccagggcggaggacacagaaggaaggcuuagguuaacuuuuguuauuucugugcagggcgauugacaucgucugucuuucauuuuuuucuuuaauauuuuaaaaaauuuauuuauuguuuuguuacuuucgaggccagguuucucugugcagcccuggcugucuugaaacucccucugaagaccaggcuggucucgaacucagaaaucugccugcuucugccucccgagugcugggauuaaaggugugcaccaccacgccuggcauuauuuuuuuacuuauauucuaucugauuguacuuugugaagggugaccaccuguggcugcauuuuacugaagaagauacuaggggacucaagauuuuugaggccaccccaaggucaccuaacugaauuugaacccaggccuuucugacuguucugucgaaagugcuccugccuucgucuccaccaucauggaaacaaaaacaagggccaggaaaguaggaacuggcaaauggcacagccauaaagauucacauggggaggguuagguuagcaggugccucaaggcuagaguucuccugaggugaccgaguuccugcaucccacagacaaggcagcauggccccgaguguggaaaucugaguaauuccaguccuuaggaucuuuuuggggccuccauuaucacuguggaagagcuuggagcuugcgcacgagacagauaggaaccuuuaaccugagcuucccauggacaggaacuggcucugaucccgccucugccuccagccgcgguggacgugccaggaggacacauucagccauuauguugucaaguugaauuaucccccagugugaaggaggcaggcuuauuucgcccgggguggaaggucuuacuagaagaauuucuaugugaaugcuugaaagauagcauaagaaaggcccgagagaggccguugugagcagagacggacugugagcagagacggacggacagaagcagggacagauaaagccugaggaaugugucaccugguacagccacaguguagggauggcugugaguuccaguugaagucuggcucuguugccgccagcccucugauggucugcacuugaguuuccauuucuggaaaugagcucugagagcauuuguuuuucuuuucuuuugaauuuuaaauuuuauuuauuuauuauuuugaggcggggagggggggaaucucacuaaguagcccaggacauagcuauagagaccaaguuggcgucaauuucucagugacccucugacccugucucucaagcacuggguuuucaggcaugugccagcguguucugaugaguccugagguuugcugguguuugauaguaaucccggagagcuaaaugagagagcuggaaggucaggguuugggaggaggcucgcuuguuagagcaucugcuacccuuuuagagaacccaaguuuggaucccaccacccaugcugagagguucacgaccacauguaacuccaguucuaggggaucaauguccucuucuggccuccaugggcaccagcagucaggagcacauacccacacauagacagauacuuauacacauaauuuaaaauaaaacuuuaaaaaguagagaaaaggagucaggcagugguggcgcacaccuuuagucccggcacuugagaggcagaggcaggccaaucucaugaguucgaggccagccuggucuacagaaagaguuccaggacagccagggcuacacagagacauugucuuaaagagggaaagagggagggaggaaggggaagggagggagggagggagagagggagggagggagagagagagagagagagagagagagagagagagaagguacuagguaugauggaauuccucauuuaaucccauucauccugaucuacagagggagacucuguguuuuguuuuguguuuuaaaaaugggucagagggcugcuaacagggaguggaaccagcccaggagaaagcaguuuguuguagucaacaaagaugaaaaaggaguggaggagaucugaagaccgcuuugacaucagccauggagaugcagaguucggaguuugcccagcugguuuccugccuugcuuuggggguuacaguuaauuaaguugaaugaaucucagaagagaccuugaacuuuggacuuuuuuuuuuuaagauuuauuuauuauauguguguacacuguagcugucuucagacacuccagaagagggcaucagauuuuuguuacagaugguugugagccaccauguguuugcugggauuugaacucaggaccuuuggaagagcagucggugcucuuaaccgcugagccaucucuccagccccaacuuuggacuuuuaacauuguugcgacugcuauagacuaugaggacuuugaaaguuggacuaaaugcauuuugcauuaugcuauguuuaaguauguuuuugaacaagucuauggggaccagggaguggauugugaugguuuguauauccuuggaccagggaguggcaccaucugaagguguggccuuguuggaauaggugugaccugguuggaauggguguguugcuguggguguggguauaagauccucacccuaguugccuggaagucagucuuucacuagcagccuuuggaugaagacauagaucucuuagcuucuccugugccaugccugccuguuagcuucuccugugccaugccugccuggauacugccaugcucucaccuugaugauaauggacugaaccucugaaucuguaagccagcccuaauuaaauguuguuuuuuauuuaaaaaaaaaaaaaaaaaaaaaggucagagggcuggagagauggcucagugguuaagagcacugacugaucuuccagagguuuugaguucaaaucccagcaaccacaugguggcucacaaccaucuguaaugggauccaaugcccucuucugguguaucugaagagagcaacaguguacucauauaaauacaauaaaucuuuuuuuuuuaaaugggucagagagagauagcuagguggucaagagcauauggucgcccuucuaaaggaccugaguucaaaucccagcacugacaucaauugcuuguaacucccgcuccaggauccagugcucuucuggccucuucagagaccugcgcucauacaaccuucccacagaccugcacauaauuaaggguaaaauuaauuuuuaaagauguauuuacuuacuuuuaacguguugguguuuuaccugcaugccugucggugugggggcauugaauccccaggagcuggaguggcagaagauugugagcugccauacggugcugggaaucaaacuuggguccucuggaagagcagcuagcaucucuucaccaauuagcuacucucuaaccccaaauaaaacaaaucuuaaaaaaaaaagaagcuagagggacuuuaaaaacuuuuacuaauuuagcgauaccacccaguaaugccccugcggucaaacccagcuuaugaguuuauuuaauccccccaaagcauccugugauauccuauagauaugugccuugauuauccccauuuuagugauaauagaagagcgcucaggcacagaguuuacauggcucuguuuaaaaaaaaaaaagugcaaaacacacugaaucugucuccaguauggaccauaaagggugaguagagaagcugguggguucugcagcguagaccugagacacagaaggugggguguccgcuggggaaggcuggcugcacccugcagcuggagacucggugggcugaagggacuacucugucagcucuggagccagcacagaggccagcuccuuugguaguguuuaauggugcagagcaaacaggcuccuuuuccucccugugacagcagcagccacagaacuccuucccaccuuauguauuuccccgggagucuguuucugugcaggcagggggauggcuucugcgggagucuguuagcauugcugaaagcccgcuguggacaggauacagcguuuccgucuccagaacccaucuucucuaccagcaccaucuaggugacuucuucagggacaguucuugagccuugugucagcgguugggauggggacaaggacagcagcugccacauacuuacacagcgcuuggcuuucuguguucucuaguaucauacgcacuuaacuacuccccgagggaagacaguuagcauugcuggccccauuuugcaggugaggagccugaggcucagagagacaaggaacacuuccauaaucguauagaugucaauagagcaggagucacaagcaagucaauaggacucuaggacccaaagucuuuugguaggguuuuuguuuguuuguuuuguuuuaucauuguuuuuuuuuuugggggguguuguuguuguugacuuuucaagacaggguucucuauauagccuuugguguccuggaaugcacccuguagaccaggcuggccaugaacucagaucugccugccucugccucuugagugcugggacuaaaggugugccuggccucguagggucuuauguaaaccaggcuggucucagacuuacuguguagcugaggucagaccugaaguccuaauuccccugccuccauuccaagggcuggggagaugacucaguaaaggugugugcucaccacacaagcaggaggaucugagcuugauccccggcaccauaguaaaacagcugggugcagacagccucugauaagagcauuugucucacagucgugagcgguuuagaucccugcacgcacagcaagcuggugucuuugcagacuccuauaaccucauccgaggaggauuacuggugcuuaccggcuucuagcuuagccaagaaaaugcgaaccucagcuuuagagagagauccugccucaaagaagcagagugacagacacgugcaucccucccccaucccuaccuuaccguuaccauuacaucaacaccaaauccaaccaacaccccuaacccaaccccaguuccacccccagcccuaacacugacccuagcucuaccccuacuuuuaccauuaaauguaacccuaacacugaggcuauccauaacccuaaccuuaaugcucgccuagugaaaaagagcuuaacuauucaauuaaaaacaccauaggggcaguuuccucgaauguccauuggagagauuaggacaaacgguuuauacaugggcuaguaaugggagauagggaacuucuaacgccuuccuucagacacagacacgaaaguguagggaaguaaggaaggacaguguccuauggguaaagcaaccccacgcccacuguagagaucacugaagucaugcacacacaucuaaaagguugggguggcaauguaucccuguaaucucaguccuggagagcaggagacagaaggauccugggaccuuguggcagucagucaagauacacacaagacggguguguguaucgcacccuuugagaaccugaagucuauaacugccacacacaagaugccauuggauugcuuagccucuuucuuuuauuuggggaggugucuaagaauggaccccagagucccuggcugccacugagcaguucccaguccccagcccaaaucuuuuuuuuuuuuuuuuuaaaggcaggaucacaugcuauauagcccaggcuggccuggacuuacaauguagcccagguugaccucaaauucuugguacuccuccugcuucagccucgccuaaugccuagcucaguucauuucuuaccuaucuggacugguaguauuuccuaucaccaacguuuauguagucauuuauuaaguuauucccaucaggggcugauuuccugucacuaacagugucucagcaauccuucaaaagaugugucccuggcuuucagaagacaauggaugcugucgguuuuccucuacccacagaggcuccugggccuaaaaugugacucugaaagggaccagcagcgccucugguucucugaggcuagcggcuguauccuccggccagcuugagguucugaaguaccccugucaggcaggaggcagucugccugugagccccacgguggcgggcggucuacccuggagcagcuguucucuuguugcaucccauaaugugcugucccccgacaggcagagggacacagagcaggguggagcagugaguccuaccuuccuuuuguucccaacuucagcggcaggcacccuggcagugcacacacaaguaucuugucaccguucucagccucuaucuccuuuucugugcuacuguaacauuugcccccuguuuggugggaggguccagagauggaugucaaaagcugugaagaucaccccgugugagguaaugucaagagugcuuagugaccuccagaauguuccugcaucuucuccagucucugucucaauccagcccguaucgagcgccuccuuggguucucaaauuccucuugucauccgccuuucaugcagcaaccaaagggagcuccuauaagggaagcccugucacuccugcuggaaaccuucuagaauuuucugagucgcucucuggucaagcugcagccugcacacacacacacacacaccccgcuucccccaccuccuaucugccccuuguuuuccuugaaccuguauagcuuguuccuacaucacguccauugcuggucucugccuucagcugggugcacacgaguccucuguccuuccgucccucaaauauuacagccucugaagggucuucacuccccaacgucccacauuuccauuuguuccucgcucuugccucugccugccuugucgugugcauuuaacaccgacucauugugugaguauguguguucacguguuggcagauguacauacgugugcaagcguguguauauaugugagaaugcucauauguugguugucaggaaccauucaucuacugaggcaggaucucauuguccugcagcucaccuaggaagcuggagugggugaccagggagccccaggaacugaaagacuccgagaggagccccucgcucaggccucaggacaauagugaacacccaagaacucaugagagaccaagcuugaugcaaaccacaugagauuuuauucggggaaagccagagcucuggggacgacucauaucccacacagggguagaggagucgaccucaaggggaaagaggauccaguuuuuauaggcccucaggggggaacggagaaggggggaguaggggauuuccagaucuaaacaaugucuauucuaaaaugauugauuccucaagaaauggguaugggagggaaacaaggaaagagucuaaugaaggugcagcacuccagauuggccccgacuaugguugcuggggagauuuuccgacucuuucccagcaaccaauaucacaaacaccuggcagugaggugcagcaaugggcacacaccuggucagaacauuggcagacacacagguucgaggagcggggagagcauugugcaccucuauuuuucuaaaucagugaagcuaguucuacuaaccauuaaaucuauuuugccaauuucagggcuucugugaccuuuuacauucugucaggaucuuucagaacccaaacgcaucuaccuccccaacucugggauuauaaacacacaucacuguacccagccuuuuuacauucuuuuuuucuuuucuuuucuuuuuuuuuuuuuuuuuuuuuuuugguuuuucuguauauauagcccuggcuguccuggaacucacucuguagaccagucuggcuucaaacucagaaaucugccugccucugccucccaagugcugggauuaagucgugcaccaccacgcccagcuugccuuuuuacauucuucuucuucuucuuuuuuuuuuagaaaacugccuuuauucuauuaguugggaaaauuaacugguagagaaaaauguuuagucagcuggagagaagagacacccccaaccccacccacugccacccauaagaacugguggcuccucugggaggccuuuuuaccuucuuaauucacuugcauguauaucaguguaucccaugcaggcaucagauccccagccuguacuuacagacuguugagagccacugucuggugcugggguugaaccugguucucuacaagaguagcaagucucugcagagcccuccggcccuguggccagcuuuuaaauguggguucugggaaccaggcucagguccuugugccuuuguuauguacugagccaacuccccagaccaacauggcaccugcuuuucugcuugcucaccuguggaagaucuaugaggguugggggcuggagagaugacucagugguuaagaacacauacugcucuugcagaggaccuggguucggaucucaucacccacaugguagcucacagccuuccauaaccccaguucugggggacccaacaggcauacacguggugcacauacaacaggcauacacguggcgcacauacauguaugcauuuaaaaaguucacacauaaaguaaaauaaguaagucuuuuuaaaaaaugaccuaugagggcagugucccaguacuggugacaggacaguuccuuucaggugagcacuguuuaugugucgaauaaaaauagcaaguuggucacggcccucaccaaaagagggccuagccagaaacugcaaagucagugcugucuaaagcgcucagugcagcaggaaauacauccugaccuguucugggagaggcacgggaguccugcgggguggcuaugacccgcuccaucuuacagacagcaaaacucaaagcaugguagacagagaugggauuuaaucccagggccgauggccacugucauagccugccuuccuguugccgcugggcaccagaguaggcagugugccacaauggaucagaaaucccuccccuagcaggggcuaacuggcuaacugcucagggcacgagaagacacuguuuggcauuggggucacucugaguggugacuucugggcaauucauguuuauuuauuauuauuauuauuauuuuauuuauauauuuacuuugguuuuucgagacaggguuucucuguguagcccuggcuggccuggaauucgcucuguagaccaggcaggacuugaaaucaaagauccuccuaccucugccucccgagugcuggaaguagggcgcuaccuaccaccaguggucaccuuaugcuugcuuacaguuuccaagggugaccuucugcuacucuuacuuuauuuccucuuuaagcuuagaugacagcuuuauuaaaaaguugucaggggcuggagaguugagucaggggucaauagcaccacuaguuuuccagaggacccaaguuugguucgcagcccacggggugaaacugucugugacuccagcugccucuggccgucucaggcagugccgcucacuuacacgugccuauacacugacacagauaccucaaaaucauaaaaaaugaguaguaaagacauaacaaguugucaugcaugguggcacaccccuuuaaacccagcauuuaagaggugggucucugugaguucgaggccagccuggucuacauagugagcuccaggccaucuaagaauaccuagagaaauccugucucaaaaaauaaaaauuaaaaaaaagauggccaguuucaaagaaagcaaacugcagucuaccgaggccugugaacacuauuucacguucgcuucuuaaccuaguuucuugguaggcccugggguggugccagcagcuuggccuuccucagcaagaguguggccuugggccagcacccaucaacucuaagccuuauuguucugugaacaaugggaugauaaauccuacuuuugagaugauugugggcacaaaugauucuuuuggacagagucuuuuguuucagugccuucuagaucacaguaaaauauaugggauugcaaggaaaaacaguuccguucucccgauggacuuugugugcgagugcgcacacaaauuuguauauguaccugaacacauguaguguguguguacacacauguuugcguauauguacugauguacauguauacauguggaggacaggugacauuccuuaggaguccucugcuuuuuuuuuuuuuuaaauguguaugagugcuugccugcauguauguauauguuugaaccacaugugugccuggugacugcuccacaaaaggggugccagaucccccagaauuggaguuacaggucauugcguauggguggccccauuucauaugggugccgggaacgggacccggauccagaucgucugcuaaagugacacgcacucuuaccugcuaagccauuucucuaacuuagaugcgcuuuuugagauaggggcucauugguucggagcucagugagaaucugccugucccacguucccauuauugggauuacaagcgugugccagugugcccaccuuuuucuuucccccaugguucuggguccuugugcauauaggcaagcacuuuacugagcagcuaucuccccagcccuagaccuucauuaucaguucauuggauaagguguguucauuuaccacuaugucuaguguagcuacuguaauuugaagugauaagcaggaacucucucucuuuuuuuaucuguaguaacugagacgcagucauaaaagaauacaauguugcuggccaccguguaacucaagggcaugaccaacaguguauugccuguguucauaguuggggggaaugcuagcucucaggaaggguuuucucaucuccauucauaguaccugcuguagcucuuauuugacaaguugaucuguggaaauaaagcaugccccucccuguuguccaugggacagggaggccaggagcaggcagacauacuucaaggcuaugggcacguaucaagagaucugugcaggcccagguugcuggcugguaggguugaggaugguguagugaaacuuuuccugcccugacugggcaagccaucgaggaccacugcugccaagaguucuugggggacgacagaagcuccgguggcaagguauguggccagccugcauucuggagggacugcugcucuuuaguuaaaccugaggucguguauaugugagggcacgguaaagacaggcugugggagaccugugauaaaacggggucccggggccaacuuccaggguucgagucccagcucugucauuuuucacaggggaacccgggaggcuguuuuaccccucuguguuucuguuucuuuaucuacaaaauagggcuauauuugcuccuucguacagaguacuguaaagacuaaggugauguuucaggcugucagugaugacuaaugucaaccuacucaguccuaggaucccugggccccucugaccacuggcuccuaagcaguguuucucugggcuucucagagaugagucaggcgcagcuucugccuucaggagcuaugacuggggagucagggacagacacgugacugcaaucagcuaggacaagcauggcgguuaugacagguauaauauacaucaaccacacaaggugccaguguuggggaaagcagugagcuuggguggaguugggagagaagcugccugguagaagagacauacaucacaguugaaauuuaaagaagcacuggguauggaggaccauucagaggaggcagccuggugguccaccauugcuggugugugaccuuccaggccuugcuacaggaccaggggaggucaggcaggcccugcugugcugcagauaccagcuaaagaauguggacuuuguccucuuggcaagggugucauaggaaguuuuauuuguuuguuuauuuagcuuguuauucucaagaaguugcaaaaauuguacaaagaguccccuucagucagcuuccccuaacaguggagucuuguguaguugauguauauuauuaaaaccagagaaccagcguugguacaucacuacucgacagcuuauucaggucucacaacucugugugugugugcgcgcguguuuguauguguguguuugugugugugugugugugcgcguguguauucaacacagguacauucacagauuuuuuuuuuuuuuuuaaagauuuauuuauuuauuuauuuauuuauuauauguaaguacacuguagcugucuucagacacuccagaagagggcgucagaucucguuacggaugguugugagccaccaugugguugcugggauuugaacuucggaccuucggaagagcagucgggugcucuuacccacugagccaucucaccagcccacauucacagauuuugagaaggggaaugacaucgguguaugcauuagacagaugucccuggcccccagagugguagcagauuguaggggccucugguaagagaugaugacgucccgcaagacgccugugcuuggagagagggaagcuggggagguuuuugccacacaucaggagaugcuuaggagguuaaagguggcgggagcuggggucuaacgaaaccagaugacagucagagcucuggcuagggcaguaaacaagaauggaggagggaggaggggaggagaugcuucguucagucuggaauguguuuagugggaagaagccaagugcagcugggaugggcaugaagauuguguggacauagauguaggguuuuguuguuguucuuuugauuuguuuuuuuguuuguuuguuuuugguuuuuuuuuucccagacaggguuucucuguauagcucugacuguccuggaacucacuuuguagaccaggcuggccucgaacucagaaauccaccugccucugccucccaagugcugggaucaaaggcgugcaccaucacugcccagcuguuuuuugguuugguuugguuugguuuuggguuuugccuucgcuacccuggaacuuacucuguagaccaggcugaccucaaacacaaauaggccuuuuuaaauauuaauucuauuuuauguguaugaaugcuuugcauguagaucuguucacaguaugugugcagugccuucaaaggccagaagagggcgauggauccccuggagcuggaguuggagcuagcacugaggaggggcugggaacugaaauugggccuucuggaagagcugccugcucucccugaccugcugagccaucgcuccagccccucaggcaugggucuggguguggguugugggguucucauuagaggucauggguaaccugggcagcagauguccaggugccaccacccagaaggugaagcugaaaucuuugcugcagaggagggguacacuuggcaagaggguggagucuugagucaccagcaugcucaugagaucaugaagugcagcagcucgucuggggauugcacaggaaucaggggcacugucccuuccauggagucucagagacauuggccuugaggccuggacagagaaaagcccacccacagagacagcagaaggauccuagagguggggggggggggggggggaugugcagaugcggccuagaguccaggaagaggcaaguuaaaaaacccugcuaccucagcagcaaggguggaaagcugcuuggcuaaagacgugaagcagaauuaggugagggcugguugcugaguuaggguauugagugagucagggggauguauguagucaacucuuguuuuaacugcagucaugacugggagaggggcaucauggauuguacccaagggagacagaaacuggaguuacugugagccaggggagacuggagcaugguggucaauggacagguccuccagcugggccugcuugacagcgaaagugacugugaugugcguaggcucuagggccaggcugccaggguuggcauuccauauaccaacuccgucauuguggauguagcagugagcuuuucuguaccccugauguccucugcagaguggggacugccaacaggaucuaccuuagaaagcuguuauggagcuuuaggggagcgaggugcccaggauagcccccuggccccaggggagccacucagcaggugcaagcacuucugugagugucaucucucugggugcagaucuucuuuuauuuauucaccuguaaaauaguggggcaaacgagcuaaugacuguucauucauucuaccagcauuagcuuacucugugccaggaccaugagaucuuccagaggcccgcacagugccucuugaacuaacgaacugugucaugguaauuaacucuuauucuuaccuucuccucgcccaccccugucucagugcugggaucugaacccagaacccugacuuuguaugcuggagcucucagguuccugguucccaccugcuaccugcccuacuaaguuggucccaagucagucaucuuacuuuguauuucagauuuugccugugggggagaaaaaaaaaaucucauuacagaugguugugagcugggauuugaacucaggaccucuggaagagcagccagugcucuuaaccucugagccaucucuccagcccucagccccgugcuuguuuuguguuauuguuguuguugcugcuucugguguuuguguguguguguguguguguguguguguguguucaaugagauaagaucucaaauuguaguucagccuagaaucaggcucucuguagagugguuauaguaguugagucuggccuuaaacuucugguccuccugccucuacuuccagagcugggauuauaggcaugugcacaacaccuggcauagaauauacacauaaauauauguguauauauacuauauguacauuauaauauguuuauuaccacuguguguguaugauguguguaugaguguguagaaacgcaggaugcacacuguuguguggcagucaagggacaacucuaaagagucaguucucuucuuccacagugggaucaaguagucaagcuuucuaucccacagguaaucggaauucacaaagcauucugaggucuauucuuuuuuuuuuuuuuuuuuuuuucuuuuugagacagggucucuaugaaguccuggcuuuucuggacuauguugacuaggcuggcuucaagcucacagggaucuaccugccucuguuucugaaaugccagguuaaggguguggcucaccaccccagcuuugucuggguucaagugagggugggaagaggggauacagugaggaucccucucuuucuaguucccauccuuuguagccagggcucugcccaggguguuacccugggucaccuacugggccucucaccacgcguuaguaugcauuacuguggcucuuagcagaagugucacugugacagggaggaguggaugagggcccaguaaguguuuauugcuagaccuuucuugugguagcaccauuaagagcccagggguucucuuuaaccagugcccacuuggguggcccuaccaaaccucuaccugccguguugcuuugugaaauggaaucuacucauuaguuuuacccuaaggccuuuauacacagcaggagaccccucagugauccauaaagacccugggauugaacuaggagaggcuuuccuacaggaaauuaugccggacagacauccgccuuggggcuagggacagaugucaaauacccuaucaaagcugaaagggucggccucuugucauuuuugagggaggaacuggugaccugagauaagguguccuagaauggucuccacuugcuggcugcauaucuuuuuguuuuugcuguucaagacaggguuucucuguauagcccuggcuguccaggaacuuacuuuguagaccaggcuggccuugaacucaaagacccaccugccucugccucccgagugcuggggucaaaggcgugucccaucaugcccggcuauggcugcaaaucuuaugaaccauuugaacauugugucuuuauccaucaaauauuggucugcuauucaugacuguaaccccagggauacccaucaagauugaugaaagguagccaugagcccuggcccaucuugcuaggagagcucaagagcagguggucacccagaaggcuccuguccaacgcugacaugucugcuuccauuuacucuucaaauucagcuggcugugguggaggauaccuauaaucucagcacuugggaaacagaggcaggaggauuacccaaagccagaggcuggucuggucuacguaacaagugcuaugcuagucagagcuccauaauaagacucauccuaaaaagaaauagauagggcuggggagauggcucagcaguuaagagcacugacugcucuucagaagguccugaguucaaaucccagcaaccacaugguggcucauaaccauccauaaugagaucugacgcccucuucucgugugucugaagacagcuacaguguacugagauauaauaauaaauaaaucuuaaaaaaaaaagaaauagauaaauaaacccaaaacaaccaaccauacuaaaggccaggucaagccccgcugcccagagccaggagcggucacuucaaguguuacccuugucuacugacugcagaaggcugccuucaagugcagccugggcacugucuggcccggucucuaacucaguugugagucuggcugggguacagaaauggcagcuuucucauuuuauguagauagccauugcugagcugaacacccugcagagggauucucauuuugcaguagccuguugaugaagugcuugucacacaccagacucuuaaaauuuacgauuuccugggcgcuguuucuguuugcgauaucuguuuccugagucuagaggaggaaagagagauuucacagggccgguccauacaagagggcaaagaggcgggcaacucugggcuguggagaucacgccuaucgcugaagcagggcuucuuuaccuccuggcuucucgugcagccaccuuggaauugaugcuugaggugacagcaggcuguguuugugaaugaguuggcuggaugucaggacuggggacggauauggaaguguuucugccugcaguggggaaaggggguggugguccugguaguggacaucagggagguuggucaggcagcccuccaacucauuauccuccugccucagccuccgaguacggagauuacaggcacgcaagcacugcaccuggcccaguguagggaaucuugauugucugaagaaaggagacucuucagacaucaaacacugggucagacaggaucaaaugugugacuuugaaggacccuccccaggguguacuugggaaggcugagggacagugagaaaacuugcccaguguuuggggacaguaccagcuagggguaaggaggggcagaggccaguuggugggcaaggccuaaccacugggggcucagcauaugugaucauggccaugccauguggugccugugcucagaccacagagauuucugccuuccacagcuuccccuacaugggacugggcccccauugcauggcaacagguauggccuuguccucccugccaaauuguacuuccaggucaagccugacccugacccguugaagcgauccagcuagcucccagccaacacucgaugagugagcauugguagugcuguuucaaggacuggagagagauuggugcuagggaaggcggggagccuuugcagggggcccaggaaggaguauggcagugcggguguaaggaauugugagaggaguaggcugcaggaaugaggggcucacucugcagacagaguaaccagagcuaucauggcuggccucccgccgcaacacugaaauacagucaggugucugaccccaagaaccacaugccggguaucuuguaagaggugggguggguucaguaugaugucacacauuuuccugugauguuuggacuauuaccuaugccaggaacucuguaucugucaccccccaaaaugucaccauagccagugggacaggaucugccaucagccccauuccccacuugagacacugagacccaugaucacaguaagagcagauguuggacacccaugucugaggcugaagccuuucuacgguccccugacgucuccaacacaguuagugucagugucccauaaauacauccauuaguuucucgguguauggaaggcuccuugggguaacagcuauguccccaucagcuuagacaucuccagaccugcugcacugucuguugaagacauggcuacaggcgugcuguggagagagacgaacacuccccuccccgacagggccuuccugggcugagcuccacacccuggcccaggcaagaggugcauccuagguaaccaccagggcucauuaagggaagagagauacagugguagccuuagccaccuggcagcuuaugacccccagcugugugagggugagugggcucacaggagccuguggcaggugccugucuguauacaaucaggugccccucauauauaaacagcuaccagcuaguguuggcacuugcugugcuccuucuccuugguggucugacguuccuggucacugguagcauacaugacugaauuuaaugguaaaacaagguuuucccuuggaacuugagauguuccaggcacugcucaugcccacccauuguguggugaagggcaggaggcccaugaguacauaccccuugcccuucaaguucaccacacaaaugagaccaguggaucacaggucugcaagguggcagcauagucccugagauggccugccacucuguaaagacccccuuuaaaccuuuagcauggaaugagcaggagggaaagagcccuucugacaggcacaggguaggguggguuagcagcuacuccccaccccccagcccugucacccccacgcgugcacgcgcgcagccugucugauugauggacuuaugcucucccugcagacacugauggagaggcagaaacggaaggcggacaucgagaaggggcugcaguucauccaguaagugggcagugggcagggggguccggcucuccuuuuccuccuggcugagcacugcucagcgugcacugggaugcggacaggugggacaagcugggaacagggcccgauaaggugccugugcugccuggcucuggcugccccuggaucuuguccaguaucauucuacccuggcccuucacuuguuuuucuuucugagacaggguuucucuguguagcccuggcuguccugcaacucacucuguagaccaggcuggccucaaacucagaaauccaccugccucugccucccgagugcugggauuaaaggugugcaccaccacgcugggcuuacccuggcccuuuucaucuucugcccccuugagcaucaguuuuccccuccacgugggaccaggagacaagcccugcccuucucccaggcugacacagugcaagcucuccugagccaaugcccuccuccaaagggagcuguagucuuacccacaagagagaauguguagccauuggcccugaguggguuguuagugucugguugagggguuggcugcugucacugggccugccgcugacuaacugagcagacuccucugggagagcagggaaaauggaaguccuugcaucagaacugagugacuccaugcuguccggucaccucuuacuucagccacagcugucugaggccuacucuugguccaccucagcccugaagugccagccucagggcuccucaugggaccaaccuggguucacccuguccugugucucucuuuucccacuaggucaacacuaccccugaagcaagaggaguaugaggugagugucgcugugguggguggaugcggugagggcugcugugcucagggcagagggcugggacugagccaggcuggauggagacccgcuuaguccccucggaccugccuugcgcaggcuuuccugcucaagcuugugcagaaccuguuugccgagggcaacgaccuguuccgggagaaggacuacaagcaggcucuggugcaguacauggaagggcugaacguggcugacuacgccgccucugaccagguggcucuaccccgggagcugcugugcaaacugcaugucaacagggcagccugcuacuucaccauggugcguccaccauccuccaacccccuacccuagccgggccccgccccccagccuugcccuacacgcccuuagccuaggccccgccccccagcagugcccuacacgccccuagccuaggccccgccccucaccucuucucaguucucuccuauuuuaaaagacagugucucauuauguagcuccgggcuagccuggaauuuucaguguauuagaccaggaauuuuguguauacaacucagaggggaacacacacuugccuuuaucuccuaugugcauggauuaaaggcaugcaccaccacacacugguuugaguuuuuuaaauauuaauuuuuauuuuauguguacugguguuuuaccuacauacacauaucuguuuaccauguaugugccuggugccuguggagguagcucugucaguaaagcacuugccuuuauugcuuuguaagcacgggggaaccugaguuugaugcuugauucugaaaauacauagucauacacacacacauaaauauauacauauacauauacauguacauauaugaugcacaucauauauacauauaacacacucauauauacauauaaacauuuauacacacauauauucauaauucacccccucacacccuuccccauauauauguguguguguguguauguguguguguguguguguguguguguguauguauaucuacauauauaucucagauagauagauagauagauagauagaaucccauuggagcucauugucuagccauuucuuucauuuuuuugguuuuuugagacaggguuucucuguguagcccuggcuauccuggaacucacuuuguagaccaggcuggccucaaacucagaaaucugccugccucugccucccgagugcugggauuaaaggcaugcgccaccacucccggcaucuagccaguuuuuauguuguuuuuguuuuuuguuucauuuuucgagacaggguuucucuguguagcccuggcuguccuggaacucgcucuguagaccaggcuggccuuagagauccgccugccucugccucacaagugcuggaauuaaaggccaugugccucugucuggcuugucuauucaguuuauccauucagugaaaucagguccacugagagaucacguuacauggauauccuugggugcacagaccuacaaacauauccauagccacaacaacaacuacaacacaacaacaacaucaucaucagaaaaacgcacuagccaucaccccccucucccccagaugaauuugagggugagccucucccugacggcauuucugagaggugcuucugucacucugagccaaaggcagacaagucaacagaugggucaccaggcaggcucacuguuguagaaccugaggcucucuccaguguccugccaguagcugccacagcucaucauccuuacaccauguguuaguuagagguuuauuccugugaagagacaccaugaccaagacaacucuuauaaaggcaagcauugaauagggacuggcuuacacuuucagagguucaguccauuaucaucaugguggaaagcaaggcagcgugcaggcaggaauggugccagaggggcuaagaguucuauaucuuuuuuuuuuuuuuuuuuaagauuuauuuacaagcugggcgugguggcacacgccuuuaaucccagcauuugggaggcagaggcaggcggauuucugaguucgaggccagccuggucuacaaagugaguuccaggacagccaagguuacacagagaaacccugucucggggaaagaaaaaaaaaaaaaaaaaagacauauuuauuguauguacaugaguacauguagcugucuucagacacaccagaagagggcaucagaucccauuacagaugguugugagccaccaugugguugcugggauuugaacucaggacuucuggaagaguagucagugcucuuaaccgcugagccaucucuccagcccaagaauucuacaucuugcacugcaggcagcagaagggacugugagccacacugggcagaacuugagcauaggagaccucaaagucuaccuccacagugaugcacuuucuccaacaaggccacaccucuuuuuuuuuuuuuuuuaauuuauuuacuauuauaucuaaguacacuguagcugucuucagacacaccagaagagggcguuagaucucauuauggaugguugugagccaccaugugguugcugggauuugaacucaggaccuucggaagagcagucggugcucuuaaccacugagccaucucuccagcccaaggucacaccucuuaauagugccacucucuauggccagacauucaaacaccugagucugugggggccacaccuauucaaaucaccacacaccaucagagucaaggcugcccucgcucccugagcugggccuugaagcucuucagcuuggucucugagcccagaccccgugcuguuccucugcaggaaagugagguugcuuuccaucccaggggucacaggcgcugaccauuggacugcuugguugucucucagggccuguaugagaaggcgcuggaggacagugagaaggcuuugggccuggauggcgagaguauccgggcacuguuccgcaaggcgcgcgcccucaacgagcuggggcgccacaaagaggccuaugaaugcagcagccggugcucccucgcgcuuccccacgugagugccgucucccaagcaucuguacugcgcccccccccaucccucccaccccccacccccccacggcccaugcgaccacguccuucugugccucggcuuccuccucugccgcgggagguuugggauccugaugcggugcugacaggagagccagggcgauguaaagagaccuugucagccuugaaacuaccuagucucaucccuagcacugcuagaaaauacguaaacacuagaaacagccuggcucugugggcugugccuauaaucccaggagcucaaggccugcuggagcaacacaaggaguuccccauuuuagagauaauauggaaaaagauuaaaaaaaaauucaacucauuugccucccccaaaauaaaagggaaaacaaaacagccuugugguucccagaaugugacuuagaaagccagcaacagcucccagggacacacaaagauguccaggagcacagcucggagcuccgggcagccuagcccaccagguguaucuaagccuguguccugccuuccacaggaugaaaaugucacccagcugggccaggagcuggcucagaagcuuggacugcggguacggaaagccuauaagagaccccagguaggugagauuuggggucggcuuaaagaagaggggugaagggagggacuagggacuauagggacccugaguaagguagccagagccugguaaagacagaggaagcaacagcaggugaccuuccucccuauuggccgaacacccuggaaugagcaguaggacccuggggaagaggaaugaacacagccaaagcuccagcucacugcagacaccagcuguaaaaacacagcccugccgcucgcccuagccgacuuuaaccaggcugaagauggcccaaauugacacugccguccuucaguuucgcauucucaaaugcccccucauuguaccuguccgaauguuagugucggcuggacuccuucacauugaauacugucguccgccgugugucuggaaacugcgugacgcagaacauauggcuugaguuucucuggcccgaccuuaaacacauuagugcauguuuccacccguuuccgcaucuggaaggcagauaauuacacccaccucaggagcucaagggaggacugaaacaagagaguguaugagauggugccuggcagaucgcagggauggguguguguucagauccucugcccagguaacccuugaaagauggaaaaacaaaaacaaaaacaguguuacucuggaagccagagccagaggcagugguaguccuggggggacgggauggaccacagcugaugucagggucucuguguugucuuggcugauguccacagucuuaaucucugcccacuucuccccaauuucuggcaggaauuggaaacguuuucucugcuuaguaauggcgcuccagcuggcuuaacagaucagguagggaggggucugagacuccaaauguuucuccaacuuuauaccagccugucuucuucaucuauucccaagagcucuggggucauuagggugaccccaagcaguagaccacaaaccuucccaugucuggcacaaggccccccagccccuggcuacucuuuacuggugcaucuagccacauccacaaaggccaggacuggucacagugauggggcuccgugaggaggccagucgaaguagagaugauaaggccaggcuugccucaguccaggaagcaucugagaacucaggagcaggcgccagguagugucuaggccugcuccugguguccuguggugccuacaggagaaauggcacaggguacaugauacauggucacacaugggcuuccuucagcugcugcauuccucacgggcuucuccagcacaggacucguuuucuggccaguuggucacucuguaugugugccuagaacuagguggccagggcugugcucacacgcuguucucaguauuuacaaggcacaguagccccggagcuuacagugcaagacacccugaagacuguaaacucguggugcagagcagucucacccagcuggggggauagcguuagccagguagacaagcaacaggauucacaggcccguagucaggagagcaagggacauuccugaggccacugguagagucaguuccuccucaggguucaggagaguuagcucugaagccgcaugugugagggucagauccugagaacacccuucuuggccuuuuauugcuaaguggauguuacuaguaggguucugugcaagaggacugggagagagaaacauggacagaaaggguggcaggagggcuggaagccacuuguucugcagggccuaggcugcacuguccuuagaagcauucacuggggccuccuuugucuccucucgccacccccacaccccaagcacguguagcccuggcuauccuggcuccauccagccuguagaucaggcugaccuagaacccagagacugaccugccucugccucccaagugcugggauuaaaggugugggccaucauugccuggacccccucgccuccuuucuguauguaaaagcagcucugugaccauccugguagccuuggucuaugcaacuuagcugugauauacaaacaccgcacauguucacugugccaucuguggacaggcucggggguggggcugaaagagcuccuggcuccaaggaguggacagaacagacagggucagggcaggcguuagacagcccuacucugaccuaggaauugcacuuuugaccaauauuugggccguggaacaucucguggagugcuggccaagcagggucggugaugcggggcuggauggguuguguugcaauuguugcuacugcuaaccuucaagcggugacuaacagugagugucugggccuucucccagucuccacagagacaagaaggacacagggucagccugggccucguaaggaugauaaaggcccggggucggggggagagcacauucuggguagaggaaugacuucugucccuuguggcuggaacaaggcagaggaguucauugcaggccaaccucccggcagcacauguuauucacaugguuagugcugagcaugccaggcacucugcugaggugccucaucucugccaguuucaggcagugugacugcugaauccuuacuuuacacccgaggaaacaaguccagauagguugccgacuuggccagaccaaagagcaagcuccagcauuucccaucccagacagggcucugaccccaguacugugcggcugcagaguacaggcucucuggaacaaccccccacccccgcaccccaggaggagccggccagguugcugccugaccugugaauucuguucugucuuugcaauggggauggacuucccaccuaagaugacguucuccuuggagggagauuagcuuccugugaggcugggggcugagccggggaggggggggcacacauuccucuaagaaaccaucuguaguguggaaggccugguaaaauccuugucacuaccuuuaaucccagcaauugggaggcagaggcagguggaucuccgaguucaaggccagccuuaucuauauagugaauuucagggcacccagggcuuuugagacccuguuucaaaaacaaaaccaaaagagcccaaaacccucucucgccucagggcauggauaagacucuacccuuuuccagguaccucagagguguaccccugcccuggggccauugcuccccugaaauguaccuaccaagcuaguuuaccccaccccugucucagcccacgccugcucggacccuggcugaaaagccagccuaccugugauaggcagucguuccccagugaguggcccucaguguacccugguggaaaugugaggccauuccacccuacaucuuuccucucacagggaacuucuaacggauugggaucuauagaugacaucgaaacagguaugucucagcuguguggggugagacaccgggagggcuucccugaggcaggccaggaacgagcacggcuuccuccucagcuugucuccguccuucauucaugccuguccgugucggacaccuuguguuagaacccucacuuccuacuuccuuuucucugcucgaguaauaagugcuugaagaaggcacugcuggucccagagaaaggugacauugguggguauuugaggagugccaaggcaaucagaacccuuccacagcuucaggcugucuuuccuccuugacuaccucugagccauugccccuggggcagggaauagggaacccagauccuuguggaaugggaagaagggaaggcguuagcuuagugacugggcaacacccccaccacacgggcuccuuucagcucugagcucacucccuccacagacugcuacguggaucuccgaggcuccccagcccugcuccccuccacucccacgaugccccuguucccucauguucuggaccuccuggccccacuggauggcagcagcaggacacuccccggcaccgagggccuagaugacuucucagauggggauguguuugguccagaacuggacacccuccuggacucucuggugagccaugcugccgacuucuuguucugucccuugaagccccucacuuagaaccccacagucucaugaagaggcaaggggagggcgccgucuucacgucucaguugggagaauggguggcccugggauggagggucuugcuggagccuacagagcagaucccagagagaucaagcagagccccacuuccucuucaugagcagucacugucaggcucuggaggaguaacugcuuccuggaaugucauacccacacgggguugggugguuauguucucgucugaccccuggcucuguccccacuuugcagucucugguccaggguggccugccuggcagugguaugccuagugagcugccucagcugauccccguguuuccuggugggaccccacucuugccaccugugguggguggcuccauccccguguccagcccacugccuccugccuccuuuggccuugucauggaccccuccaggaagcuggcugcuucugugcuggaugcccuugacucuccagggcccacgcuggacccccuggaucuguuaccauacucugaggcucggcugggugcccuugacagcuuugggucagcccgaggcucccuggacaagccggacuccuuccuaggugaggccuugguuggguacuuugucuaucuucucccuugacagcgcugcucuguucucucaucucugaagcucugcaucuccacagcacaugcccauaugucuaucacagcccagggcaauacaugcugucuuaucucugcugugcucagcacuuccugagcuugagccccgggcuggaugucucacucuagaucaaacaguagagcuauguuaaugauucuaucuggugcuguguccggcccuccagagcccuggaccuccagacucagguccuaugcagauuauccagauacaaggucaugagcuacaauagcccuucucugugcugggaaccagggacauagccauugaccaggccuugauaggguugacuuuuagaggucagagauagacuagggcacucaagacugagggaccugugugauggcauaggucgacaggaagcagggcuuccuucugggggaccugauggcucagaggcauagagucagugugguagaggaucugggucuggcugacagcuagagcggaaguuccucggggagugugagugagcuacggucucacugacccaaccuuccucccauagacaacaggaagccacaaaaggcauaaugagcaaggguagacauguuagagccucuuugcuucagggcuguugaccaugagaauaggagagugagcccaugaaacuucucugagguagaaauuacaggggcauccccuccgugcuggggaccauaacccuugcgucuucuccuuuccuagaagagaccagcucgcaggaccaccgacccccaagcaguacucagaagccagcccccucggugagugacuugagcggggcucccagaucggaccucuuauucauccgaugguuacgcgccccagauugggggugagcugagcucucuguauuggugagaugcuacauucuucaagaggggcaccugcagaguggcccuugugcuggagaacacaguugggguacuccuuaucucaaggcucagcagccauaagugauaccgugucucugcucuccacgcucugccuguucuggguucagaagagcauuggaccacaagugagcagcauguaugcauacuucagcuuagauacuagcugugugggcccuagacaaucauuggcucucccugagccuuuuccucugucuguugaugaccgggccacuuccacgagagcaguagguccuuaagcaggcccacugccauuucucugcuuuaauucaaggaaacauucuggagccaagauggcgucuacucacuguccagggucuucugaggcaggucaugauguuuugggcucuuacauuacaauacaaggccugggaagauguagaagaggguccuaggcuacuguucugauacuggguaggacauauuggagcagggaucaaaagacauaccuagucucacugcuuuggcugacccugguggucccagguacccucagggccaaacauggccaaugucucccuauuguagccggagcccucaaugcccaacaccacccugcucaucaagaacccucuggcugccacccacgaguucaagcaggccugccaguugugcuaccccaaaacagguaauuucacaucugcagcagcaccccucugcccuggaaaugccgggacucucaggaguggggaggccacuaacauuacugugugcuagugggaaaugccuggaggaagacaaggcccccccugcaggaaaugaaggggugggcccugauugggaccggccuucucucugcaaaguguugucuucacaaucccagaaacgcugacuugggcagacucaccaguaaguagguccaggacuguuagggaagucacguggugggaacguucccgggagggcuucuccaagcccucucuuucccccugcaagcacaugccaggagauaggaugggagcuucagagacccagaugagggcacguggguuuucuggauucacaccccuguguacccugccgacaggccccagggcuggcgacuauaccuaccgugagggccucgagcacaagugcagaagggacguccuccucggccgccuccggaguuccgagaaccagaucuggaagcgcauccggccgcggcccaccaaaaccagcuuugugggcuccuacuaccugugcaaagguggguggaccacaguggggcuggcuggugccagcuggguccagcuccucccagaccuacugcagugaccauaggggagaugagaaagcucuagugaagcccaagucccauaggaaagcaagcaucucucuugacuuugucugaagacggaggucauucaggauaugcuauggcgcuggagccaucugguggccugcaccaucgcaugugagggucccacgguucguacagccagguucauacccugcaggauuccagaagggauggguagagucccggagagcacacgggaaaggcuugcagaccacaguuguuuuuaaugaguacauucucuuccuugcccucauuucugccucacagaaaucuggucaguuccaaacauacguuuuugguguucuucaguuucccugaacagucaugaagcacaucuguacuucagcccuucuuugcacuuacccccaaacaucugcaagugaccuuuugguacuuagcauccaccccaggcuccuuugcccucucacccgccucauggcaacuacccacacaguccuuccagaccauucaguguccucccugaagcccuguccauggcugguggcaugaagaaggccaguguaugcccacagccacaucuccacccuaacugcuccacaggcacacucgcacucccccacccccaugacacaugcucugcccuuugagccugguggccccaguuuuggaagccauucccuguaccacucuccuaccccucugcagcugagggugcagccacgccuccagcuccaguucaguggcccauguuccuggaacugaucacccaguuauucaccuccccagugaauaauccuacagacugccccucuuuauauagcuguguguauucuacaaaggccuuugcgcauugcuugaccuguacagacacuggggucccaggguggggugggguuuggaggguguugagccuuccacacuggggccugguaauuaggaaaaggauccaucuuggacauuggcagccaccagugcucugcacugguggguucgcucccugcugaccacagugagaucacagggugcugugggcugccucccucacgugguagaacgugugucuuauugccucuuuguagacaugauuaacaagcaagacuguaaguacggggauaacugcaccuucgccuaccaucaggaggagaucgauguguggacagaggagcggaagggcacacucaaccgggaccugcucuuugacccucuagggggugucaagcguggcagccucaccauugccaagcuccugaaggagcaccagggcaucuucaccuuccucugugagguaccugccugcccagcccguucaucagaccaccaugguccccagcacagucaggagccauuagcccuggaaccuguggguguggugagguguggccggaaaaucaccaguuagguccuggggaucaugguggaacccagauccugucuggcuucucauuuuacaaaugugaaaguugaggcuaggagacagcaauaaccauccgguuuguucuuccuugggagcccggaaugugcaggauuuaggcuuuuaacccauacuuucugggcagccccaguucacagauacuguccugguucacugguggugcuaggaauugagguaggucuugccugggucaaccugagccacgcaccccagagccgaaggccaccuccugcacagcacuggcgaucuuuagggccaagcugacuuagaaucuuguccagugucauccccgaaucccauaucguggcuaugacaaauuuagccuagcucagaugucuagagaaagaugucuauggcuagccuuuucacaucucccccagcauguuccaaccugacugugccugguguuuccagccuguaacccagcuaugccgucacacaguauccucccaaguuucuucauuccuuuccuaggccaguugugagucugguagcucugcggagauuuccuggcuuuggguucuuuugucuuuucaaggggcuauugagacagagucucacuauuuaguccuggcuggccuggacuuugcuguacaggccagguuggcauugaacugacagagauccaccugccucugcuucugagcacuggaguuaaaaggugugugccaccaugaccacuggccuuucccagucuugagaguacaguugguucuguagcuccuugaaggugggaacagugacauggucaucucugaggaggagggguuggugaggcccagucuacccugaucugcugaccugcugucuccccuagggaggacuuggcucgggggucauagcucacagccauaagacaggagcuccugagcucugucuucucugugauugagcggcacagagaacccaugggauaaaguagguucaugaucccaguuugcaguugagaaaaccgaggcucgggagccauggaguaacuccugcccuaggcaccggaguuauguaaucugagauaggaaggagggagagcugugggccagagaccugagguucacagagccuggguccucuuccacauucccccuaccuagggcacaguuuacagggaccagauguccuucccuagguggcccuugggauucuagcccauccucuucccggguggcccagucaaggucccggcccaucuccucccugaacagaucugcuucgacagcaagccccggaucaucagcaaagggaccaaggacucuccaucugucugcuccaaccuggcugccaagcacagcuuuuacaacaacaagugaguccugcagcugcgcagugggugagacaagggaggggaggucccuugagggcagcuugucagacgaggaacaacgagacagagaauggugacacauucaccuaaaaaggacaggaaccaggguuguugaacacuuccugucuuccagucauugucuuggauauuuaauggucucagcagcccccuggggagggaguuacugcuccccuuguacagaagagaaagcugagguuugggaacagcuuggucagcaggcagauaugcccugcugagggcucuaaccagcaccuuccguugucaugguuucagugucaaccagggcaugggaggagcugggucaggaugauaccauuaccuuugcucuuucuggcucccugaccugccccaucauuugagauggagucaggcccuggaguuauacagcccuagguccauaucacagccuggccagggucugguuguagguuggagcacuagucauugcaaccuuggguuuccuccucucugaaaguaaugauguucccaucuugacggguuucauucaaggccacugaguuuccccacccagagaaagugcuucauuauuaucccccuggguauaagaccagcucuggggcaccaagcuggaauugcccuuucuacucaugggcauucccuucucccaaccuggugaggucuggcacuauugguagaccggugcaaacugagcuggccccagagcucugugauggagcccaagcagagcagagcugggacuaaagucuugagcguaggcuugaccuaccuccugugcuauccacauucagagaugggcuaacaggacaggaggugcccgggagaaagcucugagaaucgccuccccucagacuugcuuggcacuggaaagguggccccacugcagagauggagggcagauggugguggggacugucagcaucaugcacgucccgugugcccuccaggugccuggugcacaucguccgcuccaccucucucaaguacuccaagauccgucaguuccaggagcacuuccaguuugacgugugccgccacgaggugcgcuaugguugccugcgcgaggacagcugccacuucgcccauaguuucauugagcucaaggucugguugcugcagcaguacucaggugaggggcaggcagagcaggugaaguaggcuuggaauuggcugggagugcacagccagggccugauggccaccgaaugggaccucaggugaguucacaaacggguggcuccugggagaguccuggaggaguuaguaacccuggauaucacagacagaacucugcucacagggugcugcuagguccagaaucuggaucucucccugucuagacccugccuagggaauaugccaagauacagaugggaaagcaagaaugugugagacucgagccugguagacucagccccuggacccuacaacuccaccuagcaacucaccugcugccugaguaacggccaauaaggcaccuuucuuuccuugagccaccuucuguugguccagcgaguggauuuauggaugcucacacauccauccuucuaacugcuuuagugagcacccucucugugucagcgcauccagccuugcacuaagcaaagcccucacuuugaggacucaauggagcaagacaaacaauguacuagcaagaagugaguccuagguucuguugggccgaggaugcguagucuucuucacugccuguuguaguuuugccagcauucuuguggugucaggguaagauaggacauaugacagucaguguccaguccacauagacuuacagucgauaguguuuuaacuuuagguguguaucacauuuccugucagguggugagaaugggccugucuagggaaggccagggaaugacugcuccaggaagcaaaggacuugaggcagaagauuaucccuggggguaaagcacugagauccgugagaugguugugacccaaggucaucggggucccaguuugugggagucucuuggccuuaagaagaaauauagucaggggcuggagagauggcucagcgguuaagagcaucgacugcucuuccagagguccugaguucaauucccagcaaccacaugguggcucacaaccaucuguaaugggaucugacgcccucuucuggugugucugaagagagcaauggugaacucauauacauaaaauaaauaaaucuaaaauaaauaaauaaauaaacuauuaaaacuuacaaaaagaaauacagucaugagccaggcgugguggcacacgccuuuaaucccagcacuugggaggcagaggcaggcggauuucagccuguucuacaaagugaguuccaggacagccagggcuacacagagaaaccuugucuugaaaaaccaaaagaaaaaaaaaaaaaaagaaagaaaagaaauauagucauauguuguaaagugauguuuugucaaucaugggccaaagaagaguguuuauauuauaaugggcuggaguguacaaugaauuauaaugaaugaacggcacuguugcuuguucguggauuugcuccacugaaccuuuauuguuagggagugacccuaguuuaugaccguguagcccugaugacucagagguaaagacacugagcccugugauccccaggacacacauggcaaaaagagaaaacuaaccccggaguuguccucugaccgucacacacccaccugagccacagacacaaaauaaaccgaccugguaagaagauagcuuguaaaagccugcccuaugaugcuggcagcagcuucagccucuguucccagcauuucagacuaccgcgcaucucagagcaaaaucuagacagcaguuuccaagcugugcuggaugcuggguagaaaaccuggaacaaaggcaggaguggaaacaucaggggagauagaugcagguuacaccacgugguggcaguagagguggcagaagcggucacauucuagguauacuuugaugguggaaccagcaagauuguuaauggaccagaugugagguuauauuaaggucaagcugucagggugccuaguggaauaggggccuguguucugacaagaggcuguguguaggacaagcauguuugaaggggcuaauaccaggguucuguaugggauguggguucuaaauugucucuuggacuugaaguagaggugucgaugagugggcagucagacgugacaggugguaaguccaaagggagauguggacuguggaucuacauuugggggucaucagcaagaaccugaugucaagugugguacgcgccccggguaagcaacaaauggagaguggccucagcagagccagagccacggucugacuggacagcugaggcacuggaaagggacgaggcgcugcagggagagaggaaucaggaggaugcccugagcugggucuggaaggccaggaaggaucugacugguacucuggggccaucaugcugggacauuugcccuuuggggauuggcagugaagagccauguaccugauaccuugguaagcccuaaagacccggaaggggccuugggccacccagcaggauuccgcuugaaucuucagugagaaaagccgggguucuaaaaauggaacacuggcuugggaaucaaggcgcuuucuuccuguguuacggauggaaaaacuggcccagagaggacagugcacucucuguguccugagucuuucuguggccaggacuggccagguaggacuccuuggcuugggacacaucccagcaucccaugggugcugugucucauccuuugacaagagcuguguuuucuccccccccaggaaugacccaugaagacaucguucaggaauccaagaaauacuggcaacagauggaagcccacgcagggaaggccagcagcggcuugguaaggcccaggauuggcaccgggguaagggcgggcaccacaggcgcuguccaucuccuuugacugggacauaugaacuugccagaugcacucuucccuguaucucuagaguucacguuuuacuacuugcuuggucaucaaugagugagugucuuuuuccuaugugcaggugugcauuuuuguauaaaaauauacauuuauauacauagcuauucacacugguuuugggggggcguuucuguuuugaaccaucugggagugagcuuuggauagauguccucucaccucugaccacuuuuaaaaggggugaucugagguuggagagauggcucagcaguuaagagaacccauauuugauuaccagcacccacgugguggcucagaacaucucuaacucuaguccuagggaauccaguauccucuccuggccucugugggcacuacacacauggugcacaaaagauauacauguaaacaaaacacccauaacacacaaaauaauaauuuuuaaaaaacuauaaugaggguacuuuuuaaaaaauauacccaaagacuagaaaauuaauagaaaaguaccaccagauucugugacuguccccuaaauucuacaugacacacaguuccauuggcaaaguuauuuuuuucuccacaguaauuaguaauggcuuccuggaucaauagggcaugauggcacgugccugucaccccaguacuuggaggugaggcaggagaauuaggaauugaaagccagccucagcuacuuugugaguuugaagcuagcuugggcugugugagagacucucuaaccugccacccugcuccucaggaaauucuccaaggacauuccuugagcccacgugacuaucugugagggcucagagugguacccacuggcaguucuguuucucucguguucuucacuguggucugacuguaugagccgugacacuggggcauccccugacauggcacuacgugugugccauacuguaccauucguacucuccagugccccuuagauuuaucauguagcccgcucaccauuuacagcaugggugugaggcuuacaggguugacccuggcuucaggguguugagucugcugugcuuuagacccuguaucacccagaugcucauaacaccuugggcuucaagaucauuguaacuguagaugacaaggagacacuggcuuagggaugcuaggagccagugaguauagcacagccgugaaagaucgaccuguuucccagaccagaccaguacauugccaacuugaaggaauccugggcuucugaacuccuuauggggccaggauagaguggggguugggagggggaaauccaagcugagaggaggagccaugaggguuacuugauccuugggccuccccuuucucugucucuauauccugugugugccuaggcaugggguccuugccugcuuacgauccugagaguaaaaucaguaggucugugaaggcaaggggaugccagggcagaugcugcuugggccuagugucucuggcuuaccugugaggaguaagaaauugcucagagcugucucugcucagucagaugggaaugaccccugcacugggcagugcuggucacucuucugaggggagcuggcgggagacacaucacccgcuagcguggagaagccgaaaguugcaaucucacacccaaggccaaugggcagaagaacauguuagccaaggucaccucccacuccccaaagugacggcuggggcaaaagauauggaagaaucgugggaaaggagccuccgagacgagcugcacaucguccuuggggacggucucgagaccaaggcugucugucuguccugcugccaaaggccaacuuucccaccuuugaacuucugcuguccauagacugggcccuuaaaacugguugaucagaugggguacuuuaaccacggaggguagcagcuuugucgcaggagagcuccaggagagccccugcagccugagcagagugagugugugugagaugcgcacacaugugcaggccagaggagguaccagcguccccccaggguccccucuaccacucugccuuuuuccuuuggaggcgaagucucuugcugacccuacagcuugcacuuucuugcuagucuagucccagcacaguauugucgcugauccacucagugcugugugcagggccacaccuggaccuuaugugggugcugggaucuaagccauggucuuugauuuugcagcaagcacucuuaccugcggagccauccguccagccccugagcugaauuuugccuuuuuuuuuauuuuuuaaagauuuauuuuuuuauguauaugaguacacuguaguuguuuccagacacaccagaagagggcauuggaucccauuacagaugguugugagucaccaugugguugcugggaagugaacucaggaccucuggaaaagcagucagugcucuuaaccacugagcgaccucuacagcccuuugagcugaauuuugaaagacauuuuuuuaggauaaguuacaggaagaauacaggauaaguuacaggaguccagguagagaagacagcgugccguguagggcgcgguaccccuggacagcuccuggacccucuccauuucucaccugaguaguuuacaugugccacagacauguagguaugugagaugggcauauaaucagaauuuuguuguuuugaguugguucucacuauguaguccaggauuuccugggauuuacuuuguaacccaugcuggucucuuguggcaauccuccugccuuagcuuccuaagaaaugggauuacccacauaagcuaccacaucuggcuauauaucacacuugcuaaugaugggucauacauuuuuuaaaaauaauuccuugaaaaauaauaauucuuugguauacauauaauuuuauuguuuauuaaauuguuuauuaaucaaauguuagugagauuaacaaauuaagucuugguggaauaguucuuuacaggauguagaagcaacacuucuugaaauugaucaguauuuuuuuuuuaugguuaacaaauucaaaaugcugacacuacugugcauaaacguguagcacaaagggacagagguguguuuagaacucuauugggaauucaauacuaacuccacacuaaaauucaugucauaaaacgacucagccgugaggagagcuccccgaagcucacgagugugccugcugguggggcuguggcuguguccugcugccccugguuccguagccccuugcugcuguccugucucugcugcagcagggaagacaagauaaaagagucugaggagucagaugacagaggauuugaugugcuugauuaaauuucugcuccccuacaaauagagccuuuuuauguaucuuggggagaaaaaaaaagugcuugcugaaucagggguaguggcacaugucuuuaacccuggcacucaggagauagaggcaggcagaucucaggauucaaggccagccuggucuacagagcuaguuccaagauagccagugcuacacagagaagccuuguguugggggggggggaguacuugauuuugcagacaacucauguguggugcccaguacucacaucaggcagcucacaguagucuguaaccgcaguuccagagaaucugcugccuccugccuuccauggauaccugcguucacauaaucucauaaacuacagaagaaugagcgacucaacagcaauagcuuuaaaacacacacacacacacacacacacacacguucacacagucucauaaacuacagaagaaugagcgacuuaacagcaauagcuuuaaaacacacacacagggcuggagagauggcucagcgguuaagcacacugacugcucuuccgaagguccugaguucaaaucccagcaaccacaugguggcucacaaccacccguaaugagaucugauacccucuucuggagugucugaagacagcuacaguguacuuacauauaagaaaaaauaagucuuuaaaaaaaaaagauuuugcaaacauacacacacacacacacacacacacacacacacacacagcacaacggaagcacuguggggagggaaggguguacguggcuuauauauccugaaacaguccacugacuugggaaagccaaggcaggagcucaaacagggcaagaaucuagagcugaugcagaggccauggagggauggaugcugcuuacuggcuuguuccucauggcuugcucagccugcuuucuuauagaacccaggaccgaacagcccuaggauggccccacccacagugcgcugggcccuugucuauccaucacuaauuaagacaaugcucuccaggcuugcccacagcaugaucuuagggaggcauuuucuuaauugagacuccuuccucucagaugauucuagcuugugacaaguugacaaaaccagacagcacagucucuaacucacagagaucuaucugccuccauugcccucagugcugggauaugucaccacaucacacuuuaaaaaaaaaaugcuuauaagccgggcagugguggcacacgccuuuaaucccagcacuugggaggcagaggcaggcagauuucugaguucaaggccagccuggucuacagagugaguuccaggacagccagggcuauacagagaaacucuguuuuugaaaaaacagaaaaaaaaaaacauuugugcgaaugacuguuuugcuuacaugcguguaucuguagcauaugcauuccuauugccacagacgucagaagaggggaacuagaguuauggaugguugucauccaccaugugggugcugggaaccagccaaagucuucucuacgaacaagugcucucagccacugagccaucucuuuagccucaaacgcgacuuuuagaaaucaaacauucuaauaaaguaacccaaagauacacuacuuuaguauuuaccugcugagauagaagaauaggaaaauauuuaaagccuuuguuuucuguggaccacuauucuucuaaagcccagggagucaguaagaacacugcaauucaccagauacaacagucuggaaucugagccccaguaggcaguguuucuggguguuacaggcuaugacacagugcagugugugcauaccagguacuuagaaccaaggguuugguuaacuaacacaaugcaguguuuggaagugcugccaaacacaccucgaauuccuugcaugucuaauguuaaauugauuucugcuuguuguauauucagaagguuuugguauugccaaauuuuccaagcucccaaauucagcuaucugaccuuuuuugggcuguuaccacaguucgaggagcuguagagauuaagagcacaugcuguuguuucagaggcccugaguuugacucccagcaugucagcagccuggcuccagggguaucuaaccaaagcuucuggucuccaagagcacacacacacacacacacacacacacacacacuuaauuuaggaauaaaauagacugagauuguagcuugggccuugaauuccaacacucaggaaacaaucucucugauggaucucugugaguucaaggccagcuugaucucuauagcaaguucuagccagggaugcauagugagacccuuucaaaaaauaaauacaauaaauuuaaagugcauuuuuaacaagagcagcuguucuauacaguaguugcacaaaccagaccuguaaaagaguaaaggugagugaagaccagccagagagggcaagaagacagugguucaggagccccucuccacagcuggcuccccuagucagaagucauagauagggccuuagcugggagcucacugccugucaguaaaacugggcaguagccucgccaguguaagacugagugguccuaggacucccagaggccuaaggccugguggcuacaguuugaccaacccacuccccugucuuccaacagggugccccaaggacacacggacccagcacuuuugaccugcagaugaaguuugugugcggucaguguuggaggaaugggcaggugguagagccggacaaggaccucaaguacugcagugccaaggcccggcauugguaagcaggcacagugcgggugcuccggcagcauggggcacugccagagccacgugagggaggaggccaagacuuaggagaccugggcucugagaggaaaaagccucauaaccccaaggcuuccucucugacucucuguaaugacucccauuucuggccuacagcuggaccaaggagaggcggguccuucuggugauguccaaggccaagaggaaauggguguccgugaggccgcugccauccauucgaaacuucccacagcaauaugacgugagcacuugugggggaggggaggauacaagagguugugggcccugaaaggcucugaacuggccaacacuaggacacagcccugugggacugacugaucagcaggcuuccucuugcccacccacagcuauguauucaugcccagaacggccgcaaaugccaguauguggggaacugcuccuucgcacacagcccugaggagagggacauguggaccuucaugaaggagaacaagagugaguggcaggcuuguccuguguuccuguaucuguaucaccacguugcuaaucucuagaacacacucugggcucccugugcgugauuagucccucgggccgagcuauacaguagcagagcuuaagguuucugugccccucgaguccaucagggaucauagguagaguggauggggaaucccucaccaagcacucugucccugcccaguccuggauaugcaacagaccuaugacauguggcugaagaaacacaacccagggaagccgggagaagggacccccaucagcucucgggaaggagagaagcagauccagaugcccacagacuaugcugacaucaugguaagcccugccccgacccugagccggggccaauggggagggcguccuggaggggcugagaggggcagaggccugggagcaggcacccaccgagcugugcacgcagaugggcuaccacugcuggcucugcggcaagaacagcaacagcaagaaacaguggcagcagcacauucagucugagaagcacaaggagaaggucuucacuucugacagcgacgccagcggcugggccuaccgcuuccccaugggcgaguuccgacucugugacaggugcugagggccgugugacacggggcgcaggggcaagggagggcagggagcaggugggcccgaggacaagggcguugggcccagcuccgucucuugacuuggcguaucuuagagaugagugcaguccugggggugggcaggguggagggguggguucaggccucucucuagcccuccuccacagcacugggucagauccuagagagugcuacuuugucggguucgcugagccaggaccagaaccgucuggggagaaguguauuuuaggaagaugggaaggcauagagcucaggcagugagccuucugccacccacaggcuccagaagggcaaggccugcccagacggagacaagugccguugugcccauggacaagaggaacucaacgaguggcuggaccggcgugaggugcugaagcaaaagcuugccaaggcccgcaaggacaugcuucuguguccacgggaugaugacuucggcaaauacaacuuccugcugcaagaggacggggacaccacuggugccaccccagaugccccuguugcugcaacugcuacugcugccaccaccaccacuggggaguagggccaggucucagcuauggcaaagucuuggggucggggguggguugggggcaggggacuaccccaucaggcaggcgccaguccgcugggucccuguccauccuuuccacccccaguaccccagguguguauacccaggucauacacugcaaccccaaguggucccaggauccuuggccugucaaaaugggggcagacccuccccaauucuaguucuccugguuggagagggaggggccuggccagcuucagccuacagcuuuaaauucugucugcuccuaaauggguccaaagcucaguacuggggagccugggguccccacuugaaugugcagcaggagguccuuuuccuucucuaccuuccucuucucccuuucccuggggccagaucaggacacagcacagggcaggaggcccugccuagcuuaaaguauagucaugagauggaguugggagcacuauacuggucacuuaccaccuggggccucaguuuccugaucugcgaaaggggcaagggcuaaggcagaugauaaucugaagcuagauuaaacagucuaggugcuccuaacaaccacccccugcccgggccucuccuuugugagccacaguuguagaccguaccucagccuuggagucaacacagcccacagcccauuuuacagaaaccaaaacugaguucuaacaggaggagugauuugcccaggguuuuuagcccucucugguacagaacugggaugugaacauuggucagagaccccacccauuaguagcuggagccucugggcuccucagucccaugcaacaucccugggaccuggggaagggaugcugagacacaagcaggucuucuuagcuccauguugggagauguugggguaagcaauggaggcuauauccucaagagcugucacagacaaguggcagaauacaggcaccaugagcucagguucugacaaggugcaaagcguggggaggcucugaggaauaugaagagugggaaggcggccuaggcuccaugggccacuaugagaaauagccucucuuuccugggaacccucugugguccucucuaaaagacccagauauacuguuauggccaucuaucccagccccuuccacccuaugcucaacccugcuggcugccuaggaccccagcggacacccccccccccagcucaugcccccuuuuaccaaggccucuuuuaucuucugaaguaugucugcaccuuucccccacccccacagguagacacagccuccccuggcuacccaagacauuccagaaugcuccacccuauuggcacaagaaguggggcacccccccccagaaggaaccagaaacuaaggcuaucaaggagugagauagaaugaagacacuccuauuucuccuccagccaggguugcuagagcucaagggcacagugauaggcaccugggcauaaaggacccacccacccaccccucauccugccacugcccaaccuucuccugauaaccauggcaugcaccgucuccucuccccugccccucuucccugaccccagcuggcuagcacugcagaguuuggcugcuggcaguguggcuggaggggaggggagaccacaucuaaggugggggccauggccgugaauguggaugacacuuguucuccugacccgugguguugcagucuguugucaccagccuuguuuuaguguguauauaugucgccccugugaugcauauauacacagguauuaaauauaucgcucuauauaauauuauauaugugugugguauccaaggaaucucuucuauugagggcuaaagauaaagaauuuggcacacaaaaaaaaugcagacauccuugugaauuuugagugcuuauggggucaucugguuauuuagggcauugagacuggagccguggcucagaugauuggggcagaaaaggcaggguggcccacaccugcucugacugcuagcuucccacagauccaugucuagaauaccagugugcucaggaaaaggaagucauuucguguuuguuucccaccaaagaagaaugaauccaggguuuuucuacuguucgucuguccaggggucccugagaucugggcucccuuacauucuagaccuauguccccccccauggaagagaagagaagaaugauagggaugaccugggguggggggacagcaaaacaucuuaaaugaugacuguaguuaaucagaugugaccccucuagggccccugguuggaaggcucaggguugaagcggggccuaggagcaagaacaagauugcacaguagacauggggugaggguagugggagggaaugcugcauuucucagcugggcaguaaucaaucuaaugguccuuuaaaaaugucuguauuaaaauuuaagaauaccacacuuuaauauuaaauaucauaaggucuaguaucuugauaauaauguagauguuuuaauaacaauuuuuguccuucuuaaaauaaaaugagagaaauuugcuucuuuuag

SEQ ID NO: 7895 - RNA, 490 nt, Mus musculus
caggacagccagcacaaccuuuuguuuugcuuuuuuuuuuuuuugccagucagucuugcacuuuauuguuguugucaucucaggccuugccugcauacuuucgaagaggauacagcugcuccuuccgcugcugcuucuuggucuucagcuucuccucgugcuuggugagccggcggcacauggcucuagucuucuuggguugcaggucuaggggcuugcauuucuugcccuugaagaauuuccugagguuuucuuuuugaguuuggcuaauaacagugaggacuugggcgauagauuugcgaaccacucguaucuuggagagcuuggauguggcgccgccugucacuuuggcgacccgaagcugggacaauuccaccuucagaucgcccaguuguuucaacagcuccuccuucuucuugccgcgcaguccagagccuuaaucuuggccauuucggcguuguucauggcugaagcagccugguucgagagu

SEQ ID NO: 7896 - RNA, 490 nt, Mus musculus
acucucgaaccaggcugcuucagccaugaacaacgccgaaauggccaagauuaaggcucuggacugcgcggcaagaagaaggaggagcuguugaaacaacugggcgaucugaagguggaauugucccagcuucgggucgccaaagugacaggcggcgccacauccaagcucuccaagauacgagugguucgcaaaucuaucgcccaaguccucacuguuauuagccaaacucaaaaagaaaaccucaggaaauucuucaagggcaagaaaugcaagccccuagaccugcaacccaagaagacuagagccaugugccgccggcucaccaagcacgaggagaagcugaagaccaagaagcagcagcggaaggagcagcuguauccucuucgaaaguaugcaggcaaggccugagaugacaacaacaauaaagugcaagacugacuggcaaaaaaaaaaaaaagcaaaacaaaagguugugcuggcuguccug

SEQ ID NO: 7897 - RNA, 10530 nt, Mus musculus
cagaacugaagagucaugccgucuaggucuuagggaacuuugagagcuggggcuaggguuuggaguucucagggccccggugaugccagcaacagccacugugucccaggcuacuuccuaauggccuguuguguuccaggucugucccuacccuccccgggguuggucuacaccgguuuaaaaaaaaaagaaaaaaacguacauggcgagcucagacugcuuuggagucuuaagagaagaaauccggcgcuaaggcgcucagaaggauuccgagggugagcagccccgcugaggacguggcagggaggggucuagaggagacaaggugagaagaucgcuauuacacuucccgcagaaccuggaaucccaaccuacgacugggcugcgagggguuaaagaugccaagggaggaaaaguagucccggccccgccccggcugggcggagggacgcaucacgcagggguggggaaagcagauucaugcgcaggguugcugagggugaaacuuuucauugacuuugcucacuucgggcccaggcgcgggaaggugcaggucguugagacugagugucgugggaaccgagaggccagaaggacaggaccugccagacgaguacauccagggcuggccuccauccaccgcgugacgggugccauccucggguccgccauccccgcgccgucgccgccgagcucgaccuccaaaaacagcggaaagaaucacaugagcucgguccucgucccucucuacccucaaacgacguaaaaggacaccguggcccucagccucgcggugcccgggaagcugggagagagaccuccgucccgcggccugcagagcggacccuucguggagacccgagugagugcgcgggcuugcgggcgggggacgcccacacugguccacuccccugcugccccucuccggauccgccccuguuucgcucuccaucacucucuuugauccugggguaccuaguuucgagugcggcccucuccuaagcggagagcguuuccuccuugaccuccuuccccauuuauucacgccucacucguuauguuuuccuugccccccccccccagaaaccaaacucuggccagaguuaaauaaauuaugggaagggaggggauucuaucuuuauuuuucggcugcuuuucacgugugcgggguggugauuauuaacacagucuguuucugucccuuuggaaccugugagaugggaaauuuggacauccccuucuuggugacagggccgguuaguggagagugcccuuggguugccgagcaagaacucauugcagguugagcucuuuauauacuuguguaggcggaaaaaaaaguacccaaagagccugucggauaguguauuaauugugucugaucucuucuauuccuaaacuuccccuucugucugagggggauguacuccgcccuugaccaaaaaucuaaggagggaaaagggaaaagccauccccuccccugggagcaaccagaacuucacacagcaggcuuugggaucagcagacaggguuuccggugccaguucggugucuaaccuaccccccccccccccauccacccuaaccuauccacccuggccugggaguggguuugguuucucuuugauuucuuaacaacaauaaaaauccuguugcuugccugagcgccuacccccaaugccucacuuaagcacuggggaaaacagcuggugugggaggcaggauuagggagguuuaacacccugccggggaggguugcugaggaucugguaagucugguccuaggguaggccuuguaauggggaggagacucagacuuucugaauauuggaugaugcccggguuucagauguacggauuuugcuugccugccugggaaccuuuccccauuuccuuuaccugggucugguuucucagauuuguauuaaaagugggguaaggcuugggcacuaccggcuucgggcuuuauugucgaccgggugccuccucacagcucuacuaggaauuucuuuggcuuggccaacaagacuggagaaucggaucuaaugcuugccauucccuuccuggcuguggaggugcuggagcagagccuacugaguauuaggugaaaagggcucguuucuucuugaauacacugcuccuacaucuaccacagacagcgacacuccuuugagauccagaggcuggggccggagcgguggcucuauccauuccagcccaccugguucaucuaggaaaaaccccuuaguugcagagcccugauucaguaagcuuaggaggucaugaaagaaaaggggaguuauuggagucuagccugaacaaggacguggggagaaaggauacccggugagaggccuuaugggcagauuuaugccaaacgucucuggugaugggggggggggggcacccacucgcugcagugcgcaugugcaucggaaacuuuuccugggcuucggacccuuggccaggaccuagagcggggcaugcgcggucuaucuggcugggcccucgcguaguacacagggaaguguagugugcucgaaaaguaggucacgaguuucuagccucgccaggaggccagaggacuacgucucccagagugcugagcgguaccgccuugagugaggcgagccuggggccccugagaucccugaagggaccugccuuggacugugauaugggguguaagcccgaugcgcucaucacugcaaauauccuggaagggcugcaaucuauauugcccgcugggccgcugccuccaggauaaaagcuaaggacuaaucccugggaagcaagcugagccuugcugucgcuguccacuguggcuguacuucuugaccauguuaaaaugcccccaccuacccacauuuaccugaagcauggagaugauugauucuaggauguugggaauuugagauaccugaauuuuuuauaugggagguauagauuccuuuuccucgcccuuucuacaacauugcuucucucucgcuuucuuccuuccuuccuuccuuccuuccuuccuuccuuccuuucuuucuuugguuaucuuucuaguguuuuguugaaaaaaaaaaaaaaaaaagauccgaguccacugcagcugcuuaacagaucuguuuguucuuuuuuggaaggguaguuauuucuaagcuuuccaaucuuaacguacuuccauaaauauuuuauauauaaggacuauaauuugcccaucacuuucuaaaaaaacaaacucggccaaaugguugcgccuaucuuuagcugaagacaggacaguagcagcacuuuaauccucugcucuguaagcuucucgaagucaaaauuagagucugagcugauggagcaggggaucucauucuacucgccuggccuuuuuguaaggcuccacacuguccaucuggccugacauguccuccaguuagagaggggaaggaggcgcuuugaguccuugucugugcagaacaccucugagguauaagugaugugcagacccgguugcuuaugccacgaaugccgguucucuaggcagggcugaugacagcaaucccauuguaguuuggagugaggcagcuuuucagugacuuuggccuacauuuagaauguucccuuucugaggcuguacuguucagggguacagggguaacuggaaggcaauuguacagcaaaacuugagaaaguuucuacaucuagaaagguguagaagcccuuccggguagaauaacuaagaggcucguuuuaagagacucuacagugcguuuaagacaguaucacauugacacugaaucuguuuuacuuuucaaaaaauccuuuaaaaauaccacucguaacuucaggccccuuccagagaccugaugcaaacguucuccucauguuggacaccuucaguggaccacuguaguccuuucaaaccuccauuuuuuucuaacuuauuauuuuuaauuaugcacagaucuguguaucuucauauggguauguguacaugagggcagguggcugagaccagagacauuagauucccuggagggagaguuccagguuguugagagcugccuggcaugagugcuggcagccaaacucggguucucugguagagcagugaauagucuuaacuacuaggccauuucucuagaaccuugaaccuuuuuuuuuuuccuuuauauguaaguacacuguagcugucuucagacacaccagaagagggugucggauccuguuacagaugguugugagccaccaugugguugcugggaauugaacucaggaagucuagaagagcagucagcgcucuuaaccccugagucaucucuccagccccccccccuuuuuaaauuuauuuauuauguauauaguguuaugccugcaggccagaagagggcaucagauuccauuacagaugguugugagccaccauguggcugcugggaauugaacucagaaccucuggaagagcagccagugucuuaacugcugagccaucucuccaggcccugaaccuucauucuuaaacgaucauugcagaaggcaugaguugcuugaacauaggaguucuuuaguauagcuggccuugaacuggcuuuucugcuccuacccccaagugaugaguuuaugggcucacaucaccaugcccagaguccucagcugugaguuuuguaucugaugaugacccugauucucgucaacuaagccccuuuuucucuccuuuuuucuuuaucucuuucuccuuucuuuuggaggcauucuuucuacauagcccuggcuaucuuagaacucacuauauagaccaggcuggccuguucaaacucaaagauaugccuguuugccucccaaaugcugggauuaaaggcauuuguaacacuccuuauucgauuuaaccauucuuuuuaaacccaaaaugauccuaaaaucaaucuguuuuggucaugcguagacacuugaggaaacuagcagaccuguguggaggccaggcuaagggggaagucaggauuccuggaauucugagcagcaauuccuuucuguuucucagccuuggacugagggugauucaaugaggugcuuacacuuccugcuguagauugacucugcgugccuucccagguauacacaacacacacacacacacacacacacaccccagaagucuccuuggaagauucaguucuaagcaugcccaugagagccugagaacuaacaugaaaaugugugacagugaguguucauaaaacucaaggcucucgccgggcagugguggcucacgccuuuaaucccagcacuugagaggcagaggcagguggguuucugaguucgaggccagccuggucuacaaagugaguuccaggacagccagggcuacacagagaaacccugucucgaaaaaacaaaaaacaaaacaaaaacaaaaaccucaagguucucaaaacuagcacuagugucuggaaacuccauuuuggaacuagaaagaacguuaaucauuaaucaaaauucagcccugagucucacacaggacagaagaugcccuuggugggacauuggucaacccugucuccgaugaggucacagcauggcuuugccuaacagucuaacuagagacgugcuccggcuuugccuuuaauggaggggaacucuucacuucaguuucucccggagcuggagucuagaggccaucguuuggggggggaaaugagauuaagaucauuggcuccauccagauccucacagaucaccuuccugaaacacaaggcuugcccagauguagggaauaaagcuuuuugaccucagugggaucuggcucugagagaaucccaaaauaacaauuugaguguuugcgcugggccaucuccucugcggggcucuccaaacacuugauagaucugagcuggugccgaggacagguggucagacggucccugggagacugggugaugaugguccccagcuggaagcugugggugaugggaaguuccuuuccuuugccaucuucaucccuuuccaccuugccagaaaccgcggagacucccucaggccacacugcugucucccuuauugcccugccggccgccaaggcccugcuuccugcccuuucccugggcgccccugguccagcagcuuccuugugggcugacaaauugugguuauaacagauuuuuaucuuuuucugaaggaucauggccuuguccccauuacuggaggcucuguucacauuacuucuuaaauugguucugaaaacucagacugagccccacagcauguacacuuauggggugcaggguucuagguggauaugacuggaguccaagccccagagaaaagcuggcagugccccuucaugcucagugaccuugugucuuguucaaguuaaggagggcagcuaaaaaaaaaauggaaacuuaugucuuugccugugacaguuucagggcacaacuugaugaagacauugcagagacagcaagaaccuucuugcauccagcuggauugggggccugcuuuuauuucuucguuacuugaugacauucuuauacuguccugacuucucaaaaugguagaaagcguauuacuauuuucugugcguacuagguaccaaguacaggggagagcguuauccccucacuggguucacggaaaccaggguuuaugagaaaugacauguccaaagccaggagucacagugcaggccuguagucccagcacucagggaaggggaaguaagaucacagcaaguucgaggcuagccuggucuaccacauagugaguuauaggccaaccagagcuauauagcaucaaaaaguaagacaaggagcacaccaguagaucugugugaucaaagcuggugucugcugugcucugucacugcucacccugcuggcacggcucaggcagugugugcugggccuuucuauacaaauaguaaccuugcuucucuccucuccuccaggagccucuggaucccaggaucccucgccuguuccugccgccgcucugcucuugggcugugcacgugucccgugugugcgugcgagaucucggccuagaagagggccaugcagcuggagaucaaaguggcccucaacuucaucaucuccuacuuauacaacaagcugccccgccgcagggcagaccuguuuggggaggagcuagagcggcuucugagaaagaaauaugagggccacugguacccggagaagccguugaaggguucuggcuuccgcuguguccacauuggggaagugguagacccugugguggagcuggcugccaagcggagcggccuagcuguggaggaugugcgugccaacgugcccgaagagcugagugucuggauugacccuuucgagguauccuaccagauuggcgagaagggagucgugaagguccuguaccugggugacagugaggcgagugguaccccagagcuggacaaagagaucaagagcagcuucaacccugacgcccagguguuugugcccaucggcagccaggacagcucucuguccagcucucccucgccguccuuuggccagucacccagccccaccuucaucccccggucugcccagcccaucaccuuuacuacugccucuuuugcugccaccaaauuugguuccacuaagaugaagaagggugguggggcaucuggcggugugaguguggguggcagcggggcggguggccagcagccgccgccacagcagccucgcauggcccgcucacccacaaagaaccugcugaagcacaagagccucucucuaucuaugcauucacugaaccucaucccagccaauccggccccccagucccagcucucccccaaugccaaggaguuuguguacaacggugguggcucacccagccucuucuucgaugggguggaaggcccgagcaccagcaccacggcccccuucggcagcgguggagccagcacuugcaacagcagcagcuuugaugugucccagguguucggaggcggugcuaacagccuguucuuggagaaaucgcccuuuguggaaggccucagcuacaaccugaauaccaugcaguaucccaaccagcccuuccagccugucgugcuggccaacugaccgucuucccaucugccaggccaggagcacacacgaccacaggcaagugaaaagaaaggccaaacgcaagagggaaagaaaacuguacagaaagauuccagucuucucauucucccagcuaggaaaaggauucgcccaggcacagaguaggaggggcucccaaagcaacaaguguuggacucagccccugacuauucugccugccucugauuucauuugguugguuuggauuuuguaauuauuuuuuuuacauguaguuuucuauaugacaacuuuaauuagugguuuccugugcuaagagugguccagaugugaauugcugcuccccacucccucccuccgccccuuugggaucaguguguugaggcucaccgggaaggaagagcugaaacagggagaggcugacacccccccacccuccacccccguguccacaacccccaaccuagcugucuucucagggccugccacccaaauaagucuggcccuagccucaacucucucucaggcugggccacaggaagcugcugacuggccacuugacacccucccccuaaagcuaaugucugugacuauagggagguuagcacuuuuucuaauuggaauucuucucuguccuguggccccaucccucacccgcucuuggccuggaccagauacaugcagccucuuucuccagcacagccuuucccugagccugagguuagggcagaguuuagagggugggcuaaguguauguuuucauguaugcauucaugccugugaguguguggcuugcugucguguccucugggaucccaagccacgcgggucuucccucuguagauggguccuggguucuaucaccugcuuauuuauguacgagguugggggguggacccaggguggguugauugucucuuuguaaggaaguaugugucgggggugacacgaggcuaagcccgagaaaccccgggggacagcacugcauaagaaacugguuucccagacugcagagggagcugcacuuuuguuuugaccaaaaacaaaaaacaaaacaaaacaaaaacaaaacaaaaauaacucugaagggcgggaggauacccaagccugaugccugagaggagucccuagacuucagcaacuccgcugcguggccugagcccagcgggagggauggggagagaauuuuuuggaguccgugccuguggugggcaguccugagccuucagcugaagcagugcuuuuuggcugcccucaccucgcacuacuugaccuugaggcucugaguaucuccugugcacaggagaagcuccugcaccagaaagcaccaaagccccuggcaccccaucuuacuccacucuccccagggacucccaggugggaacugcuguggcagugagcucagcccggacagacacugccaacccugucuccuggcauugggcuccggcucuaccuccccaagcagggcgaggccccgccuucucagccuagcaccaccuguccccgagucuucuccagcuugcccaucauucucggcgcccacacaggugacagucccaaguagauaaccuccaugggacaaguuggguguugccuuacccgccugcccagccccuccucccacaggaacacagguaccaccugcacccacgacagcuucuuuucucacacauggggagacuggagccgagccccuugugucuuuugaaauaggaagaaaaaugaguguucaggaacaugacuccuggacugggcucuugggcccaguucagugucucaucgcaaaucuaggcauuuuugcuucuauuuuauuuaauuuuuuuuuuuaaggaaaaaaaaaaaaaacaaaacaagaaaacugcacuaauuuaccugguuucguagaagaacuuuuuuuuauuuuuuacauuuuuugguguccguuuguauugaauaauuugcuacauuuguaaaauguaagagguauauauauaauauauguauauuucuaauguaagaaacguaauuuuuuucuuuucaagauuuuuucuuaaaaagaggagagaaaccaauauuuuuucaggaaaaacaaacuuuaaaaaauaggaacauaaaaccaccuccaccccucgccccauccucucuaucccucucacccaggagcaaaacagaagguggauaagauugucaagaaugucagcugucagucacgcugucucugucuugaugcuguagucucuagagcucccccuagagaugggagcaggcacugaagcagccauagagaggagcccgggagcggggcgaccuuuuuuucucuagcgaaggaagaaugcaaucaagacguuuuguauucagaacauugugcaauauuuuggaaugagacauugguguguuuagagauuuaguuucaaaacaaagauugaucaaaucuguacaguuuauauuguuccagauuuuuuuaaguuuguauuaaaagcaugauauauaauagccu

SEQ ID NO: 7898 - RNA, 567 nt, Mus musculus
uaacgagugaggcgugaauaaauggggaaggaggucaaggaggaaacgcucuccgcuuaggagagggccgcacucgaaacuagguaccccaggaucaaagagagugauggagagcgaaacaggggcggauccggagaggggcagcaggggaguggaccagugugggcgucccccgcccgcaagcccgcgcacucacucgggucuccacgaaggguccgcucugcaggccgcgggacggaggucucucucccagcuucccgggcaccgcgaggcugagggccacgguguccuuuuacgucguuugaggguagagagggacgaggaccgagcucaugugauucuuuccgcuguuuuuggaggucgagcucggcggcgacggcgcggggauggcggacccgaggauggcacccgucacgcgguggauggaggccagcccuggauguacucgucuggcagguccuguccuucuggccucucgguucccacgacacucagucucaacgaccugcaccuucccgcgccugggcccgaagugagcaaagucaaugaaaaguuucacccucagca

SEQ ID NO: 7899 - RNA, 82759 nt, Mus musculus
aaugcuccugccuccaccuuccgagccgggagcuauuggcauggcccaccacaaugaguaauaaauauugucucuaaaaacaaaaaugaagacaaggagcguggccagcauggggagaaacuggaaaccuuuuggugaagaugcaaaacagguaaggaaccauggaaaacuguauggaggguccucaaauaguaaagcugccaccagugagguggcucagcagguggaagcacuugcuuccagggcuugcugcugcccggcugacaacucgaguuugaucucagaacccacaguggaagacaaccaauuccugagaguuguauacacauuacuuacacacacacagauaauacauaaaauuguaaaaccuuucaaauaaggagcugguaagacaaagggacuugcuaccaagccugaguaccugaguucaauccccagaacccacgugacagaaggagagagcaaacuccuuuagguucuucucuaaccaugaauuggucaaacacaaaauaaauaauaaagauaugucuuuuaaauaaaaauagaacuaucuggggcuggagagauggcucagcgguuaagagcagugacugcucuucugaagguccugaguucaaaucccgcaaucacaugguggcucacaaccaucuguaaugggaucugacacccucuucuggugugucugaagacagcuacuacaguguacuuacauauaacaauaaauaaaucuuaaaaaauaauagaacuauccaaaaauugaacuuaggauaacaacaguauauuaacaccaccauuucauuagaacccuccuuauaacagccaaaacauagaaaccuuccacuuaauuaaacaaaauagcauauuauauauguuauauaaauauauauuaagaauauaguaugguauauauuuaaguauauuagaagauuagccuucaaaacaaacaaaaaaaaaaacaaaaaacaaaaagaaggguccagagagacggcucuuggucuucgagaggaccagcacccacauagcugcucaccaccaucuguaacuccaguuucaaggaauccaaugcccucuucugaccccgugcaugcuacaauaugaugcacaaacauauauacauaaaucaaauaaaaaaccaaucuuuuucgaaaagauguuuugguuaaugacaggaggaaaugcagacagcgcacaccagcacugcugagucuauaugacacuacccugagaacagacucaguucucaugugcacaucugcaacagucaacucucaggaacagagaguggcggaggccgagggcugggaggggacagcagcuaaccagcgggucucacacugcagcugggcaagaggacaaagggcagcacagcaucguugcccugugguuucucuacagugaacucuuaaaggagguggguaucauacagaaaauacaaacugaaaaacauggcaugugacaggugucugcaaucauaugcaggcuuuaagagauguuuuccauuaauaaaaagugaccugagagccugcugcaguggcccgugucccagcacucaggaggcagaggcaggcaaaacuuugaguucaaggcuagccuggucuauagagugaguuccaggacagccagagcuacacagagaaacccugucucgaaauaaacaaauaaaugaaugaaugaaugaaugaaugaaugaaugaauguagcucgaaggcuggagagacagcaaucaagggcacuugcugcccuuguagaggacguggguucaguucccagcaccuauguggcaguucaagccagcuuucacuccaguccuagaggaugcaacuccuugaacacuagucauagacaguggugcauauauccacaugcaugcuuaccccuccacacacacacaaaauaaaaauaaauaagucuuacaaagguaggggggcgucgugccacaaaccugcaaucccagcauucagaacacuggggcagauggaauacugcaaauuugagucuagccuagcuauacagugaguucuaggcuagccuaauuuauggaguaagaucccaucuaaccaaacaagaaacuaaauaagcaugugucuuuuugaacuuguuaaacaacuagccuuucuuuucugaagaaagcccaggcuugccucaaauauguaaugcuccaguaucaauuagaaaaggcugggguuacagguacauaccaccacacauggcuucuaccagcacaggcugagacucuacaagguaagcagaguugccacgcaguggaggcgcaugccuuuaaucccagcacuugggaggcagaggaaggcagauuucugaguucgaggccagccuggucuacagaaucuacagagugaguuccaaagacagccagggcuacacagagaaacccugacucgaauccccgccccccccaaaaaaaagcuaagcagaggaucuuauguacuuuuggaguucuuggugcuaaugaaugauucccugguuuuggcaaacugaacagaagagaauaugcccucuuagucuaugucuaacuugaauuucugauaaggcucaacucuggagaaggcuccaaaaaaugcucaagggugacccagcgcucaccuguaugugaagcggagcuuuugaacaauggccuucaucuugucuaucugcuccugguuggccgucaccuucucaguaaagggcaccuuccgcuugucaucggcauaagggaggaagacaagcuggaagccugaaguggggagacaggucuucugagauuucacuuacgauucugcuguuugucccucuguauacuguggugcuggggcugagggucacaaauccaauuucuccuuuaccaggggccacgcgugaaagucagacuaacagacucuccggggaugcacaugaagccugacagagaagggaugccccaacaaggagccacaaccaggcaacagcgguuggucccagccacuauuuauccuccucuuccucuuccuccuccucuucauuuuagauaauccagagccagcuggacaguaccauccuuggggggcuaaguuccagccucacugggcucuccucugagcuccagcuuuccauuuucauucuagcuuccagcauacauuaaagaggaaggaguuauguggauucuaguccaguuccuuucggacucaagaaggaaaauuccaggcacuucaaccaaggcugcugccaggugaggggcccuugaugacagcacuggagguggugagcaaguaagagggagccaucaggccaguucuccccucugcucccuagccucccccugcugucuacuauugauaaggacuuugacugggcugcuggguuuagggggucagccugcacagcacacagcuugaaacggggaacugcagcugggagguuaagcaagcgcuuauuccaaugagaggacugcauuuaggcaggaccaucagggacaccuugugggaggcaugaacacugaauuaucucaaauauagaacagcuucccagugagaauggagguuuaacuugugugcccgaguuggcuggcuaauaagugucagagagggucuaaaacaaaagagaguaagcuccgggacauaucccaugggacagucauagcugugugugucacagcugugugugucacagcugugugugucagugcauaccuguaaucccagcacucagacggcuugggcaggaggaacacaaauccuagccugggcugcauagugagaccauguauggaggggcuaagaagagacuaaagcaagacugacuucaaauagcuaagcaguuuacauuacaccacauaaccuuggcacuuacaggacaaaaaccaaccaugaagggugaugagacacuuucaauaaagaaaaauaucagcgagaagcccugccacuugcagcagaaaugugcaaauagucagaauggagacaauccugaagccugacuaugugcaaauagucaggauggagacaaucuugaagccugacuauguucucucuccacacaaccaucuugguggccuugucgaguggaccugcaaaaccuuuuaaggcuuuuaaacacacauuuccguggccuaauugaugcuaggggacucaggugcuucaggacccccaagggaccucucugccacauaccuccuggagucaccugaauguucugaucauccagcuccucuuccuggggcaccaaagccacaaaauacggggagacguucuuccgggguguguaucuacacacugcuaugaccuccuucuccacacacuuggugagcagagcgcugaacaagguugagcucccuaaaacacaacugucucaguggccugcaucuccuucuccccucacgcccagcacagucuuacagguuuucuuucuuuuuuccuccuccuucuuuuuacuccagcugcaucucuuguagguaucucagccauuuaggaaacacagcccaacaaacccagugacaggcgcuggcugucccuugaacaaccauuuaccagggacgucccccaaaauagggugucuacacuuugacccuuucccagggaucugagcagggagucucggcacucaccacugaccagggacuccuccggguacacgaacagagagggccucagguagugcugcuucuucagcaucaccgugggcuuaaagcccaugaggaucaaaccuggcucaucaaaccgcuucagcuccucugucuccucuuucuccagcacaaucugacgugucccauaagucuaaaggagaacgggccggcauaguaagggccacaaaagggcuguguggagaugaaucugcggccaccaaacaucagcaacuuagaauuagcucugggggggggggggggggggggcagggagaaggcagagugggaaacgcacuugcuacccaacugugaggauguguuuagaucccuggcagccauguaccacucgaugugcccacaauuccgauguugguuugagaggacacagaaggaucgcgaggcuugcuggccagccaaucuggcuaagaaaaccauaagcuuugguuccgugagagguccugucucaaagaaccgaggaggaggggaacagagcagacacaauguccuccucuggccucuacaggcaaguggauagcacacauaguggcagagucaaauuugaguuuauaacaacaacaaaaggcccuucagauuuauucaggcgaguggguuaauaaagaaacucaguggucagagaguggcugccccauaaguccaucugacaaucuagucccuuacaaauagaagaacaugccuuauaccucauauccuucaagcagcaggagaaaccaucugguaugaaauuuauacucaaacagaaagacaaaaaaaaaaaaaacccucauagauugaauaaaaauauuucuuuuauucaguuggguccugaacguauauaaaaaugugauccucucccacauuuuacguaauuaaaaaggauguguucagccaggcaugguggggcaugcguuuaaucauagcaguagggagacaggcaaguggaucucugaauccaaggccagucuggucuacagagugagaacccaucucaaaauaacaaaaggucaugcuugcuuuucaauaucacauccugguaaagaauguacagcagagagaggacgagagagagagagggagagggagacggagagggagagagagagagagagaauguacuguaccuucuucucaugcucagaaaaacagauguggucauuucaaaggaaggggaaaaaaaucugacuaguucagcaaggagaauuucucacaaacgaauagcccacugcauguauaaacucuaacuccucaccaccugggguaaccacaaagcucuuguugucgcucuacuuaaacgguuacaguagugugugcuaagcaagccaccaacaccuggccuguuccuugacauaugccauagcugcaaggccagcugcuuccuguccugaccguuuauccagaaagacgcaguuuacagugacuuacuucacuggcuagcuugcucagugugucugucugguuuucuuucgcccagacauggucucuacacaguccugucuguccuggaacgaacucuuguaacccagacuguccccagagaucugccugcuuuugucuccugaguucugagauuaaagucaugugccaucauguccagcuccuguuguuuaaagauuuauuuaucugcauguauguaugugcagcaugugcacgccucgugcaugccucaugcaugcagaggucagaaggggucuagucuccugaaaccaaaguaugguuggcugugagccaccauguggaugcugggaccagaaccuggguacgaugcauggacaggauauguucucuuaacugcugagccaccucuacagccccaccucucugucaguucuuaaacaagauucgguaggaaagguuagccaccuaccagagaccgcuuggugucacuaggcaggaguagacugccgguguuuacauuaaaaguccuugucuugguuuucacugguucauuuguuucccgauagagucucacuggaaaaggcuuguuagcuuucuggaccaaguuauaaaugcccaccaugaguacuacgucuucaccgagcuuaaacuuuaaccugggggaggaaagggaaagagaaacaaagcaaguaugagcgagcagacuguacuuuccuauguaaaagguuuucacagcauccaaguuccagucugcguuacucuguccaauaaccuuagucaaaacacaaauagugaaugggcugcaaacagaguucagcacugggcaugggggcacauggccaaucccagcaggugagggacuaagacaguaagacgcccugaauucaaggccagcacggggaacaaauaugaccaaguaccagguacgcaggucuacacacaagacucugucccaaacaguaauaagaacaaacaaguggagagguggagaaaagguaaaacguggucaagcaugauaguagacaucugaaaacccagcuuagaauacacagcaagacccugucuuuaauaaauaaauaaauaaauaaauaaauaaaaucuaacagggcuggcaagauggcucggggguuaagagcacugacuguucuuccgaagauccuggguucaaaucccagcaaccacaugguggcucacaaccauuuguaaugaaaucugaugcccucuucuggugcguuugaagacagcuacaguguacuuacauauaauaaacaaaucuuaaaaaaaaaucuauuauuauuauuauuauuauucaccucaugcuauuaaaaaaaucaauuaaagcuaggcaugguagucuacgccuuuaaucccagcacuuggguggaggcagaggcaggucugauuucagggccagccuguucuacagagcaaguuccaggacacccggagcuacacagagaaacccugucuggaaaaacaaaagcacuuauuuaucuggggggagggugcacauccacagcgcgggugugggagggcagagggcagcuugagaaguuggcccuuucccuccacuacaggggucccaggaggagaacucaggccgucaggcuuggcagcaugcaccuuuaccuagagagccagcuuauuagcugaaugauaauauaauuuuaaugacgauaacuaacaccuggcagcuggagagauggugcagugguuaagagcacuuacugcucuuccagagguccugaguucaauucccagcauccacaucaggugccucacaaccaucuauaauuccaguucuaaggaagccaaugccuguuccccuguuucauacauaggcacccauacauauauauaacuuaucaauacauagcaucuguuaagcguacuuguauguuagaugucucugacucacuccuuacgauaaauaaccuaauggugcagaggucacuaccaucugccauggacagagaggggaggagguaucaagggaugcucagaguacuuagcgcucaaggacacagaaggcugcugcgugacuguggagacauacccugcuggggaagaacugacaguucaugcuaucccgaggaggccagugggagaacaguguggggaagucaaaucuaugccuugccugcgauuuguuaagggagguaugagcaggcuagcccaggcugggugcccaccuggacagaacucgcuuuuuggucuccuuggcucgaaccuuccuuagcaggucuuccagcuugcuugacuccucgaagugaaccccaagguccucguccucagcgguggugaugaugucccuguagaacacggauacaucaaagccuccuggcuucuucagaugcaucaagucaaggaagaucccuggugugaagaaagauuaaaaccagggauagcgaaggacagcaaaugggaauuacuguuuuuucuuuugagacagaacucacuuuguaggccaggguggccuggaauucagaaauauaucugccucugaucaaaggaguaugcuaccauaccaggcuaaguuuguuuauuuuuauggggggcggggccuuaaguuuuuuaaguuuuuguuuaaacagagauggugccaggccagauguggggauguauauuauauuguauauuauauugguauuacuaauucuugggaagcaaaggaaggaggaauguaacaaguccauaggucuacacggcaaguuuggggccagccagagauaccaggugugacuuuauuuccauaaagaaaagauuugagagaucauaucuauaccagagaggcugaggcaguaggacugcugugaguuugaggcuauguugggccacauuugaguuuugggccaucaugaguuacauuguggccuauuuauuuguuguuuguuuauuuauuuuggucucaaagauggagcaaagcagucccgugagguggugcaacaugcccauaaucccagcacccaggaggcaggucaggguuaggaccaggaaagcaagguuacccaaguugcacagcaaccuccagagcagcuugggugacaagagaaucugaaucuaccaaaccgacaggcagugcucagugucuugcuaugugaccuagacugaaggucguagacuaagcaauccuccugccucagucucccauauaucuaaagcuaugaaacaaaacacugcccaacucuagcauuugcuuucaguuaaauagaaauggaucgcauuugcugguagcccaggcuggacccauauucuucuugccucagucuccaaagugcugggauuugagguaggcaucaccaggugcgggcaaacauccuuuauucucuguuuuaaagcuguauuuaccuguuauaccaguguuuuguuugcauguaugucuguacuucaugaaugcagugcccacagaggccagaagagggggaggaaucggcuucagaugccuccuucucuagacuaggcaugacagugcgcagcauuaaccccaucaccagggagguuaaaaagggaagauggccugcuugaggccugccuggcuacagagcacuuccagaccagcacggcuuauauaacaaagccaccucaaaaacaaacaaagcucccacagaaucuagauagacuauuaacguuuccaggaccuacagaagugccuaugccauucagcuguuacaaguacuuccaacaacuuucaaacagccaccauccauugcaucacugaggucagaacaaguaagcugugguggagacuguagccagauggaaggcgacaggccacacuagugucucccccuuggcucugcuucaucuuuccuuugucucuugguggcaaaagcaaugcuugagcuauaaagaaaguaaguuaggagcaacuaaaaagaauaagaagggcuggacagugauggcacagaccuucaaucccagcacucagaggcugaggaaauggaucucugugaauuuguggccagugagccuacaggucaaacuccaggacagcaaagacuacagagagaaacccuaucuugaaaacaaaaauggaaaaaaaagcaaaacaaaacagaaaaaaaaagaagcacgggugggcucaauaguuaagagcacuggcugcucuuccagagacccuggauuugauucucagcacccacguggcaguucaccguugucgaaugccaguuccaggagauaugaugaugacuuaacgaccucuucaggccuguacaggcaccuugcacaaaaguggugcacacacaucuacgcggauaaaacauccauauauauauaacauuuuuaauuaacuaauuuuuguuuguuugugucuucaagacagauuucucugcguagcccuggcuguccuggaacucacucuguagaccaggcuggccucgaacucaaaaauccaccugccucugccuuccaagugcuaggauuaaaggugugcgacaucauugccuggcuauuaaguaauuuuuuaaaaauuaaaacauacguucauuuggagcuggauaaaugcacagacgugcauuuaaaacccccaaaugcauaaaguaaauaaaguuaaagggaaaaaagcaacuaagaaaauaaggcuggagagauggcucagcaauuaagagcacugacugcucuuccagaggaccuggguucaguuuccagcaaccacauggccacacacaaccaucuguaauuccagcacuugggcacgggaugccucuucugacuccacaggcuccuggaugcacacggggacauaacuacauacaagcacacacacacauacacacuauuuuuaaagcaaugauagaagaacaagggaagugcccaccagugucccggaggucgcuggcuuugguccuggcccggcuggcuuuagcacugucacggccaugggggucgucuucauuggugaacagcaugauccucuugugacucaucuugagcuggacgucgcugaagagguuggcacagacccagagcacuucacucaaagaguagucagacccauggccaaccgugucucggaagugcuucuuccccuguugucccuuaaacuggucgagcucuagcacucgcuuagcgccuggugagaggcagggcaaacaagagucagccaacuucaccacaggcuaacaggccaggggcccugcucacucagcccugccuaacuagaguggagggaccuucugugcaggaaaccaaggcccuagccaaggucaaagcugcuuccuccuccagggcccucuuuuguucaccuuagugauauucucacauuaaggaagccguguucuuugacuauuacugaccuggguuguccaaaucuuguaagacauaaauauuuuugaaauucacugaauuuuuaucuuucucgguuccauagaacaccacugccaggagaucccgaucgcugcuuaugaucuuacugguguacacacucuggauacacuguaaaaaaaaauaaaacucccugaguguuagcuuaacacuaagucucuauaaguaucugguguggcacagagcccuguucagucuggaugcugcguuaagucuggcauggcggcacaugaccguagucccagcacugggaaggaggaggcaggaggcuauaagccuguuaccaucaugcuggguuuguauaaugcuggggaaugaacucaugacuuuacgcaugguaggcacguccucuaccaacugagcugauccucaggccuggguaucuguuuuucauucuacaugucauacacauuaagagucgacugccugggccacaugacaagucucacucuauuaacuuagcagugaggaacugcuaagucacuugccauaccagcugcaugccuucauguuggcuugguuuuguuucauuuuuaagauuuuacuuuguuuuuugagacagggucucucuacauagcucugcuguccuggaaccucucuguagaccaagcuggcuuugaagucacacagauuugccugccucugccuccccagcacugagauuaaaggcgugcgccaccacugccucuuugagcauucauaacaguggcuucuguuuguuaucucucaagaaauggcuacucaaauccuuugucccccugucccuauuuugagacagggucucaugaagcccaggcuggccucaaacuuaaauauguagccaagcaugaccuugaaccucugacccuuccauucccaccucucaagugcuguaaauacuacuguguaucgccagcccagggucuccacacgugaggcaagcgcucuaccaacuccucuaaauccuuaguucucuucugcccauuuuaaagcuguguugcaauuguuuauuaauaguaauauucaauucucaggauucacuugcaaaaagacuuguguacuuguguguguguguagugggggauuuaagcaucauuaacagaaauuuucuaaggaguccacauuuuuaaaagugguauuuaaaggagcuggaaagauggcucaucaguuaagagcacuaacuuuucucuuccagaggacucagguucaauucccagcacccacauggagccuuacaauuguauauaacuccaggucuagacaucugaugcccuuuuuugacauccacugguaucaacuauaaaagugguacacagacauaccuacagaaagaacacccauauacacaaaauaacuuaaaaaauauguaaaauuucaguuaaauauauuuuaaauuaaauaaaaguggcauuuucugggugugauaguacccauuuauaauacuagcacaugguauuauaccaguauaauuuauaauaucaguacaugggagaugggagacaagaagaugagaaauuuauggucauccuuggguacaaaguaaauucugaagccagccuaggcuauaugagacacucaacuuaaaaaauaaugauuagccgggcagugaugacgcacgccuucaaucccagcacuugggaggcagagauaggcaguuuucugaguucaaggccagcguggucuacaaagugaguuccaggacagccagagcuauacagagaaacccugucucaaaacaaaacaaacaaacaaacaaacaaaaaaacagugauuaaaaaaaaaaaaguaaugauggcgguuagagagauggcucaguaguuaaguaguuaagauggcugacugcucuucuagagguuguccugaguucaauucccagcaaccacaugguggcucacaaccaucuguaaugggaucugaugcccucuucuggugugucugaagauggcuacaguguacucacauacauaaaacaaauacaucuauuaaaaaaaaaaaaaaaguaaugagagggcuggggagauggcucaguaaccaucugagcacguacugugcuugcagaagacccagguucaauucccagcaagucacaccaggcagcucacaacuaucuguaacuccagcucccaaugaucuaauaccccucugacccuaccuacacacacacacacacacacacacacacacacacacacacacacacacacaccuacacacacacacacacacacacacacacacacacacacacacucugauuaaaauuuaaaauagccaggugauaguaguacacaccuuuagucucagccgucaggaggcagaggcaggcaaaucuguaggaacucacucucuacagugagcugcagaacagccagggccacacagagaaacccuguagugacaauuuuggaguuucaguuucuuugaaaaaaacacagaaauacuguaaaaauguguuuucacuuagaugccaggugugggauguggagcugcucgggacuguccuccgcaggugacugugauuugucucgugcucaagcggugcugugacuuuuuucagcugcagauaguuccugcaauugugugaugcuuggcauucugaaggcuuuugggagaguauauaaaugcuagggcuccaagagacaggguggguuguugguugcugcuggucaugguuuguuaaagaagaaaugguuugcacaaagaaacaacaggaagaaauuggguauccugaugacgaaggucaaacuugccccaaucagcacagaguagucuaaaaauaaugucacccucuuuccaaccccugacucuauucagggaucucuuuccuuuccucuccauucuuucuucccuccuaucuaguguuagagguugacagggcagaagaaaaaggguggggaagggaaaaagaaacaagaacccacaaaauagcaaaaggcaagguacaaaaccuuaucucaaaaaacaaagaaaacaauuuaaaguggcacuaauuuccuucuuggcagacucucacuauggcguuacacucuuucuacuuuagccuccaaggugcagauuacaggcauaugacaucauucccagagcaucuuuagaagugggaggggacagcuacaaauuaagucugauugacaccaaagggaaauucuggaggccacaugaggccuguggauaagaaacagucugacagccuuggaaccaguguugcacugcaggcuuaagcaagucagucaggagacacaggcuaucccugccguccugaccucauuacccacacacguucugcuccacagucuucuuccuauuuuuuagcuuugugucuugagacagggucucccuauguagcccuugucuguccuggaacucaccauguagaccagguaggccucuacucaagagaucucucugccucugccuccugagugcugagauaagagacaugagccaccacacccauucaauguuugggguugaauaaugucuuaccuggaugcucauaucaaaaggugugaguucaucuucacccugagauucgaacauagcccuggaggcaucaaccagaaaaaucaagcuaucucuuccugaauauuuauauucuccuauggaaaaauaaauggaaaacaauguuugccuuuugcauuguauuuauuauguuuaccaaucacacaaaacagagacaagcccauagaguuacaaguagaacuugacaaauuauaagaugaacccacuuaaagccuccacuccugucaggacccugaguccuauguauaucucucaaaucguuaguuuugacuuauuuuuauuuccuuuaaaaauuuuugcugggcggugguggcgcacgccuuuaaucccagcacucgggaggcggaagcaggcggauuucugaguucgaggcuagccuggucuacagaguuaguuccaggacagccagggcuacacagagaaacccugucucgaaaaaaaaauuucagcugggugugguagugaguaucuuuaauccuagcacucaggaggcauuggcuggcaaaucucuuuacuucgaggccaggcuagucuacagagugaguucuaggacagcuagggcuacaaagagaaacccugucuggaaaaaaaauuauuaauguauucauuuuauuuugugugugaaaguuuugcuugcauauauaugaauguaaaaccaugugugugcuuguuacucucagagaucagaaaagugcauuagguccccuggaaauagagcuauagaugguugugaaccaccauggggaugcuagaauuagaacccagguccucuagaagaacuuacuucgaggccaggcuagucuacagagugaguucuaggacagcuagggcuacaaagagaaacccugucuggaaaaaaaauuauuaauguauucauuuuauuuugugugugaaaguuuugcuugcauauauaugaauguaaaaccaugugugugcuuguuacucucagagaucagaaaagugcauuagguccccuggaaauagagcuauagaugguugugaaccaccauggggaugcuagaauuagaacccagguccucuagaagaacagccagugcucucaaccacugagccaucucuccagccccugggagucucuuacaccaugagggagguuuccuagugcaagccuggagcugggcugauuccaggcaagaggcaggaggcaaguuagagaccaggauguauagccaccaaugcacccacuuuuauguuaacucgauucccaggagucauuagaagcucaaagucaaaaaaaaaaaaaaaaaaaaaagaagcucaaagucuacaucaguuacagagugaguuugaagucagccuggucuacauaagaccuugccucagaaacaaacaggagcuggggaggcugcucagugguuaaagcaaugguuaagaauacuugacgcucucucacacacgauccagcuucacuucacagaaugcacauggaggcucacaaccaccuauaacuuuaguagcaggagauccgacucccucuucuggcucccuuuugcaccagacauguacagagguguacacacauacauaaaauaaaaauaaguagauuuuuuuaaacaaucaaaaauauguaaaaaauaaagugacaaauauuaccauggacagagucauuuauugaagauuaauaaauucucuaucgugguuaguaaaaaaaaaaaaaggaaaauaggguuaggaauguucauagagugaaauaggaucuaaauaauaacuguaaaacucaaagggagaaaaaauauuuuagauuaucugaggagaaaagggagggauaucagacaacauaaagugcucccagcaaaaaaaaaaguacacagcgaaaaucuuccacacaggccacuuaccaccugugucggggcucuccuccuccucuuccucuuccucgcccucaguuuuguaguaggacucccacucugacauguugguuugcucacuaggugagagaaguuaugaauuuaaaugaaaaaaaaaaaaaaaaaaaaaaccaaggcagguagcucugugguaaugcgcuuuccuacaguguacccggaccuaugccacacacaccagaaaaaaaaagagagacagacagacagacuucuggguucucuuuagaucuguucuaaaugcucgggucacuaauaaagaaugugaaugauggcuccugcuuccuccaaagcucuccauaucauuggagaggcaagagaaaugugcauggggucauugcugcaacaaccuccccuuggcuaucccuuaaggaugcugcaggaccaaaauggcuaggggugagggcgagguauaacauagcggcucagcacugaagguccuaucucgagcuccaacuggacugggacgguacuuggugcucuggcugaaacauucgucuucauuucucccccaaccuucagcuagagauuggcucaaccaccaguccuguuccgccuucuggggagaaaggagcaugacccagguccugcaggucgacagcgcugcuccguggugaggccaggggucgcgcgacacuaagcgugcaagcaagccaccaaggcaggccucauccaacacauguggugcggcgaaccuaccuuaaccgcaggcgggcaagccacugggacagcagaaggugggcaccacguccacgcgggcuccuugucucucgcccaaucagcgacguugcgucaucacgcacaacacgcccuucgacccuucaagcgggcacgcccacucgcauuucccgcuuccacccccuguucccuaaacuggaacgcuugcggccagagaaagccccgccccucgcuugaagcuccgcccccgaaacccgucagcaccgaacgcacaugcgugaaagugcguccccgccccugcccccuguuccgugcggagucucugggaucucucucucugucaccucacaguagucguugccggucgcggguguccgggcgcgagcagcgcagggccgccucucccccgcccucaggccgggccccggcucggucccccgcucccucuucuccccaccccggucggguaccggaagguccaagccgcugccgggugcccgagggccaucguggccgccgccacggguccugauggagccgccaaaucucuauccggugaagcucuacguguacgaccuguccaagggccuggcccgccggcucagccccaucaugcugggugaggggaccggggucagugggaagaaggcagguggccgcuggaagcgauccaccgaggggggugggggaagacgggcccaugggugguaggaaagauccacuagggcaaggacagugaggugggauucccugaaccccuguccagcuucaugaucuaagccaaggagacacacgcuccggcugagagcaagcuccucuucagcuagagacuggggcuagccgacugaucuugguggauuccccaagaagccagggaacccugcuucuuuagcucaaaguagagaaagugaggauaccuccagcucgugucccuggugguggaagcaacacugcagacgagauccucuggugucccucggagcgacugcccuccgcgccaaaaggaaauucccucugcaguccuuggaguggaugggaagagagcgcuagagcgguggaaggcuugagcccuugccggcuccagguuaggucaagucaggucacccugagccagaucuuggaacuaauuacguucuguccgacgaugcaauuuucgcucaacaguuaauugcuuuugaccagaugguaagaaagcaguucugggggaggaccggaugcuguaucggugaggauaucgguugugcucaguucaaaugguuucaugcugagagagaaaaagagcccuucaguguagguccaacuucacuucaagucaaauaccaaaaugucugucauauaggauuugucaggcuugucauuucagguaaugguggacaggaauggauuucagggauugaaacugacauaguuuugcaucauucaauaaauagcuauaguguuuccuggagacauuggaggaaggccuauuucuuaaggaacacaaggggcagggaucaaggaagcaaggcaaguuuugaggacauccauuugugaugugucacugaguugaacuuacuaauccuuuaacccuggggcagcgagugguuucuaaaugugguuucccaucagaaucaucuaggauguucguuaaaaacacaaauaccugacugaggcuguugcucacucacugguagaguuccugcuuggcaugcuccaagcccugggguuugaucucuaacauggaaacaaaaaacaagugcauucauuuccaacauacauugucagaugggaugggguggggggagcugaaaaaacuguauuagaaccaacugggugaaacacuccgaugauccuaguacuaaggaggcugaggcaagagggcuguggguucaagaccaacaagcugggcuacacacacaccugagggaauaaaagaagaagaaaggaagugaagagagagagaaaaagcucaggucaaaacgguuccucuaccaaagaaacugguagcagacagaguggaaggaaacuuugcccuaaacuacuuuguacuaaaugugugcacauuuugugagucuuacaugugcgaauuguggaaccaugcuucacagauacuaagccagagucuuuggaaauauguuauuuuuaaugaguguuuuggaucauucuuuauguagccagcccauuauccuuagagagagauuuggaccuaagucauggguuguuggcggggguuaggguccggucaugacucggugguagaggccuugcuuaacaaggcccgagcucagucucccgcacaccugagaagaaaggaaggcaaaucugaaagcaaaaccugcaagcauucuucuuguuguuuguuuggggaacguuugagccauugguagauuauaucagucagguuccagcuaaguuccuuggaaugcagccaugucuucaguuuuaucacagagaggcaucguuuguuuccuugacccauaaagcgcccuccagacugauuuuuuuuuucaaaaagguauuuuuuauuauuauacauaaguacacuguagcugucuucagaagcaccagaagaggucgucagaucucauuaugggugguuaugugcuaccaugugguugcugggauuugaacucaggaccuucagaagaacagucagugccaccuugcuaccccacccccaggcugauuuuuauauugguccuaaaaccuaauaauuauguuuuuagcugaaagagacacuagauauuguuguuucauuaaacaaauaagugcuuaggcaagugcugauguuuaguguguuaauguuuaacaaagcuggguagacugggaaaagauguuugcagacauggagcuagcuaguguaggaaauuguguguguguguguguguguguguguguguguaaaauaacaaacgugaucuguguugaaugcaagguaggaaauaauaugagagacucauuuugaguuucagaagcuguggcuuuuaggcuggaaauacaggaugaggaagaagcagcccuccauaagagugaugagggaguuaguguuguagauaaaaggguugaccagccaagaucuggagccggaaagccuggcuguuggggcugaaauuugccuaugugcagggugguaguaaagaaagaaguaaggcaggcaggugauguauuagacucgccacccuagcguuugggccuugaacccaggugcuucgaguacucuaggcaagcagucuaccgcugagcuccauggcuagccccucugucccuuuaaauagaugugauggcuccaaaaggcaccagccaaacacgaaacuucacgaauuuggccuaucagagaucacagccucaccuacaaacuuaauucuccuuuuuccuguaguguuuuuauucacuuuguaaaacaaagaguuagggaaagucauagucauuacuuuguaaagcuaaagauacauaugagugcgcacacgcacacgcgcacgcgcgcgcuaaaguauuaaaaccaaagaaaguagaaaauaggcaucgccuuucuguucuucccuuucaccacugaccuuaaaguugcucuaauucaguuaguuuccauauagugauuucucauuccuaaauguauuugacuguuuauuuguucauuuguuuuucaagaugguuucucuguguagcccuggcuguccuggacuugcuuuguagagcagguuagcauugagcucacagagauccacgugccccugccuuuccaguacugacauuaaaaggugugcaccaucacaccaccuauauuugaacuuuuucaaaaauuaaucuguaugggccagcaagacagcucaucgugggacacuugucaccaagccugacaacuaaaucugauuccaagaaccuaaggagaaaauugacucccaaaaguugucuucccaccaucccaugugcaaagugagugcacaaauguacacgcacauacacacauacacacacacacacacacacacacagaguaaauaugauuaauguguuuacuuauuuuuguaaggauuucuagaaguauauaacauaauaauugaguacuugucacaagccagccacccaacccccuuuuccugaguugcauccacuagaauccuuaccacacccaugugaaauaggucgccugaucugccccaagucacaccgcacacagguugcagagcuggguuauggacacagaacuuauuucaccaucucuuugcuaauaccaacaguccaagauaauguguucccuugugacuaaaguaggguccuuguccuuagacagacgucucaagguuuacuggaaaagcccugggccagauggucugagcuacuuuucuagcacagugaccaucccccgucacccugcuuuucccaaagcgaauuccuguuccuuuacucauguacauuccccuauguaagaucuuaaccacggggcuggagagauggcuguguuuuugcagaguaccugcccucagcacccacaucagcaaacucaagugccuguaacuucagcuccaggggacacgacaccccucugaccuccccgggugcacacuuguacacaugggcaaauaauaauaaaguuacuuuuuaagauaauaacuuaagggcuggugagauggcucaguggguaagagcacccgacugcucuuccaaaggucugaaguucaaaucccagcaaccacaugguggcucacaaccaucuguaacaagaucugacacccucuucuggagugucugaagacagcuacaguguacuuacauauaauaaauaaaucuuuaaaaaaaaaaaaaagauaauaacuuaaaaaucuuauccaauucugcuaggguucaugauugacuuaaauaacacagauuucaccaaauuauccugucacgaugauggugauaaugaugauggggugaugguuuaguuuuacuugugugugccuguaugcuaccugugagagcauacuauagcaauaaauaacauuuuaacaaacagcaaacacauuucaggucuggggagauaguuuaguggacaugagaaucugaguuugaguguaugcaaugucugcuggugcccauggaggccagaagagggcacugggcuagaguuacagucaguuguuaaccacagaacaugggcucggaaccagacuuggguccuuuaaacuccuaaccacugagccaucccuccagccccauccuguccuauuuugaggacaugugccucccacgacacucuguugugcaguaccucaccagccacgauugcucuuagcauucuaaucgcguggacagccuaauugcaccuuuucccccaugucacuguguggcuaauauaauuagcuauuaaaacuguccuucagcucuuccucuuaauaauuuuagcugcucuuuaaacuucguggccucuuuucgugaaaaggcguguagagguaaaagcggaggcuugggaggagugagggaaagauggggcucaugacgcagcucucgaugcuucuaccuccuguccuguggccucggggccucaggcuugcaggacaagcaccuuucccaccgagccaucgccccagcccugaacuaggcuaacucggguuucguguuucguuucugacuugagguuuucuaugcauguguaaugguuauuuuccccuagaagcacaucccauuguucucaggauaaaguuuuugggaaacugugggagagugcuugccucgcuuuugugaggcccuggguuugggaaaaaagaauccccacaucuguguacauauugacagaaugcaaucuagugaauauuugggucuuuauacuuagcucuuacaacaguagcaccagggacucuacucuuagguguuaauuucuuuuuuuuuuuuaagauuuauuuauuguuuauuuuauauguaaguacauuguagcugucuucagacacaccgggagagggagucagaugucauuaagggugguuguaagccaccaugugguugcugggauuugaacucagaaccuuuggaagagcagucagugcucuuaaccgccgagccaucucuccagcccgguguuaauuucuuaaaaaguaauguguauguauguauaaaauuagauaaccauauaaaagaguugcauaccaagauaaaagcagcagcuuacuugagccuuuccagcaggaggcuggagcuucuggaggcagagaaccucgcuccucagagcacccccaggauagucgagagccagugcuccuuaaggggugugagcacccaugggugaugcggggcuggaaccaggcccucaccacacuauacccuccuucccaguauugaucauaggaaugacucagacuugcaaauuaaauagaauuuauucaaaucugagagaggguguuuuuuauauguuuuauguaaucuauuguucuuuguuuucguuuuuauuguucauugugugcucaacugucugauauccacugaagaaauggaggaauaguaacccugcaucuuucugcaaaauguaaaugaauguggcuugcagggcucugagaacuccugcuuaaugucuguagccucaucuugcccccucguguuuaacacagcacucuuuuuguuuguuuguuuguuuguuuguuuguuuguuuuucgagacaggguuucucuguguagcccuagcuguccuggaacugacuuuguagaccaggcuggccucaaacucagaaauccgccugccucugccucccaaguacugggauuaaaggcaugugccaccaugccuggcuuaacacagcacucuugacaccagguuuacuacauuagauucuacaacaaaacccacuuuuauuauuuaaaagaagcagcagcccuguucaaauuagaguuacuauugccaugaccaaggcagcuuggggagaaaaggauuuauuuggcuuacauauccauugaggaaagccaaggcaggaacucagacuaagcaggaaccuggaggaggagcugauguaaggacauaaaggggcugcuacuggcuuaccccacuugacuugcucagccugcuuucuuauggaacccaggaccaccaguccagggauggccccacccacaauggccugugcccuuucccaucaaucacuaauuaagaaaguaccuuacagguuuuccgacaaccagaucuuauguaggcauuuucucaaucgaggcuccagugauucuagcuugcgucaaguugacauaaaacuagccagcacaagcaccauuagggcuuuccucuugcagagccucagagggggaaaggcugccugguaucccagcagcacaaagugccuucaggucucucuucacagccugugggcccuauuaccaccccaggaacuuucucuguccaguucuugcccugccuaacuucugcccauccuugauaucucaguucugaugucaguucuccuacagaccuuuuccuaaacccugccuccaggucuugcucacaugccccucuucuguacuaauaccauccuguauccuccuggaaguguuuauuauccuguuuguaauugcacuuuuucuaguguggaugcaggugugucugugggagguuuugugcacugugugcaugcuucagaggcuagaaaggggcauuagaacuggagugacaagugguugugagccaccacgugggugcucuggaaaagcagccagcgcccuuaaccacugagcuaucucuucagccccuaagguuuugcugcugcugcugcugcugcugcugcugcugcugcugcuguugcuguugcuguuguuguuguuguuguuguuguuguuguuguuguuguuguugucugaggcagaguuuuauggguuugggcugguuuucagccucugucuguuggugcagagacuauagguaugugccaccauccucuuauucuuguuuguguuccuccaccaucccacuacaaaaucucacucuguaccucaggcugguccacagcaauucuccugccucaacccuccauguacuaggauuacaaacaaguauuaccacaucugacuauaguuauuuuuacacuagggaaaaaaacaauccuguacugacucuaaagaauacugcaugcuuaaauauuuuuaagccugccuuuaaauuguuuuuaugacuuugugcuuggguuagaauucaguuucuugugcauggucuaaggcaaacacucuaccgcugagcuucacucccagcuucuucaugguuucuggcaccucuucucuccccacagacaauaaggggaaggccuucugcuggugggcaucuuauacuauugacugcagagggcuacguacauuacacaaaugcugcuucuacuuuucccagagaauaaacagaugcuuccagguaacacuuaagccucgcuuacuguuggugaagugccaguuacacuacuuugcugcuaggggaggguuguguggagugaaccagggccguacuugaucuauaccaaagaacuaauguguuucuucucccugccaaagggagaccaaaugccaccugcaaagaggugucucuggagucccaucacugccaaccacuuauuucuuaguaacaggcguuaguauagcguaccagagcugauggagccuguguguuuauccagcucuguggauaaggagcaggcaggugcucacuccaagacuuuuaugugccucguaacucugugcaacgaaggcggauaguagcauaccuuguccugcacuuccauaauagagcugauauccacaccuccugcuuguuuucuguauccauaauccauagaccucagaaugaaugcauugggugugccaauagguuuagagacacacugccauaugacuacccacucucccuccaucuugcugacuaaaucccaguaggaaauaauccgcucuaugcugugcuaauauccauugggucuaauucauguccccaaauggcuuugugcccuacuuucauagcuccuauuaccacccccaccucaucucuugccauccuaaucuugcacccaaaauuaagaugcaguuaagccugcccucccaugccuuucaucuugccaaggccauagucuuacuccuuaccuccccaagaggaggcuccaacacagcaaacuucacaucucuaccugggcaucuccagugaacccaucuucacaucuugccuugucuuuuuauacuagacaaaauacaggucuucaucaucuucauaaaaugauaauaaaugugaucuauuuaacauuuaaaauaugugagaaugggcccaggauguggcuccauuggcagagugcuuaucuagugugcacaaaccccacacuaaucuagugggcuugaucccuagcaucaucuaaaccaagcauggugauagaugucuuuaaucccaacagguggaagugagaggcaagaagaucugaauucaaggucagccuuugcugcguaguaaguuagaggccagccuagaaugcaugaccuuuucucagaaaaggaaaaaaaaaaaagaucuagaccuuugaguauaguucagugauagaguacccgcuuagcauguacaagucucugcucauaccccaguacaaaugaaaauguuuagauguaaagggugaacgggcauggcggcgcagccuuuaaucccagcacauaggaggcagaggcaggcagaguucugugaguuccaggacagccggggccacauagaaacacucugucuuuaaaagagaaacagagggccuggugagauggcucaguagguaagagcacccgacugcucuuccagagguccugaguucaaaucccagaaaccacaugguggcucacaaccauccguaacaagaucugacucccucuucuggugugucugaagacagcuacagucuacuuacauauaaucaaucaauaaaucuuuaaaaagagagagagagaaacagagagguauauaacacaggaaguacaagcaugcugcucuccuuccaugcaacacugagcaagaccuagaacagaugagggugacacuuagcaauuugugaaccuuggaauugacugcuccggugagugggugaggucaccuguguuccuaccuccuucauugccuugcucauccuucugugugcuguguguauugucuccuugccugucugucuucauguuaugugugaauugucuccuugccuguccuucugugugcuguguguauugucuccuugccugucugucuucauguuaugugugaauugucuccuugccuguccugugugcuguguguauugucucuuugccuguccuguguguugugugugaauugucuccuugucuccuucugugugcuguguguauauuaucugcuguaggguuaaccuugaccucuaaucugcucuuuaacucuucucuccaauucauccucucucacagcauuuuacagcccaggcuggccucaaagucacuauguagaugaggauggcuuugaacuuuugaucuuccugccucugcccuccaaaugcuggauuauaagcauggggccacuacacuauaccccuauuaccacacaucuuuuuucuucuucuuuuuuauuuuauuuauucguucauuuauuuauuuauuuauuuugguuuuucaagacaguguuucucuguguagcucuggcuguccuggaacucacuuuguagaccaggcuggccuggaacucagaaauccgccuaccucugccucugccucccgagugcugggacuaaaggcgugcgccaccaccgcccagccuuuuuuucuucuguaaguuuagugugcauguaaguacuaugcaugcaugugaagggucagaagacaacuuucaggaguugguucuucuaccauaugggacccaagaauugaguccgggucaucaucaggcaugugucugucaccugcuuuuaccuacugagucauauugcugacccuuaccacagcaucuuuuuuuaaauguauguuuacuuauauguaagugguacaucuguguuguggguauguacaggugcuuagagaccagaaaagggcauuugguccccuugagcuagaguaacaggugauucugagcccaccccacuccacccacccccgugucagugcugggaaacaaaauuccucuggaagagcagcaagugccaagugugguacacacuuauaaccccagcauuggagaaguggagccagaaagauuccuggggcuuucugacuagccagccuaucugaaucagggaugccaggcucaguacgauauguggugccaaaaacaagagggaggaugauucagaaagauaccuaaugucaaccucuggccuccacacaugcacacacauguggaaguguagguuaggugguacauggagaaucugagcuaggaggauugcuuuguguuaaggccagccugagcuauacagggcgcagaauguaaugauguggcuccgugcuagagugcuugcuugccagcaugcacagggcccuaggcuugaucuccagcauuacagucugguaaaauagaaugcuagucauuuguuugagccaaaaggcagcucaguggguagagguaacugguggcaagcuugguaaccugaauuugauguccagagcuuauggugaaagcagagaauuggcuccugcaaacuguccucugaccuccauauguacaccguggaauuguacauauuuguacaauuuguaagggcuggagagagguuuauuguuuagaacugauuauucuuccaaaguacccaaguucaauucccagcacccacauggcagcucacaacugucuguaauuccaguuccaggggaucugaugcccucauacaggcauaugugcagguagaacaccaauguacauaaaaaauaauuuuuaaaauuuuauuguuuuuaaaaagugggucugacuagaguacucuccuaccaaggccaggccacccugccugccccaggccugcuggcugcucguuguucgucagcacgccugcccucugcccugcagaaccgcagucuucacgcuuuugagcagacucuucucucuggcagauacgcccagcuuugccccugcacgcuccuucauugguugaauucaggcucaugaagguaguucuuuaucuuuauuaacauagcacccugucuuuaccauuguuccagugcuuaucagcacaguguuuuaguuaauuauuuaugugugucucuuuccacuugacuuugagcuucugaagguaggauagccuguguuugcauuuugacaccuaacguugcugguagguaaaggaauagauaggcagugggggagcacaugguuagccauguuuauauacccggauccauuccccuggcaccaaauacgcaugcauugccuuuggaaaaggcagagcauuuagcuuggcuccauucuuucugaagaauugcaccuuagugaagaaguggggaccaucuuccagauuuacucuggguuugcuguagaugacacagagagguugaaaaggcagcguugacuuagcccccgaugggaagcaagaacagacaagcaggacaguguguucguguugcucucugaugaagcagaguggcuucugagcuuccugaccacagugucaccccgaggacugacugccuggcugccauagaggagagcugaauucuagaaagucuuccaggagguuuucacaguugccuccuggugugagugaguucuacauuuacucagccugagaaggcacucggucuuguccugaauggcuaacucucuucuuuucuccacagggaaacaacuggaaggcaucugguaaguguggugcgcuccucauugacugcucugggagcaaagccgcucacuccccaguucauuggcucugcagcuccaggcucaaugccuggcucuuuguucacaauuucccauagccuguuuuuuuuaagguuuuuucuugggagggggugggguaguuaguuuucaaguaggguuucucuguguagcccugacuauccuggaacucaagucuguuagaccaggcuagccucaaacuuaaagagaucugcuugccucugccuccugaguacugaauucuucuucuuuuuuuuuuucuuaaagaaaggguuuuuuuuuguuguuuuuauuuuuuaagauuuauuuguuuuuauuuauaugaguacccuguagcugucuucagacacagcagaagagggaaucagaucccauuacagaugguugugagccacuaugugguugcugggaaucgaacucaggaccucuagaagagcagccaguacucuuaacugcugagccaucucuccagccccaaauacugaguucugaaugcugggauuaaagguauaugccacuaucggcaccccaaguuuuacuuuuauguguauguauguaugccuuuacucuauaugugcuuagugcucaggaggucagaagagaauaucagauccccugauacucaaguuacaaucucucuagccccaaggccauucuuuucuacacagggagcuccgguccugccagggcuuucucagacucugagaaagagagaaaaaagaaaagaaggaaggacaauguuuagaaaagugcuuguccugagcauacauauucccuaucacuauucccugaacgguggagcgcaauggcauuuacaucauguuagauauuguaugucaucuuuaaagauacuuaaaaggucuaugugaguuccauguauggccuaaauuccauuuuagacaagugcaucuguggcuuugguacgagggugggaacaguccuagaucagccagcccacacugagaaugucuugcucaugucuucaucugacuaauauaaaauugucuaccgugaugccugccaucuuggggcagaugcucucucugcaguaugguacuugcuuuucuuggagaggcuguaagucccuggcucacuguccucucuguggcaggcacaccucuauaguuguacacaaggaugaguucuucuucggcagcagcgguauuuccagcuguaccccggugaguggcuuccccugaccugcagaugugggagggagggcuauugccugagaaguucagcuucuagcauguaccucuggccuguggcaguuccucguguuagcauuuaagccagguauguugguacacuacacaugucuugaaucccagcacuugggaagcaacagaugaaucugugaguugaaggcuagccugaucuacucagaauguuccagaacagccagagcuacauaaugaaagacacuuucucaaaaaaaaaaaaaaagaaaggaaggaaggaagaaaggaaagaaaagaaaagaaaagaaaagaaaagaaaggaaaagaaaggaaaagaaagugagagaaaaaaauaaaagacuuaagcuaaguaguuuuauaauccuagugguuguggaaagagguaggaagauugggaguucaacuuucuuggcuacuuauugaguucaaggcuaaccugaguuaccugagauccucucuaaaaaggaguacugcuauggcucagaggcggccgggcagggcggggcacuugucaccgagccugacuaccaagcucacucucuagaacauagacagcagcaggagagaaccuucccuuacuagcuccuccucugacugaugcucauguuuaugcccguccucuucccacaugacuuuucugauucuaauaucggugcccuuuucagagcauuucucucagagccgccucaggauugucgguucauuuuaauaucauaaguagaaagucguucuuaauuuuuucacugaccacucuaaaagucuuucauuaagccacgucacuucuuuuuuuguccacuuuuugaaauuaaaaggucucaugguugaggcuggucucaaagccacugugcagcugaagagaaccuggagccuccugaugcccauugucuuuaccucccagguucuagggucacagauguguuugcacccccaaaagccuggucaguucuuaagucaaucagucugucucucuucaucucuucccauuuuccaagagcuuucacugcaguccugagcacuuccugucuggaccggaccuaugaaacuagccuguucuuccucugucuuccauguugaagacagaauuuuuuuuaggauguaaucucuugagauccucuugccucugacucccaauuaaagauaccgcaccaccgcacuacauucaacucaccauguagccaugggugacugugaacuucugaucguccccucuucaucaccauagugcugggacuauguagcccuggcuauccuaaaacucuaguagaccaggcuggccuugaacucacaaagauccaccagccucugucuccugagugcugggacuaguguaccacuguucccuacaugaugaguuuuagaugcuugguuuuuuguuguuguuuuguuuuguuuuguuuuguuuuuagggaauuucaguuuucacagugcccccagcuuagccagaagguucagcaaaggccucccaugaccccucugaucuugucucuggaucccucuuuagccauccucuucagguuguaucuucugaccucugcccuuuuccugcuuggccauuuaauccaagacuccagccucaggauagcucucugauccaucaacugaaugugccucucuguccuucaggucugagugugugucaguucucucagacagaucucagccuggcccugcccugccacagggaccaacaaauggcauucuguguuuuuuccagcauggcccuuaucucugcuugucaugauccacaggaguauacaauuuuuaccuaccuucccuaauaaacuuaaguuucaugaggacagaaaucuuguguuuuguauacauuguacucccauuguccagcuuagacguagcguauaaguucucuacguauuugucaugugggugaacaacaggaguugcaauagugcccucuuguucuuuggaacauuagauaauuuuccucuggcugucacaguuaucauaauuacugcuccugcucaccaggccuuccccaauucugagagcaaugucagccucaaggaaagugcucagggcugucaguccauggcuuucccaggucugcccuccuugauggccaauugcuugcccuuuggcuccuguucccacugcuuugcucuccugucacagcccagcugccauguucugcccuuguggucaucuacuggggacaaagggagaccaaagguuccagauuucucucuuuuuguuguuuguauuuuucgagacaggguuucucuguguagcccuggcugucauagagcuuacaauguaaacaaggcuggccucaaacucacagagaucagccugccucugcuucccgagugcuaggauuaaaggccugcgccagcacacucagcuagguuucugucauuuuaacaagacagugaacacacagugcaggagaccugcacuggaucagcuuccaggccccacaagcaacuggaagcccaaguuuucacucuuaccuugauacaaacaggagauagccucuaccugugacaggagugucccagcaguuaaagaugaagcugaugggacaguguaguuuuaugaaggaagucacaauaaaauaauuguuuucaagccugucacagugguacauaucucuaauccgaacacuuaggaucugugaguccgaggccagccagggcugcacagugaaaacuuaacuaaaaauaauuuaacagauggggaauguagccugcaguucacaagaucccucugcaaacuguuaaaauguuaacaagauguuggggucucagcacuagagcacuugccuagcgugcuuaaggcccuggguuucauccccuggacagccaagaaaaagcaaaaaagcaaaacaaacaaacaaacaaaugaucaagauggugacuuagugauuuucuuggguugacucuuucagggagggacauugcuugggcccccagacucugugguugaugugggaaacacagaagucacagaagaaaucuuucuggaauaccuguccucccugggggagucucuguuccggugaguacggacagggugguggcugcuugugugcuccacuaggcagccgaacccuggaaggcagggccaacuuggccaucccugucccucagcuccagccagaucggucuccucucaucaugaagagaaaguuacuaugcuauagaaagagccugagucucgccaacagccagcauugcaucccagcaugcuuucugcugaagccucaaaagaagcgaggcuucucacuccugcugauugauuagaaucagugagugugucuuccuccgccucaggcaaguguuuuuccuacuggaaaacaggguuugugguaggagagagaugaaauaccaacuugaauuaauagaucuugagaugcuuaagucaggcugaggaugcaguuuuauuuggcagaguacuuuucccaucauacacaaagcuucggguucaauccccccacaccacagaaaccuaaacugauauguuggcacaugcuuuuaaucccaacacuccagaaguggaggcaggaacauuagaaguuugaagucauucccgccuacauuuggaaugaaaggccuaccugcgcuauagagacucugucucaaaagaaaaaaaaaagucaaagccugguaagaugacucaucagcacagguauuugccauagggugcaacagccagccugagugugaaccccaaggcccacacuauggaaagagaggaccugcucucaaacauuguccccacacacauacacacaaaaugaauguuuuaaaaaaaaaagaucaaggaggggcuugagggauggcuuagagaauaaggauauuuguugagagauucuuagaggauaaggcuuggggaucaguucccuggacucacauggagacacacaacagccuauaacuccaguaacaggaguuacagucuucuggccuucacagucuauaggcacaaacaugguacacauacauuuauacaugcucaucugcauaaaauaaguaaauauuuuuuuaaaaacuagauagcuuuauuaaguguucaccucugauccuagucccgaugugaguguagauucuggaauuauauagaaaccauguguuucugcuucaucuuucccuuguaagucacugcucagagguccagaucugcagacagcaguccuucuggagggugugagaggacuggucauaguccuaacauuagacucugcccaccuucccacucaacagucacagucacgccacauagaugcugcuggcccucucaucugcucuucaaaccucucuccauguacagaggagaagccuacaaccucuuugaacacaacuguaacaccuuuagcaaugaaguggcgcaguuccugacugggcgaaagaucccuucuuacaucaccgaccugcccucagaaguucuuuccacgugagugugacuacucuguuucuaccccugcgaacucugaaaaaaauccccaucugaggcagucaggagauucagaccagccucagcucccuaauggacuuccugagaagagccugggcucugugggacccugucucagaaauaaaaggaaagacaggaaacccucaaacuuagugccccuucccuagggcaaccgaauccucacauccaguaggaccugucugguggcagauuccaccacagaaggccaccauuguucccaacuaccagugugcacuagucugaccuucggccuccuuggagcuggguuuuagugccaccacagaauuuagaaaccuacuugacacuaguuuugauauuuacauaaaaccccaguaucuaauacacaaagccacuucccaaaagugcuuaucuauaguuuaggcuuggggagguggcagaauccagaguaacaggacaacccaguuccaaacugugacuugucucagucauccacacccugagcucugaugcccucaaaagaccagauucugcguguccuugaauucacaguucaaggaaagcccucaacagagguuuccucugccccugauggguccaaccuugggaagggccugugggccaucucccagaugacaucucaagaaaggacacauacucccuuuucugauucuaucaagcugccucugcucacucuaggaaauguaacacucguaacaccucuggcuucaacugaaucgggugggguccugaccaacagggguccugacagauaaacgccucauuucaaaacaaaacaaaaaaaacuacguagaaaacagggcugcucaagagcugggucuccuaggccucagacugucuucuaccuaauagauguucaaaacccugccuccagaucuaggucaugagacucugagcacgauggaguagccaaaggcuuuuccuguuaguggguggagucucugagcuugucugagugggaguugauuuaacccuuggagcaguuuacgaggaauuuuauuuccuugauuuuaggggugauuuaaauacggcaguaccagcuucgcacaguggugugcgcguagaguccuagcacuugugaggccgaggcaaacagcgugacagugacuugagacagcaucagucugagcuacacagugaguuugaggcuaggcuaggcuacauauucaguaaggaaaggggggcuaggcuacauaguaaggaaaagggggugggguacauauucaguaaggaaaggggugcuggggugcgcugagcauaaagccuguucccagagugugucaugagccacuaucuuuugugggcacuuacuuuuuaagacaggaucucacuauguagcuagacuagccuagagcucauuucauagacuauccugaccucagacgcacagauaucagcaugcacagccuccugagugccgggauuaggaccuaaggcacaguaaucuugaacucuccaaacuccaucuuuacagugauuuucagcugguuauuguuacagggacaaaccacgugcccucuagaaaaugacaucaacacuuggcaacuucgcaugaccaguuacucugaauagaagaguauguuuucuggaagaaucuuuguuuguuugcuuguuuuuuuguuuuuguuuuuugagacacgguuuuucuguguaguccuggcuguccuggaacucacucuguagaccaggcuggccucgaacucagaaauccgucugccucugccucccaagugcugggacuaaaggcgugcgccaccacgucuggcuacuggaagaaucuuaauuuugaaauaugcccacucccagcuuaucauccugauuccuucggcuuuaugccuagcuuccuccucucuccucagcuuguaucuucuucaaaagaauuguuagaaagaagcuggguguuuugguacaugccugaaaucccagcacuugggaaguagagaccagaggaucaggaauucagggccagccucgacuacaugagacgugucuuaaagcuaucccuucaucuaaggauacaaauacagcagucuguacagaaagcucuaguccccucugggcggccagccuguucaacggcaacucagcaggccuugcagggucaguaagaagaugguagggccacacagagaagggggccugggaguaaauccauagggcgagcuacuuggaagaugguuagugagcuuucugcuccuggagcacaaaccugggauacucagcucauaaagaggaagacuuuacauuggcaguccauggucaccuaacacugucaccuuugaaccugugauaaagaaacucaucauggugggagcacaugguagaguagagcugcaaagaggaggaaaaaggacuaaguuuccauuguuuccuucaagggcauguagucagugacacaacaggccccaccccuuaaaauguuucacaggcagagaaccaguauuuaacacauggaccuuggcuagggaacacuuaccaaaucauaacccucuuacgaaaaccaucugaacugugguaguagaugcugauuagcacgaggaaacucacaacaggccaaguaagaaacuggggaccucagcccuaaauggaacaggagccauugcagaagacgggauagaaagaguugaagagccagaggcaguggacagcuuacaaggaagcagugucuucuggguacagcaaggcaacagagcauaggcacgcauaggaguugugacugcaugcaccggacuugugcagacccaagcccaguguggacagaggaguuggaccugaaaccccaccccuccuuaaggagcugcugggagaggaaaggucagucuuccccaggacugucccuccuaauaguggaaagaaugugugggcagcacagaauggucuugauggaggggaaaggcagacacacaaagguagggagguggggggaaucucugaagacuuugagagagaggauuaauaggaucaaaacacauuguaugaaauacucaaagaccuuauauuuguuauauauacuguggugguccgagccuuuaauuccagcacuuggaaggcagagagguuggcagauuucugugaguuugaguccagccuggucuacauaacaagacugugugaagguagacucucaaaagauaaaagaaagccaguaugggugguccugcugugaccaccaucagugacuccauucuaucuguggugcacuccucuguggaccccucccagcucaugucuguuucuccacaggcccuuuggacaagcacuucggcccuuccuggacuccauucagauccagccuccaggagggaacucugugggcagacccaauggccaaagcuaacaggacugcacgggaccacccaccucgccagggcuuuuccuuuuuaaacaaaacaaacccuaccagauuucuauuuuauaauuuuacaucagagcuaacagggacggcuuuuuaaauuucccagggaaggaguucuucaggcugcauguaggacaaugcuccugagaaagaucgaaugccaucccuucuaauaguauuauacuaauuuauuaaggcugucuugucugugaguucacuuuugacgcuguugccuaagcguccuccacacuggagagagagggugcuuguuuaaagagaaagcaagagucacagucugggagaaccccaucucggacccucuuuccagagaacacccacauuccacccagguugccacccugugggacccaggugaguuuuauacuguccauuccccuggagcagucaccuucuagcaguaacugaagcaaaggacuuggaguacauggggcagcuggaggcuccucacucaagcuaagugaccucuuuaaccacaaguuuacccuccucccgagacaaggccacucaucacagcccagccggagcagccgcagcgucaggaucaaaggagacuggcagcaggugugaggccagagaaaacaggagaaagccauuccuccuccuccuccuaucugagugccaacccucgaugcccaccccuaagcugcucuuccucagcguagcuugaccugucaccuuuaauaaaggucuaggcugcagcagcagagacacaggccuucugucugagaauuaguuauuuauagucaauagagccagccacucacacccuuauggguuugucagcuagggacuagggggacaugauuguucucccaaaacaagucucugauguagaaaauaccauaaugauguagauucauggugggaagaaaauuuggaguugucuccaguagggacuuucacauuauccuuaauacgucuccauugucauucugaccuuauggggugugguuggggugugagugggcguuuucuuaaugauaugcugcuaggauuucaugggcagcaauagccuagaagucuaugaucuagacuccagauuccagagggaccuuaagguucccuucuguggugucagucuucuacuagcuaauaugggaaacuggauauggagaagggagcucagagcaggcaccugagacucagcuccacacccauggggagccccccaccguggcuuccugccacuucugaaacuugagcccacuuguuccuuuugggguaggccuuuccucccugaaaagccccuauuggcucccuugccccuacccugcaggcuuugccacuagccauagcaguggcaucauggagaucucugccucagagcugaccuguugucugaccagagagagcuauguccaccuagggugucgagugguguuugggaacuugaaggucacagucagaaaggucucaggacucaacaguguacagguguauguggcugucacaacguagaguggaaaccaacagagacuguuuaguguuggucucuuuggcagaauagggcuuagaagguucaguguuuaaagcuugguaucugggaaggcagagguugcuggaagccaucacuuuuuccuuugccuggccccagcugguagcaucucugcccagagcucuguccuuagggugcucucacauggccauucucuguuuuucuccucagcaguaaccaugguauucugagacauuugccugaggauuuuagucacuuaauugcuugaauuaucuccugucaugucuagcagccauccaugccaacgucuguggccauggcuagcagagagaugggaagacuggacagucucucuggucuccuuucccuaugcaaguuccguugucaccagaaucccaggccaggaaccccacaucccaccuuuacauuucucugucccaguaccucaggagcauacuguucaugagcaggugacucccccugggcauguacaagcaagcugagaggaaaaggagucacgugguucaugccacauaguggacagcccuguccauuggucaguuggucaagggacaagggagguggaggcaugagacccuuguccgcuccuagacugaaggguuucuuugagauuccuucaugacuuccuugaagucaaacuaaugucuaauacggagguguuugcugcuuuucauugguguuuuuucuaaugcaauaaacucaugucugccugcugcugugguaaguugcuugaaucuugguaggacgcagccccuggcuuccccauuuguuucccucugagguuaaccgugcugccuuugcuuaguugaaaagcuuguggaugagugagggugguaaagaaaggugugugguuuucaccauuggucuguaaagauagagagaggacccagcaggaauacugcuauacugggcagaaggcaggaggaucaccauuaggcaugcguacguguugccccauuuuggcuugcaacugguaauagaauagcuucauauucuaagaugguccuccaggaucauuaggaacaauaggagaugcugcaagaauuuucauccugagggagaccaagcaaugucuagaccccuccuuauaaggucccaaugacaaaccaaaauuccauucuaccaaagguuacccuggagauugaguucauuauuaggcugcuccuagagccuucaguguuacagaaaggagugcaauagcucuaagcagccacaccucccaggaugcuuuccccucacagcauaaacagggagcccccuuuucauccuucccagacugcagacucucaagacuccagggucacaugcaacgagagcggaauuccaugcagcuaacuaggaaaagugaauacucuggagagcguccaguggccccuccccagcccucguaggagggaguauaaagucagcaagccgcagcugaucuccagggauaguccuccuaugaggggggucugauuucaugaaguagcaacugugugugcugguuuccucccuguccugaguaagcacugugguugccagucaguuuucuggaggcuucccugguaucuccaggugugcagccuagccagcuguauacaaaauccaguaggccaagccuguguugauucuuucccaacaacagcucaaggguagggauuggacccauuacacaagaggaaacuaaggcagagaagcauccagguggccacgccaucuuugaaucugggccauagucucagacgucaucacugaggcauggagccuuuccagugugcugguuucuauaaggcagaguacggaugguuuuugccugacauaccugcuuccuaagaacacacuaggcggauauuuuugagaucccuacugauagccagccacccaggcuacccgccuugcaggguguugccacuguagccagugcuuggcacagacugcaugcucaguaaacuucagguuacuaaaguaagcccuccacagccauuggcuguggguuuccuuaaaucagugccgugcacaggccaguccugugccgagguguagcacuaccugcuucuggagggaaaaaaaaaaugacagaaaauguguugccgggcaguggugucgcacgccuuugaucccagcacuuggcaggcagauuucugaguucgaagccagccuggucuacaaagugaguuccagaacagccagggcuauacagagaaacccugucucgaaaaaaaaaacaaauaaacaaaaacaaacaacagguguuuacacccuuagguuuugagacaaaugacgagccaaaucugggguaaguucauuugaccucaguguccccuuugaacuccagacccaggacccuucacccccuagccauuucccugaaagccacugcagagcggaacuggacucugcucaaggacagcacccaguagagaaggcaaggccuuguccaguuaggaaucauacugugggacacacccaggcgacaggagagccuuaaaugauaacaccagaugacagcacaguggcugagcagaggacugaacagcugugugggggcagggccacccaggggugugggaaucagggagauaagcgcugaggaguugcucuggggacugaugggaggugaugccgccgccacaggguaacaggaauuugggugaggaagucugugucccgugccucggucuauagagaaacacugaguacaaggacucagaagagccucuauaaaacaaagaccagaggcuggagagauggcucagcaguuaagagcacucacugcucuuccagaggucccaaguucaauucccagcaacugcaugguggcucacaaccaucuguacuggaauccgaugcucucuucugaugugucugaccacagcgacaaugagcagcucugggaccacagagccauuuuaugcugccucuuaccagcuccacuaagccugccuccagaaacccaaguuugauuuaagagguaugcuuugacuucucaggguuuuuuuucuuucaaaacaaaauuugugccagguugcucuucacauggaaucuguccugucaggcacaugccuugcccauaaucccaacacuugggaggcuaaggcagaaaaacuugucacaaaguauggacuuggcugaacuacagaacaagggcauuaaaaaaaaaaauuguaauaggguauaacggcaguaacgcccagaaaaagaaaguacaaacgugcuggauagaacaggccaagaacccagcagggaccugucacaccacugaaaggagugcccugaggagccuggggacacguccugguguccaguguugcccuuuuucuugugaaauguuuguaugcggugagaaguaugaacgccagggggcacuguggaccuucaugauaccccaggccucagccaaauucccaaggcuugccagacuccugugagccaggcugcucuugacuuucaagggccucaguggcuaacagccaagcucuuuguccccauuuuagaaaggcccaacugaaacuugucccaggacacuaaccaaucacacuggacccugucuguuacucggacccuuuuccaucuccguuucucgguucacaucuacuccaggcuggauccccuugcucgcuccucacccagcaguaaaggccagcaucagugaggccuccccaagaccuuccuccucuccccagggaagcccacccccugcugagggcgcauuucuccuacaguuccaccagcaccucccuggguaucaacaaggacuaagguucgaucggguaggucauguaaacagacaaacacccacuggggucacugagugcccagagagaggcccugccacaggguucuugcugauaacccugagacccuagaaccuucuuuacaucugcaaugaugauuccauuuccacacaguuguccuaggacccccauacgugcgugggcccuguuacuacacaugcagugccuucuguaguguauacaacaauaauaaguacauaaguaaaugcaaaagcaaacccucuggaacuccucuggauuugaaccuuugacauugagcccuugguuaaggccuuccccucucuaugccucauguucaucuguggcagacaaauguaucuguggucucuaagaucugacccgucuaacgguuguccacaccuagccugagcuguggcuuggucucaugcaccauccaguacuccggggcugcucuuugauccauagagaucuguucuguccccacuggcugaagaagucccaaggagaucagagacaacccagcaacagccuccacuccagcaaacagcaccugagcaugcgcacuuagcccuuguuuaacuucaguagacugcccuagugggaaacaccauacauuguaaaagaaaaaaauaacccaauagacccacuccacugaugggcagauggccuugcaaaggccuuugcaaguccauggcuuccuugcuccccacucuuccuaggcuaacccuguuaacccuaauaagaggaagugacugaaaagauccaccuguccaaggucaccagaaagagcagacucacgaacugucaugucagucucagcuggacagugguguggcacauaccuuuaaucccagcacuugggaggcagaggcagguggauuucugaguucgaggccagccuggucuacagagggaguuccaagauaggcagagcuacacagaaacccugucucaacaaaugaaaaaaauaaauaaaaaauaaaagucacaauccaggucucaaaaaggaggcugguggucccuaaauuauuuuuuuaauuaucuuagggcuagagggguggcucagggguuaagagcacucguugcuuuugcagaggacccagaaucaagcuuucauaugguggcuuacagugacuuccaguuccaggggacccaaagcugccaccugacuuccacaggcgccaggcgcacacaugacacacauucaaucaagcaaaaaaaaaaaaaaaaaaauauauaaaaaaugauuuuaaacuaguuuuaucuuuuuggguuuuuuugagacagggucucacuauguaaacuuuggcuguccuguccuggaacacucucuguagaccaggcuggcuuugaacucauagugauuuaauugccucugucucauaagugccggaacccaaggaguaugcaaucaugccaagccucuugccuuuuaauaacagcgagcagccaggagaaagcagggcauuuaaaggaacagaaacgacuggaagaaagccuccacgaaggagccaugccacgcagaccaaauauggacagcacuuacuguggacccucagucuuguaucuugacccagaagagcccaucuugucaagcugaaguuacagguccuuggccuauaguccugccuugcucugguugucaaagucacccacuggccagucuucugcagucuuguuccuuucuuuccccagggcuuccccagggcccuaucuaaguaccaguugccaaggacaaaccuuucucuuaaagggacacacuggaagccucagggauugcucuagcucaggucugugccucagggcaaguccuuguacaucuggguuucaccacaucuguguuucaauugcuugauuccugaaggauuauauaugguuggacugcaaugggaaaagcgaccuuauggccacaguggcacagacuaauaaucucauugcuucaggagcaggggaagggggaguuuaggucagccaagaguguguagcaagaucccauccagaaagaaaagaaagaaggccagguugguggcacaaguuuguaauugcagcucuuagcagagaaggcauaagauucgggaguacagugggcagugguggugcacaccuuuaaucccagcacuccggaggcagaggcagguggauuucuggugagaggccagccuggucuacagaaugaguucuaggacagccagggcuauacagagaaacccugucucgaaaaacaaaaaaacaaaaaaacaaaaaacaaacaaacaaaaaaaagaaucgggagugcauagggaagcagaggccuuucagagcccucuacugaagucuaaaaaggacaauucacugaaaaucuaaaccagagggauaugcaugcuguuuagagaaggagaccaauucuuugucuuuaggaaguuauguuaaccuugaaacucacaagagaaaaaccacaauuuugaaccaaauuugaagcaagcuuuaauuaaauaaugucuaggaugggcuuuggucaagaccacucucuagaauucccagcuaaguggagacaauguuguaaggaauuuuaagggcaaaaucauauggccuuuguauuuucccaugugacuuuaucuuucaggaauugcaacucccagcauuccaggaaauuauuggguccuuuggcaagugggacucacaguuuaacuuuaggucuuauauucccuccucccuaagguguuguguuucuguuuuugcuuuugagacaggguuucucuguguagcccuggcuguccuggaacucacucuguagaccaggcuggcccucccucccuaggucaaauccuugacugaaggagggguacuuauuuauacugggaucuaauaaccaucaguuucaugguacccagacaugaauuaucauuugguuauuguaucaaugauguaagagccaacaguaauuaggagaagcagaacggccaaaggcucuaugauggcugacgacagaguuacuacccagaaggagccuggaauggauggggcaccagucauuuacuuuaucucaggaccccuuucuauaauaguuuuuuguaugccagauuacaaucccaaauggauuguguuguagaaaauauuuaaucucaaucuguaguuucuacccugccuuuggccauucaguucccagauaaaagacaacaugcgaccuugguauuuauaauaagccucagugagcaccacagcugggcagauauccaucuucuaugcuauuaugucgauuucccugccaauaacuccacaauaugaccggccauguuccaucuggguugcucuuagcuccaacuggccaguuuugguggcuauaauuucaauauucuuacccaugguaucuucuaucucuaccuuccuuucucuccuccuuguguuucuccccagaacccaagccccaaaacccuagacccugccuaucucaauucugcccaguuauaggcugcagguguuaguaucaggaucggcucugaaaccagugacaucacaccuaggcaacagggaccugcacaucuguugccaaggcaacugacaccauauucccagaauccacuuggcucaccucccagagcccucuaaccucucuuccccccacccuuucuccuuagcagccaccucugcccuguucuccuacaguaaaccucacguguuuggccugguauggucugucuggagccaugcuucuaacacaacagcaggcauauuuauuauccaaucagggauaacccuguacaaccuacuacagacuuguacaguaguaauaacuauuuucccuuaaagcuauauacuaccacuucauucuacauaaaccaggccaagugcuguaucagauuguagaaauauuucaauuaaugaaucuaccaguugauauauuggggcccacuuucuugguaugucaguuggcuuuuugacuaugcuagggaguuuccuuuggacuuagcauuucagccugcaggagggagguggggcaagacuuauucuccuuuguaacuacuucccacugaaacuagggcagagcugucaggaccagggaaagcugaaaggcugucaaaggcugagaaggguuucagacaauggggcauucaucagaagaaucugguuagcuaaccaggcugaggaggcaggaagcaaucacauaaacuaggcugauuuaccuagacuuucagcaaaguucagagcucagcaguuuguaguccacaagugauccccaaauggucucagccaaauggaaaucuacugagacaguauagacuagggacagaaguuaaaauguaggaacuuaaaaggaagccuuacauuuggaacuuucaggcccauagucccaguaauugacaaaagggaggagucucaagacaaguggggagaucccacccucagaacuagacaggugggaaacuuggcuacacuuaucuggaguccauuugaccugugacagguagagccaagucuuacgacucccugaagcuuaugugaauuuuuaguuuacgagaagagauaaaaguuucuagauauauuagcauuaucacuugugguaguuucaauacuuauuaauagguguggccuuuuggggaguagguguggccucgcugaggagcugaggaaauaugccacuguugggggggggggguuggacuuugagagagcuuccuccuagcugccugcagacaccagucuucuccuggccaccuucagaucaagguguagaacucuuagcuccucccacaccaugccugccuggaugcugccaugcucccaccuugaugauaauggacugacccucugaaccuguaagccagccccaauuaaauguuguccuuuauaaaaguuucuuuggucgugaugucuuuccacagcaauggaaacccuaacuaaaacaucacuagauugaaauccacauuguaacagcaguucugcccagugguuagugucacuaaguuugaggacacuauuaagcauaucugagcuaaguaacacuagcuugggguuuuuguuguuguuacuugcuuuagacuauaccuugaaaucauauacaugagguuucucucuagcccuggauguccuggaacucacucuauagaccaggcuggccucgaacucagaaauucaccugccucugccucccaagugcugggauuaaaggcaugugucaucaccaugccuggcaguucugaauauauuaaagcuuaaucaucuuuagcaguuuaauaaaaaucuuuucaugaaaggcaggcguugugaugcaugccuuuaaacccaguacucaggaggcagaggcaggcagauuucugaguuugaggccagccuggucuacagagugaguuccaggacagccaaggcuacacagagaaacccugucucgaaaaaaacaaaaaaaaaauuauuuauuuuauguauaugagcacagaagaggguaucagauucccaauacagaugguuguuagucaccaugugguugcugggaauugaacucaggacuugggagcagaggcagacagauuuugaaagaaagaaaacuaaauucaagacuucaaagcccuagccagaaaguuuauucaagguccaugauucaugcggcuugcuaguuaggagggcuuuuugggcuuagagcaaagaacaaaggcuauaaagucaucccaggaaccaacuagccauaaagauagggaagacauacaagaauguccagacuggcccggugccucccuaucucucacccuucugaccuaaguuaaauguuaaccagaugcucugcuguuaccucgaucugcauguacagucugcugauguuuacaugaacaaaucaugugaaacugcuccaauuccucccccagccccagacccuuuucuaaaaacccuagcuuucaagccucgugaucgaauccacugucuccugcgugagauauguuuccacccagagcuccgccauuauacuaccucuuguauuuacaucaagacaacggucuuuuugugauucuuugugugcacgccgaaucgggaauugaguggggguuuccccacuagguucuuucaauuucugaguucaaggccagccuggucuacagagugaauuccaggacagccagugcuauacacagaaacccuaucuugaaaaagccaaaaaaccaaaccaaccaaaacaaacaaacaaaacccagcucuugucacagguuuacuuuugggcuggagagaugacucagcgauuaagagcacugacugcucuuccaaagguccugaguucaaauccuagcaaccacaugguggcucacaaccaccuguaaugagaucugaugcccaccacuagugucugaagacaucuacaguguacuuauuauaauauauaaugggccagagcaagcagggccgacuggagcaaagcaggguugacuagagcaagcagaaguccuaaauucccaacaaccagaugaaggcucauagccaucuguacagcuacaguguacuuguauacauaaauaaaucucuaaaaaaaaugaaaugcuccuaggguucauuagcucugucgugcagguuaggcguuagaacacugcugaagaaggugaauguggagugccucuuugauaugcugaguguauuuauuuauuggccccuggugucacuagagcagucuugggcaaaucagaagaaaaaaaaguugugacucuggcugaacuccccaggaguaaccagugaaccugugggccaagggauauuguccugagcagcgguccauaaaccucaucagguccuuaccacuccccaggaaaguacuccauaaccagaauccagaaagcagacaaaguggcagagaaaggaaaaaaaaaaggauucaaugacucaccaaaaagcaggccuccagaauuugaguguggaauggucuuucugaucucacuggggccuccaaauauuaaucuugagauuagaaaauaaaaaauuuugagccaaauuugaaacaagcuuuaauuaaauacugaccaggauggaguguccaugugguuuuguccuuaaaagccccuacaacccaugcuuuguugccacucagcugaaaauuccagagagugauccucacacucuacuuucccauguggcccuauuuuuucaaaaacuacaacucccagcauuccaggaauucuuuggguaggccggccuuacagguuaacuuuggaucuuacaguuauccauuucuaguucaaggaaggcaaaacucaucucccagcucuguuaucaggaccuaauuguuucaaccuguuuccuagguuggaaaaacagaaagaauaaucuccaugucacaaaaagcaaaauaaauuuaaaaagcaaacaaaacaaaacaaagcuagagagaugguucaaugguuaagaguacuaacugugggcuggagagauggcucagcgguuaggagcacugacugcucucccagagguccugaguucaauucccagcaaccacaugguggcucacagccaucuguagugagaucugacacccucuucuggagugucugaagacagcuacagugugcuuacauauaauaaauaaaucuuuaaaaaaaaaaaaaaaaagaguacuaacugcccuuccagagguccagaguucaauucccagcaaccacaugguggcucaaaaccaucugugaugggauccuaugcccucuucuggugugucuacaguguacucauauaaaauaaaucuuacuaaaaaaaaaaaaaaaaaaaaaaaaagagcauggcuggauagauggcucaaugcaagagcauacagcucucuuguagaagacccaaguucuauuuucaacucggcugcagaggaucugaggccucugccccucuccccacccccaucugcacucacauauacccacacacagacacaaguauauacauaacuuauaguaaaccaaacaaaaauaauuuaagauaauuuaagaaugcacucagagggaggcuuaagaaccauuuuauuauaguuuaaaagaaacauagcggggcaggcaaucugaaaauccaggccgauuccagaagaaauacggagaaagccacgccuucuuggguuacauaugaaguuuaguaauggaggcucccaagcagccccauggcagaagcagaagagggggauacaaauaaagcaagagagcccaguacaucaaugguggggggagggagcccagacauuggcaaguauucaaaagauggggaaaagaaacagaugcguuuuggaacuuagaacuccaggaaguaagcagaccacaaggugaaggccccacaggugacuagagcccacagaguuucggccaaggaaaauacauucucucauuaaggagauaauuguuccucccaucucuuuagcauauuuaggucaaucaguguuacugaggugugggcccuuggccaaaaaaauugacaggccuagcuggaguaacacucuuuucuucuuucaaucccuuggguagauucucuggggagugagcaggguagcgcugcuuaagccccacucagucguccuccagcagguugaucuugguggggucaaaauaguuggacuccaugauggggaggccacuggccucucgguguuucaccagcaucgcagcuucccggcgggcccacucgaucaucuuauaguuuggcacauaagccacaaagguagugccaaggaccagggcgauggaaaaaccaaagaagaagacggcgugcauauucaaggcauccaccuucgggucgucgucguaaccauggaaguguggguucuucaaguacacguuuucguccucgggaucuggguccuccauccacugcacggucgguucuuccugcuccuuucgggccgcagcggaccgggcgaccacagcccuggaggagcuggauuuccagcaaaguggggcagccuggagccgucgaauugcggaaaggcugcgagcgcacaaacuuaaccgccaggccgccaugacagcugcaguaguggggguuggauaggcgggggccggaggagaagauaacggauggccugacgcaacuuccguuucugggggcggggcauguauuucggugguguguggagaauagcuucccuuaacugauaucuacagagcacugacauccuccgagauuaugggagcauuagaugacacaccuaaugcugacagucaaccagcagagauguaagagauggaagucggguccucuggaagagcuauaauaagagugcuuaaccucugagccaucucuccagcaccuacaauguuuauuuuauaaaucaagcacaguaauaauuaguaauaacucauaacgauuguaacaacgcuuccuugaaaauucuuggaauguggaauccucucggauucucacuguaccacauaaugcuacacgugaugccgcgggaugaugcaggucugaagaggagcuggacugaggaaaaugugggcacugggacauggggcaccaccaucuuccuccuuggacacagggacugugauacuauagagucccuaaauaaauaaaucuuuuauuuaaaaaaggugggggggggggaggcuggagagauggcucagcgguuaagagcacugacucugacugcuauuccagagguccugaguucaauucccaacaaacacaugguggcucacaaccaucuguaaugagaucugaugcccucuucuggggugucugaagacagcuauaggguacuaacauauauaaaauaaauaaauauuugggccagagcaaguagggccgaaggggguggggagaggaaacggagcaagaagaaggggggaaaaaacccaaggggggaaaaagagauuuauuuauuuaauauauacaggugcucuguuuuuaugcauaccagacuagggaaucagauucuauuacagaugguugcaagccaccauguggcuguugggaauugaacucaggaccucuggaagagcagucagugcucuuaaccacugagcccucucuccagucccaucauagacucuuaaaaugucucuaauaacaaacauuugggacauagaacccccuauuguccccaacaugagcuggauggggaagaauacaagagauuuagugagacucuuccgaauggaagaguucaaaagcuacaaauuacucaugucuggaauuuucccauguaaaguuucuggaccaugauuaucuacuguaauugaaaccacagaaaaaccagugacuucgggaugagcagcguucauuccuacauuucgacuauaaagagcuggugcgaggccugaaugugaaggagccuugaggugauugagugauuacucacagaaagauggugugugauugugcuuugucaagucacagaagcagaagacagaaugaugugugcugggguuacuguccugggguacagagcuccauuuacuaggugaagugaccuggggagggguuucgguaguggcugcacacugggaaugacuugcagccccaagcuguaagagaggaugaccugggaguggcucacuggagcucguugccugagcauaggccuagggauccccaacaccaggagaaaucaaauguaaugcuggugaauauuagugaugcugaccaaaauaaaacaaaaacgaugcucagacaaacucaucaaucugucugguauggcaaggaguguggccagggcugagaagcaaccucagcuuggggaguucuggccuguacaguccaggacauggugcuugaguccugucaggcugugagaccuugacugagaaccugggacaugcugacagcagugucuccuuacagcuggggcugagggccauguggcaucacugacaccagcaacagggauuuaggcaaguggucccugguuaccugagugugacuuggaguguguggagaccugucagucaugugggugcuccaucucucuggcacccaccaagucccuugucaaugaggcuacuugagcuucucugugaggaauguccucaaccugagucacacuugguagauggaaguccugaccagugcuaucuucugucacccaaacaggagaagugcugacucuuagcagaaaucuaauuacaucugucccugagacccauggaguccugacaucuaccuacaguuugucgucacaaacuuagucaccauugauagcccuuuauggaugauauaggggucaucucuugcuuguugcaggauauuugaucacauggugaacccugagauuauauuauuuauugaaaaaaaaaguuucuaguuauuguguggcucagcccuuaguacauaccuuuaauccaaaacaaugaaguuaguuuguagaaggaagcaccccauaauugaaagugaugucuaauuggguugcaggccaagugaugaaucagagaaagauuugacagaauaggauacgcccaacugucaacgagaagagagaggaaggggaagcuacuuaagacagcaucacagagccgggcaugguggugcacgccuuuaaucccagcacuccggaggcagaggcaggcggauuucugaguucgaggccagccuggucuauuaagugagauacagaacagccaaggcuauacagagaaauccugucucgaaaaacaaaacaaaacaaaacaaagacacaaaaaaagaaaaaaaaaaaagaguaucacagacagaaaaaggagaggagacaguuuuacugagaggguuuuacagagacagguugaagagagaacaagcuagauacagguaaaggcagaacgaaaaggagccagaagaauaaaacagauaaguccgaggccaaucagagcaaaaaguuggaagcagggagaggccagauugaaucagucagcuuggagaggacuuugagccagaauaccagaguugagccagcaggagaucagaaggaacagagaaggaugagcuuaaucagcaggcugaaaacauuguaggcuuagauaagguugugugcagauggggcuggggagacggcucagcggguaagagcacugauugcucuuccauagguccugaguucaaaucccagcaaccacauguugguucacaaccaccuguaaugagaucugaugcccucuucuggugcgucugaagucagcuacaguguacuuauguauaauaaauaaaucuuaaaaaaaaaaaaaaaagauuguguggagacuagaagcuuccaggacuaggccuagauuagcagauggaggcaguaagccuuugaaacaacaauuacuacaggagaauaaaaacuacuuuuaggcugauggccuuuuagaugucucagcaguuaaaagcacuaacugcucuuccagaggucaugaguucaauucccagcaaccacaugguggcucacaaucuucuguaaugggaucugauguccucuuccagugugucugaagacagccacaguguacucauauaaauaaauaauaaaaauuacuuuuacagucacuccuaaaggccaacacaacucuccccucucuucucuucaguucaugguacaaguuaucauuuuguaguccagguugaccuagcuggguaggggcaggguagccuuacucuugcaauccucuuuuuucagucucccaagugcugaaacuguagcccugugccagcacauccuuuaaucgcagaagucaaguugucuccuggggagagaugaggcaggggaaaaggaaggcuuccugaguccagcauggcuugguggggacagguggagagugucauggcucuccuggccauaaagaauauuuaaacaauaauguacaaauuuuauauuucuccuuuaaggacuguccuccuguuaauguuaaugacuccacaaguaaucagaccacacaagucgaggaggcaaacgugugacaaaauaguaaaugcugguaccuucaggacagcccuuaagacuguggaaaaggggggcuggagagauggcucagugguugggaacucugaguacucuucugaagguccugaguucaaaucccagcaaccacaugguggcuuacaaccauccguaaugagaucugaugcccucuucuggagugccugaagacagcuaguguacuuacauauaauaaguaaauaaaaagauaaaaaaacauuaaaaaaaaaagacuguggaaaagaccucuaaaaacaugagcuuaaaaauauauaauuucccaacuaugcaaaaacuaaggaugcaccuggcagugguggcgcacaccuuuaaucccagcacucgggaggcagagacaggugguuuucugaguucgaggccagccuggucuacaaagugaguuucaggacagccagggcuacacaaagagacccugucuugaaaaaccaaaaaccaaacaaccaaacaacccccccccugaaaaccuaaagaugcaauaugaauuguauaggugcuucaugaagcuaaaggaacagaggcagucccacuccgagccagcuucucaaaaagauacaaaggcagggagauuccuaaauccaaggucagccaaaacacagccagucuaggcaguucucuaaauucuuuuacaaaguuaaaagaaaaauguguacuugcuauuuccuaaaaauuaaggggcugcacaggauggugauucauaggauaccaggauuaauauguaaaguaaaaaacugggcuuugguguaaccuucccccacucagcucagguuucacuguuagcaagaagagagcauugggguggagcuugccgcccuaucguucugccacucucauugcuagagccugccaccuuccuguuccggagccaaacacguggucaccugcaacuggacucccaggaugauuuggcgggaaugggucccuuccccugcuucauaacccagugucgggaauaguaaaaucgaaccuugaucagaccguugucuugguuccaucucuaucgagccaccugccuagcccccucuucucuuucagauuccaagaugccuuuccaaacuagaacccagacaugugagccgcuggccacaacagaucuggcgacccaacucgggacugagaaacagcagaggacauuuggaagaaacacugcugguuuggugugaaaagccacauaugccauuacaagguaggguuggcuacugcuggccaccacccauaaguuuggguaaacaaccaaugucugcauguguaguagaguuuuuugcugagucacugccuggcccagguauguaaaugagguacugaaagcauaaccaaucggguguacacacgccucuccuaggucuauauaagcagugccaguucuggggcucggggucuuuucaccucugcaaucaagcucucucaauaaacgugugcagaaggauccuguuguggcgucuuucuugcuggcgagucaggugcucacaguuuggagcuccauggaaaaagaaaauaauuaaaggaaauucauccagagaaggucgguaugggcuaaguugaaacagcguuaaaccugcgugcuaauucacuuagguucagcaguaagguuuaucagggacuaggaacauaacaggcaguuagcuguagcucccagaagcuacauuuuuaggcaugagaaaagaaaggguuuauuaaaaggaaauuaauaaucaggcagauggcugcaguuaaaaacugcaucaugcgggaggaaaaugucccaaaaggcggagaaaaauuucaggggugccaugcuuuguucuuucugggcuuuacagcagaagugcucugcccuuuuugugucuuugucuaaagucuggugcaccaccaauccguucacguguucaauucauguauguucauguccagucuguaugaaugaaugcucuauguuuuauguuggauaauaaagaugacaaaaaaaaucaaaaacuuuaucugguacuucaucaaagccgagagcugcuacacgcuucaacuaggaaacaggcacacagcagaggcccccugcuggaaaaacugaucguuauaagaaaaaaggagcaucuacagccucuuaguuucgggguaaaaaagcugauaaaugguuuuuuccuggaggggucucuacaaucaugauuaauguguuuggcaaaugauaaacugcuuuuuauucuaugauuguagcuagaaaaauuaauauucucugauuggucuaaauguaacugcuucauuugguuuuuuuauugguaauaugcucugcauguuuucacaaucagcucauaaguuauuaguuaaaaguaauaauuguuacauugguaacagaugguuagccuuaaaauugauaacucaaguuuaaaguccuuccaacacguggcauaaggcaagccaagaggcugggucuauaaggauauuucuaguugagauaauaauuaaugugguccuauccuagaaaguaaaauuaaagauaagauuuaaaacaaugucucuuuaauaaaacauuaaagcuuacauguauucauagguauuaauuggcagccaaacuucauaauaugauaguaaugcuucuaauauuaauucuauaaguaauaauuguuuuaaaauuggguuuuacuuucccaaaguuaauguugcaaagaaacuuacuaauucuuuacagauguagccagaugcuguuuuaaugaaguucaaauucauaguuuauaaaaagucaaucagacuguaaaauuuaucaaggcauuacaaucuaguuuaccuaccuuuuauauaguuaucauagauccgaaaguuuguuucuuuuucucucuccuuugcaucuugaugauuguaaagguuuugcuucuagugaguuuguaauaacuagaauauuuugccucuaauauggcuaaauauugaucuacauuauguacaagaagccaagcguuuuaaucuuucgguguauauuguuuccuaaguggaaaauauuuuauuagcuaaugcuucucaagggaaguuuacuuuaaauccuugcucucaccuaaaagauucagagacaauaucuuuuuauuacuuaggguuuuaguuuacuacagaagguuuugcagaaaauaaagaaagcuuuuacaauuguuauuaauuauaaucauugguaauuaaauauuagcugugcccaaaacaauucuuuggcaagaaaaaacauuauuguaaagucauuuuucucauccucccagccgaucauuggcccacauggacccagcuagcugcuggcugcuguggggcggggccuugagacacacaguuucccugagcuauagugguacaagaagccaccaaaaggcgggcagcuuuacagcaaacucaggagagggccgcguucaccuuugccccaugagccuccacaugucccgaccagaguagccauauuguucucacuaagacccggaguagguuuucuggccuacaauaaauugggcugccuucagccucuucuaccugagagaaaagccgaggguagacggccaagguugagguggcuuucaccucaaaacacaguuucaauguccuauuagaaccacugugguauuaauaaagaauuguaaaauauauucguauauuuuuagaaaaccuauaacaaaaauugugucuuaaaaaccugacuaaguguauguuccuuguucaauacagcaauuuauuugguuauuaccaaauauugauaauugaccuauuacauaccaucauuuuauuuauuuuuuauuuuuuauuuuuagcuuacacaaagcaauuuauuaacagaaaauaaugagaaguccuguucacagacggcgaccacgacgaccccccuuucuucgagugcuaucagagggaaugggggugacauccucaauccgcccaaucuucaucccagagcaagcaagagcucugagggcugacugggcuccagguccaggggucuugguccuguuuccuccuguggcccggaguuugaugugcacggcggugaugcccagcuccuugcaccucugggccacauccugggcagccaacauggcugcauacagagaggacucaucucugucagccuuuaccuucauucugccagucacucggcagaugguuuucuugccagaaagaucgguaacauggacaaaggugucauugaaggaugcaaagauguggcagacaccaaacacauucucucccucagccaccugaggucccaggcugaugaccugcucuuccuucuuuuccuuccccuugcgaggcgccauuucugauugucgucucccauagcaccauuuuaaauagauugacaauaucccaaagaugaguuaaaaauuguuuuuaugcaugcuuuuauaucuucuauaauuucaugcacgcauacaucccgauuauuguguuuaauaacaaccccuauaugagacauuaguacaugugaauuagaucacaugcuuauucucuuaaauuucccccuguuucaacacaaauaaucuaguugugugcuguagaugguguuuuaauaugcuaaacaaucaaaccuuaauuuguauacuaauagucaauguuauaucucaaagcucacaauugcuuaagauuguucguccuuccgaugcuauuaauucucaaauuugcaauugcuuauguguauacaacucauagaaaaaaugcuguccucuuaagaaggcagucuuuagacauuuauuaaauuguucuaaauugccuggacaucuuaaaacaaugccaggcuagguuuauaucucaggcagucuauaggucguacauauaagauagaauggauauauaaccucauucuuuguauauucauaacaguuauaguuuaagauaauauuuuaguauucuugaaaauugugcauguauaauucuuuccuuuuaguguccccaguuacuacuuguuuccacauaauaguguuaauucuugaggacuuuuacuuaauaauuugcuacaaauaaaugcucuuauuucuaguuaauaaauaaauaaauuauacacaugugacuauuaauaacuuuucaagcuuucuaguuacaacugcuccuuaagagaaacgauugaaagugcaauuacucauugccccuuuacagucaaguauuucaaauguuuugucaacuaguuauuaauucuaaggauuagauauuguaaaacucuaauacuuuaacuucuuaaagauaaagaagggggaaauuauauccucaugcauacuaauuagugcauucccgugcacacuauuuaaaucauacuuuuauuuucaaauuuugaaaauuagaugucaaagaauuuaauaaaugcuuuauaguaucuuaaaaggaucuacuuauuggcuuauagauugauccuaaacagcuaccuuauuaggaaagggaaaaacagguucucuccacagaaugcugcagaagcaugaugguuaaaucguguuacaagcuggcaggugaguugacucagugcccugauuaaagugacuaggaaacuaaauugguuacauguuuuagauccauccuugcucgccaauuuuuccaguuuggacuagcuucaagccuuuuaacuuuauggcaaaagaacaucagagacuguauauucugacuuaauaauauuagucauuuaauagagucauaacgauuuuucucuuuucuucaaugugaccaguuauucuaacucaaucuuagacuggucuaauauuuaguccaauguuagagauuccuauuguagaaaacuaagauucuuaauuaccuagcaaaguuaauucugagcacagcccccacuuccagagaauuucuggccuuuuuacuaauucuaaaaaccagcucccccacaaggagacugagcuugagccuugcuaauuugcaacugaauaaaguaucuggacuuccucaaaagaagcuuugcauuguuacuuucucauugucuggaucuuguuuucaagcaggucaaucaacaccuucaggcugacugccacaugcuugcaucccgcucccaagacugugcagguggcagcuacuauuuuccagcacauauuguggcuuucggucugauuugagauuuagguuugcuacuagggcuagaaaggcggaaauuucaaauauuagaagaaacugguuuuuauucuuauagacgggcuuagucccuuagcuggucucugguuuuccacccuugcuauuauugcaagguccccuguggaaauaacagaaaugaggacggugaccuccagcuccuaauauaaccuagagccacagauugugguguuacuagugacauaauuuuuguugaggccuugcugaaucugagguugacaguucuccuuuaggagcugcacaguacucagaacugugcauacugauuuguaaucauacgaauacaguaugggcaucagcuugggugcagaaauuuacugcaggggaagguccagcuugaccauuucugaguucccugugagauacauccgguuuggauggagguugguaucuauuuccaguuacaaccaagaauaucuuucuaaggcucugccuccccaacccaaaagauaccaagagccaugauugugggucgugacagcacccacgggaggaaucgggucaauauccccccagccaugguuaauacccacucauccuuggaugagaaaaucauucaaucaccucaguuaagcguggccuuauuaagcuuaauucauagggggaagagagguuagagacaguacuguuagaagggcaagcccuucacagccucccacccuaacaagcuaauuggccuuguacuauggagccggucaucacccccuccucccuguucccugccugucauccaaggcugcggaggaaaauccacguacucuccuucaguguuaucauaauaaaaugccuuucauauucgaacagucaguccucuccagugucccaacgcccuagaaagaccuuucagcugacuacuugguauucaauaaaaauuucaacaaggaaguuaccuauucaguacuaauuagcauuauaaaagauggagccaacagcucagggcuagucugcuagauguuuacuaggacagaaaggauagucuuauccagauagguuuaccauagaaaaguuaggaaauccuacugagacggguuucuucauuaggcucuaagaauucaggcagaacuauagggcaugaauaaauuuuaugccucggcccagccuuuucuuuuuuauauuaaccacagggaggagauguaaccuucccccacucagcucagguuucacuguuaguaagaagagagcauugggguggagcuugccacccuaucauucugccacacccacugcuggagccggccgccuuacuguucagaagccaaacacauggucaccugcaacuggacucccaggaugauuuggcgggaacaggucccuuccccugcuucauaacccagugucgggaauaguaaaaucaaucgaaccuugaucagaccauugucuugguuccaucucuaucaugccgccuagcccggucuucucuuccagauuccaagaugccuuuccagacuagaacccagacgugugagccgcuggcuggcugcaacucuuuaggucuguaggagaugagcuagcagaacaugauagccguucuuuagaauuuuucucuagugagagcugagcuguuuggagaucucuggagaacaaaaacagcucuucaaggaucuuuuucuaacauggcuucugacuugguuggaagauccaagaauuuuuauagcagcuuuucugacuuuggucagaaaaauccaugagcuuuucagauaguuuuuaugauuuuuaguagcagagagagcagucucaaccaguuuuuagaauagcaagaaaacgcugucuagagcagagcagaacacacacacacacacacacacacagagagagagagagagagagagagcaaucuggaaagccaucucagcagagcaaagccaucucagcuugggcccacgauuugacuucuagguuuuuuuuuuuuugccacucccagacaccccuuccucagaggacacagcagagacagggaugggguugaagcaggaaacagcagcagccacaagacugguuuauuguguguggcucagcacaauaauguaguguccuugcuugagcagcacagcacagagcugguagagggagggggcaaccagaaaaggaaagacaccacaguugcugggcuggggcuguccaucaggcacugagaagcuaaagcgcugcaggaggcaggugaagaagaggaagagcuucaugcaggccaggggcucccccaggcaugaucuguggccuguguguggaagagggcucaguuaaucugggaccucauuggugcuccacccuguaaggcacccuugggagagacaggcagccaggcaucccccccccccccaggcaccugcugaguguugcuguaggccagcccggccuacaugaaucagguacuccuggaaagcagguuggggcugaaagagagacuagacggcaggagaaauaaugaggccaaggcaaauuuucucugaucaaggccugugaauuuacuaagagacugugcuuauaagggggaaggcccaauccuucccuccccucccccccauaccucccccacacacacaccaguccauucuuggugcuuggagccagccaguaggcgacgugcaggauaggaugugucucuggaaugucucauggguaucucaacagguagcagagucuuggagaagaacagcgguaguugacauaacaauauagccgucuaagacagaaggcuacaccucaggugaucucauauucaguggcagcaaagucugaaucagccugcuucaaggcugagggaggcuacagcugagaauggcaugaaggccucaggcuucacaaaguggcccugggcauccaggaagaguucaggauggaagcggaggggcuucucccagacagucuccucugugugugugugugugugugugugugugugugugugugugugugagagagagagagagagagagagagagagagagagagagagagagagauuuggcccuuugugacuagagugucccaucuagcagcaaaguacucauagcaccuaagagaucacccugcugugaccuuaccagagccagaaaacugccacugggccccauagcaucccaccuacaagaggagugucaaauuccucagcagugagaccugaggccauacauguccacagcaccccucuccacuuggucucuuggcugacaagcuccacuagacccugaucucucccccacaccgcgacucuucauucacugagggucacagggacuuggggccgcugugacuucugcucuauccaacuaagcccaaacgugcugucacaucuugaccccacacccuggccacugcgcucccaugucuuugccuuugaaaaguugagcauccgcaggccugcaguguccucucuccaucaggccugcaguguccucucuccaugugccacuaggagcgccaugccucugucccucuccacugucauucccccucaccuuguacaagcuguauggcauauucuggaaguccagcagcagcagguagcagguagcccagcacuggcaccguugcauuauguccacuaagagcaggaaaauggccgcaaauauggccacagacaauagcuagucagcagccccauggcugccuuacugcuucucugauuuuuguggggggaaaagccucaggacccucacacucaagccagcugagaucaggaaagacacuguuugcacacacagccugggcacuuggguucuuacaaaggaggcaagcuugccccguguccgcugccuugggcuaaguuguguuuacuccucaguuagagagaggcuguagaagagccagaacaagcaagauaggucagcgucagagguccuuuccuucccaggugcuuauucaguguguugguggggaggggcgggcaggaccugggaauugaguuccaccggagcugugcacacggugcuccuguugggugagcauggugggcagaugaccacgaacugcuccaaggcacgugaucacaagguguagaaaagucagucaacagauuaugcaaugcagggagaagucuggggggggggggggcgugaggacauucccuccgacagagaagagaugagagaaaguggcugauuggcaagacauaaagggcugacugguacagcaggucacaucguguggcuguccccaaggaguacacuuaaagagcuggugggagugagaggcaguggggcgggggggggggggggagggggcagcugcagccccuggagucuuucuugugcuguguucugagguugcugaguugauccggaaggccugacucagaaccuggaaacuucuuuagucagaucugagaaagcugagaaacugucaacagcggcugagaguccuugagguuggaucacuuuuuucuuuauuuuuuucugggcuugaucuuuugagacacagaggguuucucuguguagcccuggcuguuguggaacuugcucuguagaccaggcuggacucaaacucacagagauccaccugccucugccucccgagugcugggaucaaaggugagcaucguuggcuguuugauucuagauagaacuggacaacauuucauuccauaaaacagagcuaaguuuucccugagccaagcaggaaguugagauuugguuugguuuuagguuuuuggugguuuggguuuucuguuuguuuguuuguuuaagacaggaucuugcuuuguauccuggguuguccugggauacaaauucaauacuguagucugucagaacaccaaggaaagccagacaggggcucuuacaaccgcagguuuuguuucuuuuuucuuuuuuuuuuuuuaagauuuauuuauguauauggguacacuguaguuguacagaugguugugagccuucaugcgguugaugugguuguugggaauugaauuuaggacuucugcacccuccugucaacccugcccgcuccaguccaaagauuuauuuauuauuauauauaaguacacuguugcugccuucagaugcaccagaagagggcaucagaucccauaacacaagguugugagccaccaugugguuguugggauuugaacucaagaccuucagaagagcagucagugugcuuaaccacugagccaucucaccaacccucccccgccacuccccacagcccccuccuuucuucccucccacagguuuuguuugcuguugaucccauccaguccaguccuguucccaacucuguaucccagcggacacaggguuucucuguguaacaacaacccccugaccuuaguuucuccaaaacacagagucauucuuggagcuggcuccucccagguggagcagauaggagugagcucacuuuagcuguuauucuuaggcuucuauggaaaaacguuuuugccaagugugauugguccugguugcucugaguaaugucagcuauugcaggagacuuuagucagcuucauuuaucagucccauccucccaggucccaccaccuuuacaggauuagucacacccgccugacccaagccagcucagucagucaacagggucccaagggagggagugaggauuaaagaaagaaacaauuagaaacauuauaacaugacuccagucagcacuguggcugacccagguuuauuuuuguuccagucagcuuuuauaccauucuagguacuugcagagaauagggucaguucuuuuugguuuuuguuuguuuguuuguuuguuuguuuguuucgguuuuucaagacaggguuucucuguauagcccuggcggcuguccuggaacucacuuuguagaccgggcuggccucaaacucagaaauccaccugccucugccucccgagugcugggauuaaagacgugggccaccaagccuggcagggucaguucuuaaaucaaagacaaaguaaucaaaaagguaauaaaaagaucaaacaaggcaauaaauaaagcucgaggucaagauuucugggggcuuaucagaauaaccaagauaaaaggaaagucccacuuucauuaguuuaccuugagcugaguuuaccuugagcuuuguauuagcucuaaugcaaauauucuuaucugugccuacuaaccuuuccuaguccaaugucaaauucuugccaaauuucuagaaucuggcagcaaaagcucuucacacugaccuucaggcaaucugcuuucuucagcuucccccugcaaucacagguacaugguacaugccaccuugccuucuacaagguucuuauugcauggcaugccuggauguccuugaauccacuauguagcuuaagauggcucugagcucuagaaccuucuuggggauuauagacaugaccaccccccaucacuggcuagaaguuugguuuuuuuuuuuuuuuuuuuuuuuuuugguuuuguuuuuuuguuuuuucgagacaggguuucuuuauauagcccuggcuguccuggaacucacucuguagaccaggccggccuugaacucagaaaucugccugccucugccgagugagugcugggauuaaaagugugugccaccaugcccugcugaaguuuguuuuuuuuuuuuuuuuuuuuuuuuaaagauuuauuuauuuauuauauguaaguacauuguagcugucuucagacacuccagaagagggagaucucauuacggaugguugugagccaccaugugguugcugggauuugaacucuggaccuucggaagagcagucgggugcucuuacccacugagccaucucaccagcccaaguuuguuuuuuauagagagaaaagaucuaaggaaaguugaaacaaaaacagaaaguuaagucccuccugucuaaauuauuuccuuucuuuucuagucacuguucuauuggagucuggggaguuguagucuccuuugggccuaauaacaaccaucccucauacaaccgccuacacauuacaaauucaaaacagguaagaaaugucccucgagggacaggcuuugguaucucaaauaagauaaccacugauauucucuuaauugguacuacauuacaugauaaggaaaucaagcaaaggaacacaaguaucuguacacacacaugggaaggagucacuauuuguuugugguugguugguuuucagagaccugauuucucugccuagccuugguucuccuggaacucauucuguagaccaggcuucgaacucaaacucaagagaucugucugccucugccucucaagugcuggcauuaaaggugugaaggcauguaccaccacugccuggcuuccuuuuuucuuuucuuuucuuuucuuuucuuuucuuuucuuuucuuuucuuuucuuuucuuuucuuuucucuuguuuucuguguguguguauguguguugcuguguggcuguaugaggcucuguacucccaccccaugcuuggaagauacugugaagcagacaagauuauccaauccccuagaacugggguuacagagagcugugugcugccauguggguucugggauuugaaccuggguccucuggaagagcauccagugcucucuuaaccacugagcaaucucuccagccccucuucucuuuuucuuaccccuuaugcucaagaccaggucaaaaacacuuaaugugcauuguccacugagauggaaaagggugccaguggcaaaucuauuaaccugaguucaagucucugcaugguggagagagaaaagcggcucuuuaaaauugcccucuaaccccccccacauacacacacacacaugagguguuucaugcacaugcccacacagaaacacauaaauaaguaaaaauguaauuaagaaugacagaaagaaccugggugugguggugcacgccuuugaucucagcacucaggaggcagaggcaggcggauuucugauuucaaggccagccuggucuacaaagugaguuccaggacagccaggacuauacagagaaacccuguuucaaaaaaacaaaaacaaacaaacaaaaaaaauuuaaaaagucaaugccagacagugguggcacaugccuguaaucccagcacuugggaggcagaggcaggcagauuuuugaguucaaggccagccuggucuaaaaagugaguucuaggacagccagggcuauacagagaaacucugucucugucucaaaaaaaaaaaaaaaaaaaaaaaagaaagaaugacagaaagggggcagcuacaguguacuuacauauaaucaauaaauaaaucuuuuuaaaaaugacaaaaagauauagaaaggggcuggagagauggcucagcgguuaagagcacugcugcucuuccgaagguccugaguucaaaucccagcaaccacaugguggcucacaaccaucugaugaccauuucugguaugucugaagacagcuacaguguacucauauaaguaaauaaaccuuuuuuaaaaaagguacuucugaacaucucugaacaccaugauucucucucacuugcuuauucugucugucugucugucuuuauuucucucucccucucauguucccacuccauuuccccaauaaaccuugcccuagaucuguuccuggcaugaugucuuuuuuuuuuuuuuuuugguuuugguuuuuuagagacaggguuucucuguguaguccuggcuguccuggaacucacuuuguagaccaggcuggccucgaaaucagaaauccgccugccucugccuccugagugcugauauuaaaggcgugcuccacuuauuacucuuacugaggaccugaguucaauucucagcacccauacugggcagcuuacaacugcuuguaccuccagaacuaggaaucugaagcuuucuucuggccuccugcagaggaucagggauuugacacccagcaccuacaaggaagcucacaacuguggguaauuccagguccagaggaucugacacucacuuccauccugacuuaggugggcuccugcauguacuuagugcacaucaccccaggcacacacgacaaaauaacacaacaaaaaagacucgcauaaaagcuuacaaguuagagauuuauggcauauuggcccuuaguagguuacuuuugauuggaaaaaaaaaaaaagcaacaaacauuucucacaguagguaaaagccaucaugggauauuuuucucuuuucuuccuucucucucucccccucccuuuuuuuguuguuuguuuuguuuuaaaaaauagggucuuauccaaggcugucaaggcuacaaagggaaacucuuguuuugaaaaaacaaaacaaaacagaguauguagcccuggcuggcccggaacuuguuuuguagauaagggccucugccucagaagggcuggaucacaggugagccagcacgccggguucucccugagacuucaagcucaagaugacaaggcaauaccuucguccuacuaaccuugggaaucacaagcagaaggcucugagucccgcccuugccccccaacccccccccccccccaccguagggagcgcccugagaucaaccucaacccgcuggcccgacacugucuuccgguucaaccccuuuucccgccgguuccuaucuccgucggguacgaggacucugaccccgccuacugccacgccccucaauccuaggugccuguacucuucuuucggcgccgcaggccccgcccccucgcgggagggccgauggccacugcuccuccccgugcugcgcagcuggccccgccccggccccgcccggccucugucgcacgcgacccuggcgguggcugcagcgacagcgcuuggcgcgcggagcuacagccauggcagucgccgucgagggcgcccgcaggaaagagcgcauccucugccuguuugacguggacgggacccucacgccagcucgccagguaagggccucgagguuccaaagcucccgcccagagucacgccggcauccgugacccagcgugaagccgucacugccaugucaacgcagacaccugcgcgacccugucggaaacguggagugcagugguaccggcuccugucaccgaggagaugggacccaggcccucucggccuuccaggccucagcgcuccccgcgcggguuggcauccacguuccugccgggagcgcagaugcuguauccagccuccgggaggagcgucuaugggcgauagggcggguauccccaguuccaggcuugcacaggcccaggcugggcucugggguggucuuaccccauuuuagcccuaggaugcacaacuaguccguccucaagcuagcgugagaacgcggcguuccaggcagagcuccgugcgcuucuaagcccacggucgcccucuacugagggcaaggaagaucucugagucuuugcacucuggcguccauaggccuaaaacuggguuuagcuccuuaagccucuuaggauguuuguuuaccuuccaccuggaguuggagggaaagagagcugcuuuucugaugaguuuugguuuuuguuauugguauccuuuugguuccacccaugugaaggugaaaggccccagggcuagucuguuuacaauagaagcacuguaaaaaaugggagugcauucuccugucugcacuuuauaguucacccuccagucuuuagccauaccuaguuuuucucccuucgagucauccugggucguucucacccauccuucuaccuuugggaucaccgggaugaucagagcagaaauggggguggggggccgagcuacugggcagaagcccgugugaaccuaagucuuagcuuccugguaggccuuccacucuccagaaggaaucgggcaucuuucuuuccauccagcagagguggaucaggaagaugcaggauuggaaaggagguggucuagccuaggcaugccugauccuugugcugcacugacuuggcaaggccugaacaagaaccgccugucaauuugucuacuacuagacagacuuaaugcuuacuagaaaagcuuaaugcuuuuuuuuuucuucuucuuuuuucuuguuuugguuuuuuugagacaggguuucucuguauagcccuggcugcccuggaacucacucuguagaccaggcuggccucgaacucagaaaucugccugccucugccucccaagugcugggauuaaaagcauccgccaccacugcccugcaguuuaaugcuuuccaaagcuaauuuuuaauuauacauguaaguaaugaaaacuuuaaaggcuaaagaccacuucgaaccucgccaguaucccaggcccagcccccauccucgagguaguauacuggagccccuuuaucucaauugcuuugcccacagcacauacuagacaugauuuugugaggcucuguuucugacuuggcauuauccugcuuaugguauccugcaaguuccuuuagaccauaaacagcaugcuuuaagaccuugccccguuggaagcacagaucuggcuuuaucugugcccuggucugguaauguuuccaaggaaguaugugucacugucuggcagauaagcauaagaguugcuugcagccaguauuucacuauuacaaaccauaccccaaggagcagagaagcugaaaugcuaguggacaggggauggacaugagaggugucaguagauguugccaaauacuuucaaaacaguugcaccaacuuauguuuuugugggggccagaguucccguuucuucucuccccuugucgcuagcuagcuagagucucugauaucugaauauauggaaguuugaauuccgauucacuuguucaaauuuccuugguggagaauccuuuuauacuuugggcacguuauuucauuuaauggcuacugugguccccuuaaaguggcuccugguguggcagacauguuguaaaacgggaaauggggcacagaaaggcagagcccucugcuuaaggccucuugcucagauacaugagccagagcuaagcagguagaacuucugaggucucuuugccuugggcaagugaagaaucuuuuauuugaaagauuugcuaccagagauguuugcagguuuggauguuuuucacauacugagcaugugcguaaugaguuguuauuaggcaucaggagccacccggacacacaaaaucuguuuguguuuuaaaucucuuuuuuuaaaaaaaugauguauuuauuuauuuuaugauuauaaguacacuauugcugucuucagacacaccagacagaagagggcaucagaccccauuacagaugguugugaaucacuaugugguugcugggaauugaacucaggaccucuggaagagcagucagggcucuuaaccacugagccaucucuccagcccugaagucagguuguuaaaccucaaggcagguuccuccacucaccaagcccgcucauugaaccucauauguguuuuuuauguuguuuacauaccuuuuguuuccaacccaagaccacaggcacuuuagacaugugcccaacccuauuuagcgcauuucuggguuucuacgacagacacaucacuugaggucaccugugaauucucuaucuugggcauuacuuuugugcucaaacaguugugcauuuugcauuucugauguuuuaauuagggggugcucagauucagguaggagggcucccuaauucugagcacuaagucaaauagaggucuccgacuuuuugauaaccgggcccuucuguccuuccugccucaccacagaaaauugacccugagguaucggccuuccugcagaagcuacgaagcaggguacagaucggcgugguggguggcucugacuacucuaagaucgccgagcagcugggagagggggaugaagguaggcauggcaacgucuuuuccuguuggaguuggggugggguggcuccacccugaacaguuacugagucccugacaguagccagggaccuugcuagauucuggagaaacagcuagaaguggagcaguuagcauccugccauuagacgaugcacauuuuaauaucucccugcugagacucgacuggccuccauuuauguaucuguuauuuuaguuucuuugucguuacugaccgcaugguuaacagugucuguggcuuguugagaauggccauguaucaguccuauggucuuuaggggagacaugauugacucauguguguguaugugccuacauuuggaggucagaggaaagcuugcaagaaucaguuuucuccuuccauaugggccccaaggaucaaacucauguuuucggucuugguggcaagcgccuuuauccucugagccaucucaccagcucuguuuauugguuuuggagacagagucccacuguggagccuuggcuggccuggcgcuccguauguagacucuguugguuuuggauggacagcgcuccuccugccuuugucuuccgaguauaggcaugaucaccacgcucagcuuuuuguuuugagacagagcugugcauuauuguauuacaagcugaggcugacuuugagcucacagccauccuccugcuucagccuauugagucuugacgguauacguaugcaccgacacaucaaguacuuauuuuaauggugaaaauggaacaucaaaguaaucuggaaacccuagugucaucucagggucaggaaggcgcccccucaagcuagaagcuuccuugaguuuucccuucucuccuuguuuagucgcuacaaguccuaccucucucuauuuccaucuacccacaccucccuuucuacuacacaccauagccccagugauaccaucugucacccagacauuccgcagggcguccaaacugugcucccuaacucccagcugauucuuguagcacccagagcuagagacugcugugcacucucaguggguaaagagucugagaaaggagccuggagucuccaugcaggagggcugugggugcaggguggaaauggcgcccucuucuggacauuccugggaagucuuccagaagggggcgcuggaucuuggaggaugagcagaggggaccccggagccaggucuaccuaagcaauggccuagaggaauggcuggcugaugugggagcaagcaaaggcgcacagggaaaggaugccagaaaagccgguuuagagcggaacagauggcagugcuugugcuggggugacaguggcuucuugucucaugcucuuucuuucucuccugggccccaagucauugagaaguuugacuacguguuugcugagaaugggacagugcaguauaaacacggacggcuacucuccaaacaggucagugcccccaaggcuuggcuggggcgccccacuuuuccacacugggguccugccgacuugugugugccacaguucgagccuuguguucuguacaacagacgauccagaaccaccugggggaggagcuccugcaggacuugaucaacuucugccuuagcuacauggcccugcucagacugcccaagaagcggugaggcccccagaccugggcuugagggaagagagugcaaguuuuggauuuuuaauuuuugcaacuggggcuuagaagucaggaccucacccaugcuaggcaaguuuucugccucugagccacaccccuacaccaggacccuaacucauggcuggguggauucucuuuuuuguguuuuuuuuuuuuuuuuuuuuucccaagaugggguuucucuguguagcccugacuguccugguuggccuugaacucggagaucugcuugccuccagagugcugggguuaaaggaguguuccagcaccacccagcaaauagguggauucuuauacccugugaggucuagggagacuauauaggacagguuuugaagucuucuccccgagccuucuugcugucucaccccuuuucuucgucacccguagugggaccuucauugaguuccggaauggcaugcugaacgucucgcccauuggccgcagcugcacccuggaggagaggaucgaguucucggaacuggacaaggugccguuugccgggcagcuguagacccugucacucggccacucugagcuuugcuuucucgucaguaaaguggguuuggaggaggaguuuuugguuccgacuuggacaccuacugugugucauuucucuuucugucacugcugaucugcuuuccuggugucugugccaccagccccuggugacccaagcuauggucauauuacgauugcacauugcuauucacaccagauccaacaacucuaggcucccaucugcccaucuacacagaacaccuuuucuucuucagaugacccaaggcccuuccuuuguucuauguccccucugcuuccagugugccuuugagaacguuuaaaacacaucugccuucuaaauccaguccuucugcagcuccuagugcuggcuggagccucucagccucuccaucagcccugaggcaucucucugcucucuucgauucucucuccagucucucuagucuucugucuacaccaaauuuuuuuuccuaucucuuuagaauuauuuauuuuauuuauaugaguacauugaagcuaucuucagacacaccagaagagggcaucagaucccauuacagaugguugugagcuaccaugugguugcugggaauugaacucacgaccuggaagagcagucauugcucuuaaccgcugagccaucucuccagaccccaaguucucuuaaacgccggcuuuuguugcaucuuguuggcguucacccagguugcccuugaacuugugaucucccucagcaguucaaaugcuggggucacaaguguaugccaccuuauccaucuuacccagccccucccugaacauugcccugcauuuagcucacaccccugaccgucacccuuucagggguggugaggucuuccauccacacuucuguguguacaucccuguucucacccugacuccgcugguugcucuuuccuuaccccccauugcagccacggcuucugcucauucugcagauggcaguuucccacuucagcacugggcucucugccugaagcauaccgcuagaccaggcuugcccucuucuccacccuggcuucaauguccugugcggagauccaaggcacugggauggauccagugcccuugucuaugcucagcaaguaccuuauugccgacccacaacaccgcccaccccaagaaacccuuucuuuuugaaacagugucuucuuggugugcagcccagacuggccucagcgucacugugucgccgugccagcuuccuguuugcggcucuuauaggugugucccgcugugccuaccugccaugaaaugcuuucggaugaaugaacagguguauuauucucaugccacugauguggaaaccaaggcucagagaagugacucauccaggaucacuuacugggcugguugcaaaauguagcuuugauuuggcugccugccuggucucugggguuucccugaaggugggcuggccaugauaaugucaccugcacaguguacagagacgccuguaguaggcgguggacacaggaauaagggacuuuuccugcuguaguuaaaguuggucauuggagccgggcagugguggcgcaugccuuuaaucccagcacuugggaggcagaggcaagaggauuucugaguuccaggccagccuggucuacagagugaguuccaggacagccagggauacacagagaaacccugccucaaaaaaaaaacaaaaaaaguuggucauugacaaccucccagccagguguccccuucucaggucccuagguucccgaucccagcucuccguccuguucagccagugggaucggaaaugcagccuuacugaccagauggagaucagaugaggcuggccugaggcagagauagggaggaugggaaacugaggcugccauccccuaacccuugccuuggccucagcuccuuccuuugucucugguucucucucaccccuucagggauugagaugugugggugcaccagugaacugugacccugugcgugcuuaaacuccuucagacuccggggauagguaggacgccuccuuaagaugagggcccuagccgggcagugguggcacacaccuuuaaucccagcacuugggaggcagaggcagguagauuucugaguucgaggccagccuggucuauagagugaguuccaggacagccagggcuacacagagaaacccugucucaaaaaacaaaacaaacaaacaagaugagggcccugucuugaucagcucagggucaacaugauggacauguuagggccggacgucacgcauucacugcccagucaccagaaucugauagugggagaggugcagcccccagcccugggcucuugagcacccacagugcucuccccgagguacccaccugcuaggaaggcaagaucgaggccagcaaggagcucgcgucucucagcuccgguuuuuccuugagggagaagcagacagugaccgcuaaccacuucucuaucauguaguuuugacacugggcucagagaguucagguaacuugccuagggccacacaguuaaacaguauccucagcaggccuagaacccaguuagccuguagauuuaucucggcgcggguccugccugaccugacucccaugcccucccaccuuuucuuugccuccaaaccccacugaccagggucacugauuucuggaucuaggcuucagcacugcugcugaggcgaggugaacuccuguuuccucaucugaaacguuggggccauguuuacccagaagcccagggggcugagggguuacgggccugguguaccaauagaaggcccucugauccagugugcucccuucccuuuccagaaggagaagauccgggagaaguuuguggaagccuugaagacagaguuugcuggcaaggggcugcgguucucccgagguacgccuuuccugcggugggcucaggcauaggcaggggacacgauuuauccgugccugcuuugcccaccuuguucagugaggccccuaguggugaauuguccccacucucccugagcccaguccaacuggccaggugaaacucaaaggcucugaggcuccuggggcaucugguaucccagcugccaucucggcuuguuccccaguagccagaggggaggacagaugccauggucacuuagagccuacagugugucaccugcugcucacagcccccuguguaguuccacuguggcuugugucccccccucagugucauugugggucucccuggccaugucuaccuuucuaccuuugcuugcucuugccuguuuccugccugcgugagacaguacaggucaguccucaguggcucucgggauuguauaaugaacagaguaccuuagagauggccgugguaccacgucuauaaucccagcacuugagagcugacaggcaguuagggggaagcaggacaggaauucagggcuauccuugguuucauuagaaguccaaagccaaacuggauacaggaaacccugucucaaaaauagagagugcuuuucccagguuagcccggugagccuuccugcugccagccuugccugucccucccaggucuuugucacaacccucaccuuccacaggaggcaugauaagcuucgaugucuuccccgagggcugggauaagcgcuacugccuggacagccuggaugaagacagcuuugacaucauccacuucuuuggaaaugagaccaguccugugaguguggcccugccccgucccccucaacccaacaccugaggucuaggccaggacacauggcaacagaaaacagucaccguucccacucuacaguuaggaagauuggggcucaaagaaggccagacacuuauaccguaucauacagcaagucaggacaggucugacaagucauccuggcaggucuaaggagaggguuuguaggagcccguauggaaaggguggcucuugggccccccaggccugggcuccugccuuguagacaucaccuaagaucuuccacaucuucucuuuuuuuccucugagugcagggcgggaaugacuuugagaucuaugcggacccccggacugucggccauagcguggucuccccucaggacacuguacagcgaugccgugagcucuucuucccagagacagcccacgaggcgugacugggcccacagcugagcacugggaccuucaaagagcucugaccaggccugaagauagaaccauugggugccacgguucccaucccacuggcccaacacguagcauccugugggggcacugcagggucacccacacaggaccaacgucugugugggaacuguccccagccagguggcuccugacgagacgcauaccugcucucuacccugaugguccuggccucugaugcugcugguuuuggggacagaacaggucucaccacaggguggcaugggaguugugcuauggagccugcuggccacagacugacaagggacagaauggcagagaaggggcauuacuuaaaggacucugucacagauauuaaaguucccaagacaaggu

SEQ ID NO: 7900 - RNA, 1022 nt, Mus musculus
ccacuacugcagcugucauggcggccuggcgguuaaguuugugcgcucgcagccuuuccgcaauucgacggcuccaggcugccccacuuugcuggaaauccagcuccuccagggcuguggucgcccgguccgcugcggcccgaaaggagcaggaagaaccgaccgugcaguggauggaggacccagaucccgaggacgaaaacguguacuugaagaacccacacuuccaugguuacgacgacgacccgaagguggaugccuugaauaugcacgccgucuucuucuuugguuuuuccaucgcccugguccuuggcacuaccuuuguggcuuaugugccaaacuauaagaugaucgagugggcccgccgggaagcugcgaugcuggugaaacaccgagaggccaguggccuccccaucauggaguccaacuauuuugaccccaccaagaucaaccugcuggaggacgacugaguggggcuuaagcagcgcuacccugcucacuccccagagaaucuacccaagggauugaaagaagaaaagaguguuacuccagcuaggccugucaauuuuuuuggccaagggcccacaccucaguaacacugauugaccuaaauaugcuaaagagaugggaggaacaauuaucuccuuaaugagagaauguauuuuccuuggccgaaacucugugggcucuagucaccuguggggccuucaccuuguggucugcuuacuuccuggaguucuaaguuccaaaacgcaucuguuucuuuuccccaucuuuugaauacuugccaaugucugggcucccuccccccaccauugauguacugggcucucuugcuuuauuuguaucccccucuucugcuucugccauggggcugcuugggagccuccauuacuaaacuucauauguaacccaagaaggcguggcuuucuccguauuucuucuggaaucggccuggauuuucagauugccugccccgcuauguuucuuuuaaacuauaauaaaaugguucuuaagccucc

SEQ ID NO: 7901 - RNA, 52417 nt, Mus musculus
aaguaaccacacgaccuuguccuugagucguuucccuaccuccacuaagauguuuuguuuuugcugugaucuguauguacuuccaugggggagaaauuaagcuaagagccaauuaucaguagccuaguuucgaggcagcuauuuacccauucauacugaaaagugcacaguauaaaguuagagcucuuuauucacagaguaaggcacagugaggugggagacuguaaucuccaugauuuugcacuuaaguagcucuuuguagcuaccaccuagcuugguaagaacacaagcagguggccuggcugcaguguagaaaguggcugggcuucugagcuuuagucaguucuucuccaagugucugauaagagcaucuagcaguuccugcuucuucggcccacucuuaagcccaugagccuugcauauguccuucaguguagguacagugagcuuacccagugugcccuuacgaaaaugggccuucagcucuucuucugauaacucuaccuugggcuuuuuacucguagaaccuucaucaucuagagaaaagagacaggaaggaaagaccuggaaaugcuuccagugauagcccagcuacauggcacugugcacucuuaugguguguguugcauauguaaaaccgcugcucauucucuguaagccuaucccccccccccuuuuuuuuuuuuuuuuuaguuuuucucaagacaggguuucucuguauagcccuggcuguccuggaacucacucuguagaccaggcuggccuugaacucagagauccaccugccucugccucccaagugcugggauuaaaggcaugcgccaccacugcccugcuucuuuucccccaaaaaaauguacagggacuagaaguacagcauugcuagaccccauuuuaaauuccagcacauccaaaggguaaggggaaaaaacauugagaaacauuguguuaaguucugaggcaccaggcaauaaaaccagcagggcaaaaaaccacagacaaugucugaugacaacuuccaggacaugacagaguugguucugaugcaaaaugguacaagcaggauggucccagucugaccuggcuuucuucauggauguauuagguaacaaggcuuaaauaugacuugacuuagucaaaagaacaauccagaaccauuccaaaauggugacugugcccagugcugcuuuacaagugcuucuuccucauaguagaggaagcuuggggucuaccaguaauaagcccuguccuauagcaaguggucagugccaggaucagagaccagguagaaaaaagccuaaugaaacuacuccacucccaacuagagaacuacauagacaucaaagcagggcauauauucccucugucacuuccuuuuauagaaauuuagauaauuaggggcuagaaagauggcucauggagccuacugaugcagaggccauggagagauguuccuuacuggcuugcuuuggguauaggugcaugucuuuguagaagccagaggggaggauguugaguccucaucucugccuccccaccuuccucccuugaugucgggucucucauugacuaguucacuguagaauaugcccuaaaaagaggucucauuaaauaagaagcagggauuccuagccacugaccuacccuaaguagacugcaaccuaacuuuaaaaacauuuuuauuguguauuuggguguguggacauaggagaacaacuuuguggaauuaguucucuccucccacuuuuauuuggguuccagggaggcaacucagguuacuagacuugcacagggcaaaugccuuacugagccaucucagcagccuaauuuuuuuaaaaggauuuauuuauuuaaagcauuuauuuuauauauauaaaauacaguacauuguagcuucagacaugucagaagagagcaucagaucccauugugagcuaccauguaguugcugggaauuaaacucaggaccucuggaagagcagucaguguucuuaaccacugagccaucuucuccagcccagcagccuaauuuuuaaagaugagguagagaaacuggagauggccuaagguuuaaguacauuuugugcucuugcaaaaugaguuugguacccagaguugcaugguagcucaugaccaccuggaacuccaguucccagagaucugauacccucuucuaaccucuacaggcaaaacacccauaaaguaauaagauaaaucuaaaagaaauuuuguaaaauagugggcuagugaaugguucaucagauccaaguauuugccauauaaaccacauaaggauggaagaaaacugacuccacagaguugugcuucaagcugcacacaugugccauggcacaaaugugcccauacuaccucucccucccccacacaaggaaacaauauaagcacuccauuugugccaaaaugcaguuguguagaaguuucuaggcaaggauuuguaacacugagccacgguaugccauauauacaaauuucugagaagacccggcugcagcucagugauaccacugcuugcuugcuugugugaaguccugacuuugaccuccucacccccacaguacacccaccaccauucccaaaaugaagagaaaggagacaaaucaccgugagguaagaccaugaagcaccuuuaaagggagcauaugcaucuauccacacccagcccuuaccuuguuuucucuuggcaacuuuucccucgggauuauaaccuggaggauagacaaguucuuuaaacucaucugccagggaacccagucuuuucuuuauggcuucaaccuuggguacuagaaaaucaaaacaacacaguauucaggugaguuauguacauccaagagaccugccacuuccagcucuguggggaacaagagagcacugaauugggcugagggaagggcuggauacaaggcagcugacuggaccauuaaaacaugcaacaaaacccuucagacauucuucaugccuggcaugcuaugugagggaccuccguauauucccaaauccuggcaagugccagucccccuuauuuaaauggugcaguauuuacauauagcccacacacauacucucgcauccuucaagucaccaagagcaaacauggagguaguccuuccucacaggcugcugaaccuaaggauugucuuuugcuaaacucagcuagacaguccccaccaccaugacugcuuauaacaacagcuauuuugucugguauuaagaggccauggacaacugggaagcuaagcaggcgagacuaauuguucugguccuauuaacuguuacaaggaccuucauuaaguccagacugcuuccagggacuacucguuucccugucacaguccacgucucauaaacaugcgagagcaccaccaucaagaagaggucuagaaagaaggccaggagcccaggccugacagggcagagcaagcacagugguuccgggcgcaggcagacucaguaauaucucgugcacccaguucugaaugcuccgcaccuguaacuuagagaaaucauuccuucucuuaaagccccugcuucggaauuaugucagcugaaucagcacacaggacaacagugccugccacugucagccuuagucaacguuaucagcagucacacauagacauggggugaccuaguuaguucagagucaggucucgggagccugccacucuccugucacugcagagcuagcucaaucuguucaaggcagucuaaggugaccuagaaaaccugucaggcggagacggucuggacaaggagguuuggagacauuuaaaaaacaaaaaacaagaaacaaaaaaaaaaaaaaaaaaaaaaaaaaaaaaccgcauccagggcuggagagauggcucagugguuaagagcacugacugcucuucuuuuuuuuguuuuguuuuuuguuuuuuuuuguuguuguuuuccgagacaggguuucucuguauagcccuggcuguccuggaacucacuuuguagaccaggcuggccuugaacucaggaaucccccugccucugccucccaagugcugggauuaaaggugugcgccaccacgcccggcucugacugcucuucuaaaggucuugaguucaaaccccagcaaccacaugguggcucacaaucaucuguaaugagaucaggcgcccucuucuggagagucugaagacagcuagaguguacuuacauauaauaaauaaauaaaucuuaaaaaauguuuaaaaaaaaacaaaacacauccagauuacuggucagagcagcaucagccaaacaagcggucuucuauugcgguuccuccaguacacacucacagcagcacugcuuggagcugagacaggcccaggccucugauuuaauuuaaagaguguucucaacuaaggauguagcucaccaaagaggaagagcuccuacccauguguucaauccccggcaccaacacacaaaggacucccuggcucaauccacaucucuuacgugucagaucuaccacuugcuccgacuccaucauguccaaagcuagggccuccagguugcggaagugcugcugcaggacuggauucucaaaacugucgcuccugucaaacagcaucaaaacauaagaacuuccaguaagaaaacagaaccuccagcuaguggcaguccaagagcaguugagaaaaagaccacaagugaauagcagagaccuccauaucaacucccccagacccccucuaacuuuuaauuuaucaguggaugcuggaacaaagcaaaccuggcuugucacuagaagcuuaggcagagaggagaauagaagaugcagaaugacaacugugucuucugugcacagagcagcgugggaguuaggagauugaagccagagucacacagguagagcugaagccugcucucuacugcuuuacuuuuuuuuggggggggggagggguuucgaaaaggguuucucuguguagcccuggcuguccuggagcucacucuguagaccaggcuggccuugaacucagaaauccaccugccucugccuucccaagugcugggauuaaaggcaugcaccaccacugucccacucuacugcuuuccuaguuggaugaaacugacaggggguccuuguguccucuaagccuguuugaucuguaaaaugggcacaaaaccaaccuuucaggguucuuucuuucuuuuuuucuuuuuuuuuuaaagugugucugugugcaccaugccugcagaggucagagguguccugacauaggugcaacuauuagaccucucagcccccuuuucaauuucuuaggaggaugaaaggacgggacugcgguguggcuguguguagaggagaguaggcagguuuauuuuuaaauauuucccacaacaguauugcaugcggaacagugucuaacacacggaauguuuuuuguuggugguguguauguuugugagacaugcaccugagaucaaacccagagcuuguacaugcuaggaagguacaucuccagcccuccaugguagagucuuagcgcucauacuuucaggggaaggaguagagcaggaaguuagagcugaaggggaaagccuuucuuuuuucuuuggguggcggggguugggaggagacaggguuucauacauucaagcuggcgucaagcuuauuguguagccacggaugacccugaauuccuggucccuccacugcucaccaugcagggauuacagguggaugccacacccaaugaaaaggaucauuugcccagaacuagaaguaacagauagcaaagauggaaugugaaaagggcucuaacuugaugagaaaauaaagaaaaaaaucugacuuuuuaaaauugacuuuaaaacagucuacaacugaagcguggugaugcaagcugcuaauuccagcacccaagcaacucugggcuagagagcaagaccaugucuuagaaaguuaacaaaacaaaaaccaaaaagccacgccauguguccugagaagauauacaaauggccaagacauaugaguuguucaacugucauuagcuaucauuagggaaauauaaaugaaaccacgaugagcuaucaccucacgucucagagugacuagcagccucgaagcccuggauucaacuccugacaccaaauaaaccuggcaugguggcacuugcuuggaaucccagcauggagagguuagggcaagaucaguaguucagguucauccuaggcuacacagcaaauucuagaccagcgcucaggagacagucaguaguaagcagaccaguaugaggacaagcaggacuacacacugagucagugucuguccuuccucccucugucuguccucccaccuggaaaugaugucauguaucccaaaccaagcccugaacucacuauaaucaaggaugaccuccaacugcuaaugcuccugccuccaccuuccgagccgggagcuauuggcauggcccaccacaaugaguaauaaauauugucucuaaaaacaaaaaugaagacaaggagcguggccagcauggggagaaacuggaaaccuuuuggugaagaugcaaaacagguaaggaaccauggaaaacuguauggaggguccucaaauaguaaagcugccaccagugagguggcucagcagguggaagcacuugcuuccagggcuugcugcugcccggcugacaacucgaguuugaucucagaacccacaguggaagacaaccaauuccugagaguuguauacacauuacuuacacacacacagauaauacauaaaauuguaaaaccuuucaaauaaggagcugguaagacaaagggacuugcuaccaagccugaguaccugaguucaauccccagaacccacgugacagaaggagagagcaaacuccuuuagguucuucucuaaccaugaauuggucaaacacaaaauaaauaauaaagauaugucuuuuaaauaaaaauagaacuaucuggggcuggagagauggcucagcgguuaagagcagugacugcucuucugaagguccugaguucaaaucccgcaaucacaugguggcucacaaccaucuguaaugggaucugacacccucuucuggugugucugaagacagcuacuacaguguacuuacauauaacaauaaauaaaucuuaaaaaauaauagaacuauccaaaaauugaacuuaggauaacaacaguauauuaacaccaccauuucauuagaacccuccuuauaacagccaaaacauagaaaccuuccacuuaauuaaacaaaauagcauauuauauauguuauauaaauauauauuaagaauauaguaugguauauauuuaaguauauuagaagauuagccuucaaaacaaacaaaaaaaaaaacaaaaaacaaaaagaaggguccagagagacggcucuuggucuucgagaggaccagcacccacauagcugcucaccaccaucuguaacuccaguuucaaggaauccaaugcccucuucugaccccgugcaugcuacaauaugaugcacaaacauauauacauaaaucaaauaaaaaaccaaucuuuuucgaaaagauguuuugguuaaugacaggaggaaaugcagacagcgcacaccagcacugcugagucuauaugacacuacccugagaacagacucaguucucaugugcacaucugcaacagucaacucucaggaacagagaguggcggaggccgagggcugggaggggacagcagcuaaccagcgggucucacacugcagcugggcaagaggacaaagggcagcacagcaucguugcccugugguuucucuacagugaacucuuaaaggagguggguaucauacagaaaauacaaacugaaaaacauggcaugugacaggugucugcaaucauaugcaggcuuuaagagauguuuuccauuaauaaaaagugaccugagagccugcugcaguggcccgugucccagcacucaggaggcagaggcaggcaaaacuuugaguucaaggcuagccuggucuauagagugaguuccaggacagccagagcuacacagagaaacccugucucgaaauaaacaaauaaaugaaugaaugaaugaaugaaugaaugaaugaauguagcucgaaggcuggagagacagcaaucaagggcacuugcugcccuuguagaggacguggguucaguucccagcaccuauguggcaguucaagccagcuuucacuccaguccuagaggaugcaacuccuugaacacuagucauagacaguggugcauauauccacaugcaugcuuaccccuccacacacacacaaaauaaaaauaaauaagucuuacaaagguaggggggcgucgugccacaaaccugcaaucccagcauucagaacacuggggcagauggaauacugcaaauuugagucuagccuagcuauacagugaguucuaggcuagccuaauuuauggaguaagaucccaucuaaccaaacaagaaacuaaauaagcaugugucuuuuugaacuuguuaaacaacuagccuuucuuuucugaagaaagcccaggcuugccucaaauauguaaugcuccaguaucaauuagaaaaggcugggguuacagguacauaccaccacacauggcuucuaccagcacaggcugagacucuacaagguaagcagaguugccacgcaguggaggcgcaugccuuuaaucccagcacuugggaggcagaggaaggcagauuucugaguucgaggccagccuggucuacagaaucuacagagugaguuccaaagacagccagggcuacacagagaaacccugacucgaauccccgccccccccaaaaaaaagcuaagcagaggaucuuauguacuuuuggaguucuuggugcuaaugaaugauucccugguuuuggcaaacugaacagaagagaauaugcccucuuagucuaugucuaacuugaauuucugauaaggcucaacucuggagaaggcuccaaaaaaugcucaagggugacccagcgcucaccuguaugugaagcggagcuuuugaacaauggccuucaucuugucuaucugcuccugguuggccgucaccuucucaguaaagggcaccuuccgcuugucaucggcauaagggaggaagacaagcuggaagccugaaguggggagacaggucuucugagauuucacuuacgauucugcuguuugucccucuguauacuguggugcuggggcugagggucacaaauccaauuucuccuuuaccaggggccacgcgugaaagucagacuaacagacucuccggggaugcacaugaagccugacagagaagggaugccccaacaaggagccacaaccaggcaacagcgguuggucccagccacuauuuauccuccucuuccucuuccuccuccucuucauuuuagauaauccagagccagcuggacaguaccauccuuggggggcuaaguuccagccucacugggcucuccucugagcuccagcuuuccauuuucauucuagcuuccagcauacauuaaagaggaaggaguuauguggauucuaguccaguuccuuucggacucaagaaggaaaauuccaggcacuucaaccaaggcugcugccaggugaggggcccuugaugacagcacuggagguggugagcaaguaagagggagccaucaggccaguucuccccucugcucccuagccucccccugcugucuacuauugauaaggacuuugacugggcugcuggguuuagggggucagccugcacagcacacagcuugaaacggggaacugcagcugggagguuaagcaagcgcuuauuccaaugagaggacugcauuuaggcaggaccaucagggacaccuugugggaggcaugaacacugaauuaucucaaauauagaacagcuucccagugagaauggagguuuaacuugugugcccgaguuggcuggcuaauaagugucagagagggucuaaaacaaaagagaguaagcuccgggacauaucccaugggacagucauagcugugugugucacagcugugugugucacagcugugugugucagugcauaccuguaaucccagcacucagacggcuugggcaggaggaacacaaauccuagccugggcugcauagugagaccauguauggaggggcuaagaagagacuaaagcaagacugacuucaaauagcuaagcaguuuacauuacaccacauaaccuuggcacuuacaggacaaaaaccaaccaugaagggugaugagacacuuucaauaaagaaaaauaucagcgagaagcccugccacuugcagcagaaaugugcaaauagucagaauggagacaauccugaagccugacuaugugcaaauagucaggauggagacaaucuugaagccugacuauguucucucuccacacaaccaucuugguggccuugucgaguggaccugcaaaaccuuuuaaggcuuuuaaacacacauuuccguggccuaauugaugcuaggggacucaggugcuucaggacccccaagggaccucucugccacauaccuccuggagucaccugaauguucugaucauccagcuccucuuccuggggcaccaaagccacaaaauacggggagacguucuuccgggguguguaucuacacacugcuaugaccuccuucuccacacacuuggugagcagagcgcugaacaagguugagcucccuaaaacacaacugucucaguggccugcaucuccuucuccccucacgcccagcacagucuuacagguuuucuuucuuuuuuccuccuccuucuuuuuacuccagcugcaucucuuguagguaucucagccauuuaggaaacacagcccaacaaacccagugacaggcgcuggcugucccuugaacaaccauuuaccagggacgucccccaaaauagggugucuacacuuugacccuuucccagggaucugagcagggagucucggcacucaccacugaccagggacuccuccggguacacgaacagagagggccucagguagugcugcuucuucagcaucaccgugggcuuaaagcccaugaggaucaaaccuggcucaucaaaccgcuucagcuccucugucuccucuuucuccagcacaaucugacgugucccauaagucuaaaggagaacgggccggcauaguaagggccacaaaagggcuguguggagaugaaucugcggccaccaaacaucagcaacuuagaauuagcucugggggggggggggggggggggcagggagaaggcagagugggaaacgcacuugcuacccaacugugaggauguguuuagaucccuggcagccauguaccacucgaugugcccacaauuccgauguugguuugagaggacacagaaggaucgcgaggcuugcuggccagccaaucuggcuaagaaaaccauaagcuuugguuccgugagagguccugucucaaagaaccgaggaggaggggaacagagcagacacaauguccuccucuggccucuacaggcaaguggauagcacacauaguggcagagucaaauuugaguuuauaacaacaacaaaaggcccuucagauuuauucaggcgaguggguuaauaaagaaacucaguggucagagaguggcugccccauaaguccaucugacaaucuagucccuuacaaauagaagaacaugccuuauaccucauauccuucaagcagcaggagaaaccaucugguaugaaauuuauacucaaacagaaagacaaaaaaaaaaaaaacccucauagauugaauaaaaauauuucuuuuauucaguuggguccugaacguauauaaaaaugugauccucucccacauuuuacguaauuaaaaaggauguguucagccaggcaugguggggcaugcguuuaaucauagcaguagggagacaggcaaguggaucucugaauccaaggccagucuggucuacagagugagaacccaucucaaaauaacaaaaggucaugcuugcuuuucaauaucacauccugguaaagaauguacagcagagagaggacgagagagagagagggagagggagacggagagggagagagagagagagagaauguacuguaccuucuucucaugcucagaaaaacagauguggucauuucaaaggaaggggaaaaaaaucugacuaguucagcaaggagaauuucucacaaacgaauagcccacugcauguauaaacucuaacuccucaccaccugggguaaccacaaagcucuuguugucgcucuacuuaaacgguuacaguagugugugcuaagcaagccaccaacaccuggccuguuccuugacauaugccauagcugcaaggccagcugcuuccuguccugaccguuuauccagaaagacgcaguuuacagugacuuacuucacuggcuagcuugcucagugugucugucugguuuucuuucgcccagacauggucucuacacaguccugucuguccuggaacgaacucuuguaacccagacuguccccagagaucugccugcuuuugucuccugaguucugagauuaaagucaugugccaucauguccagcuccuguuguuuaaagauuuauuuaucugcauguauguaugugcagcaugugcacgccucgugcaugccucaugcaugcagaggucagaaggggucuagucuccugaaaccaaaguaugguuggcugugagccaccauguggaugcugggaccagaaccuggguacgaugcauggacaggauauguucucuuaacugcugagccaccucuacagccccaccucucugucaguucuuaaacaagauucgguaggaaagguuagccaccuaccagagaccgcuuggugucacuaggcaggaguagacugccgguguuuacauuaaaaguccuugucuugguuuucacugguucauuuguuucccgauagagucucacuggaaaaggcuuguuagcuuucuggaccaaguuauaaaugcccaccaugaguacuacgucuucaccgagcuuaaacuuuaaccugggggaggaaagggaaagagaaacaaagcaaguaugagcgagcagacuguacuuuccuauguaaaagguuuucacagcauccaaguuccagucugcguuacucuguccaauaaccuuagucaaaacacaaauagugaaugggcugcaaacagaguucagcacugggcaugggggcacauggccaaucccagcaggugagggacuaagacaguaagacgcccugaauucaaggccagcacggggaacaaauaugaccaaguaccagguacgcaggucuacacacaagacucugucccaaacaguaauaagaacaaacaaguggagagguggagaaaagguaaaacguggucaagcaugauaguagacaucugaaaacccagcuuagaauacacagcaagacccugucuuuaauaaauaaauaaauaaauaaauaaauaaaaucuaacagggcuggcaagauggcucggggguuaagagcacugacuguucuuccgaagauccuggguucaaaucccagcaaccacaugguggcucacaaccauuuguaaugaaaucugaugcccucuucuggugcguuugaagacagcuacaguguacuuacauauaauaaacaaaucuuaaaaaaaaaucuauuauuauuauuauuauuauucaccucaugcuauuaaaaaaaucaauuaaagcuaggcaugguagucuacgccuuuaaucccagcacuuggguggaggcagaggcaggucugauuucagggccagccuguucuacagagcaaguuccaggacacccggagcuacacagagaaacccugucuggaaaaacaaaagcacuuauuuaucuggggggagggugcacauccacagcgcgggugugggagggcagagggcagcuugagaaguuggcccuuucccuccacuacaggggucccaggaggagaacucaggccgucaggcuuggcagcaugcaccuuuaccuagagagccagcuuauuagcugaaugauaauauaauuuuaaugacgauaacuaacaccuggcagcuggagagauggugcagugguuaagagcacuuacugcucuuccagagguccugaguucaauucccagcauccacaucaggugccucacaaccaucuauaauuccaguucuaaggaagccaaugccuguuccccuguuucauacauaggcacccauacauauauauaacuuaucaauacauagcaucuguuaagcguacuuguauguuagaugucucugacucacuccuuacgauaaauaaccuaauggugcagaggucacuaccaucugccauggacagagaggggaggagguaucaagggaugcucagaguacuuagcgcucaaggacacagaaggcugcugcgugacuguggagacauacccugcuggggaagaacugacaguucaugcuaucccgaggaggccagugggagaacaguguggggaagucaaaucuaugccuugccugcgauuuguuaagggagguaugagcaggcuagcccaggcugggugcccaccuggacagaacucgcuuuuuggucuccuuggcucgaaccuuccuuagcaggucuuccagcuugcuugacuccucgaagugaaccccaagguccucguccucagcgguggugaugaugucccuguagaacacggauacaucaaagccuccuggcuucuucagaugcaucaagucaaggaagaucccuggugugaagaaagauuaaaaccagggauagcgaaggacagcaaaugggaauuacuguuuuuucuuuugagacagaacucacuuuguaggccaggguggccuggaauucagaaauauaucugccucugaucaaaggaguaugcuaccauaccaggcuaaguuuguuuauuuuuauggggggcggggccuuaaguuuuuuaaguuuuuguuuaaacagagauggugccaggccagauguggggauguauauuauauuguauauuauauugguauuacuaauucuugggaagcaaaggaaggaggaauguaacaaguccauaggucuacacggcaaguuuggggccagccagagauaccaggugugacuuuauuuccauaaagaaaagauuugagagaucauaucuauaccagagaggcugaggcaguaggacugcugugaguuugaggcuauguugggccacauuugaguuuugggccaucaugaguuacauuguggccuauuuauuuguuguuuguuuauuuauuuuggucucaaagauggagcaaagcagucccgugagguggugcaacaugcccauaaucccagcacccaggaggcaggucaggguuaggaccaggaaagcaagguuacccaaguugcacagcaaccuccagagcagcuugggugacaagagaaucugaaucuaccaaaccgacaggcagugcucagugucuugcuaugugaccuagacugaaggucguagacuaagcaauccuccugccucagucucccauauaucuaaagcuaugaaacaaaacacugcccaacucuagcauuugcuuucaguuaaauagaaauggaucgcauuugcugguagcccaggcuggacccauauucuucuugccucagucuccaaagugcugggauuugagguaggcaucaccaggugcgggcaaacauccuuuauucucuguuuuaaagcuguauuuaccuguuauaccaguguuuuguuugcauguaugucuguacuucaugaaugcagugcccacagaggccagaagagggggaggaaucggcuucagaugccuccuucucuagacuaggcaugacagugcgcagcauuaaccccaucaccagggagguuaaaaagggaagauggccugcuugaggccugccuggcuacagagcacuuccagaccagcacggcuuauauaacaaagccaccucaaaaacaaacaaagcucccacagaaucuagauagacuauuaacguuuccaggaccuacagaagugccuaugccauucagcuguuacaaguacuuccaacaacuuucaaacagccaccauccauugcaucacugaggucagaacaaguaagcugugguggagacuguagccagauggaaggcgacaggccacacuagugucucccccuuggcucugcuucaucuuuccuuugucucuugguggcaaaagcaaugcuugagcuauaaagaaaguaaguuaggagcaacuaaaaagaauaagaagggcuggacagugauggcacagaccuucaaucccagcacucagaggcugaggaaauggaucucugugaauuuguggccagugagccuacaggucaaacuccaggacagcaaagacuacagagagaaacccuaucuugaaaacaaaaauggaaaaaaaagcaaaacaaaacagaaaaaaaaagaagcacgggugggcucaauaguuaagagcacuggcugcucuuccagagacccuggauuugauucucagcacccacguggcaguucaccguugucgaaugccaguuccaggagauaugaugaugacuuaacgaccucuucaggccuguacaggcaccuugcacaaaaguggugcacacacaucuacgcggauaaaacauccauauauauauaacauuuuuaauuaacuaauuuuuguuuguuugugucuucaagacagauuucucugcguagcccuggcuguccuggaacucacucuguagaccaggcuggccucgaacucaaaaauccaccugccucugccuuccaagugcuaggauuaaaggugugcgacaucauugccuggcuauuaaguaauuuuuuaaaaauuaaaacauacguucauuuggagcuggauaaaugcacagacgugcauuuaaaacccccaaaugcauaaaguaaauaaaguuaaagggaaaaaagcaacuaagaaaauaaggcuggagagauggcucagcaauuaagagcacugacugcucuuccagaggaccuggguucaguuuccagcaaccacauggccacacacaaccaucuguaauuccagcacuugggcacgggaugccucuucugacuccacaggcuccuggaugcacacggggacauaacuacauacaagcacacacacacauacacacuauuuuuaaagcaaugauagaagaacaagggaagugcccaccagugucccggaggucgcuggcuuugguccuggcccggcuggcuuuagcacugucacggccaugggggucgucuucauuggugaacagcaugauccucuugugacucaucuugagcuggacgucgcugaagagguuggcacagacccagagcacuucacucaaagaguagucagacccauggccaaccgugucucggaagugcuucuuccccuguugucccuuaaacuggucgagcucuagcacucgcuuagcgccuggugagaggcagggcaaacaagagucagccaacuucaccacaggcuaacaggccaggggcccugcucacucagcccugccuaacuagaguggagggaccuucugugcaggaaaccaaggcccuagccaaggucaaagcugcuuccuccuccagggcccucuuuuguucaccuuagugauauucucacauuaaggaagccguguucuuugacuauuacugaccuggguuguccaaaucuuguaagacauaaauauuuuugaaauucacugaauuuuuaucuuucucgguuccauagaacaccacugccaggagaucccgaucgcugcuuaugaucuuacugguguacacacucuggauacacuguaaaaaaaaauaaaacucccugaguguuagcuuaacacuaagucucuauaaguaucugguguggcacagagcccuguucagucuggaugcugcguuaagucuggcauggcggcacaugaccguagucccagcacugggaaggaggaggcaggaggcuauaagccuguuaccaucaugcuggguuuguauaaugcuggggaaugaacucaugacuuuacgcaugguaggcacguccucuaccaacugagcugauccucaggccuggguaucuguuuuucauucuacaugucauacacauuaagagucgacugccugggccacaugacaagucucacucuauuaacuuagcagugaggaacugcuaagucacuugccauaccagcugcaugccuucauguuggcuugguuuuguuucauuuuuaagauuuuacuuuguuuuuugagacagggucucucuacauagcucugcuguccuggaaccucucuguagaccaagcuggcuuugaagucacacagauuugccugccucugccuccccagcacugagauuaaaggcgugcgccaccacugccucuuugagcauucauaacaguggcuucuguuuguuaucucucaagaaauggcuacucaaauccuuugucccccugucccuauuuugagacagggucucaugaagcccaggcuggccucaaacuuaaauauguagccaagcaugaccuugaaccucugacccuuccauucccaccucucaagugcuguaaauacuacuguguaucgccagcccagggucuccacacgugaggcaagcgcucuaccaacuccucuaaauccuuaguucucuucugcccauuuuaaagcuguguugcaauuguuuauuaauaguaauauucaauucucaggauucacuugcaaaaagacuuguguacuuguguguguguguagugggggauuuaagcaucauuaacagaaauuuucuaaggaguccacauuuuuaaaagugguauuuaaaggagcuggaaagauggcucaucaguuaagagcacuaacuuuucucuuccagaggacucagguucaauucccagcacccacauggagccuuacaauuguauauaacuccaggucuagacaucugaugcccuuuuuugacauccacugguaucaacuauaaaagugguacacagacauaccuacagaaagaacacccauauacacaaaauaacuuaaaaaauauguaaaauuucaguuaaauauauuuuaaauuaaauaaaaguggcauuuucugggugugauaguacccauuuauaauacuagcacaugguauuauaccaguauaauuuauaauaucaguacaugggagaugggagacaagaagaugagaaauuuauggucauccuuggguacaaaguaaauucugaagccagccuaggcuauaugagacacucaacuuaaaaaauaaugauuagccgggcagugaugacgcacgccuucaaucccagcacuugggaggcagagauaggcaguuuucugaguucaaggccagcguggucuacaaagugaguuccaggacagccagagcuauacagagaaacccugucucaaaacaaaacaaacaaacaaacaaacaaaaaaacagugauuaaaaaaaaaaaaguaaugauggcgguuagagagauggcucaguaguuaaguaguuaagauggcugacugcucuucuagagguuguccugaguucaauucccagcaaccacaugguggcucacaaccaucuguaaugggaucugaugcccucuucuggugugucugaagauggcuacaguguacucacauacauaaaacaaauacaucuauuaaaaaaaaaaaaaaaguaaugagagggcuggggagauggcucaguaaccaucugagcacguacugugcuugcagaagacccagguucaauucccagcaagucacaccaggcagcucacaacuaucuguaacuccagcucccaaugaucuaauaccccucugacccuaccuacacacacacacacacacacacacacacacacacacacacacacacacacaccuacacacacacacacacacacacacacacacacacacacacacucugauuaaaauuuaaaauagccaggugauaguaguacacaccuuuagucucagccgucaggaggcagaggcaggcaaaucuguaggaacucacucucuacagugagcugcagaacagccagggccacacagagaaacccuguagugacaauuuuggaguuucaguuucuuugaaaaaaacacagaaauacuguaaaaauguguuuucacuuagaugccaggugugggauguggagcugcucgggacuguccuccgcaggugacugugauuugucucgugcucaagcggugcugugacuuuuuucagcugcagauaguuccugcaauugugugaugcuuggcauucugaaggcuuuugggagaguauauaaaugcuagggcuccaagagacaggguggguuguugguugcugcuggucaugguuuguuaaagaagaaaugguuugcacaaagaaacaacaggaagaaauuggguauccugaugacgaaggucaaacuugccccaaucagcacagaguagucuaaaaauaaugucacccucuuuccaaccccugacucuauucagggaucucuuuccuuuccucuccauucuuucuucccuccuaucuaguguuagagguugacagggcagaagaaaaaggguggggaagggaaaaagaaacaagaacccacaaaauagcaaaaggcaagguacaaaaccuuaucucaaaaaacaaagaaaacaauuuaaaguggcacuaauuuccuucuuggcagacucucacuauggcguuacacucuuucuacuuuagccuccaaggugcagauuacaggcauaugacaucauucccagagcaucuuuagaagugggaggggacagcuacaaauuaagucugauugacaccaaagggaaauucuggaggccacaugaggccuguggauaagaaacagucugacagccuuggaaccaguguugcacugcaggcuuaagcaagucagucaggagacacaggcuaucccugccguccugaccucauuacccacacacguucugcuccacagucuucuuccuauuuuuuagcuuugugucuugagacagggucucccuauguagcccuugucuguccuggaacucaccauguagaccagguaggccucuacucaagagaucucucugccucugccuccugagugcugagauaagagacaugagccaccacacccauucaauguuugggguugaauaaugucuuaccuggaugcucauaucaaaaggugugaguucaucuucacccugagauucgaacauagcccuggaggcaucaaccagaaaaaucaagcuaucucuuccugaauauuuauauucuccuauggaaaaauaaauggaaaacaauguuugccuuuugcauuguauuuauuauguuuaccaaucacacaaaacagagacaagcccauagaguuacaaguagaacuugacaaauuauaagaugaacccacuuaaagccuccacuccugucaggacccugaguccuauguauaucucucaaaucguuaguuuugacuuauuuuuauuuccuuuaaaaauuuuugcugggcggugguggcgcacgccuuuaaucccagcacucgggaggcggaagcaggcggauuucugaguucgaggcuagccuggucuacagaguuaguuccaggacagccagggcuacacagagaaacccugucucgaaaaaaaaauuucagcugggugugguagugaguaucuuuaauccuagcacucaggaggcauuggcuggcaaaucucuuuacuucgaggccaggcuagucuacagagugaguucuaggacagcuagggcuacaaagagaaacccugucuggaaaaaaaauuauuaauguauucauuuuauuuugugugugaaaguuuugcuugcauauauaugaauguaaaaccaugugugugcuuguuacucucagagaucagaaaagugcauuagguccccuggaaauagagcuauagaugguugugaaccaccauggggaugcuagaauuagaacccagguccucuagaagaacuuacuucgaggccaggcuagucuacagagugaguucuaggacagcuagggcuacaaagagaaacccugucuggaaaaaaaauuauuaauguauucauuuuauuuugugugugaaaguuuugcuugcauauauaugaauguaaaaccaugugugugcuuguuacucucagagaucagaaaagugcauuagguccccuggaaauagagcuauagaugguugugaaccaccauggggaugcuagaauuagaacccagguccucuagaagaacagccagugcucucaaccacugagccaucucuccagccccugggagucucuuacaccaugagggagguuuccuagugcaagccuggagcugggcugauuccaggcaagaggcaggaggcaaguuagagaccaggauguauagccaccaaugcacccacuuuuauguuaacucgauucccaggagucauuagaagcucaaagucaaaaaaaaaaaaaaaaaaaaaagaagcucaaagucuacaucaguuacagagugaguuugaagucagccuggucuacauaagaccuugccucagaaacaaacaggagcuggggaggcugcucagugguuaaagcaaugguuaagaauacuugacgcucucucacacacgauccagcuucacuucacagaaugcacauggaggcucacaaccaccuauaacuuuaguagcaggagauccgacucccucuucuggcucccuuuugcaccagacauguacagagguguacacacauacauaaaauaaaaauaaguagauuuuuuuaaacaaucaaaaauauguaaaaaauaaagugacaaauauuaccauggacagagucauuuauugaagauuaauaaauucucuaucgugguuaguaaaaaaaaaaaaaggaaaauaggguuaggaauguucauagagugaaauaggaucuaaauaauaacuguaaaacucaaagggagaaaaaauauuuuagauuaucugaggagaaaagggagggauaucagacaacauaaagugcucccagcaaaaaaaaaaguacacagcgaaaaucuuccacacaggccacuuaccaccugugucggggcucuccuccuccucuuccucuuccucgcccucaguuuuguaguaggacucccacucugacauguugguuugcucacuaggugagagaaguuaugaauuuaaaugaaaaaaaaaaaaaaaaaaaaaaccaaggcagguagcucugugguaaugcgcuuuccuacaguguacccggaccuaugccacacacaccagaaaaaaaaagagagacagacagacagacuucuggguucucuuuagaucuguucuaaaugcucgggucacuaauaaagaaugugaaugauggcuccugcuuccuccaaagcucuccauaucauuggagaggcaagagaaaugugcauggggucauugcugcaacaaccuccccuuggcuaucccuuaaggaugcugcaggaccaaaauggcuaggggugagggcgagguauaacauagcggcucagcacugaagguccuaucucgagcuccaacuggacugggacgguacuuggugcucuggcugaaacauucgucuucauuucucccccaaccuucagcuagagauuggcucaaccaccaguccuguuccgccuucuggggagaaaggagcaugacccagguccugcaggucgacagcgcugcuccguggugaggccaggggucgcgcgacacuaagcgugcaagcaagccaccaaggcaggccucauccaacacauguggugcggcgaaccuaccuuaaccgcaggcgggcaagccacugggacagcagaaggugggcaccacguccacgcgggcuccuugucucucgcccaaucagcgacguugcgucaucacgcacaacacgcccuucgacccuucaagcgggcacgcccacucgcauuucccgcuuccacccccuguucccuaaacuggaacgcuugcggccagagaaagccccgccccucgcuugaagcuccgcccccgaaacccgucagcaccgaacgcacaugcgugaaagugcguccccgccccugcccccuguuccgugcggagucucugggaucucucucucugucaccucacaguagucguugccggucgcggguguccgggcgcgagcagcgcagggccgccucucccccgcccucaggccgggccccggcucggucccccgcucccucuucuccccaccccggucggguaccggaagguccaagccgcugccgggugcccgagggccaucguggccgccgccacggguccugauggagccgccaaaucucuauccggugaagcucuacguguacgaccuguccaagggccuggcccgccggcucagccccaucaugcugggugaggggaccggggucagugggaagaaggcagguggccgcuggaagcgauccaccgaggggggugggggaagacgggcccaugggugguaggaaagauccacuagggcaaggacagugaggugggauucccugaaccccuguccagcuucaugaucuaagccaaggagacacacgcuccggcugagagcaagcuccucuucagcuagagacuggggcuagccgacugaucuugguggauuccccaagaagccagggaacccugcuucuuuagcucaaaguagagaaagugaggauaccuccagcucgugucccuggugguggaagcaacacugcagacgagauccucuggugucccucggagcgacugcccuccgcgccaaaaggaaauucccucugcaguccuuggaguggaugggaagagagcgcuagagcgguggaaggcuugagcccuugccggcuccagguuaggucaagucaggucacccugagccagaucuuggaacuaauuacguucuguccgacgaugcaauuuucgcucaacaguuaauugcuuuugaccagaugguaagaaagcaguucugggggaggaccggaugcuguaucggugaggauaucgguugugcucaguucaaaugguuucaugcugagagagaaaaagagcccuucaguguagguccaacuucacuucaagucaaauaccaaaaugucugucauauaggauuugucaggcuugucauuucagguaaugguggacaggaauggauuucagggauugaaacugacauaguuuugcaucauucaauaaauagcuauaguguuuccuggagacauuggaggaaggccuauuucuuaaggaacacaaggggcagggaucaaggaagcaaggcaaguuuugaggacauccauuugugaugugucacugaguugaacuuacuaauccuuuaacccuggggcagcgagugguuucuaaaugugguuucccaucagaaucaucuaggauguucguuaaaaacacaaauaccugacugaggcuguugcucacucacugguagaguuccugcuuggcaugcuccaagcccugggguuugaucucuaacauggaaacaaaaaacaagugcauucauuuccaacauacauugucagaugggaugggguggggggagcugaaaaaacuguauuagaaccaacugggugaaacacuccgaugauccuaguacuaaggaggcugaggcaagagggcuguggguucaagaccaacaagcugggcuacacacacaccugagggaauaaaagaagaagaaaggaagugaagagagagagaaaaagcucaggucaaaacgguuccucuaccaaagaaacugguagcagacagaguggaaggaaacuuugcccuaaacuacuuuguacuaaaugugugcacauuuugugagucuuacaugugcgaauuguggaaccaugcuucacagauacuaagccagagucuuuggaaauauguuauuuuuaaugaguguuuuggaucauucuuuauguagccagcccauuauccuuagagagagauuuggaccuaagucauggguuguuggcggggguuaggguccggucaugacucggugguagaggccuugcuuaacaaggcccgagcucagucucccgcacaccugagaagaaaggaaggcaaaucugaaagcaaaaccugcaagcauucuucuuguuguuuguuuggggaacguuugagccauugguagauuauaucagucagguuccagcuaaguuccuuggaaugcagccaugucuucaguuuuaucacagagaggcaucguuuguuuccuugacccauaaagcgcccuccagacugauuuuuuuuuucaaaaagguauuuuuuauuauuauacauaaguacacuguagcugucuucagaagcaccagaagaggucgucagaucucauuaugggugguuaugugcuaccaugugguugcugggauuugaacucaggaccuucagaagaacagucagugccaccuugcuaccccacccccaggcugauuuuuauauugguccuaaaaccuaauaauuauguuuuuagcugaaagagacacuagauauuguuguuucauuaaacaaauaagugcuuaggcaagugcugauguuuaguguguuaauguuuaacaaagcuggguagacugggaaaagauguuugcagacauggagcuagcuaguguaggaaauuguguguguguguguguguguguguguguguguaaaauaacaaacgugaucuguguugaaugcaagguaggaaauaauaugagagacucauuuugaguuucagaagcuguggcuuuuaggcuggaaauacaggaugaggaagaagcagcccuccauaagagugaugagggaguuaguguuguagauaaaaggguugaccagccaagaucuggagccggaaagccuggcuguuggggcugaaauuugccuaugugcagggugguaguaaagaaagaaguaaggcaggcaggugauguauuagacucgccacccuagcguuugggccuugaacccaggugcuucgaguacucuaggcaagcagucuaccgcugagcuccauggcuagccccucugucccuuuaaauagaugugauggcuccaaaaggcaccagccaaacacgaaacuucacgaauuuggccuaucagagaucacagccucaccuacaaacuuaauucuccuuuuuccuguaguguuuuuauucacuuuguaaaacaaagaguuagggaaagucauagucauuacuuuguaaagcuaaagauacauaugagugcgcacacgcacacgcgcacgcgcgcgcuaaaguauuaaaaccaaagaaaguagaaaauaggcaucgccuuucuguucuucccuuucaccacugaccuuaaaguugcucuaauucaguuaguuuccauauagugauuucucauuccuaaauguauuugacuguuuauuuguucauuuguuuuucaagaugguuucucuguguagcccuggcuguccuggacuugcuuuguagagcagguuagcauugagcucacagagauccacgugccccugccuuuccaguacugacauuaaaaggugugcaccaucacaccaccuauauuugaacuuuuucaaaaauuaaucuguaugggccagcaagacagcucaucgugggacacuugucaccaagccugacaacuaaaucugauuccaagaaccuaaggagaaaauugacucccaaaaguugucuucccaccaucccaugugcaaagugagugcacaaauguacacgcacauacacacauacacacacacacacacacacacacagaguaaauaugauuaauguguuuacuuauuuuuguaaggauuucuagaaguauauaacauaauaauugaguacuugucacaagccagccacccaacccccuuuuccugaguugcauccacuagaauccuuaccacacccaugugaaauaggucgccugaucugccccaagucacaccgcacacagguugcagagcuggguuauggacacagaacuuauuucaccaucucuuugcuaauaccaacaguccaagauaauguguucccuugugacuaaaguaggguccuuguccuuagacagacgucucaagguuuacuggaaaagcccugggccagauggucugagcuacuuuucuagcacagugaccaucccccgucacccugcuuuucccaaagcgaauuccuguuccuuuacucauguacauuccccuauguaagaucuuaaccacggggcuggagagauggcuguguuuuugcagaguaccugcccucagcacccacaucagcaaacucaagugccuguaacuucagcuccaggggacacgacaccccucugaccuccccgggugcacacuuguacacaugggcaaauaauaauaaaguuacuuuuuaagauaauaacuuaagggcuggugagauggcucaguggguaagagcacccgacugcucuuccaaaggucugaaguucaaaucccagcaaccacaugguggcucacaaccaucuguaacaagaucugacacccucuucuggagugucugaagacagcuacaguguacuuacauauaauaaauaaaucuuuaaaaaaaaaaaaaagauaauaacuuaaaaaucuuauccaauucugcuaggguucaugauugacuuaaauaacacagauuucaccaaauuauccugucacgaugauggugauaaugaugauggggugaugguuuaguuuuacuugugugugccuguaugcuaccugugagagcauacuauagcaauaaauaacauuuuaacaaacagcaaacacauuucaggucuggggagauaguuuaguggacaugagaaucugaguuugaguguaugcaaugucugcuggugcccauggaggccagaagagggcacugggcuagaguuacagucaguuguuaaccacagaacaugggcucggaaccagacuuggguccuuuaaacuccuaaccacugagccaucccuccagccccauccuguccuauuuugaggacaugugccucccacgacacucuguugugcaguaccucaccagccacgauugcucuuagcauucuaaucgcguggacagccuaauugcaccuuuucccccaugucacuguguggcuaauauaauuagcuauuaaaacuguccuucagcucuuccucuuaauaauuuuagcugcucuuuaaacuucguggccucuuuucgugaaaaggcguguagagguaaaagcggaggcuugggaggagugagggaaagauggggcucaugacgcagcucucgaugcuucuaccuccuguccuguggccucggggccucaggcuugcaggacaagcaccuuucccaccgagccaucgccccagcccugaacuaggcuaacucggguuucguguuucguuucugacuugagguuuucuaugcauguguaaugguuauuuuccccuagaagcacaucccauuguucucaggauaaaguuuuugggaaacugugggagagugcuugccucgcuuuugugaggcccuggguuugggaaaaaagaauccccacaucuguguacauauugacagaaugcaaucuagugaauauuugggucuuuauacuuagcucuuacaacaguagcaccagggacucuacucuuagguguuaauuucuuuuuuuuuuuuaagauuuauuuauuguuuauuuuauauguaaguacauuguagcugucuucagacacaccgggagagggagucagaugucauuaagggugguuguaagccaccaugugguugcugggauuugaacucagaaccuuuggaagagcagucagugcucuuaaccgccgagccaucucuccagcccgguguuaauuucuuaaaaaguaauguguauguauguauaaaauuagauaaccauauaaaagaguugcauaccaagauaaaagcagcagcuuacuugagccuuuccagcaggaggcuggagcuucuggaggcagagaaccucgcuccucagagcacccccaggauagucgagagccagugcuccuuaaggggugugagcacccaugggugaugcggggcuggaaccaggcccucaccacacuauacccuccuucccaguauugaucauaggaaugacucagacuugcaaauuaaauagaauuuauucaaaucugagagaggguguuuuuuauauguuuuauguaaucuauuguucuuuguuuucguuuuuauuguucauugugugcucaacugucugauauccacugaagaaauggaggaauaguaacccugcaucuuucugcaaaauguaaaugaauguggcuugcagggcucugagaacuccugcuuaaugucuguagccucaucuugcccccucguguuuaacacagcacucuuuuuguuuguuuguuuguuuguuuguuuguuuguuuuucgagacaggguuucucuguguagcccuagcuguccuggaacugacuuuguagaccaggcuggccucaaacucagaaauccgccugccucugccucccaaguacugggauuaaaggcaugugccaccaugccuggcuuaacacagcacucuugacaccagguuuacuacauuagauucuacaacaaaacccacuuuuauuauuuaaaagaagcagcagcccuguucaaauuagaguuacuauugccaugaccaaggcagcuuggggagaaaaggauuuauuuggcuuacauauccauugaggaaagccaaggcaggaacucagacuaagcaggaaccuggaggaggagcugauguaaggacauaaaggggcugcuacuggcuuaccccacuugacuugcucagccugcuuucuuauggaacccaggaccaccaguccagggauggccccacccacaauggccugugcccuuucccaucaaucacuaauuaagaaaguaccuuacagguuuuccgacaaccagaucuuauguaggcauuuucucaaucgaggcuccagugauucuagcuugcgucaaguugacauaaaacuagccagcacaagcaccauuagggcuuuccucuugcagagccucagagggggaaaggcugccugguaucccagcagcacaaagugccuucaggucucucuucacagccugugggcccuauuaccaccccaggaacuuucucuguccaguucuugcccugccuaacuucugcccauccuugauaucucaguucugaugucaguucuccuacagaccuuuuccuaaacccugccuccaggucuugcucacaugccccucuucuguacuaauaccauccuguauccuccuggaaguguuuauuauccuguuuguaauugcacuuuuucuaguguggaugcaggugugucugugggagguuuugugcacugugugcaugcuucagaggcuagaaaggggcauuagaacuggagugacaagugguugugagccaccacgugggugcucuggaaaagcagccagcgcccuuaaccacugagcuaucucuucagccccuaagguuuugcugcugcugcugcugcugcugcugcugcugcugcugcuguugcuguugcuguuguuguuguuguuguuguuguuguuguuguuguuguuguugucugaggcagaguuuuauggguuugggcugguuuucagccucugucuguuggugcagagacuauagguaugugccaccauccucuuauucuuguuuguguuccuccaccaucccacuacaaaaucucacucuguaccucaggcugguccacagcaauucuccugccucaacccuccauguacuaggauuacaaacaaguauuaccacaucugacuauaguuauuuuuacacuagggaaaaaaacaauccuguacugacucuaaagaauacugcaugcuuaaauauuuuuaagccugccuuuaaauuguuuuuaugacuuugugcuuggguuagaauucaguuucuugugcauggucuaaggcaaacacucuaccgcugagcuucacucccagcuucuucaugguuucuggcaccucuucucuccccacagacaauaaggggaaggccuucugcuggugggcaucuuauacuauugacugcagagggcuacguacauuacacaaaugcugcuucuacuuuucccagagaauaaacagaugcuuccagguaacacuuaagccucgcuuacuguuggugaagugccaguuacacuacuuugcugcuaggggaggguuguguggagugaaccagggccguacuugaucuauaccaaagaacuaauguguuucuucucccugccaaagggagaccaaaugccaccugcaaagaggugucucuggagucccaucacugccaaccacuuauuucuuaguaacaggcguuaguauagcguaccagagcugauggagccuguguguuuauccagcucuguggauaaggagcaggcaggugcucacuccaagacuuuuaugugccucguaacucugugcaacgaaggcggauaguagcauaccuuguccugcacuuccauaauagagcugauauccacaccuccugcuuguuuucuguauccauaauccauagaccucagaaugaaugcauugggugugccaauagguuuagagacacacugccauaugacuacccacucucccuccaucuugcugacuaaaucccaguaggaaauaauccgcucuaugcugugcuaauauccauugggucuaauucauguccccaaauggcuuugugcccuacuuucauagcuccuauuaccacccccaccucaucucuugccauccuaaucuugcacccaaaauuaagaugcaguuaagccugcccucccaugccuuucaucuugccaaggccauagucuuacuccuuaccuccccaagaggaggcuccaacacagcaaacuucacaucucuaccugggcaucuccagugaacccaucuucacaucuugccuugucuuuuuauacuagacaaaauacaggucuucaucaucuucauaaaaugauaauaaaugugaucuauuuaacauuuaaaauaugugagaaugggcccaggauguggcuccauuggcagagugcuuaucuagugugcacaaaccccacacuaaucuagugggcuugaucccuagcaucaucuaaaccaagcauggugauagaugucuuuaaucccaacagguggaagugagaggcaagaagaucugaauucaaggucagccuuugcugcguaguaaguuagaggccagccuagaaugcaugaccuuuucucagaaaaggaaaaaaaaaaaagaucuagaccuuugaguauaguucagugauagaguacccgcuuagcauguacaagucucugcucauaccccaguacaaaugaaaauguuuagauguaaagggugaacgggcauggcggcgcagccuuuaaucccagcacauaggaggcagaggcaggcagaguucugugaguuccaggacagccggggccacauagaaacacucugucuuuaaaagagaaacagagggccuggugagauggcucaguagguaagagcacccgacugcucuuccagagguccugaguucaaaucccagaaaccacaugguggcucacaaccauccguaacaagaucugacucccucuucuggugugucugaagacagcuacagucuacuuacauauaaucaaucaauaaaucuuuaaaaagagagagagagaaacagagagguauauaacacaggaaguacaagcaugcugcucuccuuccaugcaacacugagcaagaccuagaacagaugagggugacacuuagcaauuugugaaccuuggaauugacugcuccggugagugggugaggucaccuguguuccuaccuccuucauugccuugcucauccuucugugugcuguguguauugucuccuugccugucugucuucauguuaugugugaauugucuccuugccuguccuucugugugcuguguguauugucuccuugccugucugucuucauguuaugugugaauugucuccuugccuguccugugugcuguguguauugucucuuugccuguccuguguguugugugugaauugucuccuugucuccuucugugugcuguguguauauuaucugcuguaggguuaaccuugaccucuaaucugcucuuuaacucuucucuccaauucauccucucucacagcauuuuacagcccaggcuggccucaaagucacuauguagaugaggauggcuuugaacuuuugaucuuccugccucugcccuccaaaugcuggauuauaagcauggggccacuacacuauaccccuauuaccacacaucuuuuuucuucuucuuuuuuauuuuauuuauucguucauuuauuuauuuauuuauuuugguuuuucaagacaguguuucucuguguagcucuggcuguccuggaacucacuuuguagaccaggcuggccuggaacucagaaauccgccuaccucugccucugccucccgagugcugggacuaaaggcgugcgccaccaccgcccagccuuuuuuucuucuguaaguuuagugugcauguaaguacuaugcaugcaugugaagggucagaagacaacuuucaggaguugguucuucuaccauaugggacccaagaauugaguccgggucaucaucaggcaugugucugucaccugcuuuuaccuacugagucauauugcugacccuuaccacagcaucuuuuuuuaaauguauguuuacuuauauguaagugguacaucuguguuguggguauguacaggugcuuagagaccagaaaagggcauuugguccccuugagcuagaguaacaggugauucugagcccaccccacuccacccacccccgugucagugcugggaaacaaaauuccucuggaagagcagcaagugccaagugugguacacacuuauaaccccagcauuggagaaguggagccagaaagauuccuggggcuuucugacuagccagccuaucugaaucagggaugccaggcucaguacgauauguggugccaaaaacaagagggaggaugauucagaaagauaccuaaugucaaccucuggccuccacacaugcacacacauguggaaguguagguuaggugguacauggagaaucugagcuaggaggauugcuuuguguuaaggccagccugagcuauacagggcgcagaauguaaugauguggcuccgugcuagagugcuugcuugccagcaugcacagggcccuaggcuugaucuccagcauuacagucugguaaaauagaaugcuagucauuuguuugagccaaaaggcagcucaguggguagagguaacugguggcaagcuugguaaccugaauuugauguccagagcuuauggugaaagcagagaauuggcuccugcaaacuguccucugaccuccauauguacaccguggaauuguacauauuuguacaauuuguaagggcuggagagagguuuauuguuuagaacugauuauucuuccaaaguacccaaguucaauucccagcacccacauggcagcucacaacugucuguaauuccaguuccaggggaucugaugcccucauacaggcauaugugcagguagaacaccaauguacauaaaaaauaauuuuuaaaauuuuauuguuuuuaaaaagugggucugacuagaguacucuccuaccaaggccaggccacccugccugccccaggccugcuggcugcucguuguucgucagcacgccugcccucugcccugcagaaccgcagucuucacgcuuuugagcagacucuucucucuggcagauacgcccagcuuugccccugcacgcuccuucauugguugaauucaggcucaugaagguaguucuuuaucuuuauuaacauagcacccugucuuuaccauuguuccagugcuuaucagcacaguguuuuaguuaauuauuuaugugugucucuuuccacuugacuuugagcuucugaagguaggauagccuguguuugcauuuugacaccuaacguugcugguagguaaaggaauagauaggcagugggggagcacaugguuagccauguuuauauacccggauccauuccccuggcaccaaauacgcaugcauugccuuuggaaaaggcagagcauuuagcuuggcuccauucuuucugaagaauugcaccuuagugaagaaguggggaccaucuuccagauuuacucuggguuugcuguagaugacacagagagguugaaaaggcagcguugacuuagcccccgaugggaagcaagaacagacaagcaggacaguguguucguguugcucucugaugaagcagaguggcuucugagcuuccugaccacagugucaccccgaggacugacugccuggcugccauagaggagagcugaauucuagaaagucuuccaggagguuuucacaguugccuccuggugugagugaguucuacauuuacucagccugagaaggcacucggucuuguccugaauggcuaacucucuucuuuucuccacagggaaacaacuggaaggcaucugguaaguguggugcgcuccucauugacugcucugggagcaaagccgcucacuccccaguucauuggcucugcagcuccaggcucaaugccuggcucuuuguucacaauuucccauagccuguuuuuuuuaagguuuuuucuugggagggggugggguaguuaguuuucaaguaggguuucucuguguagcccugacuauccuggaacucaagucuguuagaccaggcuagccucaaacuuaaagagaucugcuugccucugccuccugaguacugaauucuucuucuuuuuuuuuuucuuaaagaaaggguuuuuuuuuguuguuuuuauuuuuuaagauuuauuuguuuuuauuuauaugaguacccuguagcugucuucagacacagcagaagagggaaucagaucccauuacagaugguugugagccacuaugugguugcugggaaucgaacucaggaccucuagaagagcagccaguacucuuaacugcugagccaucucuccagccccaaauacugaguucugaaugcugggauuaaagguauaugccacuaucggcaccccaaguuuuacuuuuauguguauguauguaugccuuuacucuauaugugcuuagugcucaggaggucagaagagaauaucagauccccugauacucaaguuacaaucucucuagccccaaggccauucuuuucuacacagggagcuccgguccugccagggcuuucucagacucugagaaagagagaaaaaagaaaagaaggaaggacaauguuuagaaaagugcuuguccugagcauacauauucccuaucacuauucccugaacgguggagcgcaauggcauuuacaucauguuagauauuguaugucaucuuuaaagauacuuaaaaggucuaugugaguuccauguauggccuaaauuccauuuuagacaagugcaucuguggcuuugguacgagggugggaacaguccuagaucagccagcccacacugagaaugucuugcucaugucuucaucugacuaauauaaaauugucuaccgugaugccugccaucuuggggcagaugcucucucugcaguaugguacuugcuuuucuuggagaggcuguaagucccuggcucacuguccucucuguggcaggcacaccucuauaguuguacacaaggaugaguucuucuucggcagcagcgguauuuccagcuguaccccggugaguggcuuccccugaccugcagaugugggagggagggcuauugccugagaaguucagcuucuagcauguaccucuggccuguggcaguuccucguguuagcauuuaagccagguauguugguacacuacacaugucuugaaucccagcacuugggaagcaacagaugaaucugugaguugaaggcuagccugaucuacucagaauguuccagaacagccagagcuacauaaugaaagacacuuucucaaaaaaaaaaaaaaagaaaggaaggaaggaagaaaggaaagaaaagaaaagaaaagaaaagaaaagaaaggaaaagaaaggaaaagaaagugagagaaaaaaauaaaagacuuaagcuaaguaguuuuauaauccuagugguuguggaaagagguaggaagauugggaguucaacuuucuuggcuacuuauugaguucaaggcuaaccugaguuaccugagauccucucuaaaaaggaguacugcuauggcucagaggcggccgggcagggcggggcacuugucaccgagccugacuaccaagcucacucucuagaacauagacagcagcaggagagaaccuucccuuacuagcuccuccucugacugaugcucauguuuaugcccguccucuucccacaugacuuuucugauucuaauaucggugcccuuuucagagcauuucucucagagccgccucaggauugucgguucauuuuaauaucauaaguagaaagucguucuuaauuuuuucacugaccacucuaaaagucuuucauuaagccacgucacuucuuuuuuuguccacuuuuugaaauuaaaaggucucaugguugaggcuggucucaaagccacugugcagcugaagagaaccuggagccuccugaugcccauugucuuuaccucccagguucuagggucacagauguguuugcacccccaaaagccuggucaguucuuaagucaaucagucugucucucuucaucucuucccauuuuccaagagcuuucacugcaguccugagcacuuccugucuggaccggaccuaugaaacuagccuguucuuccucugucuuccauguugaagacagaauuuuuuuuaggauguaaucucuugagauccucuugccucugacucccaauuaaagauaccgcaccaccgcacuacauucaacucaccauguagccaugggugacugugaacuucugaucguccccucuucaucaccauagugcugggacuauguagcccuggcuauccuaaaacucuaguagaccaggcuggccuugaacucacaaagauccaccagccucugucuccugagugcugggacuaguguaccacuguucccuacaugaugaguuuuagaugcuugguuuuuuguuguuguuuuguuuuguuuuguuuuguuuuuagggaauuucaguuuucacagugcccccagcuuagccagaagguucagcaaaggccucccaugaccccucugaucuugucucuggaucccucuuuagccauccucuucagguuguaucuucugaccucugcccuuuuccugcuuggccauuuaauccaagacuccagccucaggauagcucucugauccaucaacugaaugugccucucuguccuucaggucugagugugugucaguucucucagacagaucucagccuggcccugcccugccacagggaccaacaaauggcauucuguguuuuuuccagcauggcccuuaucucugcuugucaugauccacaggaguauacaauuuuuaccuaccuucccuaauaaacuuaaguuucaugaggacagaaaucuuguguuuuguauacauuguacucccauuguccagcuuagacguagcguauaaguucucuacguauuugucaugugggugaacaacaggaguugcaauagugcccucuuguucuuuggaacauuagauaauuuuccucuggcugucacaguuaucauaauuacugcuccugcucaccaggccuuccccaauucugagagcaaugucagccucaaggaaagugcucagggcugucaguccauggcuuucccaggucugcccuccuugauggccaauugcuugcccuuuggcuccuguucccacugcuuugcucuccugucacagcccagcugccauguucugcccuuguggucaucuacuggggacaaagggagaccaaagguuccagauuucucucuuuuuguuguuuguauuuuucgagacaggguuucucuguguagcccuggcugucauagagcuuacaauguaaacaaggcuggccucaaacucacagagaucagccugccucugcuucccgagugcuaggauuaaaggccugcgccagcacacucagcuagguuucugucauuuuaacaagacagugaacacacagugcaggagaccugcacuggaucagcuuccaggccccacaagcaacuggaagcccaaguuuucacucuuaccuugauacaaacaggagauagccucuaccugugacaggagugucccagcaguuaaagaugaagcugaugggacaguguaguuuuaugaaggaagucacaauaaaauaauuguuuucaagccugucacagugguacauaucucuaauccgaacacuuaggaucugugaguccgaggccagccagggcugcacagugaaaacuuaacuaaaaauaauuuaacagauggggaauguagccugcaguucacaagaucccucugcaaacuguuaaaauguuaacaagauguuggggucucagcacuagagcacuugccuagcgugcuuaaggcccuggguuucauccccuggacagccaagaaaaagcaaaaaagcaaaacaaacaaacaaacaaaugaucaagauggugacuuagugauuuucuuggguugacucuuucagggagggacauugcuugggcccccagacucugugguugaugugggaaacacagaagucacagaagaaaucuuucuggaauaccuguccucccugggggagucucuguuccggugaguacggacagggugguggcugcuugugugcuccacuaggcagccgaacccuggaaggcagggccaacuuggccaucccugucccucagcuccagccagaucggucuccucucaucaugaagagaaaguuacuaugcuauagaaagagccugagucucgccaacagccagcauugcaucccagcaugcuuucugcugaagccucaaaagaagcgaggcuucucacuccugcugauugauuagaaucagugagugugucuuccuccgccucaggcaaguguuuuuccuacuggaaaacaggguuugugguaggagagagaugaaauaccaacuugaauuaauagaucuugagaugcuuaagucaggcugaggaugcaguuuuauuuggcagaguacuuuucccaucauacacaaagcuucggguucaauccccccacaccacagaaaccuaaacugauauguuggcacaugcuuuuaaucccaacacuccagaaguggaggcaggaacauuagaaguuugaagucauucccgccuacauuuggaaugaaaggccuaccugcgcuauagagacucugucucaaaagaaaaaaaaaagucaaagccugguaagaugacucaucagcacagguauuugccauagggugcaacagccagccugagugugaaccccaaggcccacacuauggaaagagaggaccugcucucaaacauuguccccacacacauacacacaaaaugaauguuuuaaaaaaaaaagaucaaggaggggcuugagggauggcuuagagaauaaggauauuuguugagagauucuuagaggauaaggcuuggggaucaguucccuggacucacauggagacacacaacagccuauaacuccaguaacaggaguuacagucuucuggccuucacagucuauaggcacaaacaugguacacauacauuuauacaugcucaucugcauaaaauaaguaaauauuuuuuuaaaaacuagauagcuuuauuaaguguucaccucugauccuagucccgaugugaguguagauucuggaauuauauagaaaccauguguuucugcuucaucuuucccuuguaagucacugcucagagguccagaucugcagacagcaguccuucuggagggugugagaggacuggucauaguccuaacauuagacucugcccaccuucccacucaacagucacagucacgccacauagaugcugcuggcccucucaucugcucuucaaaccucucuccauguacagaggagaagccuacaaccucuuugaacacaacuguaacaccuuuagcaaugaaguggcgcaguuccugacugggcgaaagaucccuucuuacaucaccgaccugcccucagaaguucuuuccacgugagugugacuacucuguuucuaccccugcgaacucugaaaaaaauccccaucugaggcagucaggagauucagaccagccucagcucccuaauggacuuccugagaagagccugggcucugugggacccugucucagaaauaaaaggaaagacaggaaacccucaaacuuagugccccuucccuagggcaaccgaauccucacauccaguaggaccugucugguggcagauuccaccacagaaggccaccauuguucccaacuaccagugugcacuagucugaccuucggccuccuuggagcuggguuuuagugccaccacagaauuuagaaaccuacuugacacuaguuuugauauuuacauaaaaccccaguaucuaauacacaaagccacuucccaaaagugcuuaucuauaguuuaggcuuggggagguggcagaauccagaguaacaggacaacccaguuccaaacugugacuugucucagucauccacacccugagcucugaugcccucaaaagaccagauucugcguguccuugaauucacaguucaaggaaagcccucaacagagguuuccucugccccugauggguccaaccuugggaagggccugugggccaucucccagaugacaucucaagaaaggacacauacucccuuuucugauucuaucaagcugccucugcucacucuaggaaauguaacacucguaacaccucuggcuucaacugaaucgggugggguccugaccaacagggguccugacagauaaacgccucauuucaaaacaaaacaaaaaaaacuacguagaaaacagggcugcucaagagcugggucuccuaggccucagacugucuucuaccuaauagauguucaaaacccugccuccagaucuaggucaugagacucugagcacgauggaguagccaaaggcuuuuccuguuaguggguggagucucugagcuugucugagugggaguugauuuaacccuuggagcaguuuacgaggaauuuuauuuccuugauuuuaggggugauuuaaauacggcaguaccagcuucgcacaguggugugcgcguagaguccuagcacuugugaggccgaggcaaacagcgugacagugacuugagacagcaucagucugagcuacacagugaguuugaggcuaggcuaggcuacauauucaguaaggaaaggggggcuaggcuacauaguaaggaaaagggggugggguacauauucaguaaggaaaggggugcuggggugcgcugagcauaaagccuguucccagagugugucaugagccacuaucuuuugugggcacuuacuuuuuaagacaggaucucacuauguagcuagacuagccuagagcucauuucauagacuauccugaccucagacgcacagauaucagcaugcacagccuccugagugccgggauuaggaccuaaggcacaguaaucuugaacucuccaaacuccaucuuuacagugauuuucagcugguuauuguuacagggacaaaccacgugcccucuagaaaaugacaucaacacuuggcaacuucgcaugaccaguuacucugaauagaagaguauguuuucuggaagaaucuuuguuuguuugcuuguuuuuuuguuuuuguuuuuugagacacgguuuuucuguguaguccuggcuguccuggaacucacucuguagaccaggcuggccucgaacucagaaauccgucugccucugccucccaagugcugggacuaaaggcgugcgccaccacgucuggcuacuggaagaaucuuaauuuugaaauaugcccacucccagcuuaucauccugauuccuucggcuuuaugccuagcuuccuccucucuccucagcuuguaucuucuucaaaagaauuguuagaaagaagcuggguguuuugguacaugccugaaaucccagcacuugggaaguagagaccagaggaucaggaauucagggccagccucgacuacaugagacgugucuuaaagcuaucccuucaucuaaggauacaaauacagcagucuguacagaaagcucuaguccccucugggcggccagccuguucaacggcaacucagcaggccuugcagggucaguaagaagaugguagggccacacagagaagggggccugggaguaaauccauagggcgagcuacuuggaagaugguuagugagcuuucugcuccuggagcacaaaccugggauacucagcucauaaagaggaagacuuuacauuggcaguccauggucaccuaacacugucaccuuugaaccugugauaaagaaacucaucauggugggagcacaugguagaguagagcugcaaagaggaggaaaaaggacuaaguuuccauuguuuccuucaagggcauguagucagugacacaacaggccccaccccuuaaaauguuucacaggcagagaaccaguauuuaacacauggaccuuggcuagggaacacuuaccaaaucauaacccucuuacgaaaaccaucugaacugugguaguagaugcugauuagcacgaggaaacucacaacaggccaaguaagaaacuggggaccucagcccuaaauggaacaggagccauugcagaagacgggauagaaagaguugaagagccagaggcaguggacagcuuacaaggaagcagugucuucuggguacagcaaggcaacagagcauaggcacgcauaggaguugugacugcaugcaccggacuugugcagacccaagcccaguguggacagaggaguuggaccugaaaccccaccccuccuuaaggagcugcugggagaggaaaggucagucuuccccaggacugucccuccuaauaguggaaagaaugugugggcagcacagaauggucuugauggaggggaaaggcagacacacaaagguagggagguggggggaaucucugaagacuuugagagagaggauuaauaggaucaaaacacauuguaugaaauacucaaagaccuuauauuuguuauauauacuguggugguccgagccuuuaauuccagcacuuggaaggcagagagguuggcagauuucugugaguuugaguccagccuggucuacauaacaagacugugugaagguagacucucaaaagauaaaagaaagccaguaugggugguccugcugugaccaccaucagugacuccauucuaucuguggugcacuccucuguggaccccucccagcucaugucuguuucuccacaggcccuuuggacaagcacuucggcccuuccuggacuccauucagauccagccuccaggagggaacucugugggcagacccaauggccaaagcuaacaggacugcacgggaccacccaccucgccagggcuuuuccuuuuuaaacaaaacaaacccuaccagauuucuauuuuauaauuuuacaucagagcuaacagggacggcuuuuuaaauuucccagggaaggaguucuucaggcugcauguaggacaaugcuccugagaaagaucgaaugccaucccuucuaauaguauuauacuaauuuauuaaggcugucuugucugugaguucacuuuugacgcuguugccuaagcguccuccacacuggagagagagggugcuuguuuaaagagaaagcaagagucacagucugggagaaccccaucucggacccucuuuccagagaacacccacauuccacccagguugccacccugugggacccaggugaguuuuauacuguccauuccccuggagcagucaccuucuagcaguaacugaagcaaaggacuuggaguacauggggcagcuggaggcuccucacucaagcuaagugaccucuuuaaccacaaguuuacccuccucccgagacaaggccacucaucacagcccagccggagcagccgcagcgucaggaucaaaggagacuggcagcaggugugaggccagagaaaacaggagaaagccauuccuccuccuccuccuaucugagugccaacccucgaugcccaccccuaagcugcucuuccucagcguagcuugaccugucaccuuuaauaaaggucuaggcugcagcagcagagacacaggccuucugucugagaauuaguuauuuauagucaauagagccagccacucacacccuuauggguuugucagcuagggacuagggggacaugauuguucucccaaaacaagucucugauguagaaaauaccauaaugauguagauucauggugggaagaaaauuuggaguugucuccaguagggacuuucacauuauccuuaauacgucuccauugucauucugaccuuauggggugugguuggggugugagugggcguuuucuuaaugauaugcugcuaggauuucaugggcagcaauagccuagaagucuaugaucuagacuccagauuccagagggaccuuaagguucccuucuguggugucagucuucuacuagcuaauaugggaaacuggauauggagaagggagcucagagcaggcaccugagacucagcuccacacccauggggagccccccaccguggcuuccugccacuucugaaacuugagcccacuuguuccuuuugggguaggccuuuccucccugaaaagccccuauuggcucccuugccccuacccugcaggcuuugccacuagccauagcaguggcaucauggagaucucugccucagagcugaccuguugucugaccagagagagcuauguccaccuagggugucgagugguguuugggaacuugaaggucacagucagaaaggucucaggacucaacaguguacagguguauguggcugucacaacguagaguggaaaccaacagagacuguuuaguguuggucucuuuggcagaauagggcuuagaagguucaguguuuaaagcuugguaucugggaaggcagagguugcuggaagccaucacuuuuuccuuugccuggccccagcugguagcaucucugcccagagcucuguccuuagggugcucucacauggccauucucuguuuuucuccucagcaguaaccaugguauucugagacauuugccugaggauuuuagucacuuaauugcuugaauuaucuccugucaugucuagcagccauccaugccaacgucuguggccauggcuagcagagagaugggaagacuggacagucucucuggucuccuuucccuaugcaaguuccguugucaccagaaucccaggccaggaaccccacaucccaccuuuacauuucucugucccaguaccucaggagcauacuguucaugagcaggugacucccccugggcauguacaagcaagcugagaggaaaaggagucacgugguucaugccacauaguggacagcccuguccauuggucaguuggucaagggacaagggagguggaggcaugagacccuuguccgcuccuagacugaaggguuucuuugagauuccuucaugacuuccuugaagucaaacuaaugucuaauacggagguguuugcugcuuuucauugguguuuuuucuaaugcaauaaacucaugucugccugcugcugugguaaguugcuugaaucuugguaggacgcagccccuggcuuccccauuuguuucccucugagguuaaccgugcugccuuugcuuaguugaaaagcuuguggaugagugagggugguaaagaaaggugugugguuuucaccauuggucuguaaagauagagagaggacccagcaggaauacugcuauacugggcagaaggcaggaggaucaccauuaggcaugcguacguguugccccauuuuggcuugcaacugguaauagaauagcuucauauucuaagaugguccuccaggaucauuaggaacaauaggagaugcugcaagaauuuucauccugagggagaccaagcaaugucuagaccccuccuuauaaggucccaaugacaaaccaaaauuccauucuaccaaagguuacccuggagauugaguucauuauuaggcugcuccuagagccuucaguguuacagaaaggagugcaauagcucuaagcagccacaccucccaggaugcuuuccccucacagcauaaacagggagcccccuuuucauccuucccagacugcagacucucaagacuccagggucacaugcaacgagagcggaauuccaugcagcuaacuaggaaaagugaauacucuggagagcguccaguggccccuccccagcccucguaggagggaguauaaagucagcaagccgcagcugaucuccagggauaguccuccuaugaggggggucugauuucaugaaguagcaacugugugugcugguuuccucccuguccugaguaagcacugugguugccagucaguuuucuggaggcuucccugguaucuccaggugugcagccuagccagcuguauacaaaauccaguaggccaagccuguguugauucuuucccaacaacagcucaaggguagggauuggacccauuacacaagaggaaacuaaggcagagaagcauccagguggccacgccaucuuugaaucugggccauagucucagacgucaucacugaggcauggagccuuuccagugugcugguuucuauaaggcagaguacggaugguuuuugccugacauaccugcuuccuaagaacacacuaggcggauauuuuugagaucccuacugauagccagccacccaggcuacccgccuugcaggguguugccacuguagccagugcuuggcacagacugcaugcucaguaaacuucagguuacuaaaguaagcccuccacagccauuggcuguggguuuccuuaaaucagugccgugcacaggccaguccugugccgagguguagcacuaccugcuucuggagggaaaaaaaaaaugacagaaaauguguugccgggcaguggugucgcacgccuuugaucccagcacuuggcaggcagauuucugaguucgaagccagccuggucuacaaagugaguuccagaacagccagggcuauacagagaaacccugucucgaaaaaaaaaacaaauaaacaaaaacaaacaacagguguuuacacccuuagguuuugagacaaaugacgagccaaaucugggguaaguucauuugaccucaguguccccuuugaacuccagacccaggacccuucacccccuagccauuucccugaaagccacugcagagcggaacuggacucugcucaaggacagcacccaguagagaaggcaaggccuuguccaguuaggaaucauacugugggacacacccaggcgacaggagagccuuaaaugauaacaccagaugacagcacaguggcugagcagaggacugaacagcugugugggggcagggccacccaggggugugggaaucagggagauaagcgcugaggaguugcucuggggacugaugggaggugaugccgccgccacaggguaacaggaauuugggugaggaagucugugucccgugccucggucuauagagaaacacugaguacaaggacucagaagagccucuauaaaacaaagaccagaggcuggagagauggcucagcaguuaagagcacucacugcucuuccagaggucccaaguucaauucccagcaacugcaugguggcucacaaccaucuguacuggaauccgaugcucucuucugaugugucugaccacagcgacaaugagcagcucugggaccacagagccauuuuaugcugccucuuaccagcuccacuaagccugccuccagaaacccaaguuugauuuaagagguaugcuuugacuucucaggguuuuuuuucuuucaaaacaaaauuugugccagguugcucuucacauggaaucuguccugucaggcacaugccuugcccauaaucccaacacuugggaggcuaaggcagaaaaacuugucacaaaguauggacuuggcugaacuacagaacaagggcauuaaaaaaaaaaauuguaauaggguauaacggcaguaacgcccagaaaaagaaaguacaaacgugcuggauagaacaggccaagaacccagcagggaccugucacaccacugaaaggagugcccugaggagccuggggacacguccugguguccaguguugcccuuuuucuugugaaauguuuguaugcggugagaaguaugaacgccagggggcacuguggaccuucaugauaccccaggccucagccaaauucccaaggcuugccagacuccugugagccaggcugcucuugacuuucaagggccucaguggcuaacagccaagcucuuuguccccauuuuagaaaggcccaacugaaacuugucccaggacacuaaccaaucacacuggacccugucuguuacucggacccuuuuccaucuccguuucucgguucacaucuacuccaggcuggauccccuugcucgcuccucacccagcaguaaaggccagcaucagugaggccuccccaagaccuuccuccucuccccagggaagcccacccccugcugagggcgcauuucuccuacaguuccaccagcaccucccuggguaucaacaaggacuaagguucgaucggguaggucauguaaacagacaaacacccacuggggucacugagugcccagagagaggcccugccacaggguucuugcugauaacccugagacccuagaaccuucuuuacaucugcaaugaugauuccauuuccacacaguuguccuaggacccccauacgugcgugggcccuguuacuacacaugcagugccuucuguaguguauacaacaauaauaaguacauaaguaaaugcaaaagcaaacccucuggaacuccucuggauuugaaccuuugacauugagcccuugguuaaggccuuccccucucuaugccucauguucaucuguggcagacaaauguaucuguggucucuaagaucugacccgucuaacgguuguccacaccuagccugagcuguggcuuggucucaugcaccauccaguacuccggggcugcucuuugauccauagagaucuguucuguccccacuggcugaagaagucccaaggagaucagagacaacccagcaacagccuccacuccagcaaacagcaccugagcaugcgcacuuagcccuuguuuaacuucaguagacugcccuagugggaaacaccauacauuguaaaagaaaaaaauaacccaauagacccacuccacugaugggcagauggccuugcaaaggccuuugcaaguccauggcuuccuugcuccccacucuuccuaggcuaacccuguuaacccuaauaagaggaagugacugaaaagauccaccuguccaaggucaccagaaagagcagacucacgaacugucaugucagucucagcuggacagugguguggcacauaccuuuaaucccagcacuugggaggcagaggcagguggauuucugaguucgaggccagccuggucuacagagggaguuccaagauaggcagagcuacacagaaacccugucucaacaaaugaaaaaaauaaauaaaaaauaaaagucacaauccaggucucaaaaaggaggcugguggucccuaaauuauuuuuuuaauuaucuuagggcuagagggguggcucagggguuaagagcacucguugcuuuugcagaggacccagaaucaagcuuucauaugguggcuuacagugacuuccaguuccaggggacccaaagcugccaccugacuuccacaggcgccaggcgcacacaugacacacauucaaucaagcaaaaaaaaaaaaaaaaaaauauauaaaaaaugauuuuaaacuaguuuuaucuuuuuggguuuuuuugagacagggucucacuauguaaacuuuggcuguccuguccuggaacacucucuguagaccaggcuggcuuugaacucauagugauuuaauugccucugucucauaagugccggaacccaaggaguaugcaaucaugccaagccucuugccuuuuaauaacagcgagcagccaggagaaagcagggcauuuaaaggaacagaaacgacuggaagaaagccuccacgaaggagccaugccacgcagaccaaauauggacagcacuuacuguggacccucagucuuguaucuugacccagaagagcccaucuugucaagcugaaguuacagguccuuggccuauaguccugccuugcucugguugucaaagucacccacug

SEQ ID NO: 7902 - RNA, 20309 nt, Mus musculus
ugaacucaggucuucaugcuugugcggucaucacacuuaccagcagagccaucucccuguucccuuuuaaauuguccguauauguguuugcaugcgcaugugcgcaggugagcaugagaccauguggcagucagaggacaacuuauggaaguuaauucucuccuucugccauguaggauccaugguuuaaacucauugucagccuugauagcaagugcccuucccaacugagcuaucucacggccccuuuauauucucaauauauucauaguaaaauagcuuucuaggcuagacuaggcuuucauuuauagacuugguccuuacgccuuggggaugggagaaaugcuaagaaguuaaguaauugggacuaaauacuuccuggaaaaacacagguccuaagagagucagcucucccgcucacuagaguuacaaaauuccaggaaaugacugggauauagccucacauuacccaaaaaaugaauagaugccacauguucaauaucuaauaucuguagcuacuucuugccuugccaggagggucccuggcucacacgcagugagaugaugucauucacggcugauuuuaucaaggagcaagaaacacgaauaagacaaagaccaggccauuauuguucaaacaguaauguuuaguuguacaacagaggcuagcaacaucuacaugaccagucugagugucuguuuggcuuguuuucaauugggaaacuaaacuggaauaucaccaaaaacgucggcugggacuaacaacguuuuuaaaaugggccauucuugcauccccgaggcuugggccucuuguuccuucaggacuuguagaugaauggcccacaagucaccagccuuugagcaaguuguguccagguggagauggcaggugggguggcugagggaggguucuagaaagacacaguguauggggcaguggcagccguucguucgcaaacauucaugcaucugaugggggcuuugcccuccauuuggguauuuuccauuagccuauagcgaccaccuguggucaggcuaaugcauugcucacauuaacagggugggggaugggaguaggaauagucaggggaggugggaagagaucccucuuauugcuaaauguauaaaagggugcuauuuuucuuccuagaguguauagcugguggguuugggguaguccauauguguguuaaauucccuuucuuuuaaaguuuggggauaauuaagucaacuccagcaaccucuuuucagcaaaacccacuucccagauggccauauuuugggguaaacagguugucuacacacauacucacugggccagccaccaguggugauuuuuuuuuuuaagugacacuagccucuggcuccccaccauguauaaugaaucacccuuauaaaauaccuuuaagcaaugaaggagacacccuugucccacacaggggcucacacggcugaccucagugacucugacaagcaggaaaguugcuuucuugaccgguuaagguagccaagaaaguacucaugcagaaugaauggcuagagagcaaugccgguucccuuggagacaguuacaagucgcugguaugcgcuugcaagggcaggagcagcuucccaugaguuccuccucccuacacaaggacuggggugcugcugacacagaugauggagcaggguggugcuggcaggaacuccauuccauugggaggagaggaguaguuuggcuaaacagaggaagcaacuguccuaaagccgcagcuagccccucccaccuacugagggcugagaggggcugugcuggugggcuagacaagcacagcgcuaaaaggggcguggcccugcagcaauaacagcugggagggaugagggagaagcagcacuugaaauggccuucauucagcaguggggcaggggguggcugguacagguggaaggacagugcccaggaggccuucucccugcagggggaguugagaacgguugaggguguggagaccggcagccggcagcagacacauaaaacagcuucuccagggagagugagaccacagcuuaguggagacaggcagcauucuccuacuuagacucuccaacacccaccauucuuaucccuugcuggcccuaggugcccaaucccaugucaccauacagggcagcucacuagagcugucagcgagcucuauguugcuaccacucuagccugacagcuggccacucuuuagugacguuauagaugaggacuagagacagagcagucuccaggaaaggcuaagaccauaggauuaggaccacuucugcuugguccacugaauugugggucuuccaucucuuuuuguuuuuuguuugucuguguguuuguuuuccuagugacuggguaauaaagggcugaagucagugaagaccaguucuacacccaggcuggaccgggagguggcauaguggauagaucaguucuaaacagaauuuugugguaucuucccuuuccuauggcuaaauggcuuuccuuaaagcagccuuagaaacuguagggaaaaaaaaaaaacuugaaugugcaaggagcaguuaaaguaugcauuaauaaauacaaggcuccugagaaggcaagagaaggcuaaauguauggcuguggguauuccugggaacaucuacaggauuggauggugagagaaugcagggaggggagaagccgagaaagacagacagacaaaugagaacagagaaagagugaguuggguuuguaagaaacaaagccacagagaagccagcuuaacauggacagaaggcugcuagaaaacgggaaacuguguuaguuugucucacaaguccagccgccuaagaaacucuguauauuuuuuccgauucuucagaauuaguuugugaauauaauuuccuccaccuaaaguuugccucauuugcccaauagaugugcuucuugaacagaacacccagagcagcccaagcuaccaaauucucccauuuccccaggcuauucccaagucagagcaaauuucaguggucagcugcagaaacuggcuuuccuagucaucuucucuauaacugaauucucuugcaaucucggcaugcccugccccaugcuuuuacuuaggaucuuauucuuuuaaggguuuuuuuuuuuuuuaucuuaugcguaugagugcuugucuauguguauguauguacaccaugcucauagaggcuaaaagagggugucagguccucuggaacuggagucacagauaacuguaagcuaccaagaaggugcugggaacugaaccuggguccucugcaagagcaaaaggucccccgaagcacagagccaucucuucagccccuagcugugauucuaucuuaggguaauagaaagucaauuuagaaagucugggcaugauuucuaaauauagaaaggaagcuaacauagaugacucuaaaaggagauaaaaggucagagacaggcaggaaauggggugaaugcaugaauauauaugaagaaaggaggcaaaggacgcuggggagggagaagagaaaucaggacgaggaagcaaccaaccagccuggaaauacagggaaggcgggcacagaaagcagugguuugcagcggugaugauccgcuguuugacagugaccccaacauagacacaaggguggagcuccauuuucagacaccaauucugcaggagccccucagcuuucuucucugcuccccacgaaucuucuguuuccccaagaaguccuagccuuccuccagauuaccucaacuuacagugaaaaguuguucugagcucccacagcccaccacaggcuagcucagccaccaguccaugaagaauacuugcagccccaguuugugggugggucagaaguaagaaagaguugccuguggcucaccugcucccagcauuauaaauuaaaaccuuccccagaccucuugagugaggcgcacagcuuuuuguucuggagcacaagaaaaaaggagacagaauggagagucauggagaaagcagacuuacaaaggacuuuccaaagagggcaaugaaaauaccucaccccugaguacacgcauacauacacacacaugcauacacacacacaggcacucuccaucacacacacauacacgcaggcacucuccaucacacacauacacacauacauacacacacacacacacacacacacacacacacacacacacacacuagacaaaauacugcacaaauaccagacaggccugggggacagagcugagaggaggugguggcuggaggugguaucuaggauguguguguguuuggagaagggggauauguaugauaacacagagaagggcucaucacggguuacugucguggcuuuccucuguguccacgcucaccggagggaggccuccauugucauugagccucuuggcccuguaagucucauaguggauguuguguguuacuucuuugagguccuggaggugaguccugaagggacacagaguaaaaaaagagaagcagauaugauuagggaucagaagaggaaaaggugguccaccucagaggcuaacacaucuccucaguagacuggacccaaugacugggacccacccuugaggaccaaugucaauuuuacaaccccucugagaugcacugggauagagagcucuguuagagagggcagacauucaggaagugaaucugggcagauggccuuugaucauaaauaauuaaaugugccagcugggugagugugggggcguaucguaccugaugacgaagucucggagcagggcaaacucacagugguugagguuuuccacuacagauaaaacagaaggaaacggguagccaguucacuagugucggcccagcagcuaggccacuuuaaugagagcaugagguggguucuuauguggacuugucugaggcuuguucgcuagugcacugguucccuuccuuucuuucucuuccuuuucuuuuuuuuuuuacaaaccgagcaaauacuuuuaaaaucaggucuaauggacacgguacccuucuagacacuguagaauaaaucuuaauauggucugguuuugucccauuuuuuuuuuuuuacaaaaauuuaaugugggaguuuaagaaaccugugaaggccuguuauaguuucuuuucuaaagaaagaauaaagcuugaaagaagguaaaacacauaggaccuaauaacuggcccagccuauaaaggucacauucuacacaguaaauugauuugacaagaugggggaacugcugucugcaaaccacucaccaagaacuguggggacagaggaggaugaggcaucacugucuggucuggccuuaacgaugcauagauaacauucucaugaauaauucuaauucaaggcaaauaaugaaauaaaaucccaagcuacuggguauggugaagucggugacgcaccacaucaucucagcauuuaagaguuagaaacagaaagaucauaaauucaaggucugagcuggagagauggcucagcgauuaagagcacuggcuacucuuccaaggguucugaguucaaaucccagcaaccacaugguggcucacaaccaucuguaaugagaucugacgcccucuucugugugucugaagagagcaauaauguacgcacacauaaaauaaauaucuuuaaaaaaaaaaagaauuuguaucuuauauucauuugacaggccaaguaauugccaccuggucacgcguuaaauggugucauuguuuccugccugugacgagcaucucaaacuguaaguuccuuaaggguagccuccagcuggcaauaauauccuaauauucuagaauacugacacuuugaccucuugcuaguucauagcugcucuuuccuucugucuguccuguuccuucuagcugccuguccuucugggagaugcgcuggauuaccuucgaugaucccccaggguguuuuccucccgaggacccucuugccguucacuugguacuccuugucacuccccaccacggcgaagggcaugcucuccugcuggagaaggagaaaagcaaaaccagaugcacaugcucagugcuagucuccaaacugaguguccagagcaggacagccuuucacaucuuauuccuuugcucauucaaugacgcuacugguugcaacagcaacagugcucagccccuugaaaagacugagcuggggcucaaggccugggcccaacccugacuacauaaguuggcuuuucuucaacuagagagcacuuugaacaguucauuguguuugggcacauauuuucauuugauuugggaccacuuugggacucucucacaaacagcacccacccaggcgccagccagacucugagauguguuauucggcucccauggauccuacuggcagaugcccagguccugaacucucaggacucugcucugagauggggcuacucugcuccaucagggcaagcacccaaauggaucugccugguauguuugucauuggauaaaagagucauguguugcugaacgacagaguaaguuuaggaaaagaucaugggagacuaugccauggggugaacucauagcauagaaguauacaaacuaauaaggccagugaccauguuaccagaugauaugguugcugggaaacacucuuauguggccccuugcuagccaaaaucucuucaugcagcauaugaauauaguauguaaacugaggacacauucauguagagcuauucucugaauauuaagccaagugugagauagaugauggaagugaacuucuuuggcauuaagacuagacuuuggaagccgggcaugguggugcacgccuuuaaucccagcacucagaaggcugaggcaggaggauuuccagcccuuggucuauagagugaguuccaggacagccagggauacacagagaaacccugucucgaaaaaccaaaaaaaaaaaaaaaagacuagacuuugggcugaggguacaggccagugauagagcguuugccuaacugacccaagacccaagugcugagguucaauccuccacacugcacaaaauauaugugugucucugugucugaucuguauauauauauauacaucugugagugugccugucugucugucugucugugugugugugugugugugugugugugagagagagagagagagagagagagaggggcaaugcaguucacagcaccacaaaaacaugaaggccuauggaugugauauauuuuaaaggcauuuuagcuaccuaaaauauuucuucuccgacauuuaagauuuauaaacaucacuuuuaaaggugauuaucugaggcuggugaugcauaaagaugcuugccaccaagucugaugaccugaguuagauccaugggacccacuugguaaaaggagaaaauuaacuccugaaaggugucaugugagcuccacacaugccauaggcacauaccagcuccccgucacucaccccacacacaaauaaguaaauuaaugucauuaaaagggauuuuuuugccggacauaguggcacacgccuuuaaucccagcacucgggaagcagaggcaggcggauuucugaguucaaggccaaccuggucuacaaagugaguuccaggacagccagagcuauacagagaaacccugucuuaaaaaaccaaaaaaaaggggggggggauuuuucuuaagugaugaacuuaauucaguugucuuuuucaacgggcuucucuauaguauucaucuuucuagaagagucucaaaaaccuaagcuguaagagauuugauuugucacugaguacacaggcuggucaauaggcccaggugucugaugcagaagcaaaagauuuuuaauuaagagcaagaccuuagacaucauauagcugauagucuccaaaccugguucccuggugcagccagagccacggaaggcaucucagcagccgccagggcugcagaguucugugccuacgauggcccagccaagcagucuugcucugcugggguguauacuagaguucuaaaguguuuuguuuguuuaagauuuuuaauuacauugcuuguguguuugugugugugugugugugugugugugugugugugugugcauguauuuacacucgugcucucucaaguguauacagagaucagggaacaacuuuugggaguuaauucuuuccuuaugccacauggauccuggugauccaguucaucaggcuaucagcuugccaucaagugccuuugcgcauuaaacauaggucguuugcucaagcuuauuuuuuaaauaguucuuuuagggacagagaaagcccauaagccacucaccuaguccagccucuguauuuuauagagggagaaaccgaagcaaacacugacuagaguauagauuccucugggcaccagcccagugccccaucaucugacaaugguuuugccaacucuugggaaggaaggugaggcuugccuacuuauuugcugauggaagggaccagcucccugugcacaggaaaccccucugugagcucacaguccuagugagggucacugacuuccauaauuccuguggucuggguuaggugacaggacaacggcuuacaguaagggaagaacaggaggaagggccugaaggcacccccacccuacccccagaggcacugaggcgggcaucuggugacaaagagggccccgugcacauacccggauuuugucauucucugucuuguccuccaaauccucaucaaauuccuucugaggguagaauucaaugccguuuacuucaaguucuuugcgaaccuagaggaggccagauaguaaagcggugauaaucagucuccaugcagacugcagggcagcaggaggaggagucagagcacaggcuccgccccugggacguccagcaggcagggaagggugguaaugccgaccucccaaccucccuccagggcucucagcucuccuucaagaccagcuuccucugggaccucuucgguguuguuuuugguuucuuuucacccaaugggaacaagcagggcuuugcuaccgauuaguaaccuaacguuggauggguucucgguugaugaguguaucugggagccuuugccgaccaaguguggacugggagggaaaggcaaccugggacugauggccuugccguuggucccaggaacgucuagcccuugccuuggauggggaagugggagggaguuaggguggagaacuggaguacaggggaaguggaagacauggcagacaggagaugguuuggacccagaggagaggaaggcagcacuagagguaggaaaaggacagagagaucccagcucacccucugcuugaauuccgacuucuccuccagggucaugguaucagccuuggcaaugacaggaaugauguucaccacuuugcugagauguuucaugaacucaagauccaguggucguaagcuggggcccagagaaggcaggaaggucagagccacauccccuuccugacucagccacugccaccgcgccagacugccugauggcccugaggagcggacuggucugggaaccuggcugaagccaggcagcugaggcccugcagcugcagccucuccucuugcacaugucuacugcuucagcaccugcugcauguccccaacuuuguccucaaccccucagagucaagcucccucuuaucucccucaguuucuauacaaagcaucccucuccuuaaacucucucaaaccacccgagacaccuucccugacccaagaauuucuuucuuugggggacaaacauggauggucaucaccaacugaacucuucucaauggccuccugucaguccccacagcucauaccguagaggcaagcucuagccccccacccccaccccagucugacucuaguuugcaaucuggggauccauuaagucagacugucugacaguguccacuaacuguggacugaggucugggaagagcuagcugagcuaucuugcuagcugagggaggaagaucucaauuucaaggccagccuggacuacagaguaaacucaaggccauuuuggacaacuaagugagacccugucuuaaaaagcaaaaggagggccaggcaugguggcaccuucaaacuucagggucuacauccucucaaaagcuuuaaguucugaccuugcagaggggcuuagagguacacaguaccccgcaggagggugguuggaaacauggaugagaugucuaaccucugccuguugccacacucccuaucccaccugcugcuuacaaaucguguuccuggcacagucucuagaugucuggcucccccuacugagauggccacucuagcuagauucccacagccaaguuccacaucuugccuaaauaccaagcccaaugcaggagcccugguucucucugcuucaccuuucuugccacccccauaccccugagccuugcccaaagcaaguaucauugagcaaacgagguacccucugcuuaaauucucucugcugguacagcugggcuguauggagacaccggugagcaguauggaagacaguaacagccaguuuuacucuuucuuauagaaagucugaggaacccuaaggucccagggccauggccuuccagccaucuggcucuccccagcuaaguccagcuauggcgucuccagucuauggcacagaugauccaaacuggagccaggcccagcaggaggaguaggugugguacguacgaguguccugucggggagaugaaguagaggcagcaguggacacgggugucagggaugcguuucuuccuggcaauguucaccuccuccuucaggaacuuuucguacuguucguugauguauuucucaaugggcucccagcugaagggcagggaaaaaauagacuguuuguauaugcuuggcccagggaguggcacuauuaggagguguggccuuguuggaguaggugugucacugugggcgugggcuuggagacccucauccuagcugccuggaagucagucuucuccuagcugccuuuggaacaagauguggaacucucagcuccuucaguuccacgucuggccaugcuccugccuggaugauaauggacuaaaccuuugguccuguaagccagucccaauuaaauguugucguuauaagaguugccuuggucauggugucuguucacagcaguaaaacccuaacuaagacagaugggauccacccaaagauccaaggacaaaacuccagcguggcucugaggcauagucggggcacaauuccgcacucucuccuuucucaacccaacggccagcucuuccucagucucuccaacaaauggcuuucgauggauggccagcaagaauagcucccaugggaccaaacuccuugucaagggaggauacagguaguucucagugggaaugagucuucaccuugccuuccuagcagaguauuuaaggggaagaaaaucucagaggcaggcacauaccaguuuucauuguugaucuggucuccaaagccuggugugucgaugacugucagcuucauuuugacaccaccuuccucuaucacuagagagaacagaaagcaucggagguccugcgguccacuagccagcaacacccauacuucucagaagcagcuaugugcaaagucaagguuacagacuucucccacuuagcacuuuuacgcaugcuguucgauacaccuaggagauugugccuggcuucuuccucuuucuacuucuaucuaaauucucccugggcuuccucguucaagaaccaccgcuuucaugucuguauccugaaauacacacacacacacacacacaaacacacaccacuccuaccucacuaggccuagcacccuaaggaguuguccaacaaauuuggggcuuaauuccacauugcaguugucuuccacaucuuaguccccacuaugcccccuuccuuucucuugcuuggcacagccccccccccacaccgcgcgcgcucgcacacgcacacacacacacauacacacaaacugauguccacagaggauccuggccuaguucucaccaugcccaaucgcuuugaucuccacugucuuggggaucuucuccucccgguuccagcuggaggccuuucggcucacuugggacuugaagaggguguugaccaguguugacuugcccaguccacucuggccugcagcaugggaaagggagacagaaaaagggagacaggccccacaucugccuccugagcugcagagcccuccugugcgcuuacagaacuccagagcuguaguccaggccaaaccuuauuugaacaccccuugaggaaugagcacuggugucucuuuaacgcagaggggccuuggaaaaugacaguuggauuccaugucccuucauggacuccaggaccauggggagaaagcacaacuugugcauguggguagugugggugguguuuucugguuugguuuggcuugugguuuuacucaacuuagcuuuucuguauuuaauaacaguaaaagugagaacagaagaguuacuuuacuuucagauccugacucauggugccugagcauuuccacaucuguuaauaaaauuggucuuuuuaacgccccucccccaaccaaccggugcuggggacugaaaaccagggcacugugcuugacagucacacagaacuaaaucccuaaccccuaaaauuauucuuuauaccauccuuguauaucucauaacagaguuauaucccuagcuaagauagcccuagaaaccucuucuaauguaacauguaugaggcagcaaugagugaaugcaagaccagggcucacaccccaagaaugaugccacauauacauaugcauauacauauacauacauauauucuguguauauauguauguuauauauucauguuguaugugugugcauauauguguauguguguguggugugugguguagaucuguauauaugugauguguguauuauaggcuauguauggauggauguuauaugcucauuuauacauguauguauguauaccuaaguauguguguauacauaugugguaugugugauauguauacauacuauguaugcaguaugugugauauaugcucauguguauauaugugugugcaugcauauguauguauguauaacauguguauauauguguauguauguuauguuuauguauauauguacauauggguagacauaugggaguauauguuauaugcucauguauguguaccagugcaugugcuugcagaggccaggagaggacacugaguguguaucacuccccaccuuauuccuuugagaugagaucucugauugagccuggaguuaggcugguaaccagcaaggcccagugagcuucccaucucugcuccccacggcaccagggccauggguacaaguguagcuggcugcaccuagcuuuuuauguagaugcuggagauguaaacucaauuucucaggcaaccggugcucuugcuuacugagccauccuucuaaccccccacuacuuuuuaaauuguguucugagaaggccuaaugaccuauuggagaaaguacugggagaggagaggagaggaggcugggcaggcaggaccacagcaccuuccuccaugauggcucccuuucugccuguguuaguuauauagcucugccuucaaagagggccuccaaguacaagcucgcucaagaaccacaggucugagcagcaguuuucaugcguaagaauaacucagagggcuggugagauggcucaguggguaagggcacccaacugcucuuccgaagguccgaaguucaaaucccagcaaccacaugguggcucacaaccacccguaaugagaucugaugcccucuucugguguaucugaagacaacuacaguguacuuacauauaauaaauaaauaaaucuuuaaaaaaaaaaaagaauaacucagaaugccucguagcuggugauuaaugcugccauucgcccagaugccugcagaaguuccaccucagagccacaacucggaaccuguggcuuagcugggcuuuaagaggaauuaacuggaugguaaaaccgagaagggcuggucuaaagcaucccugugguauguugggguugggggaggggggggaguggccaggcagagaggaaagagcccgggguucuacacaccaacugagguguucccacugcuuugggcuugucaugugaugccugcugucucuuuacagauggauaaggaaggaagggaccagcagagacuaggaguggcaaacagaugcauuuucucaugccaccuggggaguuggcaaaagccacuuaaaccaucauguaaugacgacucuauaggaaagagcucagcaaguggaaggccucugugugcagagcggaguguagacgggaacugguaagagcugacuuggagcagcucccagucaagagggagucuaaauuuaucccgagguuaagagagagcuauggaauuaggauggaugguccaaugaguucugcagguuggaaaagccauuggguagccaguggacaaggaacuggagaggaagggagaccaggagagucaaggucaccacuccaacugucccacagcccagcuguaaguguccaugagccaacugcuucugguucuugugcuaagacuuugguaggcaaaaguuaaacaucugccucagagagccacugucagcucagcuggugcauuuguagcaaacugcugggaggauuucuaaccuggccacgguucuuauccugcuccaggucaguacuaugugagcaacgcuggcuuggguagcugcaguaauccaggugagauccuagcucugccuaggguugugguagagggaugggcagaagccaacacaccuaggagaccuuuacaaggcuaagugacaggauucgcugauuggacugggagaagaagggagaagaggaugccucgcucucuguuugcacacucagggagcaacucagauuagacaaaugcuccuuucugcuacauucugugacucacuaaugcuacuuagugaccaaaacccuggaaaaauuugaagcuuuacuguucuacaaaacaugaauaauaagaccaucucuuucuggggcuggagagauggcucagcgguuaagagcacugacugcucuucugaagguccugaguucaaaucccagcaaccacaugguggcucacaaucaucccuaaugagaucugaugcccucuuguggugugugugaagacagcuacaguguacuuacauauaauaaauaaaucuuuaaaaagaaaauucucuuucacaguccucccacggcucuuggaggugggaaaaggcuaccccauuccaggugagaaaaggcuaggccaucccacaaaccuaaaagccagcucagagugaccgacagguagccugucuacacuguuaguggggaagcuagccuggccauccauccaaaucuccuguccuugaaucagcagguuaggaggggaccaggcccuugugaucagcaucugaaauucucuguccuagaaagagcucacccuagagaagccaggccauucuggggaaagaaaugggauccugggugcugcccaccacuaggccuuccgugaccccauggcuuuccauaccaacgaccaugauguugaagucaaagccagucuucauggucuucuugcgcaucugcucgauaauggugucaaugccaauguagccuagcagguuggaguugaugcugaccggcuucaugggcaccgccggcuuaggccugggcucagguaccagcucagacauggcugcguccguccuagccucugggagcccugcaaagccaaggugggagagauaggcagggugagcagcaagagagcaaggguuucauagaagaccaagaguaucuugauauggagucauggcgcugggacuagaagagaccauaacaucauccggucuggaucccacacuggauguagggaaaacacugauguccugaggacuugcucaagaugagcacaguuuaggucagugucaaaaucuguuccaguaugcaguucuccaggguuauuuuuaucuguuuucaccuuaugcauaagguaaguguguguaccauguguacucagaggccagaagagggcacuggaucauccugaaccugcuccaaaguacuacaucugcaugugcaauccaagggccccuuccccuuagcccuacugauacuuggguaucuacuguagcaggauugacugucuuaugucugcaggauaguuacuaagcauccacagucucuacuaguuuccagaaggagucucucagauauggccaccaaaaguaucucuacacaguaccaaauauuuccuggaggauaacuccauuccaaaagaucacuguuccacaagacaucucaguuauucagaccuacaucuuaccuugccaacuauggaauggagaaccuuuaggguaguagaucuaugucucuaggucuaguaacugucaagggccucaguuacuugggucucuuagaagccaucggagcuacccuucuuugcagaauguuacuccaccuucacccucaguuuccccucugugccaugaguugcguggcuggugugcagcggaggauccccugacacccuuccacaccaaguuuugggucuacagagcccauaguaaggacugagacccaaacaaggauugcuaucucccuaugaugacacuuucauaccaguaagccacagaagagaaggcugagaaaacagcccucccucccuagagaagaucaucaaagguccccuuggcagacccaagauguguucacacauaggagagauguagcagggucacacugcccaacagaguaaguccaagaagaaagcaacuccguuucccucucuguacaguggggggggggggguggugcagugaaagagaucuuagcucugcugucugucagcuuguugacuugugugggccacuucucuucucucaaccugcuucuuccucuggagaauggugguagggccacgaugaagacugugaugggcaucaccgugagguacgaugcucacgagcccagaguauaaccucacagauccaugccuugcccuuuucaaguucggcuuucuggagaggggaagguuugaagcugugcacggggaauguauuuaggagagggagguguccccagcugcuaauuucccaaacauauucucugcuuccauguucucuaagaggcuuugccaucuuaggguaguucaugacuaucgcccugcaucucagccuugugugugaggagagucgacggagcagcagauggucaggaggaagugggaacgugucucccuccccaccgccaagcccaggcaaggagucugcucugguacccccaccaccugguccuucuccugguacuggcaagaugugcuuccugauaggaaacucuucuuuuccccuguccuccucaggcacagcuaaaucugacaaagcuuuaacaccuccccagagccuggcucaguucccuccugcuucccaggaggcuguugccagccagguggcuccagagggcagcaagguuggcucagcccugagacagcugacucugaauagcuugagccugcuccuccacuccauacauggcucauaugccccuuuagcacaucugccuuggaaaccaguuucuucuuccugcuguucccacagccuggcccuuuugguuuccugccugccugccugccaggcacauuugguacccacagccugugcugugacacaagcaaccagggaugcaggcaaggguacuuguauauguggaggucauaaguaugcuuacaaagcauguggucuuacaucguggccuacauggcucugucugucugaccuugauugaaagaggaagcugaccaaaugcccaaguaacuccuuggccaauuugauggccacgcugcugugucacaagcuuggcuggaacgcccuguccccccucaagaucccagcuaaguaacaacuccucagugaaagccuucccauuugauguggugggccccucacugugggcugccuccauccucuguagguucuacaguaccuaagcguauccauucauuccaggacauuccauaggcugucaagcgaaagcccaacuaaaucaaccacuacaguaaaugccaaggauaucguuguauccaagacaaggucauuguccuggaggacccacugucugugaggggaccuaaccaguagaccgcucuggaguuggucucuaugggagucuguucuucccauuccccaggucccaccaggccaucuuuggaugggcagcugacacaggcaugaaucccagccuaggguuuugguuuugguuuugguuuuuuuucucagaagauagggggauguaccugccuugcuugcuuggccuacugugaaaaccaugcauguaaaugccccgucggugaauaugugcaaguuccuagcccucuucgaggaaggagccaugccuucuuguucucuguccccaacgcaccuggcauaucauagacucucaacaauggauggauggauggauggauggauggauggauggauaaaggaugguggacggaucauagucccaccaggcaggugucccugcagacaccucucuccuuccccagagcaccuggaccccacccccaaccaacaaauagcuguuaugugcgccacagucaagguagguacaccuauugaaaccuccucuguccucugcaucugagauuggaagggggcuccccaagaauagagaaagagcccauagcugugcucauggcagaaagcagcuagaugguccuuggggacccccuccuaagcucccagcucacccagaaaagggugcaucugucugcagcacucccugcuagguaccugccacaccagagcuccagaaagagagacaguccaccugacucagcucuggucccuccggacagcagacuccaucccuaaggcaagcaaggauauagugcuuucuacuaugggaaaaugaauggcucugucuuugucuggaccagaaaccccaccccucuguuggaaagguggcaauaggagaaggagaucuuucagggauagugccuguccccuuagcuuauggcuagggcucucccuucccaccuaagcugaggaaucauccauucccugauaaccagcagccuuuaagaucccacacccaucauagagccaauuccaguucaucccagcuccagcccugggcagcuccaaaaaaagaaaaaagaaaaagaaaagaaagaaacaaauccuucuccauuaaaagaagcaaagggcccugggacacuccccuucccccauucuagucaggaggccaauaguucccuuggagaccaccagcuggugccugucucugugcuuggucucuguguggggggaggggacugacuaaugugucagcgcacaggucucuuacugguuguagguggucugguacccgagcucgagcucggaguucaugcugugcgugugugugcgugcccugcugugccccagcggaggcuuucccuaagcaucugggucuccauaccuccccaagcuucucugugggcuuuugcccgagacuaugcuuccaagugugugccaccgggugugcgugcguccaugcauaugucacacugcacgugggguccucagcacagcaaacccucccuuugguagggcuuggggccgcagccuccuccaggccgaugccaagcgcccaggcgacagcccuaccuuuggacaugaauccuccuuugucucggguccuccgggagaugcucagggcgcggggcugcaaggcugagccgggcgcgggcucucccugggccaagcggccccugcagccgggccucgccccucggcgccguaccgccuacccgcccgacccgccacccggccgcgccgccccugcgccccgcgcccgcccgggaccucgccuccgcucgcucggcgccgcgccgccccugcccgcgcgcaccgaugccgccgcugccaccggcaccacgugacccgcgcgcaggccagccucgccgagggccccuccccuucccgcagcucccgcgccagcacgagggagcgggugccggagcuggggaugcucggccggguaaggugccuguaucccaguccuugucugucuccuuagagccuaucccuagccccuuaccagguccagggcgcaggaggcugguggcagcugccggcgaccgugcgcgugcgugagucacgcggugauugggauauugcgcuggaucgccgcgguucugcccaggcgcgguugcugacugagcuccgaaucaagagaacuggguuccagacccagcuccca

SEQ ID NO: 7903 - RNA, 10152 nt, Mus musculus
cgcguucugcgcguucccgaggcgcgcucccgugggaagucggcuugggcgcccugugcgcgcgccgcugugccucgggucugguuggaguccuccguccuccgccccagagggcgggggugguggcccgcacugcccgugcucaguaaguagcugugcagugaauuccuacagagggcgauaccuugcucuuuuuuuguuuguuuguuuguuuguuuguuuguuuuauuuuguuuuguuucuucgagacaggguuucucuguguccuggaacucauucucuagacgagguuggccucgaacucagaaauccaccugaaaccuugcucuuaaccacucgaaaacgguagugaaagaggcugggugggguuucagcucucgaaaggucaggaggcugcccccuccaccugacacccaagggguuguucgcccacccacuccccaaauguauuuauucauuacuuauucauauguuaaacacaggcuaggugccaaccacuauuucuggaugccuuuacaccgaugaugaucauagcuguccccucuccgaaucugugccauuuuccuccuaucagguaauggcaaaccgacuucucugccaaucuuuucucucagccuuuacaugcaauuguccaaaaauugauuccugccuuuaaauuccaccucucaucccacccaguaacgcuggccucauuacauauugccuggaugauucggagacagcccucaagggccuccuuuguccaccuuacuucuccaaggcagccaaggcaaaccugaaaacucagcucugugggcugguaagauggcucagugguuaagagcacuuagugcucuggcagagcacgaggguccgucuccagacucacaugccaggggaucugaugcccucuucugaacucugaggccaccaggcauucacauggugcacauacaggcagauaaucgggcacacacuuaaccuaaaaaaacgaacccaacccagcccuggucuugucucucugaagucugugugauggcuacucucuuaguuuggggaaaugguguuucuaaaccccacccucuaccuuuugacccuauucccugccgucaucuuccucauugcccuccuuguggccccucaaacacagccuuugaaccagcugugccuucugcuuagaaugcacuucuagauaugggcauagccgacacccucauuucccuuaauuauauguccaagugaggucuacucugcccauucuucuauuuaaaaacggcaagcucuccccucccuccucaggaaacucaugcuguauucuccccuuacccacccucccgcgaccuucaccuuguaacacauuuacucuaguggauacuacuaguugaagaaaaguuagugaacauugcagccaccaaccaccacacuccccccuuaaaacauccagcaaaauguaggguaugcuuguuuacauugugaggucagggaggagaccucagagcggacagcugagaccuaaaugucaaggagcucuaaguggggguagggugagaggggagggccggcugggcuucaggaacugcaaagcaaggguugaggugggaauccacaaagcccgugggcaggcaggcaggcauuugaacacaguugcauucagggcgacuacgggaauccuggucuccuaucuuauuagugcuuuccccgcagccuucccugcaagccuauggacagacuccagguagagccucaggaccacaaguggacugcagaccugcguuggugggugauagaagccgaaauggccaauaucuagaggcagagauggggcuaagccaaagacuugguugagaaccuuagcaggguuuugcaggauguguaggagcucgcuuuaggaagcgcccuaucugaugauuugucugguuuggcucugcacgcgcgagagggaagagaggggcggaucggggagauacuggaugggcuguaaggggaaacuuuugggggaaaaagagcacuccuuauucuucuucgguguagagcuggaggccuguggguagccugagguugggcuugggguucgagacgaccccucaccgacgaguccuguggcgcaggcagguccccaccuuccagggccucaguuucccuccaauaugcgagccgaggcgacuuugcggaucuggaggccugguggguacugggcggggagcggccggggcgguaccccgagccucccgggcggggucucccggcuccugcggccacguuugcgaccugggcggaggccgggguucagagcgagaaagcccagggggcgacagcaucgcacucgacgggccaggcccucgggcgccggaggugagagccggucaggcgggcuccgggaggaggugaccaggagggcguggccguggacguggcuggaaagcccgggcgggauccaggggacccaggcaccagcagggcugccggagggagagaccgcggccgcaggcgugcguggacucagccccuccuuggggcccacaaagggcagcggcuagaacagccuuccucuauuccaggccugcuugcuucucucucuuuggagcccuucuuccccucccgccuccuggcuacguuuuuuaucacucacuacuugauuaauucauuauuuauuuaauuguauuugcuuacggagugucucuuuugcuggaaaguagauuucaagaggacggggaccuaguuuugucuacugaugcauuccuacaaauucagcaagucugcacagggcugauuauuggcgauuuaaccacucuagauguccugcaaauagggaggggaggugcgcgaaagggacaaagccaaauucgaucuuuggguacaucaguaaucaggagacuucuccccaauaucguggugacggaaaucccauagggacagccaggaaaucuuaacugcacuuaacugaccuaccuagccccagggagcccagaauuacagucaagagacagugggccaagacauacagggaacuucaguugcccuacgggaugagcagauuaugaaaaggaggagcgcuuccggcaaaaggcugcccuuuuacuggggcccugaaguuagaacaguucucacguucucugagaacccuuuugcaggcucucuggaaaccauguggcugagcugugugguuagauaagaggccacccuguccccuucugugacucugcugauaagugugucaccaacaaggccccaccuagaaguuauaagaccaagugcugacucuuccucauaugacccuugccaguucagcuguauaggaaccuuggagcaccagaauuuaguggcuaugucuucagugccccaggacacaccgcuggaguuuacagagccggucccauucaccccuggucaccuccuccuuccucuggugcucguuggugugaugugguuaccccuagguggucucggucacuggccugucccuccccugccuccaucuggcucugaaaugugggcuggauaccacuggggcuaguaggggcucaggaaagucgugggcucccuggagguugagcuuacacuugcagugaggggccccauguuuaggauguuuaaagcacaaaagugucuuugggccuagggucccuuucaucccuccccagggguuauuucuuuggguuaaaaaaaaaugucaaaaggaauauccagguuagccagggauaugguaugacccagccugaaagccaugauuaaaaacuacagccauaccacccugaacacgacugaucuuguuugaucuuggaagcuaagcagggucgggccugguuaguauucggaugggagaccaacugggaauacugggugcuguaugcuuaaaacaaacaaacaaacaaacaaacgaacacccagaagagcuggggcuccgugugcucagggcuccugccuucaaaaccuagcaugacagaagcugagcaugggguagguaugcaggaagaacugggcagauggggacagucagcucagaagcugaauucagaucagacauccuuggcuacauagugaguucaagagcagccugggcuaugagacucugucuucaaacaaacaaagcaccauguugggcucuucuccugauacaacuauugucuuuuuuguuacaguguuuugauguccagguucuuuuuuuuuuuuuuuuuaaauuuuuuuggugacccuuauaagacuuuugagaugaaaggcaaggaagacuaguccuucagcugaagucugagaacugcaggaacauggucuguaggagccacaggacugggcugcuggucuucugagcuggguccuucccugcgggugcuaccaucucucuaucucacuguucucgugggagccaugaagcugaacaagaggaguguggcccacuaugcgcugagugauucuccggcagaccacacuggcuuucugcguaguuggggaggaccagguuccccacccacucccaguggcacuggccgaagauacugguuuguucucaagggcaaucugcuauucucuuucgagacuagagagagccgggucccgcugagucuugugguauuggaaggcugcacgguggagcuggccgaggcuccuguacccgaggaguucgccuucgcuauucgcuuugaugccccuggagugcgcccacaccugcuggcagcagaugggcaggcugcccaagaggcaugggugaaggcacugucccgagccagcuuuggcuacaugcgacuuguggugcgagaauuggagagccaguugcaggaugcccgucagagccuggccuugcaucgcugugcaucccagagggcuguugccaauuguaguaaaucucaggcuccugaccaccgagcuccagacccugagaacggccacuuucuccccagggaccgcaguuccauugguacuguggaagaaagggggauccggccaauaggucgggauuugaccgagugggaguuacagggcccugcuagccuccuccuaagcaugggacagagccccguguccccugagagcuccuguuucucuacccugcaugacugguaugggaaggagaucauggagcugaggcgaggguggcagcaaagggcaaaaggaagccagacagagaacaagucacagaauaggcccugagccagagcccuuuaagcuauggcccuguccugcuggucaggaugccggggucagaacgucagggguuaaauauuuacucauuuaccagguugcucuguguguguguguguguguuccccugcucuguagacuuucucuagcuuccagauccuccccucucgcuggcaugaacugaagaaucauggcucccuacuuauuuucugaggucuagaaaggccaggugguugaugggaagauaauauaauucaggaaguggggcucugcucucuagccauaaaguccaacacaagaagucuugggcaucuccaugccagaggugacaggaaguggcuugaagacugacaucguuguagcuugggcagggcucucuguaggagaaggucuuuaggugcuaaagagggauuuguucucucucccgcugcugcccuguccauguauagugcuggacauugcccgcagggaggcaggcagccuuuuauauagaagaccugaccugucgucauggcaacuuguagggacucuuguuaccuagcccgcuuguuccuaaggcuugucugcugagggcucucauagcuacucugucccgugucauuccaaguaucuuuuucuuuagcucuaaggucagauggcuaggucuacagagccagaaaccaggcccgucuguccccuuuauauagauguagugacaguggcuguggcucaauagagauguauaccguucccaaacaaaauuggacucuuccugaccucccuccuuucccuaucuggggccuugggccagccugacccaaauccaacaaggccuaaaggcuggauuuugccuccaggagacugaguuccaugguuccucuggucagggcuauguuucucaagccugcuuguaaccucauagccagcugcccucacuguacacacagguaccuuugcuaaguuucuugucacaguaguuaguguuugcucuuuuaauaguuuugguuuuuggagaccaagucuuuguagcccacgcaggucuggaacuccuuagcauggcaaucugcugggauuauagauaggagugccacaccucacuugguuuugguguuuguuuugcagcaggaccugguggaaggccuguuagccuccccuccccccuucccuuuauaaccagaacgguaaaguuccccgguugguagcaaagagguggaggaggaucaggaguucaaaagcauccuugacaacaccgcgaguuuuuuggcuagauugggcuaugugugagacccucucagaaaguuaauuuugguuauuacaaucaacguguuuacaaaugaagaaucaggagccugaguugcaaagcuggugucugaggcuaacaauugaguccaagaaccuggcuuggugguaugaccuccaucaggccaauccgucuauuuguuuguucccuagaucuguaggggaagcccgcuguccacugcacccauuguaccaauguccacagaaaccaugagcuauuuauuguuaacuugauuuuuuucgccgcacuacguagcuccggcuguccuggaacuuacuggauuugaacucacagagauccuccugccucugcaucccaaguaguguaagauuaaaggugugcgccacuucgcccagcuuuuuguuaacuuuuuguuaccuuaaaaaaaaaaaaaaaauauauauauauauauauauauauauauauauaaauucagauaccaaguagaguuuuucauuacacauucugguuccuuaauucaagucuucccgaggugaggggcgggaacaccuacaaagggagcccuggcggccccgcccucuggaguccgggaggggcguccuucuccugacgucacuacgucguccgggcgccgaggacuuucccaccggcauacgaaugcgugcucugcgcaggcgggagggcggugcuucccgugugugucacgagucucgcgaguuuuggagaaaguuucugccagaggccgccuuggaugcgugggguguggcucccggcgaggggcggagcuggagauggcguccacggcggcucggcggcuggccuggguugcaguucgacccggggcucucuggagcgggccgagggggaggagagguggcgaugucuacaccguaccgggcagcucaggucucagccagguaccgucgaggucagucaucgucacucgcagcggcgccauuuugcccaagccggugaaagugagugucugucuugaggcgggacgaagggauugaggccggugauugggggagugcaugugaccuguccugauugacaggcgcagaggccaaucauaguauuggcauagacuggggaccggacauaggacucaauuugugcagcuggguuuugcugacuuugacagguggaggaaaauguuuccauaaaacucacuguuaagcuggguuccuggacacagaagcuggaaggcagcagcgaaaugugcaauuucuuaucuugagggacauaaugaccuauuucuucagggucagaagaaaggcuuugugucgauuuauacaagucaugcaaucucugccucaaaggugaugggauaaaacaauccugagagcuggagagauggcucagagcuuaggaacucugcucuuccagaggacccagguuuaacucccaucaccacaggacagcuacaacuaucaguaacuucaagaucugacaucuucgcauagucauacacgaggaggcaaaauaccaaugcacauagaauaaauuacugaaagagugggaagggaaugcggaaguaauauacuuaguaaaaaggaaaugaaggagaacggauagggggaugugggagcaggaccuucugugcugaggaauguguagguuuuacagaugaagucagggcagagcccugaagccagcauccaaagcuaggaguuaggucuugacaaccagagaccacauccugguuuuuccauacuugaacucuugucacuugcccucgguaccccaaaggaaaaaugggaagucucuuauaccaaaggugugcuuuuugacggcauggccguauggagucgaagggaaaacaaaagucuuuagagcaagccugagcgguagcaguugaccccagucaggguuccagcgagaagcaaaaaugugcagcugcuguauaaaaagucacagcuaggggaagcaggaagcuaauaccggugaaaucucauuggcauuccuuccguccauguugccuuugcgagcuuuuaacauuaauugugaagcaagguugcucagcagcaggagccagcuaaaagagaaggaggugagaggccccaucagugcacacaccuccuccuaacucgaguuuuauuuauguguaugcauguuuugccugcauguaugucuguguagcacuuaagugccacaugcccacaaaugcuagaagagacugugccauauuggagcuggaguuacuugcgugugagaggccacgugggugcugagaaccagguccuguagaagugcugucagugcuccucaccacugggccaucccuccagccccggaacucacuuuuggguggagagagcugguuagagcccagccagccuaguguucucaccuaacuuuguaugguucuugcaaggaauuagguuuggccccuaauuuugaguugcuuaguuuccuaaauuuaguuuagcuuuauguuuuucuuucugauauccauuuugguggccauaaaacucacuuugucucuucguugcucugaguuucuucaaagacuuuaaaaaucgagugguguggggaucaguaguccauuggaggcuugggcgcagccacuggucucccggagugcacccauucuucucucugcagauguccuuuggucuucuccgaguguucuccauugugauccccuuucucuaugucgggacacucaucagcaagaacuucgcugcucugcuugaggaacaugacauuuuugucccagaggaugacgacgacgacgauuaacagguaauccuugcccuucuuguaaaugggcagaagcagcaggcggaugaucugcucuguggugcucuggccugcggcaccaucugaacccucagggcaggagcagcaguggguucaccacucgagacuuacucucucucauguuggaugacuuacacucccacuagguuaagguccucaguggccuucucauuguccuugauggacuucagucaacugacauucucuuaaugugcuuuuuauuucaugaagucaugcaaucucugccucagagauggagggauaaaacagcaaaugauggaggagaggaaagggaaugcagaagauaccaguaaggagaugggcaaagggugauccaggaaggcauaccacaggaacucucacuuccuacuuuacauuguuaaagcugcuuuguaugguuucuccuccucccccgcuguuucuugaguuacccacauccuuacccaucuccaaguauuggcccauccuccuuccaccguguaauccugucaucuuccuuuacccuauuuggaagugacugcugcuaaagccuggugugggaucuugagcuuuugugaucccagcacugcagaaguagaggcacagcucagggguuaacaggagaacuuaucucagaaaacagaaaugccccaggccugguggcacacagcaguaaucccagcaccggggagguggaggcaggaacaccagaacuucaagauccuccuuggcuacagugggcuugagacuacucugggcugugcgaggcugucuuacaagugacugaugcacgccuuucuuacagggcacagggagcacaggagaaagcacugaugaugugguggcaugcucagcucccucccgucggcagaagggucaaggaaagcccucagccucaccuccucaugguuugugacaagagcccagaguccugugcuuugggaggcucccucacggcuguccacagaguacuggaaauaacaagcaagcaaauuaggaguguauaauaaaugagucauguaugaugagaggucguccccauuucucacucccag

SEQ ID NO: 7904 - RNA, 531 nt, Mus musculus
cgauucucccacaguggaugugaaaugguaacuuuguuacugucucuguacuuauguauauagcuuccaagacuuggcagcaaggcucuuccaucagagggaacagagcagcacuguggggacagcacuagaacugacugcccggaggcuagcccuucugcuuaggagcacuggucugcaaaugagcuuagcugccuccucacugcagagcacacuagucagugcaaacacaacacacugguccuacuacuaaugcacuuucuuguucaaacaggaucucauguagccaaggauagccugccugcucccuguguagccagggaugaccuugaacuaccgauguucuuguuucgaccuucuucccuggacaguccugaaugcugaagaaaggcacucacaguauugggguuuaauuacugaaugaccccacagcaccagggauccuccccgcccccccccccaggggcccaaguguuaucaaauauucugcuaagcaguuaacaaagcuuugcauguucagcacauggcaac

SEQ ID NO: 7905 - RNA, 4186 nt, Mus musculus
gaaagggguucaccagugcaauuuuaucacaaccaaccaucaaauaaugaguuuauuuauacucuaguuaaauauuaacaugcaccuucccaucaggugaccucaugggucauggcccauauagaacuuagauaagaaauccuuuggccuugguguuucuguuucauggaaaaaccgcauaacguguguccgcugcuuccauacuuugaugguuuccuggagcuccaucuuucccuguguacaugaaggaaaaguagucaguuccagccauuaaaugaggaacacagcacacaaguucaguucuguguuguguuuggcauggacucgcuaaugaccguacauuaaccauacccagagccacacugccuuccugugguugcagacaggugagacagcguguguuccaggguggcaucccauaggagcuagcaauuccuacacuugacacuguuauagcugcagcaugucccuccucccucccccagaccuccccuucagggccgaggcaagaggaugugugguuccagcccaggacucuaucucaaaaguggagacauccaagugggguauggugguacacacuuuuaaucuuggcacuuggcaggcagaggcagguggaucucagggcuagccuggucuacagaacaagucccaggacagccagaacuacauacugagaccuuggcuuuaaaaagaaaaaaggggaccuccaaguugaacuuggagacacggcagcugcugagucuagagcuggcuuuaauggaggugguauucacuugaagacucaggggcucaggacaagccagcggcucuuuuaagucugccagagagggccaguuaccuuaaugaccagcagaucaaccacucuggggucugugacaugggcauucuucaugaacauuucucggacuuuaucccguccuuguuucaccgugauauccagcugcauuaagugcacuaaagagaaaacuggacuguagaaaucagaccuuuuaagcaugguuuuagaagcuuaugucagugggugaccacuggacauguacaaguggcucaguuacuuuauuccgcauagcccaacccuagccuggauacaugccuuacuaaacugcccaaccuggaucucagugcucuugagugggcuucuggagaggcuguguaccuaccuugcuuuuuguguaugggcggagcaggcugaggcagaaucuagggccuugcacauguuaggcaagggcuccaucacugaggaauauuguuuuuauaugggauauaaaauauacuaccauauuauuuuuauauggaauaaccagcaagaauaaaggcaccagaguugaaaucucuguaaaauaauguguagguguuaaguacuauaugaauuugggagcuaagggguacugccaagaguuugcacagggagggaaggcuguaaucaaaccaucagacaaccuggggaaggacaugacucuaagccuuaacugagagugggacagucaccuaugacugcaaacaagauacaaggcugccacuguggagccaugagucacaccacccugcaccaccacccccagauaagggacugaaaccgaacacaauaaacuucucuucccuuaaaaagggaggaggcugagagguggcucagcaucgccuuuccaauccccagcaaccaugucaggcaacucaaaaacccuguaacuccagcuccagggacccacccaugccucugaccucugcggacacuugggauuuaccugcacccucccauacacacacacacacacacacacacacacacacacacacacacacacacacacacacaacuuuaaaaaguaauaaaauacauuuaaaaagucacaguauucaccaaucuauuaagucaguggcuaaacaguggcacaaacucaggugacugaacuuaaugugcuacauggguguccuuuggagauuagguuguaaacuggacuuagugguaacaggacuguaaacccagccuacaggcuggagguuugccguggcuguguauggugcuaugaauccacagcaagaucuuguuucaaaagagaaaagcaggcuuuagucacccauccccugacacucagccuucggcagauuugcugaggacaccaaggauacaaaaggaucacuagguguuaaacauucuggcuacagaggucaguauauucauuuagugaagauaccuugugcacuggccauucuugugacauguccacucugaucuauaaaacugcaaucagccaaccaugguggcagaugccuuuaaucccagaauugaggcaaaaccuuaacaaaaacaaaaacagugcugggcaugguggcgcacgccuuuaaucucagcacucgggaggcagaggcaggcggauuucugaguucgaggcuagccuggucuacaaagugaguuccaggacagccagggcuauacagaaaaacccugucucaaaaaaacaaaaaacaacaaaccaaaccaaaacacaacacccaaaaacaaaaccaagcccggugugguagcacagaggcagauggcucuuugaguucaaggccugccugguuuacguagcaaguuccaggccagccaaggcuacaaugugagacgcugucucagaaaaacaaaacaacaaaaagucacaaaaacacagacaaaaucaugcugugucuaaaucagguuugaaucuuuuguuauacuccaauucagugauugcagaaauggugaacacuaggcuagguucugagagagcugucaccaaggucagugcgcacacagggauuucaggaaagaacuguacaaugacaaacugagacaaguuuaaguugagacagaacccgucacucagaaucuuaguauuugugaagcaucaggcccagagacugaagggugcaguauuauaacuacugucagguaaacuccagccugaggugggcaugguuuuuuuguuuuguuuuuucuccagucuguguucuaauaacuaagaggaaucuucucccaucagugccucccccgaguuuuauaucaguuacuuaaguaaccuauuuaauacaguaacucccggaagaagacaguauuauggccauuucacagaugagcaaauaccggugaaaaaucuuacccaaggucacacagcuaauaaaggucgaaacugaggacaguguggcugccucucaagcagugcugaggcgugcuguggagcuguuguuacucauuggaaaacgccuuuccccucagaucagcucaaguuaaauacaugucuacucaacaacaaaagaugucccugacauauguaggacauuugaacucucgcuaacccccuuuuaaaauccacuacaguggcagcauugagggagacaaccaagauugcagauucacacucgccacucaggugaacagacuagauucucccaccuacgggaaaaggcguguuuugcagcagaaggggguuagacuucaaaauucuggggcaagcugaucuagugagcaaagcuggggagcucugaggggccauuucgucuggaggcuucaaagggcagcaggcagcuacugggugaccuucgucaagucguuucccucucgugaugcaguuuguucuccagacuaaguaacagauaacugcuaaagcccuucgccacuuuaguuacaaaaucgaaugggcaucuagaaccuucucuggaacuguaaagcuggguucaagaagcacccggggcuagcucaggaccgcggacgccccucccaggggcuccauaagaaauaaggaacaaaggccaccaaagcaacuggggcgcucggaagcccugucccgguguggggcacucuggcucgggugacccccuucccccgaagcccagggcucguuucugucccacuacgugaccucagcucggccgagagaccuugggcaggugccuccggcgccccgaaugcaccccugccucucaccgguguucggcaccucccgauaccaagcgcgguagagcucgcgcacccuccgcuuggccucguucaggucgcgacugaaaaugggcuucaccgagguacuggcugccgcagcagcagcuuggcgcaggccgguggccgcggccgccaucuugccgaggaagccccgccccuucagcgugcgcacgcgcggugccacgggacucgcugccgugccuccugcagugcagagggaaggacugacug

SEQ ID NO: 7906 - RNA, 7951 nt, Mus musculus
gagccaagucagaaaggaagcagacaugugagagacagagcagcguggagcuggaaagaaaacaggcaugcgagagagagcagcauggaguuggcaugugugggguuguggucacguucuguguguuccagaacagcaggcuggcggugagacgcuauuuccagucuugguuguguggucuuuggguccagagcaagcaggcuuuggaggaguguaggaagaccgagccgaucaacaggaagugagcaaguauggcugcccagcaagggucagaaucugcuccuugcuuccggaucgcccccucggccugauggacccaguaaacaaggaaaggaagcacacaggagcuccgugugugccccacaccgcaagucugguaaguucggaaggaaucgguagaggcaugcagucacgucuggcagccagcagagcagagccagagcagagcgucuggccugagcccugucgcagcugagauguguuggucuccuguggauuuugaaugcgugcaucgugguggaggaagcuuuggggccugggaagggugaggcuaagcagccacgugaggccagagagaggucacagccucauuuggcaguguugcucuucuagauugcccaggucuccuguaggcagcacacuagcacaugucuuuauucucucggguugcugggccuggguaaucaguucccacccacugaucugcaaacccaggguuucuccagcuuucuucuaaggcugcuguguacuuaauuaccagggggacugacaccuuucucaaggccaaggcuguccguuauugauuucuucccucuggacucauacugaaagagaaccuauuuuucucgaaaguucaugcugcccuguaaccaugaacacggagcaaguaaaccccauacaaccugauagugcccacaauagugagcguuaggaguuuugcuugcuuugguuggaaaagcuaugugucugcucaugcauuuaauacuugauauuucccccauaaguuugaaugacuuucaggaauauuuucgcugagugucacgguaugcaccuguaaccccaauacucaggagccugagguagaagauuugguaggauuuugaggcuaaccuaaccuaugcagugaauuucagaucagcucaggcuauaagguggaaaccuguuucaaaacccaguaauucuuuacacugaaauggagaggcaggcaugugcaugacuucagggccaaucuagacuacauaaugaauucuaggccagcccaagcugaacaaugagacccuguaguggccauuccugguugucaacuugacuauaucuggaaugaucuacaauccagaacuggaagguucaccagugauccuaaucuggaggcugggagauacaaguuucugaccuggauuuuggcauggagaucuugcggcaugguggcuaugaaucccagaagauuaagacagggagagcucugaguucaaggucaucugggacaaagcaagucccagaucccggcaugguggcacacaccuuuaaucugggccacaccuucugcuggagaccuaauggaagaaggaagauuugcucgcucucuuugccugcuugccuuguggggcugagcaacugcuagauccuuggacuucuauucacagcugcugcugaccauuguuggggaguuggacuacagauagaaagucaucaacaaauucccuuacuauauauagagacuacccauaaauucugugacucuugagaacccugacaauacagauuccaucucaaaaacaaaaaaaagaaaacaaaaaaaucccuuaaaaaauauaacaagcuaggcagugguugugcaugccccuaaucccagcacuuaggaggcagaggcaggugggucuccgugaguucaaggccagccagggauacacagaaaaacuguuucuucaucuuucccaccagccugcaggagcaguguaacuauuucaagucuauggggaaaacaguucucgacuaugagacugcagaggcacuauaucacagcucagguauggaggccaaugcucucaugugagccuagagaagacucagauccucauagucagcaccuaugacaucaagaugauguguaagcaaaagagcucuggagaaacugggcacagcgauacacaucuuuaauuccagcacuugggagcagaagcaggcugaucucuguguguuugagaccagccuugucuguggaguagaugucaggccaggcagggcuaucuaaaacccuauaacaacaacagaacacaacacaaaaccaaccaaccccaaucuaccucuugagaauuucucgugucuccuuuggccaagcucaaagcagagagccuuaucaucccccagagccccaccucccucccagccauuggcuaacuuuccaugguaguaguccagacaaugccuuugucccagugcacauguguggcuuuagaauguggcucaauguucauagcucagcaagguagcuaguguaacaaggacaccugucugggauuagagucuccuugauguccuagauccaagaacuuggggcaguacauaaacuuuaaugugguacugggaaacaacaagcauuaggaguaugggaguccucaggccuuagaggguacuuggugcugaguaaauuguucucuuagcgaaugaucacaggguccaccuguuuguguuuuagaggcuucuaugguccugcguuuccugagaaagcucuggcugggguuucuucuagccucugauccccugcaaggugagguaccacaaacaagaaaggcuccauuagggccuguuaucugcugcuucugaaagggcagcugccuucuuuucagggucccaaggcugcuuugggauauucaugcucucccaccagcugcaggggcauacuuccugcucccuaaucuuccugcucucuaaucucauguguacucuucagugacacucgagggccuaggccagcccuuugacacagugcuagaguccagauguccuggaacaugagcuacacacaugcucgcgcacgcacgcacgcacgcaggcaggcacagugccaccgaucaggggaucaguggcagaacuagcuggauacugcaggauccucugggggaaaaagugucccaggcucucugucaagaguggaauuuucugucccaggguguuauuaaaugcacugaagugucaggugucuccuccccaccuccucccgugcucagcucagcucagcuuaguuaccauuccauaaagagaagugacaaauagcagugccagcucugggcaggugcuuuaguuacucuguaggaggggacaaagcgcccagcaacugcaggaaggaaggguucauuuagucuuucagucugagggugcaguucagcauggugggaaagggguggcagcagaggccugaaguggcugcucacacugcuccuauaaccaggaagcggagagggauuguuggcuauaaccaggaaguggagagggauuguuggcuauaaccaggagguggagagggauuguuggcuauaaccaggaagcggagagggauuguuggcuauaaccaggaagcggagagggauuguuggcuauaaccaggaaguggagagggauuguuggcuauaaccaggagguggagagggauuguuggcuauaaccaggaagcggagagggauuguuggcuauaaccaggagguggagagggauuguuggcuauaaucaggagguggagagggauugauuguuggugcucugcucacucucuccuuuugcuucaguccuggacacaagcccaaggugcuguccaucuuaauuaacucaaucuaggaacuccucagacauggccagacauuugucucuuuggugacucuacauucuaucaaguugaaacuaucuaucccccauagcgggaaaccguaggccagccaaggucacaggcccaggagucagagcaggaaggcaaucugguauagugaagaauagaaaauuacuggccucuugugagaacaugaacuuuuuaccucggagcccacccccucccaucuagagguuguucucggaacacuccuaaacuuuucaccccaaaacuccucacccuaaaguucgaaaaaacuguuccaagaacauuuuugagauaaaggccuccugaaacaaccucaaaaugaaccggguacauugccaaaugauaggacaugacuccuuaguuacguagguuccuugauaggacaugacuccuuaguuacguagauuccuuuggcagaacucccuagugauguaaacuuguacuuuuccugcccaguucucccccuuugaguuuuacuauauaagccugugaaaaauuuuugcugaccuucgagacuccucuacccugugcuaagguguaugaguuucgaccccagagcucugugugcuuccauguugcugcuuuauuucgaccccagagcucuggucugugugcuuucauguugcugccuuauuaaaucuugccuucuacauuuuauguauggucucagugucuucuuggguacgcggcugucccgggacuugagugucugagugagggucuucccucgagggucuuucauuuggugcguuggccgggaauucgagaaucuuucauuuggugcauuggccgggaaacagcgcgaccacccagagguccuagacccacuuagagguaagauucuuuguucuguuuuggucugaugucuguguucugaugucuguguucuguuucuaagucuggugcgaucgcaguuucaguuuugcggacgcucagugagaccgcgcuccgagagggagugcgggguggauaaggauagacguguccagguguccaccguccguucacccugggagacgucccaggaggaacaggggaggaucagggacgccugguggaccccuuugaaggccaagagaccauuugggguugcgagaucguggguuagagucccaccucgugcccaguugcgagaucguggguucgagucccaccucguguuuuguugcgagaucguggguuugagucccaccucgcaccuuguugcgagaccguggguucgagucccaccucgcgucuggucacgggaucguggguucgagucccaccucgugcagagggucucaaucggccggccuuggagaggccaucugauucuucugguuucuuuuuugucuuagucucguguccgcucuuguugugacuacuguuuuucuagaaaugggacaaucuguguccacuccccuuucucugacucuggagcauuggaaggaggugcgggucagagcccacaaccagucgguggaggucagaaagggucaguggcagaccuuuugugccuccgaguggccaacguuuggaguaggcuggccaccuaagggugcuuuugacuugucacuaaucgccgccgucaggcaaauuguuuuucaggaggaagggagucgaugucaggaaauagcguuuggcuuggcugguuguacaaguccaggcguggacgagugugcuuagagauacuggugucuucuuuuucucuguugcuaucuuguuuuuguuugugguuuuugucaugagacacagacacuguacgucagagguaaagugagaucccucccugucuguaugucugugugucugugugucuuguucacuuguguguccuccauuggaccaccuucugauucuguuuuguuuuugguuugucugguuucaggucuggucuuggucccaaggaguugacugauuaucuugguuugguuuuaggccggucucagguucuggggccuucccauggagacagguccauuuggguuggucauagugacaguaagcuucucuggaaaucgcauguaagaugcccuguauuagucuuguuuguguuugucauuucugugguacugugauucuauagugguugccugaaaaacgguuucugugugugucuuuuuugucucuuuguguucggacuuggacugaugacugacgacuguuuuuaaguuaugccuucugaaauaagccuaaaaauccugucagaucccuaugcugaccacuuccuuucagaucaacagcugcccugccucccacuccaacuccagagagcagccugcgggucacaguggucccguccauggaccuggagccuagggggaaaaugaguucaaaaauccggagcaaaugaggaguggucccugagaagucaguggccugaauguuguggcugcugaaacaaaaagaagaggaggcugugcgaguagccggccaagaacgcugcagguucccaggcagcuucucauuccccugucccucccaucccgucucuuguuaacagaaaaacugcuuucacuuuaagauaagugccgguugcagccagcugugagagcugcacucccgucucugcucuaaaguucccucuucucagaagguggcaccacccugaguugcuggcagugagucuguuccagguuccagugagggaggcauccgcccacuuggggcuucuguccaagguaaggagcaccugugagucuaacugccaggcucugaugggggucucgucucugugggacuagaaagugucccaacaaucugaccaagguaacaggaaguuaagacaaagacagagaucagagucagaaucagagcugugcugugagacaaaaagauaagaaaaaugaaaugcuggccacaaaagucaggaaaacuagaaaacuuagauaguaccuggcaacaaaagaaagcuuuuggcuaaagaucaacguguauacuguaaagaaaaugagcacugggugagagacugccccaacaaaaagaagaggagccccccucaugaccaaacccuucaccuguucguggcuaaaaguaaagagauaacaaaaggggugcuaacacagaagcugaguccuuaaaagaguccgguggccuaccuguugaagcagcuaaaaaaagagacuguguuucauacuccuccacugaccagugcaaaacaagcuaaaaaguuccugggcacugcgggcuuuugcagauuguggauuccaguuuugcugaguuaaagagauaaacagcccuucguauaaagaaaaaaaaaaaaggaacaaucuuagauggccuuagaugcucuugagacugcccuaauguuauccccagcuaugggacuccuagaugugacugagaacaaagguauugccaaagaaguucuuacucagagauugggacccugaaaaagaccuguggcauacuuguaagaaauuagaccugguggcuguaagauggccugcuugucugcacauaguggcuucuggucaaggacgcagauaaauugacucugagacaaaacuuggcacauguccuagaaagugugguucagcccccaugaccgauggcugacuaacgcucuuaaaagcauuauccaacuguuccccugaccgauggacacauugucagagcuuuuuuugacugaacgagugaccuucgcucccccugcuauccucgaucucacuacugccugagacuucaccuacucaucauugugcugacauucuggcagaaggaacucauacucgaaaugaucugaaggaucagaucagccuuggccugagaguucgagcugguacacggauggcaguagccucgagguuaaggguaagcggaaggcggggacagcagugcagugguggacagaaagcaagugaucuaggccagcagccucccuaaaggaacuucagcccaaaaagcuaaacuuguggcuuuaauacaagcucuauauauacagacaaagagagcuguugacaucugcagagaaagaccuaagaugcuguggcuaaaagaaaucagauggcaaaucuaaccgcccaggcauccuaaagagcaaugauccugacagucugaagacuaucaaguuauagacaaauuaagacugguaaaagaaacccuguauaaaauaguaaaaac

SEQ ID NO: 7907 - RNA, 3032 nt, Mus musculus
uuugccauucuuaauguuuauuguaaaaacgcucagacugcgcauguuuaaaaucucaguauuauuuaaugagaacgccccacccugccauguacagggugccccgcacucgcuacucacccaccauguuaaggaaaagcaccaggaaguacagaggguccucauggcugcucuccagaguuauaauuuaaagguauuucuccaugguaaaacuacaauaguuaaauaccaaggcaauacuacaugcuuuacauagucccaugaaaaaaagaauucaguugauccuaaucccugaugcaaggcacuucaaagcacccgcauaaaaugcccauguaaacagcagugcagugcaccuuccaaauaacaugacuugugcacaaccugacccagacagaaggaaaaagaaagcccaucacugccacagcuaaaggcauguuaaaauuuccaccaagaaacugcuucccucauuauucacagaacaggcuacauaaccuuugugagauacaaaacccucgugggcauuucauacucccaaaccagcacgcgccaggggugggcaccaagucagagugcucaggagugagagcgcuaggcaucgcugaacacgcacguuuccuagccaccagcccgggcaggcugucuguagcaccauggaaaaugcaugagcagccacaaagguacaaauuccaaucagcucuuucacgaggcucacuuaguccacaguaaucaacaguagugacaauaauuuuuaaaucauugacaaaugauuagcuuucccuagaagagaaguucuguaucaguacaucccauguacacagcaccaguuuaaacaggguuaucaaacaccugcagcagcgcauggcuaacuggaaaguucauuuuuuagcgcuuuccaggucgggauaaaaucacaacagugaugaacacugacgggggauucaguaaaacagagggguggcaacuguccagguucuacugccuucucaggaaccacaagaggcagaggccaacggcagggcucaggccccaucagguuucuacuaccaaacaacugccacacacacuacugggagaguaagggggucugcgugugacugcaacccagaggguucugaguccaccuccagcuucgaguccacggagggcggaggguuagucgguguccaacagagacaggcacaucugccuuucaccagcuugauucuuaguagcaugcccuacuuaggcauuuaaagggauaagggcauauauagguaugcacagugaagaaucaacuauaaauauuccgacuguugcuuuuuuaaaauuacagauugaagugacuccucagagaaaaccaguuucuucauaaaugaaauauaguauauaaaaagcuggaacgauggguaguuaaaauacaaaacucaaguacaaaacacccuauuuuuccuuuccaaacuacacagauucauacaguugacucuaccauauaacugcuucauauauaauuacaccacuagcguaaaggaccauuaacacuaaagccccucaguuagcacacugaggcucucuguccugaggucugcauuagaacugcagcccugagcccgagcugagaggcacccuuccuaaguguggcucucuucuuccugcucucgggucccacaauuauuaaaagaagggaucugcucugcaaacgacugugccauccacugcccauucggaacaucgccgggggcugcuucuccucucggcuccgcacugugggcuguuagcccauuugaagcaaugccacaagguuccccauuacauggguuuuccccauaggcgccgccguaagcugccuuauagccuggaucauacuuuucuuccuuaacugccaucuucuuugcauccucuugcgcaagcugcaggucaaauguauacugcacuuccugaacguccgcguugcguucaaugccuuucagcuggucucucaaguccuucagcuuaauguaguaaugaacuuuguccugggcccggggaaacugagcacaucuggcgcuggacgacggcaugacguagcacagaguuucugugucugggaucuugugggguugaagcccaaauuccaaguucuuaaccuuuacuccaaaaacuucuuuacugaaaauuucauaaauacauuuuccauuaaacaccgcuauucguggcugauauuucugcaguuucugcaccaggaugcgcccuccuucccggaacucuuuacuagacagauccuugcugcccggcgucguccguuccaccauguuggugaauccgaugccguacuugccggguaagguguggucauucaugugauucagcugcaccucacucagccccgacaugaacagacacuuccagaagugauuuccaggcccaggguagugauguccuuuguaagcagccauuaaucccggguuaaugccaaugaucacaauauccagauugaaggucaaaaugucaggaagagucuuggucagaagcucagcuucagagacgccguugaagcgguccacuuuccuuuucacuuuaaacgcgucugugauuuucuccugcuuuucuuuugauuuuguagacuugccggauuucuucgacguagcagguuuuuugggcuccacugguuccuggggcucugcugcucuggguuuccuuuuccuucucuuuggagcuucuggugcagguuccuggacaggagcgucugugggcaccugcuguucugucacgguugccauguuaggagcuacugcuggcaccugcuguccagucaugacugccauguuaggaacuucugccaucauuuguugaaauagaaaugaauacaaagcuugaacuugcuccagagaauagcugagcgcagccucugcguccauggcggcgccgccgaggguacggccacuccugccgagcccacgggcgcccgcucugccgcucagcgcgcggacucaccacaggaucgggguggcugguggauggacggcgcuggccucggccccuaccacgcugcuacaucaccguggcgagucccccca

SEQ ID NO: 7908 - RNA, 1611 nt, Mus musculus
ugggaaaacuaaguaaaauauaaguacauuuaaaaaaaaaauuccgggcuggugagauggcucaguggguaagagcacccgacugcucuuccagacugcucuuccgaagguccggaguucaaaucccagcaaccacaugguggcucacaaccauccguaacgagaucugacucccucuucuggaaugucugaagacagcuacaguguacuuacauauaaauaaauaaaucuuuaaaaaaaaauaaaaauaaaaauaaaaaaaaaaaauaaaaaaaaauuccaaaacaccaacgaaguagcgguaauuugccuuggaaaaaaugaaaacccaaaggccuggggggggaggggggggggcauuuguugaucggucaaaaguggucaagagguccaguugcaugucugacccuaccccaacgcugcacuaugacaggaaagcuccaaaaagcugcuuccuaggauuaagaguagguuuagaaucauccagucaguucacaauagcacaaaaccucuaaccuggauccaaguaauccugguuugcuggugcccuaagguaccuaaaaauacaucaagauugcucagccucuaaucacuuaauaaauagugcuccaaaguccaucucuaacucacaaacaugagcagacaaaauacugucagaagcaugaagagcuaggauucagaggaaguccagauacuagaauuaggaaacuauaacauaacuauauuaacuauguuuguaaacaggaccucauuauguagcccaaacugaucucaaauucacaaucaaguuucauucuccugagugugggaggcaaugagugcaucuuuaccaccacaccugacuuacacuuaauaugaucuugguaaugaacgccgcacuggaaaacuugaggaaacagaaauccauaaaaaaagaaaaagaaaaaacugaaaaauaaaaaagcuaucaaguguguucuuuaucucaauuaaaaacaaauuaaagagccaagugugguggcucacaccuuuagucccaacgcucaggagauaaaggcaggcagaucucugaguccaaggccagcuuggucuacaaaaugaguucccagguagccagagcuacaggagaaaacaaaaaagcagaguaaagaauuaguuacagaaagauuggucaaaauaaacuaccaaaauuacaagcuagaaaaggugauagaauacaauaaauccaagacagaaaaugcugcaaagcaguauguaaaaagaacaaauaaaagaccccaagccacagauucaagauggugaauacauggagugaauacauguauguacaaggaugagcagaugaagagccuagauuaaaacauuuaaaggcauguuaaagucuaucaaucccaccaccuaugcacuaucuagcaaaauaacaguaacaaaauguuagggagucaaugucuuacauuuuuauuauguuuuauguguauagauguuuggucugcauccaugucuaugcaccacaugcacucagucagugucuucaagaggccagaugacggcaugagauccccuggagcuggaguucuagucacuuguaagcugccaggugaaugcugggaacuggagcccuaguccucugga

SEQ ID NO: 7909 - RNA, 3860 nt, Mus musculus
gggguuucugcuuccgguuuccuggccccugaaaagagccugcucuuccgcuaggagcaucccacagugaagcuaguggguccuagugggucuccugcaggggucgugugggggucaggguggggcugcugcaggucuuuggagggagucccaagccccagggcacagggauaaaggacagaguaaggcugggcugugcaaaccuccuuucugccuuuguguuuucagccuuuaaguggaaucaguucacccuccugggccacaguuuuggugagucagccuaaggcggaaccugaguucggggggagagcuguaggaaagagagaacuugacacugugguaccuggugccuuucccugccccucugaggagaggggugagagagucaucuaaugcuuaccguacaguucuagagaccgagucucaacuccauggugggaaaggaacuagggaugggacacccccccccccccaggaaagagcuugggaggaggguacugggaucuggggaggggggccacacagaaugucaccacugcucuuuugucuggcagguggcuguguggguggcacggugaguuacuggcuggggaccuuguggggacaagcagaagguaagauaggaagagucccacaccuccuuagcgagagucacuuuccacacacacuguguccuagugaaggucccuuggagaguuucugcuguccugacugucauccccaggacuccuaagaccaggguuacuggggucuacaggcaggucugagaggaccacgcuggagggacagaagucuccuguucuggugaaaucugugccuuccccacccacucacuugucccucucucuguugucccucucuaguucgccugcauguucccugagaugguggacaaacugaucuugcuggacucaacgccauuuuuccuggacucuaauguaggagagccuccugggaggcugucauaggggacugaccccagacuuuaggggaugccuucagcucugugucuccugugguggacauuaaggaggcauuaaggagacugggacagaaggguagauaaguuaggcagggaccuccccagagagagcagcauccugaagcuugugacccuaagaaugugagggaccaagggugugggagcuggugggaagcucuguguguggccuggauucugcagaaagcugguggaucccauguagacugugaaacagcagaagguggaggagaggagcagauguggcuggaggaaguucugggccacagccaggucccugcacugacacuuaagcaucauuuuauacugagcacauggaacaccaacccugaguggggcugauagaaaacuaccaccaccucuggcaaccacuaccaucagucacacagcacaccagugcugucccugagucugagccguugcucuguccuuuuccuacugugugaccccaaggaaguuaguucguuaauguguggaaugugcugugucaauuuaaauccuuccauuuauaaaauggccacacaugcccugaggacaagaacucuuucuuucuuuucuuuuuuuuuucuucuuucuccuccuccucuucuugagacaagaauucauucuguaaucaaagcugaccaugaacuccuggcaauccuccugccccagccuccuccuaaggguaggaauuacaggcaugagccaucauaccuggcucugugcguuuuuugccuuucuauccucaugucuccuaucccugcacucgguaauuuuccacugcaugaaccaguaacucaugggucaauguggaauccagugcacagacuaugacagacuucacccuuuggucuuuguaaugucccacugaugacacaaggauagauagacccuuggagcuuccuccuggguggggcuggguggcaguaagcuccaaaaaccugaaccuguuggucuucuuccauugggaacacgggguguggcagauggaaucucagaucuaccuccucgacgaccugguucuaucccugccauuagcaaugacaucauugauugcuauccuagagucaugucucuuggcaguuaagagagaugccccccuaccaaaaugccaucuagcuccucuagcugucccaggcuaaggagcugaucccucugaagggcaccuaggauggcgagauggcgggcaggaccgggaggggcugagaccccucaucuggggcuucgcuacucaccagcuguggcugaauccguaggaaauggagaacauacugaccuacaggcggagaaacauagagcacacacuucagguggaggccucccagaaaaagucccugagagcugucagcccagaggagauguugcaggggugagugcugggggcaagggaaaagcggggagggggggcagaugaggagggggacuggaacggcuguguccuccaaguuggggagaagaugccuccucuuuuuccuucccccuuccuccuccccuuccccuccuccucacaaggucaccccccuacccccaccccagguugcuucccucugggguggcagccagcaccaggccuccuggacaugucucaggagccucuuguuaccaacccuccuuacuugugcucggagguggggaggggaggcucuuccuugccccccucaguucagguuuuauuuguacaccccuucccucugucuaccaaccuugggcuccuuaacaauuugcccacaguucucucccauucuccugcuagagcugugugguggcuucuaccccagagcggcugcacuaccuguguccuugauggccucuaaaaucugcaagcaugggacugcccuggucauauuugugcauacugcaucuggugguacacacaguagguaggacagggcuuuuuugcuuguuuuuuuugguuuguuuuguuuuucgagacaggguuucucuguauagcccuggcuguccuggaacucacuuuguagaccaggcuggcuuugaacucagaaaucugccugucucugccucccuagugcugggauuaaagaugugcaccaccacgccuggcaggacagggcuuuuuuguuggugguaguguucccuagguccaucagccuuuuauugacaagcaaaugcuuuuauacagagcacaauaacauuacgucuacauaaguagauauggacacaaagcuaacaggcaggcuguucuccauccuucaugggucaccuccugucucuucuuccuccuuccugcuguccuuucugaagauugaaccuaagcccucaugggugcagcgugcuaggcaagcacuuucccacugagccacaucccuuccccuuuuuguugcucauuuguuuuagagagaguuagcuauaauucaggcuggccuugaacccacuacguagucaugacuggcauugaguuccagguccuccugccucagcuucucuuaagugcuaaaauuuaaagcacacuaccaacuccagcugccugcgccccuuucugucugacucccagcuugauuaaggucuggcuccuuuaguguauuucugucucccuccagguuccugaauaacaacagccacuuggauaaagacuguggggaacucauccuacagagaggaaccacgaagguggacgcagguaaggacucacugucuguuauuaccaggggauggcauggggccuaugccaggcugaugcuuggcguguccagugucucacagacucuuccauugccucacacgaggcccugugagagcaggggagacugagccugcaaguggccaaguaaucgcugaaaggucacauaagcaguggagaaagacauucuaugggaaggacggcuagguauuucugaaaguugaugacugucauggccgu

SEQ ID NO: 7910 - RNA, 2490 nt, Mus musculus
cgggagugcgcgcugaguggcugacggcgcugcacggaagaggcucggcgagagacuggcuacuguggcgccucuguguggcuucgggagguagcuuguggcuucugggccuguuuuguccuggugaagagaacaagaugucgcccccgugaugggcucucaaauccugagccuucgguccugggagccugccggagcugauugugcuggccagggcucuacccgcucacggggcguguugccaacaccgcuggcuacagaguucaggcuacagcccugcccugccccauuuucaagccugcgaaccagucguuccuuccugaacaaaucuccaaacguacugaggccaguuccggauuaaaguucaggugucaccucuuuagcuaggccagcucuggcccugugcucccuccaagggacgccacuagugcagaacggucuuuguagcgcuucaguuauccugccuguuuauucacgaugcucugcgcccacguacccauuccacuagaugguggggcuuccccaagccaggagucugcagucaguucucuguguacccggaccucagaacagagccuaucacauacucuauaaacacucguaugucccuggcauuccggaguuuucuucaaccugguccuggccagauagggaauggaagacugcucugagagcggcagagugaggaagagacuugcugccuaaaaauugagaacuauuaaccaaacucuucaauaccggaacacuugaugacccaagcguucaauaccggaagaggcagguggaucugugaguguuccaggcuacacggugagacugcuaguuacuuuucuguugcugugguaaaacaccaugaccgaaggcaacuuuagggaagauggaguuuauugugucucacaguuccaggaggauaagagcccauuauagcuggaaggcauggccggccacaagcagcaggaaaaccuggcucggggagaaggaugcugagagauaacacuguaccuuaagugggaaccugagagagagcuggaaguggggccaggcuauaggcucucaaagccaccccaggcacauuucuucauccagcaagaccacacaccuccguaccuccccacaaaccaucacaaauuggggacuaaacguucaaauacacgugccuaugagggccauuucuuauucaaaccaccacagagacccugucucaaauaaauaaauaaggagcaauggucagcacaucugugauuccagaauuuggauaguggaggcaaggguucaagguuaucugacccuggcuacagauugacuugaggucagccuaugcuacaugagucuccgucucaaagaaacaaacaagugaaaaaaaaaaaaaaucaggagcuaggcuguggaagggcaccuacuacccugggauaugaggcuggaucuaauaucaguuaaguauuauucugcuuuuaaucucagcacuugggaggcugagacaggaggaucacagacacaagccagucuguucuacagaguaagaccuuuguuucaaaaggggugaggguggauaugggggcuccucuugugucuagaaguaaggaaccuaugcaauguguaccagaggucugaacuguggucuucacgcuugcgcagagagcacagcuccuguuaccaucagagccaucuucccagccuucccuguugccuuccuuaggguccuuacugacuggccaucuccuuucucucuggcugaaccuccucacaguugcuucucuuccuaaagauagcaucggucaggggucaaaggccucacugaggcaccucccugcuacuucagauccugucugcacucauacuucaagcgaccggcaagaugucaaacguaaagccagagaggagacuucacucuugagauuuugacggacacuuccacagaaagaagacuggcugucacagcaggcgucacacuagcauggcccccugacuggucauauaugaccuccaggccaugcugacucacgaccuggaaaagcagaacugauaucaaaguggaaaacaguugaagcucauuccaaaauccagacagaucuugucaucuuagggaagagucauggggucaggagaguugcuaugacuacugaacuguccagaggaagagucacagguuggagagaugacucagagguuaagagcacuugcuacucucagaggacuagaguuuagaucccagcacuuccaaccaugucagcuccagcccuaggacaaaaagaccaucggaaaacacagguuauuuacauuaugauucauaacaguagcagaauuacacaaaacaacuuuacgguugggagacaccauuacauguagaacuguauuaaagauugcaucauuaggaagugugagaaccgcuggucuaggggaaccaacacccuugccugcccuccaugaauaccuuguacaaauaugcucuuacacagccauaaauaaaauaaaucuaaaaaaacgcaagcc

SEQ ID NO: 7911 - RNA, 25057 nt, Mus musculus
cggcgcuccuguccgcugggcucaagccaccgcccuccagggccgcaguagccgcccgccgacgcgggagccggagguaccuggaucucagggacagggcagcgggcagggggaucucguugggauccggggcgccccuguucuaggcuggaaagggaggugagcugcaagacaucagggacccggguccccgccuggccaccuguucuacaggcgacaauggugcgggcaccaguuccgcgccguggucccucagcugccgcccgcaccggucugcgccccgaaguugagcgcggcgcggcgcgagcuagucuggggccggcuaggaucccgcaauuccuucccgcagcccaggaggcccucggagggcgagguucacgggggagggggacgacugggaauccgaaguccagaucccaaagcgcugcucggcgacguugggcgugcucugggaggucgcggcggggcgcaucccggagaggaauggaaugccgcgcgcugcagggagggcuucggguugggaguuggcucugggcuuucuggaugcuccggcuucggaccugcaccgggaagggucuucaggugcaggggguagccugggaaaagcgggggagcaagggaagccagcauggagucgcgagacccagggcucggucccggaucagcacgcucgcgcuucuccccuucuuccgaugagaacaguugagguaugggacuggaagccgaauaggguuggaagaggcugcgccugggagauuuacccuauccacuccuuuucacuguuagggcgagcccccuugccucaaugucuucguaugucaucuggggcuagaaguucuuuucaucuccuuggcagaguccacugagucucuagcccgcuggagauuaaaaguauccuuuccaucucuacucugucacauccauagcaauccagcugcugcaaccccagccgguuccgaagugacacccuccggcuccccgucaccccacuccacccccucuuugaccuuucuccucccuaagaauggggacuccaauaaagcagagcugcccuccacucgcacuccccuagucucuggcauucagcagcagaaaucuuucccauaaaggaaaguccucaaacgaaagaccaaaaaauucacaggaacucagccucccgguuuuauuuguuuguuuguuuuguuuugaaaacgcuucuucaaugccucaagggcuggucccugccuggacagcucaagggucgcugcgaccuauuaaacaauucuguagaguuugcuuuguuucuuugaaacaauuaaggcucugcagcugucuauauugacaaggauuagucccagagaaagguuguucacucaugggagaagugaugaauaucccagggugugggcaggguugcuugaaucucuagaggcgacugugacccaccauaucaccccaaaacagccuggucuuagagguggagguggaaggcgaggagcaguccagaccuucaaugaccucaaguaacagcuuuacuacugagccgccucaacugcccugguuuuuguuguauaaugaaagcauuugguucuuuuagauacuguuacccuuuguuuugagacagggucucacuguguagcucucacugcccuggaauacuguauacaccaggcuggucuccaacucagagaucugccugccucugccuccagggugcuggaauuuuuuuuuuuuuuuuuuuuugguuuuucgagacaggguuucucuguauagcccuggcuguccuggaacucacucuggagaccaggcuggccucgaacucagaaauccgccugccucugccucccaagugcugggauuagaggcaugugccaccacgcccagcucuccuggugcuggaauuaaaaggcccgugucaccacgcccaccuagauacuguuacaucauuauaaaugcauacaguuuuuaugaaugguuagauuuuccugagaaaagaauuagacuguucagugugugagccgguuucaccagcuggcucugccgaaaccccuagccugggcagacuuccucagaccguguguuaguaucuccauuuucucuagaaucgaaaccgcugagucaaacagugagcagcuaagaguuugugugcuguucaucaggugugaaggcuuugccccuuggcugcuccuuggcaaaguuugucuccuuuauuguagauuucagauauauguuugagaagcugggguguuuugggguuuuuuguuguuguuguuugguuuugaauuuauuuauuuuacuaugaaugagcauuuuugccagucgguaugugcaccccacccaugccugguguccauggaggucaaaaaggguguuugaacuggaauugaaguugagaauuacauguggucacugggauuugccaaguauucuuuuuuuguuuguuuguuuguuuguuuuuaagauuuauuauuuauuauauguaaguacacuguagcugucuucagacacuccagaagagggagucagaucucguuaaggaugguugugagccaccaugugguugcugggauuugaacucuggaccuucagaagagcagucgggugcucuuacccgcugagccaucucaccagcccguuuguuuguuuuuuugagacaggguuucucugcguagcccuggcuguccuggaacucacucuguagaccaggcuggccucaaacucagaaaucugccugccucugccucucaagugcugggaucaaaggcaugcgccaucacgcccggcuucuccaaguauucuuaacugcugagccagucccaggagcugaguuuuuauuaguuuaaguuguuguuaguuuuuuguuuuguuuguuugguugguugguugguuguaagagucucauguagcacaaacugguuucuaacaugccauauugcuuuaagauuagacuuaaacuucuuccgccuccagaaugcugggacuacacagaccaucauggccguuuuaugggguccugggggucuuagucccuucugcuaggguuggacuggcuguuugagucuccucuggaguccucgcccaugugagguaccagguguuaacacacucgugcacacacacacacacacacacacacacgcaagauggagagauacucgcaggugguuauuucccuucugagcuuucugucugguaaauuuaaugaaguggagcccaaccguucugguaauggagugccccuuucucuuucccaggggaccuucauuuccaucuggguggagcccuauccgcagagcuggucuggacacccuugagccuguagcucuccucugggccccaguucucccacaagcucgcucccucaaacaacgcagccucugaggucacaccucccgguguaaacuggcgauagggaagcuuggggaacaaagagcacuuagcaagcuggagaaggguagauaauaaaggggcggaagacauuguuccaaagcaggugugcuggcucacaccuacaggcagaaggaguaagaugaguuuaacgucaguguggauuguggggguuggggaagagaggcgggaggggagagagggcgggacagagaugggggcccgcucagaaacaaguauccagguguuaguaguguugcauugcuccuccuggaaggucccugguggcagccucacaaggggccagacucuaauuauucucagcuauccuuuugagacaaaacucaggauccaacgacacugaaccccuuucagcugguaaaugauguuugaaucccacccagcauuuccauuucccagcugugccuugguuucaacucuuuuuaagauuacaaauugagggucuggagagauggcucugcaguuaagaacacugacuuuucuuccuagagguccugaguucaguucccagcaaccacauggugucucacaaccaucuguaaugggauccgaugcccucuuuuggugugucugaagacagcgacaguguacucacauaaauaauaaauacaucuuuagccgggcagugguggcgcaugccuuuaaucccagcacuugggaggcagaggcaggcagauuucugaguucgaggacagccuggucuacaaaguaaguuccaggacagccagggcuacacaaagaaacccugucucgaaaaaccuaaauaaauacaucuuuaaaaaaaaaaaguauuaaaaaaaaaagacuacaaauugaacugaguguaguggcucacaccuuuaaugccagcacuugggaggcagaaacaaguugaucaaugaguuugaggccagccuggucuacagagcuaguucuagaagagccagggcuacacagacagauccugcccccccccccccaaaaagcccaauuagauugaggggcaguaucuguaggguauguucagggggcaguuuguuaccuaaauacagacuggcagcgcaguuagcauuugaaagucaucaaacacccucucuaugccagacccuagcuauucugaaauauguauuguuucuggcuguggccagaacaccuaaagugcaccacacagccaaguccuagcuaacugagucuggugucugaagcaaucagagacuccucccuucuucuccccuuccuaacuucucgugaccacuccucuacccacuucuucugagguugauguauuuaaccugggggauaaccucacaggauuaagagcagaaaguaaaaugauacuaguguggugcacagcccggugcccuggagggccaaccccugugagggugugggcagggagguggaaggauaggcuguucacugugucuuuauguaaagcgauauuuaccugccuuuggacccagaacucuccuuuccaggagcuagccauaugggaguaguuacagauuuucuacgagauguuaaguauggggauccaaagugggauccauuugcuguggcguuucugaaaguccgaagguggaaaccacuucuggcaucaaaguggggaaaucggaggaaggcaggcagcagcaaccuucacugacaggaagcaguggugcucuggagaugggggcuggauacauuaacacgggggcuucacuucacagacucauccuuagcuacccaugaggcauugcucuagaaucccagaacacuaaaguagcuuucaugagcuagcgcaguguuugcacguagccugcacacgucuuccauauacuuuuaaauuucuuugaugcugacuugaacacaagggccuugugcaucgucauguccaaagaaacccaggauaagguucacucaguaccaguggcuccucccagcaccucagcccucacagguagcuaaggaugaguuuaccuuaaaccucuccaacccagggaccagcuucucauuccuauauaaaccugacauuucagccuugaauucccuuuguucuguuccucucuugguccucagcuucucacuggguccacugauccuccuccucccccccccccgccccccaaucucagggccccuguucagucuggacucuggccagaugaugccucuaacugcauucucauaucuacaauuaaaaccuucuugucaaccauaccuaagcacucuaaugcccuuguuugcauucaugcaugcuacaaauguacucugacaucgaggcaacacacccuuccauguacuuauauuuuaaaaauuauuguugcguaugcgcaaauaugguguguguguguguguggcugggugugugugaagaucagaggacaauauagaguugauucuuccacuguggguaucaaggguuuaauuaacucaggcuguuuucauggcuuuaaaagcaaguacuuuuuuuuuuuaaauuuuacuuauuuuauguauaugaguacacuguagcuguacagaugguugugagcucgcuccggcucaaagauuauuauuauuauauguaaguacacuguagcugucuucagacacaccauaagagggcgucagaucucauuacagaugguugugagccaccaugugguugcugggauuugaacucaggaccuuaggaagagcagucagugcucuuaaccgccaagccaucucgccagcccaagagcaaguacuuuuaccugaugagccaccuccuugccuugcuaccuaguaguauuaaucugauuuuaugacuccacacaagcuagagucaucagagagggagccucaauugagaaagugccuccauaagauccaacuguaaggcauguccuuaauuaguggucaaugggagagggcccagcccgugggggaugaugucaucccugggcuggugguccuggguucuauaagaaaacaggcugagccagccauuuacaacaagccagugaacagcauaucaccccuccaugggcucugcgucagcuccuaccucuagguuccugucuugacuuccuuuaaugaacaguaauguggaaguguaagucauguaguguuugggguuuugccgaucucaacaggugagagauguuuucugaguguguccgguuucauuucuccuccauuggaaaaaaaaaaauguccuugggagcuaaggauguggcucgguuggugaacugccuguggagcaugcauggagcucuggguuuagugaaaccucuaugguggugcacucuaacacucgggagguggaggcaggaggauuggaguucaagcucuucuucagcuacacagggaguuugaugccaagggggccucuugagacauugucucagaaacaacaagagcacuauccuugacugcgcaucauuauuaaagggucauuuuguguguguucaaauugucccuugcccauguugggggugggcaggcccagcagaacuucucagggagguagcaguuuggcuuguaggguccuccuguguucaaauuaacguguguacacaugguuuucuguuuaucugugcucugaaacuuccuaaagauuuggggguguaggggcucgaaugagggagcagcaguuaggaguacuuguucuuucuuugguuuuguuuuguuuuguuugguuugguuuuuuggguuuuuuuguuuguuuuuguuguuguuguuuguuuguucuguucaagacaggguuucucugcuuagcccuggcuauccuggaauucucaguagaccagacuagccuggaacucaggguuccugcugcuucugccucccgagugcuggaauuaagggcgugcccccacaacuugcuggccuuuccucugaaguguuaagcugucuuccaccccuccccccaucccauuccuucuuccaucuuugguggcagggucuacuggaacucagugugcaaccuggccuugaauuccugauuuuuuuuuucccugccuccacuccccaguucuaccguuaacauaugccauuaugcccaguuugucucuuggcuacaagacaggguuggucagauggcucaguggguaaagguacugcccuaagugugaugaccugaguucaaucuccaggacccacaugguggacagagagaacucaggaguuuacaguggcacauguauuccaccagcgcggccacauacaaauuaaaacaagucaaugaauaagguaacuuuuaaaauucuuuucuucuuaaagauaugugaguucaaauauaaaauuggggccaaacugguuguugggauuugaacucaggaccuuuuggaaaagcagucagugcucuuuaaccgcugagccaucucaccagcccgggacuuugcuucuaaaaacuaaauucuuuauccauccuaaggggacauugcugcuugauaauuagaggcuggagagauggcucgguguuugaaagcaauggcuguucuugcagaagaccugggucuaguuccuggcaccaacauccauaacuacaauuccaggagaucugaugcccucuucaggcaaaaggcauacacacgccgggugugguggugcacaccuuuaaucccagcacucgggaggcagaggcauucguauuucuuuuuuuuuuuuuuuuuuaagauuuauuuauuguuauauguaacacacuguagcugucuucagacacaccagaagagggcaucagaucucauuauggaugguuaugagccaccaugugguugcugggauuugaacucaggaccuuaggaagagcagucagugcucuuaaccgcugagccaucucuccagcccggcauucguauuucugaguucgaggccagccuggucuacagagugaguuccaggacagccagggcuauacagagaagcccugucucaaaaaaaaaaaaaaaaaggcauacacacacagugcaagugcauacacgcaggcaagccucucagacacauaaaauaaacauaaaccugaagaacauaucaaagcuguggucuuuaagccuggugggacacacuagggaaggaguagcaggcagcucucugugaguuccuggucagccaaacuagugagacacugaaaaaaacaaaaaaacaaaaaacaaaaccaaucuggccugagccagcaagaggcuaauggauagaaguaucugacauguaagccucacugagaaccugaauucaggcccucaacccauuaaaguuguccuuugacuaccacacaugaguguuuugccugacguugguauguaaaccaugugcaugccuguuccucaggaggucggaagagagcaucuuaucuccuggaacuggauuuauagaugguugugagccaccguguuagugcugggaguugaaccuggguuggcugcaagaacgaguagauuuaaccaaacugagucgccucucuggcccaucucuuagguuugguuuuuguauagggucuugcucuguagcccagcuggccuugaacucacgauaucccaggcucuaucuccaaagugcugggaaucacaggugcuccuagucacuccuggcuggcuuacauguggauguaaugauaaaagcucugggccccucugaguaucaucgugucucuucugugaacagagagagaugccuuuggucucuccuuccucauagcucugccccauuuuagcugauaccgugagcagcucuagcaauauuucuaaagguucuggcaucuuucagggcaaucgaggcccacagcacacguggagaucagggcggcuuugcuccuuccacuguggguucugggaauugaucucaggucaucacagugcacagcaauugcuucucucugcugagccaucuccuuggcccgguagccuauaguuuuuagggcaaaagccaggguccuagcaaucccaucagauucagcaaggccaccugguggucaagguguggccuggcuggugguucacccaguguggucagaaauacuugucauugcucaaguagaucaguggggcuccaugcugagcaccucugucccaggguguagugggguguaaucuauucauagaugauuaucuucaucuagguguuagucucuaggagguauauguauguguugacagggucucaacccuuccugcuucagccucccguguguccagacuucagacaugugucccuaugacccuggcuacuuccuuccuuugcuuuguuguguagcccuggcugcccuggaacuguucuuuuuuuuuuuuuuuuuuuuaaaugcguguaaauggcucugucugcauguacaccugugugccagaagagggcaucagaucccucuuauaugacagaugguugugagccaccaugugguugcugggaauugaacucaggaccucuggaagaacaguuagugcucuuaaccacugagccaucucuccagcccagaacuguucuuauagaccaggcuggccuccaacucagauucaccugccucugccucccaagugcugggacuagaguagagugucacugggcuugggucacuucauuuuaauucugaacaacuucccaucugguuucuggacaacaacuaggucucugguuuuguaucaacagugucuaguccccaggaugggagcugccccuguuggccugaucugaucuuauguggggaauaagagaaaggggauggagcucgugccagcaaacccauucuggccaaauuccgugaggucaaagguuugaagggaguagcucuuaggacugaaccuagaguccauccucacauuuaaagcugucuguccugugggcagugucaugucuucuaaauccugcuugaguuaaugugugagccauuuuuucuuguguguggaaugccagcagacaacagucacugugacuugcaaaagaaacguaaaaaacacaaccucaggaaucagaaagagaccuaaauagaaacuaguacuuguuagagguuuuguuuuguuuuucucaugaguuugacugcagaugcagcaguagacaaaacuguccagccaugucuugugugcucagcaucuuagaugauauuuuugauggacagcauuguguugugucaggaccauccaauguucucaauuuuauuuuuauugaaaguuuuauuucucguguguguguguguguguguguguguguguguguguguguguguagggcuguccauggugauugugaucugcccuacauggguccuggaaacugaaacucgauuccucuggaacugcaggcaagcacucuucagcccucugacccccauugauguuauuuuuagaaauguaugugauuuuuuuuuugucuuacuuugguuuaacuugguuuaacuugucuggguuggggaaugaagacauagaacucuuagcucugccugugccaugccuaccuggauacugccaugcucccaccuugaugauaacggacugaaccucugaaccuguaagccagccccaauuaaauguuuuuuauaagacuugccuuggucauagugucuguucacagcaguaaaacccuaacuaagacagaaguugguaccagaagugggguauugcggugauaggccugacuaugcuuuuauuugaaagaauguggauguugggacuuuggauuuggaaaacaguggaaugcuuuaaacgaggauuaauggaucauccuaguaggaauauggaagacuuuguugcugggaguaauuugaacuguguugaccuggcccaugagauuucaaaggagaagaauuucagaauguggcauaaagacuguuuuuaugguauuuuggugaagaauguggcuacuuuuugcccuugccugaaaagucugcuugaggcuaaggugaagagacucagauuaauugcacugacaaaggaaguuucaaaaaagcucagcagagacuuuauucucugguuaagucuuaugaagagaaguuugaacaagcauagcaagcuuagaaaggaaaaauauaaaauauaugguuugaguauuaaagggguaccaggaagugaaauggagcaaaauccuguguucuaggagauaauagauuaaaggagugggaccuuggggcaagauccuacccagcuaaauuuagauccaggcgugguggugcacaccuuuaaucccuggagacuggcaugcugaucucugcguucaaggucaaucuacagagcaagaaccaggauagucaagcuuagguagugaaggauuuggaaaacauaaagcccagugauaauguacuaguacaagggggucaaguucuaguuccuguaagcagcaaaacucggcagcuucagccauguggcucuggcucuagaguuaagaauggaaggaacuacugggacaauugaugcugguuagcuggagcuaagagguaugcaauuaugaaaaagagaccagcaucacugaguugaaaucugggaauuguuuucugggagcauaaagaagcuguguuccagagauagccaagguuguaccucaugcugcaguuggacuugguaauguguaagucacccaggugguacugguuuuugaaggcaugaaggugucaugaagaccagcugagacuuggcacugugagaggucauggaaggccacuggaaaagguauagccucagcuguaguugauggcccaggacugaaggggccacgcaaaagauuugaggcuuggcaccauaaagagagccuaugagaggcuauuggugaagccuaguuggagugaaacacccuuguguauuggagacgucaggaccaugggaugaucaccaagaacagcagccauaguggaguggaucaaccugagcuuagagugcugcagagggcagagcuggagaagugaugccagcccuuaggaguagcccaaaagaucaaguggaaucccagacacugaaacaagaagcuguaacauugaaauugccuuggagagucaaagaauguuaaagaugccagagccaugggauauaugcugaggaaagcugcuaacagggaguggaaccagcccaggagaaagcaguuuguugcagucaacaaaaaugaaaaaggaauggagaucugaagacugcuuugacaucaaccauggagaugcugaguuuggaguuugcccagcugguuuccugccuugcuuuggggauuacaguuaagugauuggaugaaucucagaaggauuuuaauauuguugagacugcuauagacuaugaguauuuuaaaaguuggacaaaaugcauuuugcauuaugcuauguuuaaguuggcccucauagacucguguuugaacaagucuauggggccagggaguggagugucaugguuuuuauauucuuagaccagggaguagcacuauuuggggguguggccuuguuggaauuggugugaccugguuggaguaagugugucacuguggguguggguuuuaaguuccucacccuaguugccuggaagucagucuucuacuagcagccuuuggaugaagacuuagaacucucagcucugccugucccaugccugccuggauacugccaugcucccaccuugaugauuauggacugaaccucugaaccuguaagcuagucccaauuaaauguugguuguuuuuauaagacuugccuuggucauagugucuguucacaguaaaacucuaagacaaaaguuuuaaaugugacugcuuuaaaugugacuuaaugggucauccuaguaggaauauggaagacuuuguugcugggaguaauuugaacuguguugaccuggcccaugagauuucaaaggagaagaauuucagaauguggcauaaagacuguuuuugugguauuuuggugaagaauguggcuacuuuuugccugagacuaaggugaagagacucagauuaauugcauugacaaaggaaguuucaaaaaagcucagcagagacuuuguucucagguuaagucuuaugaagagaaguuugaacaagcauagcaagcuuagaaagaaaaaauauaaaauauaugguuugaguauuaaagggguaccaggaagugaaauggagcaaaauccuguguucuaggagauaauagauuaaaggagugggaccuuggggcaagauccuacccagcuaaauuuagauccaggcauaguggugaacaccuuuaaucccuggagacuggcaugcugaucucugcguucaagaucaaucuacagagaaaauccaggauagccaagcuuagguagggaaggauuuggaaaacauaaagccagugauaauguaauagcacaagggggucauguuuuaauuccuguaagcagcaaaauucauguggcucuggcucuagaguuaagaauggaaggaacuaagacacccuucuagucuacuuaggccacgccuccucccaucucccucuuagaagugaagcuugggacaaccaaccacugggguuuucugagauccuugccccugggucccugugcacccguccucuuuccccgcuucaguguuguggauggugaucacugcuuucggacaugcuuacauggauuguaagaguuuggguuuucucuguauccucaacucucuaaagcuauaacguguuuagauuccauaggagaggggucacaacgaagcuauacuuucauucccguugggacagagccuccucuccucuccacugcuuuuggauaguggagacuagcaagaauauagaggaaagaagagcugggggacgggggaggaggagggaaaaccuugccauuauauacaguguggggcgccguguguggggaaauaaagggggugggagagaugaccuacauuccaccagagcuccaaggcaggcagacgggcgacugcugugugcucuccacacugcucaugugggugucuggcuaugggaagccacggaaccccagucugcagaggguggagagggaacaaucuggggucucagggccagagacgacauguucucaguucuggacaucccagacaucgcuguaugucucggaagaacugagaacaaagugagggcuggggggcgggggggggguggcucugucagucccggggcugaagggagaaggggacagggugagaaggugguucccaugcgggggucuuugguccagccugguggcuagaaaugcugugggagacuagaccuggcucuuuaggagaaggccuauuccaucguucuagcacagagagguggucugugguuuuagagcuuuauuguacgagagagagagagagagagagagagagagagagagagagagagagagaggggggggggguagagaaguacaggccauccauggccacguggaaagaggggaaaagggagggagagagggccucuuuuauagugggcugggcuaccuugcaguugcagaguaacuguggggaggagcauaccuggcuuuugucagguuaacugugggggguggagaagccagagagggaggagggagccaagcagccucuuuuauagugggcugggcuaccuugcuguugcagaguaacuguggggaggagcauaccuggcuauugucagguuaacugugggggguggagucuagccagaaugccuggagcuugggacauugucuacaugaaugauagucacaggauuauguuguugaggacucgaggugucaggcgccugugucuggaaacguggcucacuguugagucucuuguagaguuuucuaaugggucucuggaguaagccuugcuugagcagaacacagacugccuuuuguggucccacaauacaggauaagugaugccugggaagaugggagucuaucaucauacaggaggaauggggaagguuagaaggaucaggaugcuagcuuugagauguuuaacaaguaccuauaaauaaggguuggaggagucugguagcuaguuuaggcuuuaauauguugauagacaccacagguaugucaauagagagcugucuuaguuuggguuucuauggcuaugaagagacaccaggaccacagcaauccuuauaaaggaaaacauuucauuggagcuggcuuacaguuucugauguugagccgggcaugguggcacacgccuuuaaucccagcacuugggaggcagaggcaggcgaauuucugaguuugaggucagccuggucuacaaaaugauuuccaggacagccagggcuacacagagaaacccugccuugaaaaaccaaaaaaaaaaaaaaagaaagaaagaaaguuuuugauguugggccggagugauggcuuagugguugggagcacugacugcuuuucuggaagacccggguucaauacucagcacgcacauaucaucucacagcugucuguaacuccaaggucugacucccucauacagacuuacaugugggcaaaacaccaaugcacauuaaaaaggaguaacuuucagggguuuaguccauuaucauugugaagaagcauggggcacacaggcagacauggugcuggaagaucuacaucuugacuauaacccauagugggcaugccuccacagugacacacuuccuccauaaggccacaccuacuccaacaagaccacacccccuaauagugccacucucuuggccaagcauucaaauacauaagucuaugggggugggggguguuauaccuguucaaaccaccacaaggagccauaugucccuucugccagcaagggaaaaagaugccuguugcugaagagauucccaagggaugcuggcuuuuaucuaacugccagaaauccuuccgucuuccagcuugagcugagucuauaaauucaguuuuggaucaagucaaugucaguggacaugacauaauuguuuguuuuuuaagucggggucuucuaucucagcuuugcaagcaaagaugaccuugaaggucucaucuuccugccucugccucccaacugcuagaauuacaggcgugugccaccaugccugucuuguguggugcugagaauggauggaauccugaacugucugugugcuaggccagcacucuaccacgugaacugcuuuuacagcccagccccugggugggacuuuauccauucuucaggcauguaguaucccuggaagcaaaguggaaugggaacccucuuuccuuugcccugggugagccccugcccugggccuccuacagcucccuggagccugggggccaaugagauagacuuuaaaguacaggcgaggaacccgaggcucagcgaggugacuggucuuguggcauguguccuguacacagcccuccugggaagggauauugaaguggacagggggacuccgggauaccuuagucuuugucuaagcaggggagaaggcaaugggaaaaggaccugacuggacugaacuggaagcagcugaaaccauagaguuggaauuguauccugaccaaucacucuugagaacugggaggauaauauuaaaaaagagggcuaguccugaucaauggcauacugcucaacuuggaaaucccuaaccuuagagacugcccuaguagcucuccuuucucagcccucccaccugucacuguagucugugagaccugucuaucugucuguacuucuuuuuuaaagaauuauuaggggcuggugagauggcucagcagguaagagcacccgacugcucuuccgaagguccugaguucaaaucccagcaaccacaugguggcuuacaaccauccguaacaagaucugacucccucuucuggugugucugaagacagcuacaguguacuuacauauaauaaauaaauaaauaaaucuuuuuuuuuuuuaaaagaauuauuuauuuuauguauggguaugagagugcacugucacugucuucagacacaccugaagagggcaucagauuccguugugagccaccaugugguugcugggaauuaaacucaggaccucuggaagagcagucagugcucuuaaucgcugagccaucucuccagccggagaccugucuuucuggcagggcucuagacacauaccauguuccccaagccgguaaggcucagagccuccacccaaacuggggcuuugucuuccugggucccaugucauaugccaucagaacucaccccauccaagccugaguuccucugguggccugaaaaccccagcagacuugcccauggcucacuaauggcucacuaaugaggcuaccaccaccaccagucccucuuugcaaggaucuccugggacucccacuguacagccccugcucagcuacucaggcuccauaucccugguucuccuaggugugucccacgaaacccuguuugguuguugaauagagucuuaugcguuuuucuugcaccuuaugagaggaccccugguuggggcugcauaucaugucugcagaggucuggggagggaacaggugggguaccacacauaggaagccuggguggggaucuugccugagugaccaccucucuucuugugccuguauccccaucagaucgccugacucucccuuggcucauucuguuggcacucagcccagaggugagaucuaugggguucaaugugggcugcaucugaccauccccaugacaccaucuuggcucccagucagccagggaaacagauggagguacauccauuaagaguguugcacuugaguuggaaaacagugcuggaccuggugccaaguucugucucugccagccuguauuucugcccagucucacugccuacagugaaucauagagaguccugauaacagggagccgggguaaggcuuagagcagcacuaugaccaguuaacacacuaccugaaaauagcucccugcccuagggaaggaagccuagggguaccggggagguaacagggacagcccaggcucuucugacaagggcuaggacuugggggugcagcugcaaggcccacccagugggggaugggaccaugcuuugagucuaaagucacauggguauugaguuguggccaacuuggcuggguacauaacuucuauuccuggaucuucagcugggggccaaugauaccaaauauggccugauucuagcaccuucuaguuguggucaggcacaccuuaccccaccucaggccugguggucggucuccacccuaugccauggucuuaaauacucagggguacacucugcugauggcuguccauacauccaucuaccuguaguccuacuggguucccagcacccagggaauauaggaggcagaucucugagcuccaggacagccagggcuacacagagaaacccugucuuucuaaaaaaaaaaaaaaucaaaaugcuuaugaccaaaauagccucauuccccaaaggaggaggacagagcuggugacuucccagggucugucucgcugugggcucagccacacauacgacucugguugggcucccaaggagcucacugaccuugguuccagccucacuggcucccuggugcucuuggucauuuagcaccccccacccugcucagccacugaucugcuggcucccagacuuccucacgucuugcuucauucacugccucuccuaccuguccaacagguugacaacaccuaucgagcuggauaggauuccagaugcuaaacaaguacaacaaaauacaaaucccugaaugagcuucucaucccagcaggaagggaaguugggagcaagauccugaguucgaggcuagccugagccacugccucaaagacaacaaaaaaacacaaggcugagauaucagcugaguugguagaacguuugccuugcucacgugaagcauuguggaaggaggaucagaaguucagggucaucuuugggcuauauaguaaauuggaaacuaggaaacuagucuguucuacaugaguugcucaauaaaacaacauaucuacccuuguugggugucuuaggguuucauugugaccaugaugacuuuuuuuuuaaacgaauuagugcucugucugcacguauaccugcgugccaaaagagggcaucagaccccauuaucgaugguugagccaccaugugguugcugggaauugaauucugaaccuuuggaagagcagcaggcuuaaccacugagccaugucuccagccugaacaugguauacucuuauaaaggaaagcauuuaacugggguuggcuuagaguuucagagguuuagucccuuauagucauggugggaagcaugauggcacacagacagacaugaugcuaaagaaggagcugagaguucuacaucuugauaugcaggcaggcagggagagaaagacacuggguguggccugagcagcugaccucuaccccauccccaagugacacaauccaacaaguccacaccuccuaauauugccacucccuauguggccaagggagccauuuucauucaaauuaccauauugggcuauuucuaaauaauuuaccuguacaguaagcacaguguuuugggauaagugcuagggagaauaaaccaaaguggaaggcaggggggagcucuagagugaaguauucgaggcuugagagcaaguuaggaguggagagugagccacccaagcagagaggguggcuaguccugaggcagcauauugaguucugagacacuggaaagacagauggcuuagauagauaaggagccagggagagggugguaugacagaagacacagguauaaggcauauacagggccgggggaccagagugucuuaaggucuguucaaggccauuugaacuuacuauaauagccuaggcuagucuugauccucuugucucaucuuuguagugaugaaaacauaguuugguugguuugguuugauuuuucaagacacaguuucucuauguaguccuggcuguccuggaacuuuaagaccucucuuuaagaccagguuaauuuggaacucagauucaccugccuugcccucuuaagugcugagauuaaagucagauuaaaacauuuuuaaaagaugugccagccgggcagugguggugcacgccuuuaaucccaguacuugggagguagaggcaggaggauuucugaguucgaggccagccuggucuacagagugaguuccaggacagcuagggauacacagaaaaacccugucucucgaaaagccaacaacaacaaaaaaagugucuauuuauuauuuaugagcacacuaugacugucuucaggcacaucagaagagggcaccagaucccauuacagaugguuaugagccaccaugagguugcugagaauugaacucaggaccucugaaagggcagcuggugcucuuaaccacugagccaucccuccaacccccccagauuaaaacauuuuuaagagucauuucauguauauguauuuaucucucuguguguauguaugcaugugauuguaaacagggccagaaagggaggggguacugugugucuuagagguggaguuguaggcauuuguaagccacuaguugugggaucugaacuccggucugacacagccaccuuccuugguaccucccauugucccuuccagccuauggugccaacaaaggugcaggcuccuacugaccagugccuccaccaucugacuguucuucccuucucuucccgaucgaugcccagcccaagugucacuucacccagugaguucuagucaauuggacugacccuguuucuagacaguguucccacagggcugagcauaggcaaaugugcucaguuugacaacagggcgggccucuaaaagccagagcugaguggcuugcccuucuggauggaagggagugguugcugauggccucuagcugucuuggacuuuuuugccuucuaucuuuugcaggugggugugacaggccugagcaugagaggacaagcuauauacuccgguuggcacagaagacuaguuccuaacccagugugcauguccaggaugccugcaggcugcuaggaccccucaccuccuuguuauggacugcccaggcuggucaguagcucuuuauccuggacggaguucaguauguuggcucaaaccccaucccugugagaugauaauuccaagaguccuggagggacucaguucucaguucccaguagcaucuaccugacugggucuaguccugugaccucuuuccacucaaaauuucugguuucuaauguccaaauaaugcgcaauuggccaggugguaguggugcaugcuuuuaaucucagcacuugggaggcagaagcagguggaucucugagcucaagguuaaccugaucucugguuuauagagcgaguaccagaacaucacauccagggcuauacagagaaauccugucucccaaaacaaaacaaagcaaaacaaaacacacacacacaaaccaagcaaaccaaaaaagcccacaaaacagaugcaacuguccucuggaguggccgagggucugaggggugugacugcagcccagaacaugcagcagguaugguguuaaaguucaggucauagggcagaguucauccagcaaaccagacacacccuuagcuacugucuuccaggaccagcuauugcuccagagagcccacccugcccacuccucccaugcacauccugucacugucugccuggggacagcuugaugacuauagacugucuauuuccucauccuuaaggcagaggcgaggagaggcaaggauuaaccuggucagguugccuguaaggguuuaacagguuuggaugugugaaaugcuaaauuuauugaaagagcaaauguaagaagcaguagagcauggaggcugaggcgggaggaucacgagugaaaaaccagccaggucuauauagugaacucccauccucaccaacuuagaaaguccgccagguguaguagcacacgcugccaauccuguaggagaccugaguuuggucccuaagaccuauguugggcagcucacauccaccuguaacucuagcugcaggggcuccaaugcucucuuuuggucucugcacgcaucuacaggugugcacgauacucaccccaccccaccccaauaauuaaaaaugaaauaauuugagucuaaagagcugguccagugguuacaagcacuggcucucuuccagaaggcucgaguuugauuucugcaacucacuugacgccacucaaaaccuucuguuuccagucccaggggauccagugcccuccuuuggucuucaagggugcucaugccugugguacaccaauagacacacaggaaaaacacccauacaccuaaaauaaauaguauauaauaaauaaauccuuagugaaaaagaagcgcauggcccaaguauccuuccgucucuauccccccgggguugggguucuaggcgugcacugcuguuucugucuuuuccacggguucccuggauccgaacccagguacucguacuagacauguuacccacugagacaucucugccacccuaagcccaggucuucaugccaaaugugugugaggcauuuaguggccugucuuugaguaagccaaagccuguucauggagcgaagggucaaaggacaagcuaccgccccaauaccaagaggaggcagacuaggucaggcagaggguguuauguggcaaagucauugcuucugacugcccuuucacaugcuagacauuggcuguacacucugagacacaucgcuucuggucccuacguucacggguuuaugauacaaggggcaaaaaggaccuugcccagacccugccuacgguucccaugucacagaugagcagccagccugccaggguacaacucaugccucaugugucccagagacccugggcuuuggaauauuaucuuucccuggcgucaguaggaaacguguuucuugagggucacagaugccuacgucuggccuaccugaaugcuggugcucauguuuuacagacaagucaaucuuuaugggcaucuccuguucccaucuggaggagaccauguccaagccccccgacugccugcugcggaugcucaggggcacccccagacagcgggucuucaccuucuucaucaucagcuucaaguucauguucuugaucuccauccugaucuacuggcacacugugggugcacccaaggaccaaagagaguauagccugccaguagacuucuccugcccccagcuggccuuuccuagagucucugccccaggcaacaucuucuuccuagagacaucggacaggaccagucccaacuuucuauuuauguguucuguggaaucagcugccagggcacacccugaaucccaggugguugugcugaugaaagggcugccuagggacaccacagcucagccccggaaccucggcaucucucuucugagcuguuuuccuaaugucuggauacgaccucuggacuugcaagaacuguuugaggacacaccacuggcagccugguacucggaggcacggcacagaugggagcccuaccaguugcccguacugucugaugcuuccaggaucgcacuccucuggaaguuuggugggaucuaccuggacacagacuucaucguccucaagaaccugcucaaccugaccaacacgcugggcauccaaucccgcuauguccucaacggugccuuccuagccuucgagcgcaagcaugaguucuuggcacugugucuacaugacuucguggccaacuacaaugguuggauuuggggucaccagggcccccaacugcuuacccgagucuucaagaagugguguuccauccaaagccuggaaaagagccaugcuugccguggggucacugcccugccccccgaggccuucuaccccauccccuggcagaacuggaagaaauacuuugaagacaucagccccgaggagcugacccagcugcucaaugccaccuaugcuguucauguguggaacaagaaaagucaggguacacaccuagaggccacauccaaggcucugcuggcccagcuacaugcccgcuauugcccuacgacacauagagccaugaagauguacuugugacagcccuucaggcugcagucauaucauaucaacauuguuaccgccuuuccagggagacaagaugagcagacagggaaaaaggggccuuugagaugcugcuguugacuuuagaggagaccaagcuggccuggggaacacuugccaguucuacaccugccccucuaagccaaagggagaccgauggagaacacuuuguccgguguucuaggcugaccagugauuacagaauuacuaacaucuggggccuuaaugggcuagaucacaagaacacuaaagagcauucuaagguagcuggaagacagcugguuagagguggggucaggagcggagcucugaaaaccuguguagaaaugcugagggagaaggaccuggcucucucagccucaugagcccaaggggaggggcagggcucccugggaacaccaucuuuccuccccugggacagugcucugaagaucuaucacagccuguuccaguguucggggauguggacuuuuuuuuuuuuuuuccgagacaggguuucucuguguagcccuggcuguccuggaacucacucuguagaccaggcuggccucgaacucagaagcccucccagugcugggauuaaaggcguaugccaccacugccuggcuuuuuuuuuuuuuuuaauuuuuuaauuuuuuauuuuuauuuuuauuuugguuuguggaaauucuuuagguuuuaaaaaaggaaaaagaguuuuaaacucccucccuguuguagacacugggggcucuaauaaaagugacucaccaacaugu

SEQ ID NO: 7912 - RNA, 50543 nt, Mus musculus
ugucgucacgcgcagccccgccccucggucuccgggaggcggcaaccgcuacuccuugucucuucccgguugucggggacugcuucaccucaguucucagugacuaugggggaccccagcaagcaggacauccuggccaucuucaagcgccugcgcucggugcccacuaacaagguaacggccgcaggcgggcuugggaccccgcggcccgccggaccccgguguggccgcggccgugggaggagccgcccggccugugacacgucgcacugugggccuggcagccgccgcuccccaaccuucgucagcaaggggaggaaaagggggcgcccaccaggggcuuagcgccuggggcacagggacaugggcauccggaggauguccaggacuaaaaggcagagagccuggggucacaggacuggggcauggacaucugggaugucuagcauccuagggcagagcgucuggggucacagggggggcugggacauggacaguugggguguccgccaccagaggccagaacaccuggggauagacagaagacuggggcauggacaucuggaacaggagaccagugcauuucauggcagagagaggacugggguauggaccucuaggaguguccagguuacccagacgccagacuaccugggggcuuagagagaaggcuaguucauagcaucuaggggugucuaggggucuggagaacagagcaccuugacccagaagcacagacaugguaggguggaggaaacagauguuggaaguguguagcugggcucugagaaggcuggugaggcagaguucacuccuucuggccucugugaacaaagguaaaaaucccagccaccuagacccaggggucagaacucuaaguggugcuaaguucugggaaagaagggcuucuccccccaccauggaccuugucuugaguguucuucagggcuggggaccuguuggauuuuugucaccauuguccuucgguggcagccuguuucccaguccaguagagcuaagguucucuucccugguugccagcucucuggguuccugaggaagcucacuaaaacucacguucaucccucuguagguugaggucugucccuacaauuuuuuucuuccccuuaugugaccccccccacacacacacacacacagaccccacccccaaccacugggccucauaacuuuuagcauguggcuggcaguguuguuuugauacacaggguuaaggugucuacuuccuuaggaugacggaguaggguggaacccgaggagugcaaagggcugucgugucacuguggacucuccccaccccucuccaaguuccaucugguugccaccuucaccucugaggaaccaucuguuaaugggcacagccgugauuacagaguccugcauggcuggcauagaaaguuccaacaugucacaaaauucaggcuuuuuuuuuuuuuaaugucuugaugguggaagggagcccuagguuuuuauagccuuaugaugaaggaaaugguuaaaugggggugauaaugucagguggguauaaggaagaagagcuggcuuccagccacugcauuguccagugucugucacuugcugguuucuuguuuuuuguuuauuuuuuucagauuuagauugaucuguguguagcaaggacuugcuucuuaccacacaagguuggaucuccagcuggcaggcugggaaagugcguaugcugccacuuucucugaguugcacgccaguguguauucccuucgaauguaucaaaaaggccacugcuaaauaacaaaacaaaaaagcaagaagcaacaacaaaaaaaaggaagacacuccuuuuacaucagaagucccugucaucaauaccagcagacacuuuuaaggagcccacgugggcuugcuuguguauuaaaauguuaguugaguacaguagcacauggugcgaccccagcacuugggaggugaaagcaagaagaacaagaguucaagggcagccuccgcuacagagcaaguucuaagccagccuuagacuacauuagacuacuucuccaaaaaaaaaaaaaaaaaaaguaaaauuauuguccagcuggccaugagaguacauaccuagagucccagcccuugggaaacugaggcgguuggauuuccaauaguuaaaggccagcuugagguacguagugguuuuuugauuaguauguguuacaaagcaacacaaaaugccucaaaauguaaacacccagacacacacgaaagccuggucagacacuaaaccacaugaaugcagcccucccccuuuuuucauuuuauucugaagagcacaccuauagaaacuuuauguucuauaauaugauauuuuuuaaauuauugauuuuaaauauaugaguccucugucucugucuucagacacaucagaagagaacauuagaccccauuacagaugguugugagccaccaugugguugcugggauuugaacucaggaccucuggaagagcagucagugcucuuaaccaccgagucaucucuccugugauaugauuucuaaagcaagauuccaaaguagcuucuggucaugucucauggcacuggcuuuccuuuaugguuguggcuugaagccauugcugacuggauggauuugacgugaaaagugaugaaacuaguuucugguuuugugagaugggguuucucuguguaucccuagauguccuggaauccacucuguagaccaggcuagccucaaacucacagagauuugccugcugcugccucugcuuccgcagugaugggauuaaagcugugccccaccacgcccugcuggugaaaacuaguucuaaugacuagaaggacugggcaacaauaagcuccaucauucuaguguagugcugggguuugaaccuaggaccuguguacucuaaacaggcacuuugccauugagcaauaccuucaguucguucuuccuuccuuuuuucguuuuuucuuuucuuucuuuucuuuuccuuucucuucuuuuccuuucucuucucuucucuucucuucuuuucuuuucuuuucuuuuccuuucuuuucuuuuugagacagguuuugccuauguagcccaggccagcuuugaacucacuauguaacccuaggcuggccuugaauuuugcaauccuugccacagcuuucugaaugacaaaauuaugagaugaggauggcuucaagccacccagucaucaugccuagcuuaacagcacucuuaaacugcuugaguugaggcaggaggauugccaaauucaaggcuagaccauauaacaauguucuuucacaaaugaaaauuaaaaacaacaacaacaacaaaauaaguacacuauguaaagacucaucugggguuguaaggacgugcccucuaaguaaacuuuuugcucugauagggcuggaagcaugauaccugcuucacacuuaauuccagcaccugaaaggaaaggcaaggaggguugggaugucagauuuacccacagcuacagaacaagugugacccaggcugaguugcaggagacccugucuaaacagggggagagauuguaaaaaaaaaggggggggccucaaaaauacguugucagaaaagcaacaggaaggcagcuagguuuccuuuuaucuggaauccacuguccguucccuuggaucuaacgauggucugcuuggaugaaaggucucggcucgcaggcugguuucuguacuggacugcuccucgggucagucagcaccuguugguuccggugcuguguaaagcucugcagacuuuuacgcuggagguagagacacagcacgugccuucagggagccugcaguagggguggaaaauggaagggacagggcuggagagacagaugagcagugaagagcgugugcugccuuugcaaaggacccgagugaguucccagcaccgacggcagguggcucacugccacuuguaauccccguuccagggaccgugccucuggacucagggcagcugccauacccacacauacccacaugauuagaaaauauauauauauaguagauggggaugcuggaaagauggcucagugguuaagagaacuuaugucuccaacacagggccuguuuuugguuccugguacccacgugauuaugcagaaccacucaaaaccauccauuaacuccagcuccugaggacccaaugcccucugcuggugcagacaccagacacacaugugguguacagauacacguauaggcaaaacacuuaauuucauuuuuaaaaguagaugaagaacuuugugauacugugcuaacacggggggagacaucugcuuccuacguuucucauuuucguucuguucugaaauaagguuucagguaucccaggcuggccucccaugcucuguguagcuaaagacaaccuugaacuccugauccccuuaacuccacugcccaggcaugccccaccauuccauuccgagagauuucccaggugucacagucacugaggcugcugaggugauaaacccuuuccuucagguuuuugugaaggcuuuguguaguguuagcugccauuuccguaagaaaguucucauuaucgggcuaaacgcugucagcuaaaagcuguugcuuuuccccuucuacgaacugaauucuccuuagaaaaccauauuuuuuguuugggaucaccuaucaaagcagagcagaccccauuucgugucucccuuccccuguaguucagcuugccugcccuagacugugcacagcaaacuccugccuccucgccucuuccacagggccugcauaggacaccuuguuugauaugcuaaccuaaagccauaagaucacauaaugaguugucucucccacuagaccagcgagugccaaggggcagccguuuguaccagggcccgcacaggauagaaagugcauguuaaagucaggugagcagcacuguccccuccaggaagcuccugacuuccagagcuggugcccaagcacuguuuggugucuguguccgucucuccccacacaguggccagcacguggccuggcagagacugggucucaguaugcacugcuggauucuaugauggcauccaugccuuuguaccuuggcuccugucauagugucugacacguagcaggcaggcagagaacaccacagugagucacuggccagcugcucuacauacccgaugucacuccacacccacugucgccgaucagccugagcccggcugguggugguuuuuaguaguuuuuccuuucccaaggucagaagcagcucuuuccucaggguacuuuuacuuuauaaacuguaucuagagugagcuggguucugaaaaagagacaauuuuccugcuuguaagaauuuugugauugcuauccugacuugaauuaacaugaugucuguggaaggcacuauguaugcauggauuuauuuuggguguacaggcucacaugaguaccauggugugugugcauuccauggccugcuugagugggucagaggacaacuuaagggauucauuucuuccauuauguaagauccaaggauugaacucgggucaucaaagcuuggccacagcaccuuuacccacugagcccucuggguggcccagcaaguguuuucucucaucauuguugaaggaagggucugcugacaguuuuugagcuggcaauaauugguguauuguuguuagcuuggcuuacaaagguuugcuaagugcuuaggagcagggaauaugggaucaagguccgugggagcuaaauacccagagcuguucagccagcauuaagcaccugugcuaacagagagagcagguuacaggaaaggccuagcccugcaggagcucucggugccugcagagcagagggccacugcugaggugacuugugauucuaauuguucucaaagugucguguuucagagaggaacacuggacuagcccuccaaacuuagcgucuacacccauguggguucagagauuaggaguggagagugacuuagcuggcuggguguguccugucugugacacagcaacggucauuugagcagugugguguggucaggccuccgaucuccacaggcgguucagcuagggccuuagcacuugagccucugcccagggcuaucugagucuccuggagaaaccuuagcugguuucucccaagagguagugacccaggggcaacgaggccguggugucuuagccuaaucacaaaaguagucuacaaagugaauuccaggccagccagggcuauacagagaaacccugucucaaaaaacaaaaacaaaaaacaaaacaaaacaaaaaguagugggugaguccugccgccuccuucuauaaggcaccuugguaaagugaggcagagauugugugaggacgugacuauuaagaggugagggaugacggggcaucugacagacaagacucacacccaggagccugccauguaggauacagccacugcccaggugauggugugggacugugucccagcagagccucguuccucacaggcaugaauuuauauggcaagggucccuacugagucuucaaagacagcagcguuuggccuggaucuauagucuuuuuacucuaauuaucguaguuauagaucauuauuauaaugaaagaaacuuaagaauuuugaaaaccuagguggaauccuuucuuuuacucuguguguguccauguggaugugugggcacacgugugcugggauauaaaugugugggcacacguguguguggaggccagaagacaaucucagcugucauuccucagaugccaucuaccuuguuucucugaggcagguucucucacaggcuuggaacuuggcaagcagaucaucuaccugucucugcccacuaugugauaugcagccacagccagcuauccucucccccucccccaggggcccuaggaaccggccacaggucuucaugccugcaagaccagcacuuuguggccugagaguuuccugagccucugggugacacacuggcuuaaaagugugacagcugagccaccuucauaucagccuuguacucuugccuccugggugaguccccugcuaaugccaguuaguccucaaccaguucuaaugacuguuuguucuuucagguguguuuugacuguggugccaaaaaucccagcugggccagcauaagcuaugggguguuucucugcauugacugcucuggaucacaccggucgcucgggguucacuugaguuuuauucgguaagugaacucucuccacuggcugguugguaccuggaugucucccuaggaguaaugcaaaggagaacagguuaguuuggcucucaguuugagggugcaguccaccauagcagcaggagugaccugacugccccuauagcuuccaagucgggggcagaucugaaugcugcuguucagcucaauuucccagccuggggaugacgcagcccacguucacggugggucuuccccaguuaaaccugcccggaaacucccuaacaggcacacuccauguuugcuuucccauguggugcggaagccagucaaacuggcagugaaaauaaaccacccaugggcuuggagacaggcugcugcuccagaggugcugaguucagugcacagcacucacauggcugcucacaaccauuuauaccugcaucccuccugugccgugccgaugcucaugcagacagcacucauacccauagaauauaugaaugauuaaagagaaagggaagaaaguuaaccaggaaugucccugucucccccugucauugauguugacuugacaucaguaaaaugacacguaaccauaaucugggggucggggguuaacucuugcaucaucuagugacgugggaaaacaggccauuuuuuuucucgggccucuguggagaucuuguggaagaaaucaagcucugguguugaagacaaagucagaugggaggucucaaagcaacaguuccuuuuccucccaggccuucuaagaaauuaaaguacacacugugcacacacaagguugagaguucacaugaaggguggaguccuccucauccagaugugguacccagcauccuccuccagcucccauucccacuggcacuagcagggcaaagccugagcggaugaguugguccagcuuuugcuggugaugucacauguuuguauaggaaggccuuucuucccucuuuacccuggccacuccagugaggaaauguccuuccucuucccacacugugggcuccagagagaggugcagccccacagugggagggagggaaaaagccucugaagugaagugaagagaaauaaugacuaggcagagggcuggaguuagaccagaggcccagcaggaucugcccagcugccugagccuugucagggcaccuucugcaggucaucucagggacucaggccucuguuggugccacuuccuccagcagcuggccugugucccugcuccucuucugggaaagaacuguggcaaugauuucuugucauuguuguuaacuuaaggaacauugucacaaugugacuaccacaaugugacaaugcuacuaaaguagcauuuaucccuguaugaaaaaaccaauaaagaugagacuuuuuacauaucagcagagaaacuauacagugauggcuauaacaucuucugucuuuaauuuuuuuaaaucugugugaguaucuguggguggguaggggugugugugugugugugugugugugugguaggugugugcauguauguaugugguugucuauggaggccagcagacacccuccaaucuucuagggcugaaguuacaggcaagugugugucacguguguucugggaacagaacucaguuccucuucaagagcaauaagcauccagagccaccagcccaccugagggcaugguguagcuggcuggcuaacugcauagguaauuacuaagaaaagggaauugcuuugaguauuauugcuuguuucaaaauuucagucaucuuccuuugucugagauucugguuccagaauguuuggagugugccaucgcauacuuguuguguuuuuggcuguuguuguuauuauuauuauuauuauuauuauuauuauuauuauuauuauuuuggcuuuucaagacaucauuucuccauguagcccuggcucuccuggaacucacucuguagaccaggcuggcuucaaacccacagagaucugccugccucugcaucccgaguacuugggauuaaaggcauacaccgacaccacccaguuuaugauuugccuauuuuaauacuuucauguucuaguuuucaaucuguuccugugauaaaacauauauccaaaagcaacuuaaggagaguucauuuuggcucaggauucuaaagggagaauccauaaugguuuaaaaaaaaaaucgcagcaggaaaugaggucagccugacagccagaaagcagagagagauuaggaagaggggcaagguucucagaauuuaaagccucucugacugacauccuccagcaaggcuccaccuccugaggugccauacccuuccagagagauccaccagcugggaccuaagccuucacggcucgcaggaggcugcggucacugacccaagccuucacggcguguauggauagaguuuggaugcuugcuguuuugcacuggcuugacuuugcacuuagcucacucuuaccauccauuccuccauaacccuuuccuugcugagacugaauaacgcucuagggaucuauaaacacugauuugcuugucuguccaaccauggguagacacuugaauugcucccacaugguagccauggaaauaaagcugcccugagcauguguauacacuugucacuuugagaacuguccugagccccuugaggacagcacucggaagugcugucaacaacucaggugauaacuauauuucuccucuugugaggaagccccuccuuguccagaaugacucggccaccauacaucccgccauuucugcuuaucuucaucggcacucagcaucuuccuccuccucuuccucuccuccucuuccuccccuccucuuccuuuccuccucuuccucuccuccucuuccugguccuuacccuccugcuccugcucuucuuuucuuuucuguagugcugaagacuacaccaggggccucgggcaugcugcauggguauucugcugcugagccagacccuuagccaagacucacucccucccucccucccucccucccuccuucccucccucccucccucccucccuccuucccucccucccucccucccucccuccccacccucucgcaccagccauugggugugagguaguuucuccuuuuauuucugguaugaauuucccagugguuagcgcucagcaucuucucaugcacgauggacgucuguguuccugcacccugguuuggauugaguuguuuguuauauugagcuuucagaguucuuuauguuugccauauauugaucccuuauaauagauacaauuugaaaauauuuccucccaucugauggauguaucgauuuucuuuucuuucuuuuucuuucuuucuuucuuucuuucuuucuuucuuucuuucuuucugucugucugucugucucccucuuucuuucuuucuuucuuucuuucuuucuuucuuucuuucuuucuuuccuaauggcuguaucaguacucuuucuuucugucugucugucugucuuucaagacaggguuuccuuguguaacccuggcuuuccuggaacucgcucuguagaccagacuggccucaaacuuaaaaaucuuccugucucugccaccugcgugcugggauuaaaggggugagccaccaccaucaucaccaccuccuggcucuguuuguugauacacuugucuuuccugacauccuguuaguguaugccuuuuggauccuugccgaggcgcacacaucaaacccacugcuggagguuuucauccuguucuuuccaaggguuuuaugguuucaaauaccacauuuaugucuuugacccuuuugaguuuuguuuuuguuacuuagauagggucucaccauguagugcuggauguccuggaacuugccauguagacuaggcuguccuuaaacucacagagauucacuugucccugccucccaagugcugggacuaaaggucuaugccaccacgcccaguuugaguuaauuuuuguuugugguuauaacuaagugaauaacuucauagcgggggggggggggcgggggagcagaugaacugaggaccguguauguaugaacgccacauuaauggaugcuaggcaguugaccugguagaaugugcgcuacagggaagugaaugcccagccucucaguacuuuuauuuugagacagguucucacacauugccugggcuggccuuaaacucacucugugguccacacuggccgugaacuuguaaucuuccauccucugccuccuaagauuauagaugugagccgccugcaccaccaccccuccccccagcuuccagacuuacuuuugagaauguuuuucccagauuggucacgagcuguucauacacagugccacacccuguccagaguauagaaagaccggacaugaggccacccacagcugccccuccucugccugugcuguucuguccuaugaucaccucugaggcaugugcccaugcacagaguuccaggaaaccagguaggaagaggacuggccuggaaccuggacagcgagaucuguugggccugugcagguucaagcuugcaccuuuuaaaagucagauaaauguaugagucacaugcuuauggaagauucaaaaaauaacaaguaaagaacacugagccaaaggcagcugccaaggcugugggcgggagaaaguccagggcacucacugcugaguuaaggcuagccuggucuacauagugaaguccaggcuagccaggacuacagaaagacaaaaucagacaaacaagccaucccaagccugacacaguggcacaugaaaggaaccccagcccuggggagucuaagaguaaccuaauugaccucaaaagacccagaaaaacacaaacacccacagugaaaaaguuucagcagccccaaguaugcaaaugagagacggaagcuccugcacuggccccucccuucuuucucucacuaccucugccagccacacacaugcacacacagacagcuguagcucucacaugugaacacugggaacagugugccauggaugauauaguuaaccaagggcagguuuuguuuuuagguugaauuucauguuagugauuuuuacaaaggacaaaguaauuucuaaaccgucuuugguugguagucaaugaagcaaauuaggagugugaguacagacaaaccagacgugaugccuaggccaggacccgggcagagcuguucacaggggcgcucagacucagccaggugacugaccgcucaagggauuaaaaaagagccugagcagggccugcgucuccaucuccucgccucagcgguuaacaagagcacuuuuuuuuucccucagcacucggcuuucauaggacucugccaagcagcagcucuuccuguggcaguggguacugccuaaggcuucugccugcuggggugggcguacauaggccuuuaccaccuuugucuuggggggucuagggcuccgcaggaaucccuggcagcucaguuuaagagcccugccuaaccggagcuggagaggugacuccaguuuuaguuaagagcacuugcuccucuuguagaagacccagguucagcucccagcagucccgucagauggcgacgcacccgugaccccauccauaggcauauaugugacagaugcaacauacauguacauaauaaaaauaaauguuaaagaaaaagagaagaggauggaaagauagcucagugaugaaaaguauuggcuauucuuccagagaacccagguuugguucccagcaugcauguggagucucauaacuguguguagcucuagguguagaccagguauacacauggugcacagacacacauguggguaaggcaaacacauagcagccauagugcucacccugggcuccugucuuaccccuugggggcacugaaacaggguuauagggaaaucugucaaggcucugccccugccuguguggguuacagggguaacaggugcacagcaccaggccuggccacacagaacuccccaaaucccacagugcaaggaaauguuucuuguuuuuguuuguuuguuuuuguuuucauauuuuuggauuuaucuauuuauuauguaugcagcuuucuugcugcauguaugucugcaggccagaagagggcaucagauccccuuaaagaugauuguaagccaccaugugguugcugggaauugaacucaggacaaccucuagaagagcagucagccaucuuaacuacuuaacuacugagccaucucuccagcccugagggaacauuuuggaaguuuagcaguuugaugccagagauggagaguuucacaucuuguaaccuuuguguuccucucagguccacagagcuggauucaaacuggucgugguuccagcuucgaugcaugcaaguuggagggaacucaaaugcuguaagucccccggacuugcccuucccucugcugguagaccagaaaccuuuccaguggagccagugugugugugucuucuggggcaggggcacgacaggguucguuuucuucagugcuguagccagaggaucauuguucaggcuccaauaaauagccccaccccaugcuucugccagcaucccuaacugaacucagugggucacacaaaaaggcaaggccaacagaagacaugaaagaagaaggggacuuguugggacaggcggugacaggagagcgagaggguaaaaaggagcagagcaugucagacacagggacagaguugucaaagaagagaacggucuagccagaaacaucuuuugagacacugaugucccauuuguuuccaaaugauaccaacuggugucugggguccuuucugaggugcaauugaaccaaaugcaagaaaucauauguggucccaugugguggccacaccugauacaggaaucccugacacccagcaagcaggaacaaggaggaucuuugugaguuugaggccagccuggucuacauaaggaguuccaggcuagccaggacuauauggugagaugcuagaaagaaaagaaacuacauuaguauauaucucaaaaauuaugucuaggcuuaaauauuuaaaaucauaaucuuuuuuaaagacuuauuuauuuauuauauguaaguacacuguaacugucuucagacaccccagaaggagggcaucagaucucauuacagaugguugugagccaccaugugauugcugggauuugaacucaggaccuuugaaagagcagacagugcucuuaaccgcugagccaucucuccagcccuaaaaucaaaaucuuaagucuaaaauauugacuuccaaaaauguaaaauugccuuagaucagaauuucucaacuguuuuuauuauuccuaagcaaaaagaagauaguagaguauuucaaaguuauguuggguucuguauuuccuaaugagaaaaauuaagaacuaagaaacaugauccuguagccaggucauggaggcacaugccuuuaaucccagcacucgggaggcagaagcagguggaucucugaguucaaggccagccuggucuauagagugagccccaugacagccagggcuauacagagaaacccugacguuccccacccaccaccccaaaaaaguaagaaagaaagagagaaagaggagggaagaaagaagaagaacucuaauucugaguugaggcacucuguggagggcguggccaucagagaaaugaaaaguugucauguuuauucucuaagacaccauguuuguccugccuggcuuuccuuuugugacugugcaucccugguuggucugagcucacaggcauacauagugagacccugcccaucaccgagcccacagaggugguucgaaaagcaaugggcucguucuccuaucuagucuugugucugguuuuaucaaaagauuaacauuaggaccugagaugauucagcuugcugucgagccagaugaccuagccucuauaccuggaacccacuuucuggaaggagacacuagagucccccaaguugucacaugaccuccacauguacuccccccaacaauccauucauccauugaucaauccauaacuguucaauaugaaaauauugucacuauauuggaagggauccuccuuuucaguucuuuaugacauuuaucucuuagcguguaugugcucucaugcuccugcaccugcccugguucguguguagaggucaaaggacaacuugccagagcugaaucucucuucccgagagucucagggauugaacucaggcugucaggguuugcagcaggcgucuguaccuacugagccaucucucuggcccacgauccucucucgaaagggaaguuuacuuuagaccuucuaugcugucuaguuagcuucauuuucccuugacuuucuaagccccucuuucagaagcaggucaaccaugaggucagaggucuugugguauuucuguuaauuugccugcuuuccucuguagucuuccuucuuccaccaacaugggugugccaccaaggacaccaacgccaaguacaacagccgugcggcucagcucuacagggagaagaucaagacucuggccacccaggccacccgcagacacggcaccgaugugaguucuuuaggugaaguucacuugguaaaguguuuuguaauuucucugaagucuccugcaaggagcccaggguauggugggcccucgugaugagaagggcucugcuuugucaauucacaugugacccagaccagcagguuauucuucaaugacaggguccaaagugguaauggcggaaagauaaagaagcuagggaagcuggggguuaggugaugcugcacaagcugugucuuaggccgggcaaguuuacuaagcacagcaucuccuguacaaacugcagcacagcaucuccuacacagacugcagggcaaaugugacagcucagcagaaggcuaccacacaguggagcaaaaucagcaggaagccagucaagcgaugcugcacaaagggaacacagggugucucaagugugucaccgccugagcucacagcagccugggaaucgaugaccacagcccuuuagggggcaagaguugcguuuccaagagcugaagucauagguccucuaagacucuggccccaggcugucacugagugauccagauuuuagaaaaggaacauuccuuguccagaucagccuaucccucagcacgcugggacacugagggucacugcuggggacuuuagguuccuuccagucucccucacacaggccaugucuccauuaacugaccagugcauagcucugcuuaguguguuuggaguuaaagaugccucguuuuaaugagaugagcuggcugacacacagugacaucccagcagggauggcaucucaggaggcagaagaaggaggaauccaagcuugagcccagccugggcucaaagaccccaucucaggagacaaaaauaagcagagaaggugacucacagcuaggguccuggccacucagaaggaaggggcagagagagcacuucaguugugaggccugucugaccuacauagugaguucuaggcuagucagggccuuggaaauaaucaauaaaaggauaaccucauucaauggaccuaagcccagugauagaaugcuuguugccugguaugagaaagacacggggcuugaacuucaugcaugcugcagaagaauuagugcauuaacugccagccuuguuucaugugcauuggaugugcuuccuggugacuacacacagucagggcugagagaggagguaucacagcccucgggggccuaggagcccuagacagcugcucagcccucuuccugggaccaugcucuccauggaaaccaccaggagaauaaaaaaguaugccagugagcgaggcacgugcccugagagggacaggagagcugcucguuugugagcucaggacagcgugccugacucaaccucgcccaguagcgcacuguucucauagcugguucuugcugcgugucuaaagaaggacugagaaccucaggagugcuguguugaggucacaagugacuucaguguggaaagaaaaucgagucugaaauccaggcggggccagaucauggugauuuagaaucugcacuuacaucuuaaccuccuagggguguggaauuuucuggaaugaucccuucuuccaacggugugcucagggcccuguacggacacucuccaguguugugugugagggacuagccgcaggucggcugcaagcucuagaggggagugaggagaggaggcaaacucccugcuaagcucagcuuuguuuuccuuccagcuguggcuggacagcugugcggcuccaccuguguccccuccuccaaaggaggaagauuuuuuugcuucucacgccucucuggagguaaguuugccgccuuguucucaagguuuauuuuaaauuaugugcauguauguguaugaggggcagugugugcauguggaugugguacccauggaguccaaaagagggcaucagauccccaggagcuggaguuacaggcaguugugagcagccccaccuagguacucugcaagagcauuucaagcucucagccacugagcagucucuccagcccugcuucaauuaauuguacagugcacuugcuuauucuaaaaguuauaacaaguguaagauacaggcuaggcuuagguuugagagucuaagaugaacccaugaguaucuugagucaucacuguagugugugcagacagaagacagacucuagacagaagugcaucaggacacacaugucacccagccuccccgcaccccaaccccaagaauacagagauagugacaaccuagcucagcaagcacuucuagcaccuggccuggcuuucuaaagacuuauguguuuaugugucugugugugcguguguacagugugugcgugcuuggugccugcagaagccagcagaggacaucacauccccuggagcuggaguuccaaguagucaugagcugugccugguguggauguuggaaccaaaccugaguccucuguaggggcaaccaguacugcuaaccacugagucgucucucuccagccccuaagaugcugguuucuaauucccgucuucuagcagaggagccaggacuaccuguagaaaacagccacugagguuucugggccacaugugcagaccaucuggaacuagaaacuagaaucuaguucuagcuagaacuaggaagugaggugcggggagagaacgggccagcuguguccacaggacucaggcaguucucagggccucccacuggucagagcugggcagccugaaccacagccucagugcugggcuaccacccagggggucagugaccucucuugagaacagaguggaugggggcagggccggucuuucucacagauccuaaagugugugugggaguccuuaggaaguggagcucagcuggcagguccuacagggggguacuucccaagaccagaaaggaagggaacuggcccacauuaccuuaccagggucaggggacugucuccagugucgagucccauuggcacaggcaaggaaagaaccagcaggcggcuacaaagcacuggacagcgcccuucaaaaguuucaaggccaugagaaauggucgcaagcuacaggggcaggugagcuccucgccccagaguccccaaaccuugaagggaggaagguuggagcccugcagagcccugcaugccgaggggagcugcaucuguaacaguuucccacucugacaggugugcaaggcauuuuaaugccagaggaggcugggugcauagaaauguucuguguggacuagaccaguuuuccauaaauugaaauuauuccagcuguguguggcagugcacaccuuuaagcccagcacuaaggaagcaaaagcaaacagaacucuguaggcuuggggccagcguagucuauaaagugaguuugaggcuggcuggccagggcuacauaagcaagaucguaucucaaaacaacaacaacaauuccaagauuuauucccuagaagggaggagccugggaauguaguucaguuggucacauacuggcuagaacaagcauggggaccuggguucuauccccaccccaacacugcauacacuaggucuuggucaucuguaauccaaucuguagucauugggcagguaaaaggagaaaaagcagaaguucagggucaucuucugccacaauaccaaguucuaggccagucugagguucaugagacugucucaaaacaaauaaaaaagggugagagagagagagagagagagagggagagagggagagagagagagagugugugugaauauugaggcggggcugaggacagauacccaugcucagaagaggcccugcacugcuaacauccucccacccccaugcugguuugccuuaguggggaguccuugcuuuccugccagcuaauggcuucucucaccugcugcaggucaguggugcuaugcaggcauccgcacagccagagucagccucuucaacaccguggggcuuggaaaccacuccagaaaaacaugaagguaagucuguggaguaacucuagagcaauguccuguggucuccuggucaagaugaaacugcuguaguuaccauagaaaccuguuguguuagcccauggacucaggaggcuuucuagaaggcccccacuaagguguuaacuagaggacagcuggauuacuaguuucugccgggcaugguggcgcacgccuuuaaucccagcacuugggaggcagaggcaggcugauuucugaguucgaggccagccuggucuacaaagugaguugcaggacaggcuggucuacacagagaaacccugucucgaaaaaacaaaaacaaaacaaaacuaguuucugcuucaaugaucuaguaccgaaguguggacuuuuauaacuggaaaacaagauuucaggauucuuuuccaaaucuaguuguguuuguuugguugguugguuguuuuguuguuuuuguuuuguuuuacgcauugucuccuuguguagcccuaacuggccuagaacucucuauguagaccaggcuggccgugaauuugcagagcuccauuugccugugccuuagcaaugcugagauuaaaggcauugcacucccaugccugguaauauuucaguuuuaaaaguaauaaauauuucacaguuaauaagucacacauacuuauuauauguauuguagaacuguauuuauuuauugguuuuugaggcagagucucacguagcccagacuguccggaaauucacgagguugcugaggauagcugaacucuugauccuccccgcucugccuccugagugcuuagguuacaggugugcccugccacacccggcugugcaucuauuguaaauauguugucaaucacauaugcauuagaaaugaccuaaguggugugcauagcugccccuucuguuuuaaaacugaguaucuuuuauaggccgaaauguuuuaguaaauuaacaauaaaauguacuuugacagccaagcagugaacuugggauguggaaaacaggaaggacacacgcuggcuuguggaggcucaguaccagcccuuggcuuggggacacaguuagugucugcaaugacuugaagucagugcugucugucaugggaaggguguuaggagagagcggcuccagaggccucagugcagaucucuguuuccugggagagcaguggacagucgguggcugcuuuucauccauggcuuacaaccuguggguuucuuuuucgcauccugugauugagccaccuuggaggaaggcaggaguccaccuggcaucuucccccauucccaucaugccuucucuccuggagaugcagcuccaggugcugccauuggccacgcccagcacagcuguacuuugucucuggccuagcacaguaugccuuguucuggagauaauguggguugcaugugacauguguccccguggaggggaguauguuguccaugugcccuuaguaaaacagugccucacuguaaacugaguccagagugguggcacaugucuucugucucagcacuucgguaaaggcaggaagaucaggguuuagugccauccuuggcuacauagggaguucaaggcuggcccaagcuauaugaaacucuguccaaaacaauuacaaaacaggacagugaaugguauuauugaaagaaaaaaaaaccaccugucucaaaaaacaaaaccaagaacaaagcaaaauauaaaccaugauauuuaaaaaaaaaaacccacuaaauuucauucuauaaaaccaauguuuuaaaaaugcauuugcauuuaguagcucacucgcucuugcucucucucucucucucucucucucucucucucucuggaccccuaucgcucagguuuucucacgcaugcucuauugcugaggaugaguguggacuucugguguccugcuuccaccuccuggggcugcagcugcaggaggacaccagcacagagugcuuacagcacuucuaagucaaauugcuuaugacaaggcucauggggagggaggugacagagccaggggucuaguuggauaggggaaugacugccaugcuuugcagcaucuuaacaugcuuaaagcuguuagcauugauugccuaauagcagagaucuuucagauaugucucccagagagagguggcgguguuugauaugauacaugaccacugcacacuguacacauguguugaaguauuacaguuugucucauaaguacauauuauucugucaaccuaaaagaaaaauguauuuuaaaagugaacauggggggcuagagagauggcucagagguuaagagcacugacuguucuuccaaagguccugaguucaaaucccagcaaccacauggugguucacaaccugaugcccucuucuggugugucugaagacagacagcuacaguauacuuagauauaauaaauaaaucuuaaaaaaaaagugaacaugguggcacacaccuuuaauccuagcauucaggaggcaggcauaucuguuaaguuugaggccagccugguuuacagagugaguucuaggacagcgagggcuacacagagaaacccugacucaaaaaacaaacaaaacaaaauaauaagguccacaugguggcucacaccuuuaaucccagcacucugagcucaggcagccugguuucccugguaauuaugucuuacugaugcugaggagugggguuguagcucagugagagcaccggcuuggcaugugcaccauaaacagcuguaaugauggacuagaccauggagcugcacagcacggggacugaccugguaagguggaaacacagaagccauguggaagaggauuugccaagaguguuuucuacauuaacaucagcauuucacacuuucaggugggccaggacaagggccaagcguggaaggucugaacaccccuggaaaggcugcaccagguaauaugcucagggcccuggguccaucuuugauucugcaucugucucaguuccuaaagugguccaacuuccugauagaacccguuccugaguuuuaccaggcaaagcugcuuuuccauguagccacaucaacggaaaauaacuaaaccuucugguuauuuucaucagacuugucagacuccucagaguugggaaacagaugcagaaggagucuaaagcagagcaauggagauagaguucccugugggcauccucccaccugacuucacaccugggcauccuucacaccugacuucacaccugggcauucuucacaucugggcauucuucacaccugggcauccuucacaccugacuucacaccugggcauccgucacaccugacuucacacauggggauccuucacagcugacgucacaccugggcauucuucacaccuggccauccuucacaccugacuucacaucugggcauucuucaaaccuggucauuuucacaccuggccauccuucacaacugauuucccgagcuaguauauccucagggcuacagugggggauuuacaugcuuuuuccccaaccauagaggugcgugccucuguguguguguguguguguguguguguguguguguguguauguacacacauguguauuggaguggaaccagggcuuuauguauacuaagcaagggcucuaccgcugagcucuacccccagcccaagguuuuauucuuuccaggccacuaaaacauaauucuaaaaccaggauguauaacuguugacugaaaaugaugcagaaagugacaauuuaaagaagcucuacacaguguguauuucugugacauuuuacaaauguugauaagaaggucuugguggaaaagagguggcuacugaacgacaggaugcuuccuguguuucagaggcugauggcaaggucugugcauuagucaguaagcacaguguagcccaugaguuagugccacgcagugcugggcugcgauuuuaaggagcugauuauaccucagugguugagcuccugccugugcugcagcuggcauugauugccagugccacagagcaguggugguggucaugacaaugaagggguaaggauauaauggaggaggaggaggaggaggaggaaguggagaaagaugaggagggggcuggugagauggcucaguggguaagagcacccgacugcucuuccgaagguccagaguucaaaucccagcaaccacaugguggcucacaaccauccacaacaagaucugacucccucuucuggagugucugaagacagcuacaguguacuuacauauauuaauaaaauaaaucuuaaaaaaaaaaaaaaaagaaagaugaggaggagaugguggcgguggcggugaugguggugguggccguggugguguaugcaaggggugcaguaaagaauggccaugagugcuccacgguuugguuaagggaaaggucuuauaaauaagaacaagagaacacccgagacaucuggaagaguccagaacagcguggaaaagaaacagacuggacauggccagagcuaucugcaagaaaagggagacucaugcacagggggagagcaaaaggcaagaaaaccagagccagucaguguauugagccugggguggggauaauacagacgcaggagucagaggggagaugggguagaggcucagaaaugucuaacagguacuugaggaacugagggagccuggaggcccuaccugggcuuucauaugcagacacagguauaugucaguggaugggccaugugucccuucugccagaaguaaggaaaaugacuccuuuuggcauauggggauuaguuuuaugcuggcuuuuaucugaacuccaaaaauccuguagucccauuugagcuccuuucuagacauaugaacagccugagaucuugagaccuaacaguggugggggaggugguggaggugguggugauggugaugguagugaugguggugauaauggugauggaggugguggugacagugaugaugaagaugacaauaagaaugugugacaauaauuuggugacagagcacuugccuaacauguauaaggcccugugaucuaacccuagcaacaaaaacacacacaaagaaacuuagaaccaugaacauaguccagcaguagugugcuugcuuauuauauuaguauuucuuagguucuggguucaguccccagcaccaaaaucuuuuuuuaaagaaagaaucaaagacaaacaagacacaguuguuaccuggucauuggggcauuggaguagaagaaagguucuugucaggagugggacuugucacauccuggcacacacagcacagcccugggaucccuacuguccacagacacuguagucaccucgucaacuuuguaaggcuguauagaggaauggaacuguccacacuggggccagggagcugugguauuuaaucaggguaggugugaucugaagauugaagcugguagggugccaggcuaucaaugucacccccuggcagucuccaucugggagcaaaugacagagguugccagaaacugucacugaauguagcuggaaccacagcuggacagagcuuagauggcauguggugugacagugcuuccuguggccgcacagggagagcaaacggggcucaagaugggaguagaaaccaagaggucacaagcagcagaaaagggauccaaagaaaccacaguaacagggccagagagauggcacaguggggaagagcacugacugcucuugcagaggacccgaguucaguucccaggcugagcgcucacaaccaucugugagccugcucucagacggucugaugccucccucuggcccuugucaguaccaagcacacagauguacacagguuugcaugcagccagaugcccccucugccgagcaguccaguaagcauuggagggcuggacccaggcccgcgccccuucucaccugguggcagccaugcuugaaguuuuugaugcauauaauugaauaggagagaugauuccuuuuuaaaaaauauuguauugcauuugauuuaucuguggagggauacguauccuggcauguguggaggucagaggacagcuugcgggagcccaccacaugggucccugggaucaaagucaggugaccaggcuuggcagcaagccccucuccuccugaacuaucucacagaagagcguuuuuaaacugcuguggagaagcgccucccgggagcucagacuccagugugguguugagcagagaaggcugcugugacucggggugcagcauggcuuuuaccccgacacugcugacaacgccccagccugagaacacgcagaccucaaacaaacaaggcacauuuauaccacucacuccagcaggggagccacuuaugguuucuacagaucugacuugaauuuuuuuuuuuuagcagagguuucaucgauuauaaaaaagaagccaaaucaagcaaaaaaaggaguaaguaucauguuauauaaaaacacacaggaguuuggcucuugaacuagaaaugugcuuucuccuguguuuuuuuuuuaaauuagguauuuuccucguuuacauuuucaaugcuaucccaaaggucccccauaccccccccaauccccuacccacccacucccccuuuuuggcccuggcguuccccuguacuggggcauauaaaguuugcaaguccaaugggccucucuuugcaugugauggccgacuaggccaucuuuugauacauaugcagcuaaagacaagcgcucccgaguacugguuaguucauaauguuguugguuuuuuuuaaaacuggaguagauucauuguauaugguacugacuuucauuagccagaguggugguggcgcacaccuuugguccccgugcuugggagucagagagagccagggcuacacagugagacgcugucugaaaaauaaaacaauugagaacauuacucucauuuauuuugagccauauauaauuaauggcuuuuuucauucaaugagauuaguuaaauuauaauuaguauuuuauagaauguaugugucuuagucaggguuucuauugccacaaugaaacaccaugaccaaaaagcaaguuggggaggaaaggguuuauucagcuuacacuuccauauuucugguaguauugaaggaagucaggacagggacucaaacacagcgggaacccagaggcaggaacugaugcagaggccauggaggagcaaguguugcuuaccagcuugcuuccccuggccugcucagccugcuuucuuagagaauuccaggacuuccaggccagggguggccccacccagaaugggcugggcccuccccuauugaucaguaauugagaaaaugccuaccagcuggaucucauagaggcauuuccucaacugagacucuuucuucucugaugacucuuaacuugugucaaguugacacaaaaccagccaauccagcauauuucaccuuguuuucuccugcuugugauucugaaggccaucggugcgugugagcaucagagagaguggauuuaugaaucauuuuccauuaaggcagugcucugcacugucauuccugggggcagggcuugggguggaggcacccucacuuucccacacugucccucacccacuccagccacaccucacuaggugguccuggcuaacuccuugagucagugaccuccacgggccucauucuuucuccucuguacugugcuaaggacacugccagccucgaagagcagagaggacuaaaugcuugucacaggccaggcagcucacacggaccucagaguacauagcugcagguacagcucuuaacugcccaagauagaaucaaaucuuauuuaucuuucagcuuggagccaaaaaaggaagcuugggagcccagaaacugacaaauacauccuucacugagaucgaaaagcaagcucaggcuguggauaagaggaaggagcaggaagaccuugccaggggugccccaaaggaggagucuauguaagcgacauuugcuuucucuaacacaccuuagcagggagagcugucuaugccuugacuugguuuguuuuccaaauaccuugaauuuuuggugagugugcuauacaggguguaguuucaugagaauuugugucauacaggcauguguguuggaaaggacaggacugguggcucuggggaacagcagugguccuugggggagccaugggcaggaagagcagaugggacauaaugucagggaaaugccacuucugacccaggaagacaacuguaacagaaaagacaggcuagugcaguguuccccuccagagccaccccaacagucagguacugagguggggugcagaaggcagaccagaggcugauguccuggccauuaacucucucuugcuauucuggggccaaaagcugaugucuugaggcgguuaccuccugagaccacugcgaggcauugagaagcagacacuuaguuaccugggcucuuuucucuuugacucaugggagagcgcugaccaggugagaggccuggagcuccuuaacucuuagugagccagagagaaagaaaagaaagagaccuagcgagauagcucagcaguuaggagcacugacugcucuuccagagguccugaguucaauucccagccacuacauggugacucauaaucaucuguaaugggaucugguguguuugaagacagcuacgauguacucauauacauuaaauaaaugauauuuagccgagcgugguggcgcacaccuuuaaucccagcacuugggaggcagaagcagauggauuucugaguucgaggccagccuggucuacaaagugaguuccaggacagccagggcuauacagagaaaccuugucucaaaaacaacaaaaaaacaacaucaacaaaaaaaaaaaaaaaaaaaaagaaaagaaaagaaaaagaaaaaaaaaaaaaaagaaaagacaaaagaaaguggguagguaagucaggcacacacacagacacaggcacacuggaugaagcaggaaaagggcuacacugcuaacuuuauuguuguccuuaguuuuuauaccuucucaagauaauugaucacaugguuuucuaagcacuuuuaaauuccauaaguucauaguaaguauaaagcaauaguuugcugggcaugguggcucacaccuuuaaucccagcacuugggaggcagaggcaggcggauuucugaguucgaggccagucuggucucaaagugaguuccaggacagccagggcuacacagagaaaccugucucgaaaaaaacaaaaaacaaagaaaaccacaauaguucaugucauagaucaauaagguuuagggaguuacagcagaauuuuuacaugucuuuccauuaugacuagcacuugacugaacauuccuuauugucuugcuccauaaguucauuauaaguuuaaagcaauaguuuuugucacaaguuagcacaguuuugucaagagacaagucauuucgaaguuuuauagagauaaacuagucagucuuuuauuuucugcccuugcaccuacaauagauugcccauucccagcucaugaccuuuaguuaccagacaguggccucauuccugaccuaggagggauguuuuccuugaucauaaaucuguuccaagcccguuuucuuccccuagugcaauuagcccauggcauaugaggguuuacagagcucuucuuggagcuuuuauucuauagggggcuugagauuacuuguaucaauuuaggaguucuauaaaaucauuaucaggaauuaugaaaucaucaauucgucugcacagcauuacuacaugaaacuacaucugcauguugaucuguaggaaauuuguccaacagggugagcugaugcccaggcuauauaauugugguaacaaaggcaucucagcacugagaagcaauccuggggugaagucucuggggaaccugcaucucagagcacacccauugcagccaugcaaaauggugggucaucuccaggaaacucacuugcuugccauagccuuuccuagauggcuuuugucacaacuccuuugggaguuucacggggaucgcuuaagaucauuauagaacauagauauuuacauugcaauucauaacaguagcaaaauuacaguuaugaaguagcaacaaaaauaauuuuaaaguucgggggucacuguaacaugaagaacuguaugaaagguagcaguguugggaaggcugagaaccacugggcuaguggcacaguguguaccuagcaugcagaagggcucacacagagagacugucagggaugcuaguagaacacaagugauugcaacauuauuaguagcaaugggaaagcaaugaggcucaggcaguaacucaguuggagagcaucgcagcaugagccccgaugggcagaguaaaggagccucaauguugucuccuggugacuaaggaccugguggguccucacagugcaauuugauggagcuaugaaaagaaugaauacauggcuggacuuggaaaguuuaugcaaagaagccacacacaaaagugcauaggguaugauucuccccacaggaaacauucaucaagauuacagagguagaggcugauggggcagaugguauugccaaagcagagggaaagacagcaggaccuugugggguuuuuuuguuuguuuacuuuuuaaaaauuuauuuauuuguaugugcauacacacacauacuuagagucacugcauguguggaggucaaaggacaugcaggaguagauuuucugucuaucguuugggacccagggaucaacucaggcugucauacucagcagccucuuucccuuuuauccagggagcugcgcuggaccaucuucugugcacuguuuuucuguaaacuaccucccauggaauccugucucuguguagacuaucuuccgaagagucuuguuucuguguagacggucuuccauagagucuuguuuuuguauagacugucuucuuuggauucuugucucuguguggacugucuucuguggaaucuucuuucuguguagacugucuuuuauggagucuuguuucuguguggacugucuucccuggagucuuguuucuguguagacggucuucccuggagucuuguuucuguguagacugucuuccauggagucuugcuuguguguagacugucuuccauggagucuucuuucuguauagacugucuucugaagagucuuguuucuguguagacugucuuccauagagucuuguuuguguguggacugucuucccuggaguccuguuucuguguaggcuguuuuccauggcguccuguuucuguguagacugucuuccauggagucuugcuuguguguagccugucuuccauggaguccugauucuguguaggcuguuuuccauggcaucuuguuucuguguagacugucuuccauggagucuuguuucuguguggauugucuucccuggagucuuguuucuguauagacugucuucugaagagucuuguuucuguauagacugucuuccauggagucucguuuuugugaagacuaccuucugugaagucuuguuucuguguggaaugucuuuuguggagucccguuuuuguguggacugucuuuuguggagucuuacuucuguguggacuguuuuccguggugacucauuucuauauggacugucuccugaagagucuucucucugugaggaccaccuucugugauguucugguuuuguguggacugucuucugugauguccugugucuguggggacugucuucugugauguccuguguuuguguggacuguuuucugugguguucuguuugugugugaacuaauuuuugugguaauuguuucuguguaggacauuuucuguggagucuuguuucuguguggacuaucuucuguggagucuuauuucuguguggacuagugucuguagagucuucuuucuuugugaacugucuucugugauguucuacuuuuguguggacugucuucuguggugauuguuucuguguggaguaucuucuauagaguccugguuucauguggacucucuucuguggagucuuguuucuguagggacuguuuucugugcuguuugugucaauguagauugucuccugugauguucugcuucuguguagacugucuucccuagagcuuuguuucugugaggacuguuuccugggauguuuuguuucuguguagacuaucuucugaggagucuuguuuuuauauggacugucuuucauggggucuuguuucugugaagacugucuucuguggagucuuguuucuauguaaacugucuuccagggagucucauuuuuauguggacuguuuucuguggugucuuguuuuuguguggaccgucuucuguggagucuuguuucuguguggacuaucuucuguggagucuuauuucuguguggacuagugucuguagagucuucuuucuguguggaccaucuuuuuugauauccuguuuuuguguggacugucuucuguagugauuguuucuguguggaguaucuucuauagagucuugguuuuauguauacugucuucuguggagucuuguuucugaauagacugucuucuaugcugcuuguucccguguggauugaccccugugauguucuguuucuguguggacugucuucccuggagucuuguuucuguguggacggccuccuguaaaaucguauuucuguguggagugucuuccauggaaucuugcuuuuguguggagugucuuccauggaaucuugcuuuuguguggacugucuuccauggagccuuguugguguguggaaugucuccuguaaaaccuuguuucuguauggagugucuccuguggugucuucuuucuguguggauugucuuauaugauauuuugguuuugugugaacuaucuucuguggugauuguuucuguguggaguaucuucuauggagucuugguuuuauguagacugucuucugcagagucuuguuucuguauggacugucuucuccacugcuuguuucuguguggacugucuccugugauguuuuguuccuguguggaguguccucuaugaagucuuguuucucugugaacugucuucuauguugcuuguuucugugugggcugucuccuguaauguccuguuucugugugggcugucuucuggaauguccuguuucucuguggacuuucuuuuguggugauuguuucuguguggaguaucuucuguaaagacuguuucuguauggacuguccucccuagagucuugguucugugaggacugucuucuguggagucuugguucuguguagaccaucuuuggcgauguccuguuucugugugaacuaucuucuguggugcuuguuucuguguagucugucuccugugauguuuuguuucuguguggacugucuucagugguguccuguuucuguguggacugucuccuguggaaucuuguuucuuuguagacucucuuccauagagucuuguuucuacauggauugucuucugagcgucucuugucuucauguguuuuuuaucugcuuuagcuggaauuguaguccgauguauaaugagggaaauaacccuauuuugugagguucguucaagguucaacuuagaugacauuuauugaaauucugacaacaguaccuggagcacaguaggcguucaaucagugugaccagcacacagugggugcuuggccaguguaacuuguucccauuagugcuaaugaugguuugcugagugaaacuuagaggguaagcccagaugguucaaaguuguuauuucccuguucagcucucagaacaccaggggcagcacuaaccuguguagacagacuuucucuaucauaggaacagagaauugacuugaauuucucucuuuucauugguuucugaccuggacagaggcagguuagcuuggcuguuggaaagccugugcugcuggggcuugagguaaagucagaagccuggugccaacaagagccuugagaagcgcccacgcccuccuuuguguggucaggugguuggagaggcaggacacagggagaguagcaugggaugcuggcuacacccaccuuccaugugccauuaggauucacugaaaacacauugauacaagggcuuggcuuguagcuuguggguagaggcuuugccagccaugcaggaagccucugggaaagagugauuuacuugggaacccaauuggcaacuuuguugccuuucuccaggacgucaugugauugaccaccgucagugcuguacagcgcuguacugucucaccccuuggagcaagugagggugcuguucuggaagcugagguuucuagugauuaugaaguuacaguugaggggucauuggagcaggcggcaggcccggcacugucacacugcaaagcuaaaggccuuggcagugccucauccuggcuggcuacgcugccugcuucugagcaucugacagcccaaccuuaacagagaggagagcaucccugagagccaggacagucccaugucaggaguacuaagaggaccucaccauggucuucauagcucuucuguugucuccagagggucuggugccacaguuugaucagguagugaugcuaaagacaccugauguuucaccguugguuugcuaaggaaaacgauacuaagagaguuaaagaaaaaagacaccugccgggucagagcuaacccaagaaaucccaugucuuguuacaagaagcaaagaucaaaaccagcuauaguuucccgagaaagacauugucuucccugcuacgccacaggagucaccuuugccucagguucuaacagggccuuuuuggugagggguccuggcacuguccagggcuuugggaagcagaugguagguggauugucacuucccacggcaguggcaucacuugcugcauaccgcuguuccugcugcugcaggcagagcaagggcagugugcacacaccuuccaaauaagaguacagcuggcagugcucacacuauggcgggcuggugggauggcucagcagguuaaggugcuugcugugcaggcugauaaccugaguccaauccccaggagagaggugacuccacaaguugucuucugaucuauaacacacagagagagacagagacagauacacacacucacacacauacacaccaugacauauauauacccccaacugcaccccccccagaacauguguacacacaauaauaauaaaauaguuggguuucucuguguagcccuggcuguccuggaacucacucucuagaccaaacucagagaucuaccuccugugugcugggauucaaggugugugccaccaugcccagccuaauaaauguuuccuuuuuucaguguuuuuagauuuguuuguuuaugaaugcucugucugcauguacaccugcgagccagaagagggcaucagaucccauuacaaaugguuauaaaccaccaugugguugcuggaaauugaauucaggaccucuggaagagcagucagugcucuuaaccacugagccaucucucuagcaccuaauaaaugguuuuaaagcuaaagaccuuggcuggauagguagugacuauccauuuaaaugcucucagaagugugauacauaaagacaccuacaggaaauuauuugaaaugcaacuaaugauuauauguuuaugaaaucaacuuuagauauaguuucauuuuuuaauuaaaaagaauuaauuggauguaugcugucuaucuauaugugggaguuugcguguucuugcagaggugccuuccaaggucaaaagagggcaccuggagguggaguuaucggugguagcucccauauguucuucuuaaacaacacggauaaggaggacuauccuccugcacuggugugucccagggaaguguccucugaugucaggcugagggaggacccuguggggagguaagagagaccugagcuuguguuugagagacuggaaagcccuugucuggagcugaagcaggaguuacagucuccagacugccugugauuucaaugcaaggccacaguguuugaagcugggcuaaaagggugugcuuuccccggcaguguuucguccuugcgacuggccuacaaggaucuggaaaucagcaggaagaaagaugaaagacugaaccugaguggccagaagaagguggaagccgagcggcugggcaugggcuuuggaagcugcaggagguagggucugcagggcccggggcagucugcucacagugaagggucggccccggggcucauuuccucaguacucuccacuuccucgccauuugcuuugcugagcuauuuaguacaguauggcgaaggcuggagcuucaugggugcagcgugcaccaagcccugggcuggagaccaaggcuggggauccacucaaggccauucugcgcccaagggugcuuguugccucaaaacaaccaaucaauagggaauggguugaagcuuaguggcuugucccucaaauccuagcucucaggaggcagaggcaggaagaucaggaacuuuaaggccagccuaggcuauauagcaaggcuaaccuaggcuauaugagacaggguuuuguguguguguguguguguguguguguguguguguguaugcgcgcacaagugcgugugugguggugacaaguggcacacaugguucuuggagagaauaaaauaggugugagucuccaugaagugugcaccggauuguucgccacgggcacacucuuugcaugcggcuaucuuccuggcagcccagcccucacaauggcuuccaguuuccaaaguucaaacugagcucccagcccuccuggucuucuuguguuuguucagagugugcucaaaagauccuuucauuugguaggacggaaagccuuuaggaagccagugauguaauaauuccuguuuuacucuguccuuucaaguggcaucucccacucggugacuucagacaugcagaccauugagcaggagucgcccacacuggcaaagccgaggaggaaguaccaggaggacccagaggacucguacuucagcuccagcuccaaguggucugagcagagcagcagguauggggguguuaaagaucggccuugggagccaggacagaccggugccuggcaccaucugagagcucuggcugacaagcgucugugugcugccggaacaaaggcuggggaaacaguguagggagccaugcuuacagcuaggaaaauguuuguugauacaguuaaaaacugaggucuaaaauuagagauaggcaaggugugcuguguacugugagaagugaagaggucugucuccagggcaagggcuggaguacgccccgacccucagcagcuucugugguagaacacuggcuucuggaagcugccaucaaauccaguaugaauggcauuuguauaugagucuauucaugaaagccaugacuguucugaggggaacccauggaacuaggacagccugguccuguccuuuugugucuacagucugcuggggcaaaaccugugacuggcauaaggcugauugcaguugaggacaagugucaacuugaauagagucguguugucagggucacccagaagcugacuuuacaggaaauugggaugguuuuggcauagcauguaggaacagaaagcuggagcccggguugagugccggccaugccacauaggaaccacauagcaaugaccaacagucacuaaagugcuccaugcugcagcuuccuugucuaagugaagaguccugguggugccugccuuuugggauccauagggagaacugaggcaccgcagaguacaaugcucuucugcuguccggcuucuccuguagcuugugaacucagccaggcauguggcucugugauugggcagcugggcggugcauuaacaauucaggacccuuucacagccagaguuggugaggauaggacaccucuaucaguaaccgugcugccacagucacacagccauccuggugucacagggccagcagacacggauuggguagguagaaucgucauagguuaugguaucuaucaucaacugugaaaggguucacuuuccuauccaggcuccugugcacugcacagacagcucuuucccugauuuuaagcacagcucaaaguuacuugagucucaauauuuuagaaagauagcugacggauccauggcuccuuguuggccuggccagaggcugccugccccucucuaaccugccuaugccucagcagcauacauggcucugucuauacagugccagcugagaaaaaggaaguacaucucauggaggagaaauucaaguuugugaucggaccuggaaaccacacaucagauccuuucacguuugguuuuaacgagggcaggacuggggcugaagaaccucgccucuccccaccucuuggugacuucccugcuccguagugaugccuguagagggugguguagagagccaguucugugcuuggauagcagggcuggugagagaaaggguucuggguacggucuccagcugaguggaacauuucccaucaccacaaucucaggucacagaggaaggaacucgagcggggccuuggagccuucagaaacaucuugacucauuuaaaagggucagugccaaaggcuuaaaagccucugugccagggucagcuccucagugugaaaccugagggcaaaugguguucagauggagaacagggagacuuugaugcuggguggguggugagcugggcugaagggcacuggagugaccugugcagguccccuauaacaggauacugucuguguucagggucaaccuuuauauaugccuuggagccuccagaaaccucucucuuccuuggcucgaucagaagggucagccacaaaggccgcugugccagggacccauuucaguuugaaaccuggggguaaauggcguagagcagagagauuuuggugccguguggauggugagcuguggguugucuagggacagaaucaucccucuaguucccuugaugaccacagugacauagcaggguugagugaggugcuuuggcaccagaggugaagcaaacacacucugaaagccagcauaucugugccauagagugcuuuuacugcuuccaaauuauucaucagccauuagaacuugcauauugugaauuaugaaagagugcugcuguuucuauuaagcaagggggacauauccuugcaugguguucguaguguucuuuccagacugaaaaugaugcauuauuguaguagugcauucagaauaaugagaacgacugccuugcugagccccauggaguccaaauggcuuuuggugggggaugugacagacagcagggcaaugugcuguuaggggcuuugacaggaacugcaggggugcguucagaggggaggaagaugcagggugagggccagcaugaaggaaaagcucguggagaagaagggcccagaaaucaaagcccaugcugggugaaggucaguggcggggagagcugcuggguccuggcaugagacugaugccugggcagacuggcuggcguagagcguugucugugagugacuggggaccccccauaggguaccagagcagagagucccuugugagugaaugaggaguagggaagaccccauguguggacugcucaggacaaguggcaucuucuuuugcaauuuaaaggagccccagugcucucucugcaggccagaugguuuucuuacucagguagguggggaacauuccugcccuggcauugugcugaucuccucgacacuaagcccaagaguuucacuguugacaagaaccugacuaucucagccccucccuaucugagggaccaaccaaccuccucuuagcuaugccacagggcaucgcaacugaccaaggggacggaggucucagcagccugaggcugcagcagaggaaggcugucccucuucccugaagccuucagugggguugacugcaccccagcugcugagaagaccuuaaaggaaugccucgugucagcucauguucauuggccaaccuagugucugucacagcugcccuucagcacaugacugggcaaggaagcuaggucccccauacccagaagcaagagaccccaauagggacggcauccauaagugcucccgucacuguuccucccucuccagcagguacuuugacgaccccauggaguuaagaagcagcuccuucucuagcugggaugauggugccgauuccuacuggaagaaagacagcagcagagaccccgagccugccaugagaagcaccggcucuucagacaggugggagcugcaggcuggggagcuaggugacuccauccuaggaccagugggcgaucccugugacaugcguguccugugcuccuuuaggacaugacugcauugggagcacaugucagaaacaccuguggcuguuagaaaguucccuagggguucucaguccgugggucagugagcagcaucauggaugagucaccuucccccauuugaagggccuccuuuccuaggaaacagcucuguggucuggucuuuguuucugggcauauauguauaauauacacaugugggccagggagcugugucugugugugugauccugggcauauauguauaauauacacaugcgggccagggagcugugucugugugugugguccugggcauauauguauaauauacacaugugggucagggagcugugucuguaugugugguccugggcauauauguauaauauauacaugugggccagggagcugugucugugugugugguccugggcauauauguauaauauauacaugugggucagggaguugcgucuguaugugugguccugggcauauauguauaauauauacaugugggccagggagcugugucugugugugugauccugggcauauauguauaauauacacaugugggccagggagcuguguuugugugugugguccugggcauauauguauaauauaaacaugugggccagggagcugugucugugugugugguccugggcauauauauauaauacaugugggccagggagcugugucugugugugugguccugggcauauauguauaauacaugugggccagggagcugugucugugugugugguccugggcauauauguauaauauauacaugugagccagggagcugugucugugugugugguccuggugauauacauauaauauauacaugugggccagggagcugugucugugugugugguccugggcauauauauauauauauaaaauacaugugggccagggagcugugucugugugugugguccuggugauauauauacaugugggccagggagcugugucugugugugugguccugggcauauauauauaauacaugugggccagggagcugugucugugugugugguccugggcauauauguauaauauauacauguggggccagggagcugugucugugugugugguccugggcauauauguauaauauauacauguggggccagggagcugugucugugugugugguccuggugauauauguauggagauguguauaccugcauauguauguguggggcuaggaauaugugggcguggguguauaugugggggacugauaucuggaggccagagggugugguggauaaaacccagcaccugaugccugcuugccaaccacacuguacugaacuacacuugugcccucuucaauuuaauuuuaugcuuuauuuugaggcaguguuucacagaguugcccaggcuagccucaaaauuggcauccucuugccucugccucagauuacagcucaugccaccacaucagcacugauucaguucucauaauuucaacuaacauauggccgaguagugaccaucaagaacaaggcacagggcauucugucgcccccaaguuccuugcucugucuucagccacaggccacugcccauuugguuuuugauuguccugugcaggaagacgcuguguggacuauucaucccauuacugccuuugcccaucuggcucugaacucugucaccugacugcagagacucagguugggguggcccccacagcucaccugcugaagagcuuccccuacaguugauggcaggaagccaucauuuauuguccacacaagggacuuuacacauggaaccugagguugccccauaacugggauguccugugagcccaugcaguuuauacacugugugauagacuuguccuugugcacucacacaguguaguaaguguuuucuaacauagcugagaugcaggacuccauacuaguggaggugugaacugaguuugcuucaccacagcuugcuguguuuucuguaggcccagugcucgccggaagccagaauaugagcccauuggcagcacagaugaagcccagaagaaguuuggcaacgucaaggccaucucuucagacauguacuuuggaauucaagcccagacagauguaagggcacagagagcuccuacagugaccaugagaaccaggaaggaagcuucgcuguggggaccaugugagaacaggcugcugagagagaagggaccuggccggagacuccuaggccugccugaggcacccgagagacugagucagggaccccggcucauugcuguccuaccucucuagagagaacagcaucagccaguggcuuuugaguuaacuuaggagguuuuuauguggcagcaguugcuuuucaucagcuuagccacagugaaaugcagccuggauguguugugggcagaugcugcguugcccagcuguccugucucaggagucuggcuaagcugaagcuaagcccucuuccuuuuccuccagugcucaaaugcagggagugguagcugggguggggaucugaacucugacugcucauuuguucccuggggugcugguuugucucagagcagaggccucauggccaaagggaucccuccaacacuuaucuuaaaacugaugggcugaagggcagcucuuggaagaguacuugccuaacauaccgaaagcaagugugggguuccaauaccaccccacacccacccacacacacauacacacauauauacacacacauacacacauauauacacacauacacacaugcacacacacgcacauacacacauauacaugcauacacacacacaugcacauacacacauauacaugcauacacaugcacacauauacacauacauacacacacauauacaugcauacacacauacacauauacacauauauacauacacauauacacccacacacauacacccuugaagccauucaaauugaugugcuaaguggugugggcauuucuaaggaauagcugagagcagagugucaacucuggcugccccucauacugaucauaaugacagugaugugggauguugccccacccaccugugaccuccaucaucuccaggcccuggcuuggggugacugggagguggagaaccaagggaacaagcccacccccaucucucuucagcaguucuuggagucugacucugccucuauuucugccuaguuugaaacccgggcgcggcuggagaggcucuccaccagcuccuccauaagcucugcagaccuuuuugaugagcagaggaagcagacugcaggugaggcucaccagggcuccagggcauccccagccccagcgcgugcauccccauaggaccuucccuucccaagauuccacacccuaguacccuaagccuugucccuaugugagcaaugagagcugagguguccccugagacggaagucaugacauuuaugccacagugccccugucauuuggcaacuuaguaucaagaucauuguucauagagguggcagggguuccugugaccugugagaugccagccacuggcuaguuggccucugucucuuuccuguggaaugguugaccugagauacuguguacgguaucaguccuggagugagccccaggagccaccucacaggcccugagcccucaggaugcacaggugggaaggagcgaguaacuccgaaaaagacucgguacagcuugggaauugacagguggagaggaagggccuggcugcacugccugcuacaucucugcauggggcgucuggucauccccgggcuggaguccacccaggagcucagaguaggcccuucacugccuggacagagcugugccuucugcauugaccucuguacccccuaucccggaaggccuacaugaacaccgcgcacagcccaccaggccacagggcgagcaugaaauggcagcagccucugaggucguuucaggaaaagaacuaagaggaagagaucucaggcgccagcguugcaggcugagugcucucuguacgcuggauugcacacuucacaaccugacuggcuuuggugugcagaaggccugagcauuuguguaggguaaccauccugguggccacaccgucucucagacauguggaucagacauguguauuggaugccgcuuccacagaggaggaguaggguagucucgacucucuggaacuuucuguguggagguuugggccuuagauacagcagcacuaaccagcuuccugggccuaagccaggagaaccauucuaggcuggugugugcuggcaaaguggcuggcagguaggcaacaguguucagagagacaggagggccagcuggcugcgcuggugccugacagggcagaggcugcuguucuuggucagucacugcccggugaagcuuuagcuagggccacccugacuccuggcuucagucugacccucacaucauagccuucugucgggccagcuuccugcugggaugugacccuggcacaaaggcgcuccgccuccucaaggucucccagcagagcgccugcccuggcagugccggagccagucagacagcucagucccaaggccaaggcuguugaagucucugaaugcuuuucuaaugaauuuccuggaacauuuacuccaaaacauuauuguuauaaaaacaaagcgaaacaaaacaaaaagaagaagaaaaaaaaaaaaaacgagagagcucuuugaagggaacacacccuucugcccugcauguuguuacagagcucaggccagcucagacuuccuccugccccaaccacagaacaaagguccacugaacucugacccugggcccauagcaacucaguauugugagguacucccuagggcgccaggccaccccugacucuggcgacuauggcuagcugucugccuugagcagaacuugccccucuacugagcccagguaggugggacuguuguggcugccugccugaaccccccuuaccccgccuccgagcugcuggauggccuuacagaggacuacucauucuauagaccaggccggccucgaacucggagaucugccugcuaaggaugccucauuuggcaugcaugcacagcugcaaagagccuaugcuaguguuggaagcaggucuguguggccucauucccaucacucucgggucagaucaagcaggcugggguucauggcccaugugugcuuccugggaaguagaugcucuaugaggcgugcuagacaucgugcaugguacucagggcuggugucugccagagaagguugaaagacugaguggggagcucggagaucaucagagccaccagcgcagcagggccagagagugugugggcuguggacugggcccugugugggaaggauagagugcucagggccccagaugcgagaguaggggaaagagugacagccauguuagggaaaggcuauuucccacuuccccgcuuaucccuuggugcuuuuagcauguaagaguguguuguauguauguguauaugugugugugcgcguaccugugcacguggaggacagagacuggugggaaucuucccccuucacucuccacucuccauucuuuaaggcaggucucuuaauugaacccagagcucacagaucggacuagucuaacuggcagguugcucugggagaucugcagucuccucccuucaaucuggaauuacaggugggcugccacgcccaucaugggcuaugauccgaaccccuccucacacuugaugaguucuuuauccagagagccaucuccccaacugcccucccccugcccagugucucuuucaaggacagauuguuccaguguaccguaagcuauggccccacauccugaaccacccucuugcugagcugccuccgugcaaaguuggcucaggggccaggcgugcagccugugugagcaugugggcaugcgggccugcagcuccaggcucagcguguucuuagaccuuugccugcaagcuccuuacccacgcucucagguggcagcacccugagggccagauucuagcucacucacugaccuaugauuuuagcacaucagaggcugcggugccugucucagacaaguaccugccaguguuuugaacccugugacauucgccauuuguaaagccauaggcuuuucucuugauuggccucacuucugagaauuuggcucauaauguuaaagaagauccaugucuccccuggaaggggaggggcagcccugagugcuggauuguugcccaggcuccuugucugcaagccccucccaugguuccaggccuuucugauuguuugcucucugucauuuccucaucuuggcugcccccaugccccccucuucucuggaaguucaacccaugugcuagagcccuguccuugguccgauguccuguccuugugcccagucaucagcuuucagccuggcuccuuugaccucccuaguucuccccucuggcugcccugagccugugugcacaccucaggccuuuacgugcuugugccucacucaacgucaggaguaaggcaccuggugaccugacuacaacaguucuuucauggggagcacccaucuucucuuucugugcccuuggcacuugacagagcccuugcaugugucuguugaaugaaugagugaauguacagagaaugaauggagccugccugcugcccuucccaauaccuccaguaacccauggccaguguuggacauggugauaugccugauuccaguuugagccuuuagagucacuggacagagucccuuguuccccuugcugugguggcugaaggaacuguguguugugaccaauacuugccacugcccuacugcaaggucccucucucuggacacaacugaugccuggaaggaggcaagagaguaggguggguucacugggcugcacauguccuuagaagaggggcaagcugacaucuuucugugugcaggaaacuacaaccuuuccaaugugcugcccaaugccccagacauggcgcaguucaagcaaggugugcgcuccguugcuggaaaacuuuccgucuucgccaauggggucaugacguccauucaggugagugaggcaaugcuggagcuccugggguccuggagcugccgcugggagcucgggagcugugcugcagagcggaccaggcaucaugaaagccuggcacggugaaguacacuguaauauugucuauaaucacagccacugggggcugaggcaggaagaucaugaguucaaggcuugucugggcugagacccugccucaggacagugcuuucuuguuuguuuguuuguuuguuuguuuguuuguuuguuuugagacaggguuucucuguguagcccuggcuguccuggaacucacucuguagaccaggcuggccucaaacucagaaauacaccugccucugccucccaagugcugggauuaaaggcgugcaccaccaacaccugacaguguuuuucuaaguuccuacuggaguucguauauuucuggagaauucuguuuuaaaaaauuuagauucauuuauuuuguuuuauugauaugaguguuuuugccugcauguguguacauauguaugcaugccuggccucacagaagggauuaaguccccagaacuguaguuauaggugguggugagcugccaugugggugcugggaauugaagccaggucuccugcaagagcaauaagugcucaaaacuacaaagccaucucucggcuccacagaagaugcggacaccacccacuaccucccuguucugggagaacccuuguagcauucugcugucuuguuuuaccccccaacccccagucagggucucucuguguaaucuuggcugaccuguagcuuacuauguagagauuccauggcucugccuccugagugcugugauuaaaggcaugcagcaccgugcccagcauuuucuuugaagcagggucucacuaugcauccuagcugguuuggaacuggcuuugugacagguuaacccaucacucacagagcucuuugcccuccuggguacugggauuccaggugugugcaccgccauuccuggcugcauagauuuuuuuuuaaaugaauagggaguucuauucugugacugccuguucuuuuugucagugacauguucuaggcgacucuggaauucuccagaagccauuuucuguggaguggaaaugugcccauggaagcugcuuguuccccccaguggaacugcacugcacucugaucuccaagcuuuauuuauuaguguguacuccucguacaugguccuggucaccgaaggacauuucaugauguauagaacugacuugaugcauagcucuuccacaccucugcccuucacccccaccccuuacugccuuagacaguuucucuucugcuuuacacuguauacacagacaucuguuuuugguuugguuugguuugguuugguuuuuuaagacaggguuucucuguguagcccuggcuguccuggaacucacucuggagaacaggcuggccucgaacucagaaaucugccugccucugccucccaaguacugggauuugggauuaaaggcaugugccaucaacugcucagccacaucuuuuuauguaucuguagaaauacuugucuuucuguguuagacuuaauucaguucauauacaagaaggggaagccuguuuaugacaaggaggcugucucagauuguaugaacagcuugcuucgggaaucuucuugguuguguaaagucauuuuagacgcauucuauuaggaugaaaugugacccugagguguugacugaauugacauugcaacuuauggguccauggaggcuucuagucugcagaccaacccugcuguggccuuguugggaaugcgagggagaagaaaaccuaaaacugcagaggcugggagcucuccucccucccuucuuccucccucuucucuccucccuccucccucccuuaagggccuguuggcuggaagguaguauuccuguuuuguggguguggccuuccuguauuuaagaaucauccugcuugugucuccauuuauaaaugaagaagcagaggcagccauugaaccucugcuaaaugagcagggacuucagacagaucccucaggaucccaucacacgugcucccuggacagcucaggacauggccccaggcuccggccugggccccugcuuugcaauccuuaguccagccugggagcccuaggccuugggcaccccucacaaguuguaauccuggcagcucucacaaggugugaucccgggcaggucuccaggccccacuugcccuccuagccauggagaggcugaggcagugcuggcaccacacagcugcucuuuaugcagagucuguggccagugccaagagccaggugucccucaucaacagcaaucgcacgcugugugcauggcaggacacagaugcaguguaucgguaguaaauguuggucugguucucucuaggaucgcuacgguucuuaauccuggugccaggcuguccaaccugguaaaacuccacuucagauggaccugagaccacaucuggcugcgccaaugccccagcugcuuugugggcaggcucuacuaguuggcgaggcaccugcacauuucugaguguccauguuuccuuugagacauccccauuucuauguaggugggauuuugcuuucauuucugauuuaaauuagcuccuuguguccuugcuuuaucuuuggggcaucuuuaguuccaagaacuggaagccagagcugcaggcuccucccaccucucuccaggcugguguugacugggcccggaaaucaauccccagcacuuacuucucacugcaaaggagcaaaacaacaaaaacagcaagaccagaagugcccagccccuugcugacagauugcuucguguguguccccacacaacacacacuuaaagccaucugucacucuguaaguuauuuuguacauucucuacucuuaaaagugucccccagucaguuccuuuaacagaccugagcuucuaugaugccaagggcguucacugcgaccugggaguaaacagggugucgcugcccugugagaggaagauggggccaccccagggcucccaaugcacucggaagucagcaguaccaggagcucaggcugagaaggacagcagugcggcuucaggacgaagcucagccagggagagggcgauuauaauuggguaguuuuguuaauauuuuuuuaucuuguccuugauauuccaaaaguuacaggauagauguaaaucaauaaagucauuuggcuguguuuuagacagcuccagaauauauuguucagcgcaguaaaauauauuuggaauuugaugaaccaaaaaugugauuucagaugacuauuuugugacuuucuuaaaaggucugauuuguagacuucuaaauauaacacacagcacagcagacgguugccuguguugucauuccuca

SEQ ID NO: 7913 - RNA, 1840 nt, Mus musculus
gaaguccuucucagaucacaggugcugaucuguguggugccugggguguaguugacaggaggagacagaaggaaagcucucccaccaaccccccuccccgacuuagggcaguugguuccauugagucucaccacaagcaagacuggucuagcucaaguaguccaucccaccuggcagaccaaguucagaguucaagucccgaggcugccuucuguucugaaacugguggaugcagccagcucuauucuggucuguguugcaggaagaguugggcuguggaaggacaucuucaccgucuccaugaacgagaaguuugaucuaguguacaaacagaagauggggaagugugaccucacguuugacuuuuaucuauaauaccagaauccgagaacuugcaugcucacgguccccggacgcucuacuagcuaaaaguccuguuugcguucuuuuauuccucgcuggacacacuuccggaagcugcuuggaaacagcagggggcgagccugguggagagagccgaggaggagugagaggaugcugucuacagcagccgccuggccuggcccauaguguuuugagucuccacaugguggccaauaccacacgcacgggcagugcaaaugucugccccacaccccguguuauucacuauuuuauagcgcuuuucacugaaagcggaaauaaauaucugucagccaaauacaagugcauuuccaggggggagcaggagcgugcugugccgggaugcuaggaagcucucaggggucacuguaauuuuuguagucuuuucucuaggcacagccauccuaccuuguucggagaucaaagaacggguuugggggguggggugagcuggagagguuggugucgccuguggaguucagucuuuuggaaccauccugauaccaagccaggaccugucccaggccguuuucagaaacaccucuaagcgcgcaucucucucagccccagcacagaagagcccaaggaauguuucggcagggaagcuggcccgaggcugcggguggcaucugaaggcacugguagguguggaagaggccccacagaugccagacugcaccaagaauuaguaucuuucacagccuucacgugcuccccaaggcagcgacugacacacuccugcuggcaagagauacaggacauagcaugguucuaaagucccuagucgcugucccaucugcuccaccugugccaagcgaggcucucacccaggagacccagucugcagguugaccguccuccgugcagauaggauuggcaagcccaccugugugaguggggcaccuuagaccucaagagugucuggggggagccaugauccugugugcugcccacccccacaccuaugggcuugaauuugaccagaugagcgguggaccaggagaucgcugcuuguggggaccgacuuguucuguuacucaccaggcugggaagaacgugguagugggaggcugaggcuguggaaggggccugcucugggccgucucugaagcgggucugguugucguggcauuaccucuguccagagagaagcuuguguaggucuggugcaugguucucuggggugggcauggcggcagcgccuuuccugugugucuggggaggaaggcugcuuucugugaaauuuucuuucuauuuuucuauuuuuaguacuguacggauguucuggaaccacacaugguaaucucugcuugccugcaucuuuaauaaaagacaccuccccuguuuguguguuuugucugugugcuggguggagggggggagggucccugagcguucuccucaaaggagugugagccccauuccugcccuguccccu

SEQ ID NO: 7914 - RNA, 49463 nt, Mus musculus
cagagcagcaacaccgggagcagagcugaacugcagcgccgcccggagcuucaagcaccauguaugacccagagcgccgcuggagccugucguuugcaggcugcggcuuccugggcuucuaccacgucggggcuacgcuaugucugagcgagcgcgccccgcaccuccuccgcgaugcgcgcacuuucuuuggcugcucggccggugcacugcacgcggucaccuucgugugcagucucccucucggugcguccacggccacuacccaggccccgcgugcggggagggguugcuacaccuggggaaucgguaacacuuuccggggugcccgaagaaaccuguccggagagcucucauccuucccggugccguugagcacucagcuggagacccugggccugucaccuggcgugggauuucccggggccggcuggagcagacgcgcuccgagcaucuucuuccugacccgcucuggcgcccugguccugucagcugggucaucccugagcagcagggaacgacgcagguuugccggguccucuggucccugagccgcagaagguuuguccuguguggcucuggcuagugucccauggcuggugccgccaggaagggcagaaggcacccagacuagaacacccuuaguggcaguccaaugcuccgguugccuuuagagguggcuggugggggcgggguacguggauuagagaaauauuuggaacacucccuagaagcuggaauggguucccagacagauccaguuccacucucuccugucuucacuagccuagauaagcggcccuucccagaucgaugucacugacauucagggcauuugaaucuuggccuaauuaaacauuugcccaugcacccaugagcgagaggaggcgaguacucuccucucccccacuaaacuacuaggaugugaugccuucucuucccagugucauagccggaugcuuuugggguugugggcagggcuuggcuaagugcccacgggggggggggcggacugcugacacccaaagguccccaggcugcaugacaaugucccacaucaacccucuuugaucuggggccucuuuaacacuuuacucuuugcucucugcuggccacagccagcagggagagacuuuggcaggcaggggaaagccccugcugaugagcggagcucugccauuggaugggaucggugagcagacccugagccgaugagaaucagggauuagaagacaagcaaaucuggcugugugccugcuugucuggguuucccagugaggagggagccaggaguaaagggcagugagaguggccucuggaaagacuagauuaguccaguggccauugcacacccugggcuucggcacuaaaggcaguuaguucuuaaauggagggcucugagcccaauagcgauggaugauuauugggacaugguuuaaaugcauugacuccaggaaucuuaaguacacccacuuucauauagagcaaugguucucucaaccugugggucacagccucucugggggucuaaugacccuuucacaggagucaucaaagaccauugggaaacagauacuuaugauucauaacagcaaaauuacauuaugaaguaucaucgaaaauaauuguauauuugggggggcaaccacaacaugagggacuguauuaaagaguuccagcacugggaagauugagaaccaaugauaaagugggguguuuguaacugcucagaagacagggacagccuggggcuauccugucaggucacagagagggcacaaaauuacagauuaucucuggugggagcugcuaaggugcauugcccagggcuuggaacgggcacagguguuuggggcaucugagcauuuggcuggacuugacagaggagguaggugcaauuggcuaccagugugugaguucacccucaagccaggcucagcaggcuggcuugggguaggguuugcugggagugagaguuagaguuggaucagaaaaggcugggauaugccuggccucauggaaccaggauucauguugucauaagugcuagggcagaguggauuagucaaagagggcuggucuggagagugagggcagauggacugugaauacuacuguguaccuacugugcgaucugggaagucuuggcuuagagguuuacacggagccuagccgcuuacacagucuuuucuggacugagcauuuuauagaccuuauuuuacacaauccuuucugccuccagaagugaauccauuuuuacucuccuugaaaaaaggcagucgcugggcgugguggcgcacaccuuuaaucccagcacucgggaggcagaggcaggcggauuucugaguucaaggccagccuggucuacaaagugaguuccaggacagccagggcuacacagagaaacccugucucaaaacccaaaaaaaaaaaaaaaaaaaaaagaaagaaagaaaaagaaaaaaggcagucuagcagcuggagagaugucucagugguuaagaucgcuuacugcucuuacagagaaccagcuuggcaacuuacugaccaccuauaauucuagauccugggaaugugaugcugucuucuggccucugcaggguuuugcacacauguggugcccauaagcuccuacacacauaugcauauauauauaaucguuuguuuguuuguuuguuuguuuuaaauuaaagucaaucugugguauagacagauggcagagugcuuuccucuguaaggggcaggggugagaucuacauuuagguccaggccuacauuauuucuucugugcugucugauguugaguccauugugccaaggcuggaaugcugauguguucguggcuuguggcuuuauagacaggcagguggaauucucaugagcaugcgucaccggaagaccugccccagcaccauccaggaaauaccuuauacaacaggcuauuauauauauauauauauauauuuuuuuuuaguugcucccuugaauaaaguuagacaagggugaaauugauuuuucuuuuugagucauacccagaauauuaccacuuuguaaugacuguuaauuacuguuaaugagauaaugucaccuagcaagccuuuggaauauagggugucaccucuagcuaccuugaauguacccagcucugagcaaaacacagggugugcuuuaugguaucuuaauuggccacaguucacgaguucugcgucugccugguuucuguucgccagugugguacccuguucuauguguuuauaucugucacaggccguauaauggagauccucauggaccucgugcggaaagccaggagccgcaacaucggcacccuccacccguucuucaacauuaacaagugcaucagagacgggcuccaggagagccucccagacaauguccaccaggucauuucuggcaagguucacaucucacucaccagggugucggauggggagaacgugcuggugucugaguuccauuccaaagacgaagucguggauguaagcccuuugccucucuggguguggucccaugaaagcacaacaacgcagggcugucauugucucacuggacuggggccaugggaaugcuauacauucagggacugugucuguuaacccggaagccuuacuaugccaggacucuugaauucucuucauuuuuccagugcugggagaggagagagggccuuggucauaucaggcaaggacuugaugguagggcugcacccuaccacaaguuuuuuuuuuuuucccuccuuuaagacucagagaacugguucugggugugccccacaccucaauaugcauguuaugcaguaauguuggcuuuuugaaugaggcuucuccaggguggauccauucuuauuugcuucuaucaccagaucuugcacagagaagaucauuugugccauaucaaaaugccacauuuggcgcauacacacacacacacauauacauauauauuguaguauauauccuuucuauaguucuugaaugaauggcugcaugugacugaaugugacucccugugaggcauccuguguccagcaucccugcaggcagucugggccuccauuugaauuucuaguagcuucugaacagcggacaccuaucuguucucaguggacagugugcuguucagaacagugguucucacagugugcucuagggaaccacuguucuauaugaccccuaacuggcuucaggagagcucugagggagggcccagguccgugcuuccuguaaugccugagugagaugugugauuccagcucccuaugccaccaagucaacgguguggucaaccugggggucaaggacagcaagauugaacugugcgauuaguaaagcuaaggaccugccauugcugcaaagacuuaugagccucaaauacaagcgugagggucauucauucacucagggauuaaaaaaauaaaaugggcuggagagauggcucagugguuuaagaacacugaccacucuuccacaggucccgaguucaauucccagccaccacauuguggcucacaaccaucuguaaugggaucugauacacucuucuggcgugugucugaagacagcuacaguguacucauauaaauaaaaauaaauaauauuuaaaaacaaaaacaaccuacugucacccaggaggcagaggcaggcagaucucugugaguucgauugccagccuggucuauagagcaaguuccaggauagccagggcuacaagaagaaacacugucuuggaaaaaacaaaacaaccaaacaacaauccccagccccccgugcccccccccgcccgcaaaaaaaccccuacugugugcagagaagcaucucacuuacacugcucacuugggaggcgcugugcccugugacugacuacucccuuuuuucucacaggcccugguguguuccugcuucauuccccucuucucuggccuaaucccuccuuccuuccgaggcgagguaaguguugggggucguugggcagcugaguguuuggggcugcuauuuguaaugagcuggggucagguccccaugacuguaucuaacugcagagcugggaucugagucuugaggacagaagccauacauccccagcagacugaccacagacuuauacccccaggaguuuccucaccuccugccugcugucuguuggauacacuggccugguucccuuaaucugguccugagcacccuagggagccuccugguggccuaauuaaaguguaagaugcuuaggaauuaaauuacucuuguuagguaguugauuuucaugagaauacaggcuagcugucuauuucuuuuuuaaucuuuuagacaggguauuacuaugugacuuuggcuagaauucucuagguagaccaggcuggccuuaaacucacagaacauuugccucugcuucacucugccaccuaaguacuaagacuaaaagacaagugucaucacacccaagagugaaacaaucuacauuuucuuuuguuguuguuguuuuauguuucuugauaaauaugaggauaugccugaguguacaaagacccuagcgauuaagcacaucuuugaucuugauacugguccccagucuucuugugauguaauuuaggcuaaguggaagggacucggagcauuauggcgaugucccuacacucccuagaaugcacgccuagauuuuccucuagacaggagagucaagaguucaaggccagccuuagcuucauaagacucuaucaugacacagugacuuucacagguaaucccagcaaucagggacugagacuggagggucaugaguucaaggccagcccguaacccccucuccccaaaagaaaaguauugccgggcacugguggcgcaugccuuuaauuccagcacuugggaggcagaggcagguggauuucugaguuugaggccagccuggucuacagagugaguuccaggacagccagggcuauacagagaaacccugucucaaaaauccaaacaccaaaccaaacaacaacaacaaaaacaaacaaaaaaaaaacccaaaaaacaaaagaaaaguauuacaagaaaacaggcucaauugaauaucuuguccuagaucuccaaagggagucugguuuugaaccuauggccaugugucuccuuggugcaggguucauaucacauacuauccccaguacauguaacacccuucguuuauauggccccuuuaugcauacaguagccacucaccuaugggugaccacccggcauuaggauguaagaagcacaccauggaguggacucucaucuccaugugucuuugccuggcacuuuugcauggggggcauccuuugcaacaguacccguaaccuugaaagucaggaagaaacuccuagaagggugguucccagaccaccauauuggcugcagugucuuguaaaaacacuuaagcacggccuccucccuuuccccuuccccacagcgguacguggacggaggagugagcgacaacgucccugugcuggaugccaaaaccaccaucacggugucaccuuucuacggugagcaugacaucugccccaaagucaaguccaccaacuucuuccacgugaauaucaccaaccucagccuccgccucugcacugggaaccuccaacuucugaccagagcgcucuucccgucugaugugaaggugagccaggugcuagggugccacucucugccccuacccccagauagcuggggauaccaguuagucccuccaugagcagacagaaauagauuaugccaugauggugacuuagaaaagguugcuaucguaaagcugaguaaucacgccauagccuuuaccaggggucacacggacagaccccgaguucagacucaccuucuagggauucggggcuaagaagucagggguaaugaacggugucuaaguuucuuuuccuguuguuaagauuuucuuuuuaaaaaaauccugacaagggaaaguuuucugaaaaaaaaaaaagaaaauuuauucaggcucacaguucaagguacaguccacgauagcagggaagccaguugucgggagcuuguagcaagcaguuggucacauggagcccagaaucaggaagcagggugugauggaugugagcuacagcccagcucccuuucccacaacauguaaaauccaggaugccggccagagagcggagccacucacagugggugggucuuccugccccaguuaacgccaucaugauaaacucccacaggcaugcuuagagguccaucuccuaggugaggcuagaugguaucaagucaacaguuggcacuacccacagaaggguaggugggggugguauauaccuguauuccagcacccaggagacugaggcggggggauagagagcuugaguugagucugggcuuucuagaaagacccuuccuuacaaaacaaaaaacaaauaagcaaauuguggauggagagauggcucggcaguuaagaacaccggcuacucuuucagagguccagcacccacauggcagcucacaacaauaauaggaucagacacccucuucuggcaugcagacauacaaguaggcagagcacucauacauaaaauacauaauaaguaaaguuuuaaaaagcuuuuaaaaaauuaacuaggaagauggcuuagaggugaagaacauucucuguucucguagacgacuugaauuugauuccuaauacccauaccgguacaggacugcuuguaacuugaacacuaaugccuguggcuucugugaccaccuguauacacaugaacauaccuauauaugcugggcagugguggcgcacgccuuuaaccccagcacuuggggguggggguggaggcagaggcaggaagaucucugugaauuugaggccagccuggucuacagagcuaguuccaggacagcuagggcuacacagagaaucucugucucaaaaacaaaacaaaacaaaacccaaaacaaacaaacaaacaaaaaaguaaaacaacccccuucagagaaaauaccuauauaaauuaaauaaauaaaaauauaaaaaauaaaucuuaaaaacacacccacaaacaagguggguuucuuuaaucucagcucucaggagacagaagcaacuagaucuuugugaguuuaagcuagggcuauagaaagagacccugccucaaaaacaaaaaccaacaaaaaccuaugggcccuuaagauggcucaguguguaaaggcugccaagccugaggacccagcucauuuuugggaacccacagagcaagagaaaguaacaauuuccuauaaauuguccucugcucuccaugugcacacguggacacacacauaugcacacgcacacacauuaaauauuuugaaauaaaacagcagcauggccccgccauuuggauuuucuuuuuuuguguuaucgaggauggaagccacggccucagguaugccaggcaaagagagagcauugaaucaugaccccaacacucacugguggauuauggguaaggccucacagcccagccaugccuucauauccucacugguggguucuuggcaagagcuauacugaugagccaugcccccaauucagagcucuuuuaauuuugguuccugacgugauucugauuagcaccgugacaaggagucaccacaaucggggguuuccuuuucuaaugggucuuuuagugcagcgaccgugucuccacagagcuauugagagaaccuggccaccuguacccgaguugcucaccaaucaugaugcucaaugaugauuggccagggacaggguaguacuuuguuagcuacagugacaaggcugagccccaggccgaggcugcaugaaacacugcuucugcuggcagagugucuguagagaagacauuggcgcugagaccuggggaagcacagaguuaaguggacccucucagggggccuccaagucuugaauguccuagguccucagagggcauggcaguugcagccccagugguucaccugcccaauuugcucacucacaggugaugggagagcugugcuaucaaggguaccuggacgccuuccgguuccuggaggagaaugguagguccuggcugggggguuacuacagagucuuucaguucugucauccagacuuguggccuucccagagccucacuucaccugcuucucagcccuguggaauaggaaaccuuugcccauguuauagauggcuggggaggagaggccagcagggcaggggcagccaucaugauacagagcugggauuugaaccugggaagccugagagcaccgugucgucaucccccccccccccgcaccuccccccccccccgcacccccccccccugcaggcaacuugcuucucuuucuuugagcucucuugcgagcccuuagcauaaugagcucuuugacaggguucagggcaguuuccagauuagggugucaaaaucugcucccuagccaaauguggguuccacccagacgagacuucuucccagcagguccugagucauccaagcucaccuggcaaccagguugcgcugugcauacuuagucacacagugggauggcauuuugacaucaugacugucucaguuuucacgggcacauccuauaaucacucggcgaggaaagcuagcccuucuuaaaacaugcccaugucauaagcugagccugguagcaugguccugucgucucagguacuggggaggccgaugcagggggauugcaguuuaagaccuagcuugguugccagccugggcuacuuugcaaugugggggguggggguggggggagagcuacuuagugagacuuuguguguaugugugugcguguguguguguguauauauauguguguguguaugugugugugcacgucuauguacguguguguuauauauauaugugcauguauguauguguguuauauguuuguguguguuguguauguauguauauauauagccauauacauacaaggcuagggcuauagcuuagugauagugcuagugugugugccuaguauauagaaggcccuggguucaguccucaggcccaucaggaaaagaaaggaagagaagaaaaagagggaaaggagaagaaaacaaaaagaggauuaguagaacauuugcccagcauguguggcuagaagcacauuauggagacagaggagauacuuuuguaaggacagaugugcauucguuacagaaagcuguaugcugaaccagaucacuacagggccauggcaggagccuuugcagccuuagagccagccugagcuauauagugagaccuuggcucaaaggaaagaaacagaaagcacaagagaagaagaaagacaaagucaaagagagaaaaccagaugggaauuggaugugucucugccggccucuuggugcuugacagccacgugacagaggguuuuaucuuggaccccagagcuggcucugccaaguaauggcugugugacucugaacgagcaucccgugcuugugaguccucagcugacaguugucuuaguugguguuuuauugcugugaagaaacaccgugaccaucgcaagucucaugaaggaaaacauuuaacuuccuucggaaaacauucugguuuucugaauuggcuuguaguucagcgguucacaguccauuaugucauggcaggaagcauggccacuguccaggcagacauggugcuggagauggagaggagguuucuacgucuggaucaccaggcagcaaggagagacugucacacugggcagugcauugcuugcacugcccagugugacauauugcacugagcauauaugaccucaaagcccaccuccgcgaugacauacuucccguaaaaagggcacuccuacuccaacaaggccacacucgugucacacaccugagucuauggggggccguuccuauucaaaccaccacacaaguagaccugcugauuccgguaccuguugaauggccacugacugcuguuguucgaggccuggaguuugugcucauccugugagaggagaguuauugguucacuguaguauuuuccuuuaaagcuuaugaacaguugcagagagacucccacacagcuagagagugagcuagcgaucuggggcggaaccacaaaccacacucccaucucugccugacugcgcacaccgcacuccucauccucucuguucugcugaggaaggccaagcacagaugcucguucagagucgcacagccauuacuuggcagagccagcucugguguccaaggugaaacccuuaacccacacccugcaugggaucauagcaagugugaagugcuguguuggcucaccuuccccgcugucucccaucuaucuuucccuucacggguaucucuguguucucugcaggcaucuguaacgggccacagcgcagccugagucuguccuugguggcgccagaagccugcuuggaaaauggcaaacuugugggagacaaggugccagucagccuaugcuuuacagaugagaacaucugggagacacugucccccgagcucagcacagguacugcuauucuggggcaggaugagcucagggcaugccagccagugcaagggacugggccaccugcuguuugucauguauuuuaucucauuggcuguuaaguagauucuaaauguucuuuaugucugugucccucgaaauuccugcacugacagcagaauggggggagggguguccuuaggaggugaagccagggguccaaggcuagccucagcuacauagugaauucugauggucagccugggcuacaugaacuccuaucucaggaacaaaaauaauucucauacugaaauccaagcccccagggggaugauguugggagguaggcaagcacuggaacaacuccugagggcaaggccuuccaaaugagauuggugcaguaaagagcaacccauccaggcggugguggcgcacacuuuuagucccagcgccugagaggcagaggcaggggaaucucugauuucaaggccagccuggucuaugggaugauuucugggacagccagaguuauauagagaaagccugucuuagaaagaaagaaagaaagaaagaaagaaagaaagaaagaaagaaaggaaggaaggaagaaagaaagagggaggagggagggaggaagggagagagagagagagagagagagagagagagagagagagagagagaaagaagccaggcagugguggcgcaugccuuuaauccuagcauuuggaaggcagagcaggcggauuucugaguuccaggccagccuggucuacaaagugaguuccaggauagccagggcuacacagagaaacccugucucaaaaaaaaaaagaaagaaagaaagaaagaaagaaagagagagagagaaagagagagagagagagagaaagagagagagaaagagagagagagaaagaagaggaucaguagauauccuccaguccuucagcccacagagaugcaaucugugaccagggccuccaccagacaccagugacugcuggcaccuuaacacuuggccuuccagcauccaagucugugaggaggccguguuuuuugguuauagaaguggcuggguaacggugugacaguggucugauccaccaagucagacagacuaguccacaaaccagcuuccugcuuggcccaggacagauucagccaugaaugggacccagugucugcccuccaggcaguagcuguucaauuggagguauccggaggucaucaggggaagagugagccagcugaggagugcggguguugucagggaagcugugugcucccucaaacuuaucuggaaacacugaggagucauagacuuaaacgugugccaggaucggggagaggggagagucucaccguguagcucacacuggucacaaggaucccaagugcugggauuagaaccaccacacuuggcuugaguuggaccucaucacccucacugugggagagacaacucacaagccccagcugccugcccuuuggcuccaagcuuccuguauuuauuucaaagcccaucugcucgaagggcuugaacccugguguucucaggagccauucggacuugugguuccaaacugccuuuuuuccccccagcucugagugaagcgauuaaggacagggagggcuaccugagcaaagucugcaaccuccugcccgucaggauccuguccuacaucaugcugcccugcagucugcccguggagucggcuaucgcugcaguccacaggugagcaucaaggcauggugugauaguucagugagcugaugauagaggcuuuagcccaggcuggccgcaggccacaagauggagccccugggagaggcuucccuuuguagaaauugaagauaagauugccugugagguccugaguguggaguagugggcucauguguccaguucgcaggggggauuuguuugcauguugacuucccucguuggaaacuucagaggguuugguuuuguuguugcuacuugggaauucgggguguuugcacaggcuuaccaguuaagcaaguucaaacagguaaacaucucagacguguuuugagcaucacaccaacgcucagaaggcuucugacuuuuacacuggguguggcggcacacaccuguggucccagcacuguggauggaggcugaggcagaagagucaggaauucaaaccuauccugggccacagaguuagucaaggccagcuugggcuuuguauagagaccaugucucauaacuaagaugugucuggggacguaacucaguggauaguuugcaugguucaaucccugugcuaccauuaggaaggagaagggagggaaggagaaagagaggaagggaaagagggaaaggggggaaagagagagaagaaaggagagggggagaagaagagagggaaggagagagggagaggggaaaaacagaaagggcaagaggaagagagugagagggagggaaggagagagggaagaagggggagaggaagggagaaaacaagaggggaagagagaguaggagggagggaaggagggagaggaaggaagggagaagaaggaagggaaggaaggagagaaaaagaggaaaggagaggggagagaaggagagagagaggaagaagaggaggaggaagaggaggaggaggaggaaagaaagaggaggguguguuaucuagaggcucuggauguaccuucugcccuggacuacuccuggucuccuuauccuguccaaucugggcccaugccucagggacaugacccagcccugcccuuccauuucuuugcacccucuuuuucuuggcacucucccuuguuuuucugaagcgaagccuuccuaaauccccagggaaacagcagccugccagccuccucagagccucaccuguuccugcacuggcugcugggcagcugcucgcaggccugcgggcacagucuguccucugagagccuagcuggggcuccguaagauuauuuauucacgacuuccaccugcucuucuccucuguggccuguagguucuuggucuuucuuuccaccgacugcuacuuucucagucaaaggcccucucucuccugguuuggggacaugaccaucuguaauuaaugccuguaguuucgucuuuccuggggcuguuucuucucucuuaugagacucuugugagaugcuuugccuggaacucuguagaccaggcugaccuuagacucacagagauccaccugguucuggcuucugagugcugggguuaaaggaaugcaccaucguugccugacauagaaacuucuuuauuggggcagaugggaaaugagaaacagaugucuucagggucugagggaaagccuagagcagagaagccuucauccugggagaaagaacagaucagcagcuuaugaaguuguuagggagugcccaggggaauggugaaggagagguaguccccaagagcgccccagcggggccgguagaucuggaagauggugauccagguggugagaaugaaugaucaccaagaagaggaagcccacagcugagcgccaaacauagccuuugauuuggcucugcucuguguaggcuggggcgaggaaagccucucuaaagaaccagaaaauguugaccaaccaaagaaaaggcaggaacgcaaauccaccaagauaguacuuccggcacagguucaacuucuccucauuggauacccgcuccaaguucauaguugcgcuggagcccggugguccuaagggucugcagagcaagacccaaaugacaggcgcaagaucacgagcaaccacgccccagugcgguuuaucccuucugccugggauuccuuugugggagauuugcgggagaugccgcaguuuucaguggaguuuguugucgcuuuauuuuuuucuucuccugcccagccccccucgcaccccacccucuccgccaguuuucaguggaguuuguugucgcuuuauuuuuuucuucuccugcccagccccccucgcacuccacccccuccgccgaaacuucucuuucuuacauauuucagcccuuuggcuuuuugccuccaaucugaagucuucucagcuuuacccuccaguucuacccuucgggguuuuaacauuagcagcaugagugagcaugcugguccuuucuucugguuccuuuacuugagcauucucagcuugguuuguggguguugggagaaguguauugggggugugucuguggaagugggugugucuguauguugagggguauuuuuacuuuuauuuaugucugugugcacugauugguugauugauuuugugugugugugugugugugugcgcgcgcacgcacacacacacaaacuguuugagcagacaggcuagccuugacuucuagauccuccugcuucacccucuuagcacuaggauaauagauaugcgccucugugcuuaggugaguguccugccguccugucuuucuuuccuggcuauagcagggccacagccuauguguggaggucagaggacaacucucagaaggaguuggcccucuccuuccauuuucuggguccuaaagaucagacucaaguugugagacagggcagaaaacgucauuacccugugaaccaugucugccuccuguguaaguacuucugagacagaauucuaguucuguagcccaagcuggccuagaacuuacuguguagaccagacugaccuucaacucaagucggaccucuccccugcaugcaggguguagggcuugauucaccccucccccaucccacucaaggucuuguauuaggggcaucagccuagcucccaggcagggaguagugcugagucagccugcuucuggaggaagaagggcucccuugugagggugggggugggggggugcuuccuccuuguccuuccuggaggauuagacacaaggccaaguuugacuguaguaccagugcuuuguggugucuggcucccuccccucuggcugaggcuaugggaucucauagccagaucaguaguucacacuugcagccagcucagcugcuuagggggaagcccaggaggucuagaccagccuguggagagagacuccguccucccugcuccccgucacugugcucccuuagcaugggagcaccucuggauaagaggugcagcaagcuaggcuuagcuuguccucaccccaccccacguccucgaauuuguaucuuagcacauugcacaggcccaaccuuuaguuucucuauccaaacccuggggcagcuuuacugauccaguguuccccuucaacagcuuccccaccgacgucaugauaaaucgaauuaagucgaaguuguaaaaagucagguuuauuggggcagcucugggugggcucaccaaugucacaggaaggggucagcaaaguuguagaaguugccgggcugagcuccaguagaggcugcugggggagugggggaggggagucgugaagugaugguuauucauuugguaaguuuagggcccuguaggugggucuuuagguccagcgguuacuuuggaaucuggaacugggagcugacuuuguccaguguuuuagaugggcuuuugcaagcaugggcgccuggucagaagagaaaggggguagggucucuuggcccauaccaucuuaccgguguuccaaacuuccagucugccaccccucaagggaaguucuuaccagcaacuuaccucuugccagagucuacagaggguuuuggccccgguggcuccaguuggauuccuaguggcccugcaccgcuggcuucuauggagccuaggccucggccagcacuugcccucaacccuugagaaauuagguagacccaccccacgcugcugccuuucccguucauucccaggagcuuucuggaaccuuauauggccugugugcuuuaagagauauucucagagguucaccuuugugcugauaucccacauaugccuuagggaagguaucagauugcgguuagaggcgauacaggcagcucacuaggauuaaggucgcgguugucuaguugguugugagccaccacuugguugcugggauuugaacuuagaaccucugaaagagcggcccgugcucuuagccacugagccaucucuccagcaaugggacugcuuuuuauugcaguguuggcugcuuuuuauugaccucuuuuuuuuuuuuuuucugguuuaaucuuuacagugaacccuuguguccaugugauauuugugcacauguacauauaucugcaucuguguuucuaugugaaguauacaugcauggugucuguuaugaaaaauaacacaggauuaaagggccaccuggagggcccaugccaaggugucucccugagaaaucccaccaugugacagaccuggcugguauaagggaggucuauuguggggcaagggaggggagacagaaagggggagacagagacagggaggcuggcagggaacauguggggacagagaaagagagagagaauaagaaaggggagauagagaaggggaccgggguaacaugguccucuuacaagcucccaggccacccacaccugguggcagcucagguagcaauggaggcaggugaugaccuaagcuguugcuaggucucuguuguuaggucccugggaggaaaccagaaucaccuguaagccaauaguguccuuggcuuccuucccacaggcuggugacauggcucccugauauccaggaugauauccaguggcuacaaugggcgacaucccagguuugugcccgaaugacgaugugccugcuccccucuaccagguaaauacuugggcccagggugugugggccagauaggcaucccucccgguuguucccagagcucuuagggucagagcuuggguggugacagccuuaacaagccaggcucagccgccuguccccagcaugccauuaaagaaaccgguagcagagaaagcagguuuauucgaauauaaaaagguucaagcccccacccgguuaaucuuuaagauaccaacaggaggcuuaaguuuaaacagaguuacacauaaacagucugaaucagggcgugguccugcccaccauugucugggcuucaagguuccuucuuucucucccuagcaugagauuccugggacaaucccaauuccuuggccuccauuguaucaaagggcugaaaaccaaagggaaggcacagcugucucuucagcaugccucuucugccagaaccacugcaagguuuggugcucaggcugugcaaacauucuagcaauguuugacucagugucaagcaggugacaaggaacauggugcuguguggggggaacccauggcccaggugagggcuuauuggugggugaagcuguggguguucaggugguggagaaggccuuaagggaugggacugacaccucagcacugaaggcaggaggaagcuguggcucuggguugcaccccugccuggcuccacccucucuggcaucuguagaaguuacagcugguucuuccucucagccccaugcucccagaaauaagacucagacccaaauuauaguuacaaauaccuuggccauauagcuaggcucuucucagacuagcucauaacuuaacucauuaauuuuaaccuccauccugccacauggcugguggccugugcucagguaccaugaguccagcucuucacaucuuuccggaugaaucuuccauaauucuuucugccuccuggauguuccaccuucuauuccaccuuuuccuauaggccaugguuuuguuuuuguuuuuuuuuuccaaauuuaauuuaauuaauuaauuuauuuauuuuugguuuuucgagacaggguuucucuguaucgcccuggcuguccuggaacucacuauguaagccaggcuggccucaaacucagaaauccgccugccucugccuccugagugcugggauuaaaggcgugcgcaaccaugcccggugugguuuuuuuuuuuuuuuaauugacagguggaugcaucuauauaauccauaacauauucucucuacagguaucuauuagguuuugggugagguguggaguucuagggaacucugagagaaauuccuggggaguaagugguuuaucaaguugauuggaggaguuuuuaaugcuauggacagacagacagaaggacaacagcauagucggggcuaccagggaguucaggccccggcaucggagauagaagcaggauggggucuuugaagagauucugagcccacacagcagaggagggacucucucuuuagagcuuuugaggaugagggagguugacugcaagagccuacagccaggcucgaggcaggcaggggguggggagcaggauguaaaccccuucgaugcugacagacucacuucugggguaaaauauuaugagaugccugucagugucugugaagagaccugagcagagucuggauucugacaucaaucauguucuuacaauacugaagaccugagagccugcaaucuugguuuguaaauugcuggucuccgugcuuccagugaacuuggacauucuucucaugguugguccaggagaggccaaagcugagggcacccugccuuccacccccaguccagcuugaccuuuuaucuggagcaacagugucuagaugaugggugggugaggggugcuauacugucugucccucugggaaggguucuguuacuuuuggaggcagcuaggaaguuucucugugcagcugcccccuggugcuguguggugaccucauugccugugaccccaggaucacaggaucugggcuaaagugguaguccauagaaaccaaagacaaugauuugguguuuagaaagcuacucuuggucugggugaagucuggugcuuaagggcuaucacaaagagcgugucaaaccaucucucagccugugagucaguggggagcccaagggcaucaguguuuggaaacuggaauccaaaccgggcaaucucggaaggaaacuguuuaggaauugugaugggacgggccguggcugucucugaaaagggccugccagauaacuuauuacuuuuaaggacaccuuuggcucuuacuaauuuauaaagcauuuuauauaaacacaccagggagugcauggugaacuacacguaugaucaguuaaguggggcuagaauuagguagggagagcaucggaccucugccuccucaaccucaacuugcuugcuuucuccacuggcuccaaaucuuuguauagucaucagccaugaccaccucucucccuccccaucuacuaccagcagcguuaaugggaauaaguacccacuucucucagguguacuauacagcugugggugugguguguguuuccuguaauucacacuuuagaaaggaaacaagcaaacaaaagaaaccaggugcugcccauacuccuaaguguagacagugaaggugugugucucccaugccugagucuccuggaggccuagugagcuccagguucaugcaagcacaucaggaggaaucauauaaucucagcacgguugauccagaugggauaagaaaggacucugggagagagaaugugguucuagagacaaagugucuaggcuacacagaagauaagacugucccaaggaaagaaaagaaaccaggaacuagggugcagcucaguugucagaggacuucucuaggcuugaagcccagaguccaaucucagcaccuuauaaacuguggagugacaggcagugacaucggccuguaaucccaacacucaagcaguagaggcaagaggaucauaaguucaaggucuuccuuggcuauuuagggaguuggagguuagcucuggcuacaugagacccugucucaaaaaaaaaaaaaaaaaaaaguagaaacuucugccuugcuuugagcugccccuuucuggacguuucucaucaguagagaauauuccugccacccuaucagacaaaacucccacugguuuggagucucuccauucucaggaacaccucaggagucagacagugagcagcagggagcaaugucuugacuuguaagccccuuagcaaggcugguucauuuguuuauuaaaagcaggugugggugaauuuaugcaaaugaguaugcaaacuaguggaacagcagaaggauugaauggauacaccaaaaauaaccacaacuguuuaagggaaaaggguccauaauaaauguggggaacaaaaaacaaauaaaugugauuuuuuuuagaaaaauguauucucugucucuucugccucuccuacaacuaaaagggccugugggacagcuuccucuauaaguuuguguucuucccuguaggcgugcaggcugaauguccuccacacugcaaaaugacuggguuggugcuguauagccccggcuggucuggaacuauguaguucaggcucaccugcuuuuuccauucuccugccucagccuucccaguaccauguucacacacaaccacaucagcuuggaaugugcauuucuaggaagcguugggaaaggacaauggcauagucuccagaaccacugagggaaaagucuggagcaaauaacugugacaaagggcugggugcgcaugugacucucucuggccacaggugaggccagcccugaagaugacaggagcacucaggcauccaacacacagggauaacccgaacacaagcuuggaucaugggcaguguucaaggcuucaauuuuccccaguguaacaccaacaaggggguagggcagggaucguuuacugaugaagaacuacacuucccagcuuccccucugauggacuacauuucccagucuccucuugugaacuaguaagucauuucuaccucuauagagggcuucuccuguggccauuuuggccaccugcaugugugggugacaaaacgcucccucauuguuaauaaacaugauccuaccuaaggucagaccaaggcuugcucugucuucucucccucuacaacugcuuuuuaaauaaucuaacagggagaacauaugagggcuaaagguauguuuuaaguuuaaauuacugugcuuaagagaccuauauaaaaaaaaagccucuaaccuguaagucccacuuggcccaggacagauaacuuccuggauugcuggaggcuguuguccacguaagauaacuucugcaaacaagcuugguggccccaacugcacaggaugugaugaccacauauaggugagagguauacuugccuccaguggaugaaggcagaaaguacauagccuugugggcuuugccuuuguaagcaauuugaugccauagucugggaauucuggguauggaccuagcuagugucuauuguccuggccauuauuuauuaaagcucacuucaaauuugucucaaaaauugugacaaugguccuauuccugaccaguggcacuaacagacauuguaugugcaugaugggagaaugauucugggcccuuagggcuuuuuuguuuuguuugcuugagacagggucucucuguguagcccaggcugugcuggggccaucuauguagaccaggcugcccucacccagcucugucuuugggaaggaaaguagcuaaguacccuagauugcguuaggauaggaacauagcaauuauucaugaaucccugcauggugucaggcucagauucacgggaacaugggccccaucuuugcagaugcuuaacgagaaaaaggucaggagugucccggaaggaggggauggaaaaggaagcuaggcuucaguggucaagugcaguggugucagguugacugcaggucagaggacaggaaccccacucuaucuuuaguaaacugcaguucagagcuaccaguggcuuuuauuacauuauucuuuugaggcacaguaacuguuucugcuaccaaaacacaaacgcacagcugucuuuuuuguuuauguaaccguccucaccugaacacucaagagagcuccauucaucuuuuaaaaaauaugaaucuggggcuggugagauggcugaacgguuaagcgugucaacugcucuuccaaagguccugaguucaaaucccagcaaccacaugguggcuuacaaccauccguaacgaaaucugaugcucucuucuggagugucugaagacagcuacaguguacuuacauauaauaaauaaauaaguauuuuuuaaaaauaugaaugugggugguggugguccaugcaccuuuaauuccagcacuuggaggccaggggcagauggagcucagugaguucgaggccagccuggucuacagagcaaguuccaggacacucgggccuacacaggaaaaaccuuuaaaugaaauauaaugucgccaggcagugguggcgcacgccuuuaauccuagcacuugggagacaggcaggcggauuucugaguucgaggccagccuggucuacagagugaguuccaggacagccagggcuacacagagaaacccugucucauaaauaaguaaauacauaaauuaaaugucauacacauuucugaggagucugggaaggcgaaauuuauucacuucugagagucuguucgcuccuaacaccaugugggucugcaggauugaaccaagcugucaggcuuggaggcaaguaucuuuacauaccgaacucucuuuaaagacgccuccaccccauccucagcccagacccuuuuuacuggacccgucgguucccggagcacacacucugucuuccuugcgcccuucugcucacaccuuagaaguggaacugaggcuccaaggacuagaccgggguaagcccccauacaacgaggagcucagcuccguugccuuuucacgggaccagcucugcccauaaccgcagcuuucugggcgucacugaacgcuccacgcuugcacugggcuuccuggcguucuugugaacauccgggucacucucucauacggaccaaugagcggagggucuugagucagggggcggacccuaggugguacaacauggcggcgcucggcacgcagcuuccgugaccuguagccgagccucuuguguuuguagcugaguuugguugggcgcgggcaccgccuuggggcagcagccggagagggagccauggggacagugcacgcccgggugagaggcccccgcggcggcugggcgggacacgcgcgccuggggcaagggcggcagcgagggugugggagcugcuuugggccggaggcugucugucgcggucgggagggcaguggugacuugcccaaggucauucagcggaauuuccccaggugaccuuacagcaccaaggcuuggaagaaggguuugucagaagacaagacacaacaaguuauuuugcagccuuguuuuacaguuuccaguuacuauuaugugcaccagugugugcgcgcgcgcgcgugugugugugugugugugugugugugcgcgcgcacuuugugugcauagcccguggaggccagaagggggcaauugauccccugaaacuguaguuccagagaguugugagccuccuuauaggugucaggaaccacucugguccucugcaagagcaguaccugcugaacccaucgcuccaacccagcacuauugcuuaaaaaggggugugugugugugugugugugugugugcaugcauguggaggucagaagacaacagcuggagucaguuuucuccuacuuugugguguggaaacuggggaauggaacucuggugauuaggcccuaaggggcgagugccugugccugccgaucuguccucacuuuugaguuggcuuucauugaguuggcaaccuggaauugggcagaaugagcucccuccccauaaaugggcagagcaaacuauagaagacccuugugcugucucagcaucuccuccaucccuauuucugacuuuggcuuuguagcccaggcuagccucauauuaguagucuugucuaagcuucugacgagcaugugucaguaucucgggcaagcacucacugagcuauauccauagaucucuucaacuauuuuccuucacuaggcugucagggccagccuggagcucagucuguaguccaggcuggccuugaauuuggaauccuucauaccuuugaguagcugggcuuauagauccaguagcuaggcauggcacuacacacccuuaaucucagcacccaggaggcagauacagugaauuuguugugaguucaaguccagcccugucuaugcagugaauuuuaggccagcgagagcuauauagugaggcccugucuaaaaacaaaacaaaacaaacacuacguagugagagaauccccauugguaaacagguccuggaggauacugagcuguggcagaagugugaaccacagugacaucugcccuccagauuguggggcugguggccucuggaggacuuugugucaugcuuugccaucuuaggagggaccauuggaacuuuuuaaauaauagaaugcagacuuugcccuuacaaagcggauuugccaaccguuggauuacacauggauccacaugcacauuccuccucugccugauguuuucauacuuggcagacguuaauagugauuuaagauuacuaacagcaggaacccaaugaauagugacgugaaaugaugucuugucugucauccuugguaagugcccauauuagcguggaaccauugccagcccgaguacuagggcucuaggcaugcaccugccuuuuucuuuuccccucacuuaguaaaagaacaaaagaaaauugcauuuaaucaguaucccaugaauaggaauugaguaccaaaaaagggagaaacugucugaagucacaaaauucuaacauuuaagagguaucccuuuggacccggacaugguggcuguaauuccagaaaguugggaguuggaagcaggagguuuagggcuuccagacuguucuuggcuauguagcgacuaugagaccaucccuggguuugugagaacuugagucugacccuucacacauggguauucucuuuauuugugugucucucuguagcacgcacacacacacacacacacacacacacacacacaaaaccacacagaaugguucagaggggauauuuagcauggcaugguggcucgugccuauaauugcagcacuuaagaaucagaggcaggagaaucacaguaaauucaaggccuguguuccugucugaguaccucacccccuccaaagauagauagcauuuaagguggaucuucagacgaugcaggcagccagcauggccucgugauggaggcacuuauacuggcuuggagucuaggugugucuccacauagguccucugaagaccagucuucagggcagguguggaggaguugugauccucuugggcuccuuccugacacucagaaccugugugcaaggugcguguggcagaaagccuuccgggaggaggaggaggcagaggcaaccccagaguccccuugcuccgcacauaucagugcuugugggcaccguagaggggccugacugcaggaagcagccagauacugccugccuguucuugaaaguccccugaaauguugcucugaguccacuucaaggaugcuuggaaaucucugcugccaaguguuccagugacuuaggguucacucacgggaacagauuacauguuccauguacacacagauaaagcacuguaguaugugugugucauguaucuguaauuguguuuuccagucuucccaguccugguuacccagccccagccccagaagcucauuaagaaguugcucuagugauuauuuauuuagugguagaaugucuucuccucagccucccggggcugggauuauagccaugugccaccguggucggcucuguguuguucugaggugguggcaguucauaguaccacuuggaagcagggugggcucaggaggaguuucaaagagagccuuggcuacacagggugugugaggagagacccaaucucagaaaacuaaagagaaguagcaaacaagguugggaguguagcuuggugguguagacacugccagcauuuggguuguguaaagugccugcuuccuggcccacugacaagcauguacaagggcuuccucccacgcccccaggguuucucuguauagcccuggcuguccuggaacucaccuuguagaccaggcuggccucgaacucagaaaucugccugccucugccucugccucugccucccaagugcugggauuaaaggcgugcaccaccacugcccgauguacaagggcuuuuugaaaucuuuguuucacuuacuaauuacccagugaacaugcuuauuaagcacgguccccaggaccugcaccugcccacuggccuacaccagccucccuauguaucccauccuguccccagcuccucauccucacagggagcagcugugcuggaauucgugacaccaccugaagccuaaagguggaggccuggcuccuuuucauuguaagcuccucugucccuugcagagucuggagccccucccgucgaguggaacugacuuuggagcacugggggaggaagccgaguuuguggaaguugagccggaagcgaaacaggaaauccuggaaaacaaagaugugaguauucuguggaacaucuugaugcuuuucuggaauguucucuugguaaggcccucuggaaagugaagcagcuaacaugucaccagguacaaacagagaaccuugacuugaggacaguagcuccuuguuccuuagguucuccugggugacagucgauguggcugguuuaggcaaauacauuuguuccuacugaaaaaaaaaaauagaacaaaaauugguuuuucaugguuggagagauagcucagacggccuagguuugguuuccacuacccguaugguggcucaaaaccaccuguaacucuagcucuagauucuagagucuagaagaucugacagccuugcacacauguacagguacauacaugcagguaaacacucauacaucuaauaacauuuaaaaaguuuuucaaagauagacucaaauuaugcuuaagucuauauacauauauauguuuagauggauguauagauggauggauagacaggcagauaauauuaagggcgugucaccagcagaggauggcaucccagacaagugcccuaccacagagcuacagccccagcucuggaguuuuuauuuguuccuuuuuccuagaagagucaaggucauucaucccacaucaaaggcaaguguggcccagauuaagaaggccgggccucacugcuugcuagggugauccuggguuguuuggcuggagaggccagagcucauucauuuacugccaagcaguacauacuuggcaaaagcuaaaucuugaaauaggaguacaggagcugacaacaaaacaaacaaacaaagaaacaaagaguacagggcgggagagaugguucauagguuaagagugcggcuuuuccagaggacuuggauaccagcacccacauggcaggucauaaccaacuggaacuccaguuccagggaaucugacacuguuccagccugugugggcaccagguacucacaugcuccucagacagacauguaagcaaacacccauacaaggcaaaguucaaaaagaauggagucaggaguaagacaguuacuguacuugagaagcccuugcccccgucucagacccugccucuagcuacagucccaaccugcuucccgugccagacguggugaccucuguucccuugccacauuuagguggugguucagcauguucauuuugauggacuugggcggacuaaggaugacaucaucauuugugaaaucggagaggucuuuaaggcuaaaaaccucauugaggugaguuuguccucuguguggcacacuuugccugugacuucugaagaaucugagacccacagcccugcccccagccagccucucacugcagagcgccucccagagcuuacauaaacugucggcucuccuuaccucuguucauccugaggaaggacaagucuguccucuuaucugcuccgccugccuguccugcacucuuccugacucucagcaucagcguuguccaucccuggguuccucuguacaauccuccccacaccccaggcccgugcucuguuggucacauugacucuuuccugugcuguaggagauugucuauccuguggcucccucuguccugccuuuggaccacacugaccagagguuaucagugguguccuuguggcccaguuaccuggcuccucucagccucuugcuaaccuuggggcagggucagcaaaauagcaaucacaaguuuguguuuuuagagcauaaggugcuguuuuaggacaguuacauaagagguguaacucacagguggagagcguguuggugugaaugugcacacuuccuugucaccaccauuccccgaggccaccugggcuccuccugguucuucccagugucuuccaugaggaugaacccagguggcuggcagcgcugggcuucccuuuugucacugugagggcaggcgggcgggccugucuguuagaacaugugugggaagccucacugcagacucugugucguugcugugucucucuguggauggacauuaacugagcugagugcuuggcucucauggauggcuguguccucgguguccuacuguugugucgcagggugcacagugcaaguaggguuacuacgucgaagggcacauugucacuucaagggucagcagauuggucucuaaggagagccaccauucuacaccccugcagggggaugggcaagguccacuccccagagcugagaagcacguucucuaaggucuugccauccguuggacauagagugugguuucacugagccaucucaccagucucaaauacuuuuuauuuauauauuuauuuccaucccucucucuccuguuuuguuuuccuuuuccccccuuuguuuagauauccucucacuguguaguccaggcuggccuccauccuuagcucucccagccuuagccucugaaugcugggauuacagagaugugccuauuuucccucauucccaggagcucuuugucacuuuguuuccaguguccuccugucuguuaccuuuucuuccugcucauccuuggccuuuucugugucugggcgcucacucccugugcuggcugcuggcugucucagucagguucaccucuuccucgugggacuugacaggcauuuccuucuacacacuucccagugcaagcauuuauaggucacauggcuucagugcucccgagucuuaagagagcucacucucugucgucugucccucucccagguaaugcggcgaucucaugaagcccgggaaaaacugcuucgccuaggaauuuuuagacaaguggauguuuugaucgauacaugucaugguaagugucauggggaguguccuucugaugccauccuguagccuccaagguuucucaagcaggucgcagaguuagcagucucaaaagcuacaccugugaguuacguugcagucccugcuggacauggccuugcacuggucagcuccucgccucucucugugacuccagcucuuacccggcugcaccauagaauucccagacagcagaggcuagcuuagggcuuuguaagccugucauugugcauguuacacuacaugucaccgacccgacugggaguugugggcuugagggaauggucauuaugagugugugcuugacaguugugacaagugaaccuugugagugugagguguuuaaaguggcacgugucagaguaguaaggguugaaaagaggguuggugugguacacaccuucaaucccagcacucgagaagcaggggugcgggggguucucugucuauguggugaguucuaggccagccaggacugcauugagagacccugucucaagaacaaacaaauaccagaccagcaccaaggcuccucccaccucagccccacccugugucuccugcccccagccuguugagaccacuggacauaccacagcuauguagcaggaacacccagcagguguccuggguggaaggcuugagcuaccccuccucugagaccacacccugcaggguuuugccucacucugcagagagcaccccagcccuuggcagguugugacguagaaaccuccauugcagacacugcucacaccccacuggaugggggacguuuagcuguacuguuauaaaauccuuacugucaaaugaaucugagcuuugauguuggcugccugggacucagagcauuuuccaggaccucccaagcggugggcccauucccagcugaggugguuuucaggacagagagccuagucgguguuagguuuagaggucuguuuugguuguguguaugcauguacgugugcaaguaugugucacucggaggacaguuuccaggagucaguggguccugggaacguacccagccuggcaggcaugguggcagugccuuuacccccgagcgguguugacccuuuugauacuuacuucuuuaggugaagaugcccugcccaauggguuagaugucaccuuugaagugacagagcugaggagacugacgggcaguuacaacaccaugguuggaaacaacgaaggcaguaugguaggguguggcuccguaguuguugucuagagcucugaguguaagcuuugaaacgggccugucagagaaaugcaguugcucuggaaccugcuggcuuuggacuugcagugcuguucaguuuuccuucggccuccuaggacuggucagccugagcuggggguucucuguagccaucauaaccccuguaauaggacagaugugcgugcugguggucuuguuuagauuccuggucgggagguuugggguuggggcaggagacuucugccuuccagcuccccaggugcucaguguggcccucuuccagcuggucagccuuugugggguggcgugcugugugcuuggcaaggguguccgugggaagcaaagccugucuacccggucuaguaccagcuucauccuuuccccucccuuagguacucggccucaaacuccccaaccuucugggacgagcagaaaaagucacuuuccaguuuucuuauggaaccaaagaaacuuccuacggccuguccuucuucaagccacagccuggaaacuucgagagaaaguaggaagccaagcagguccuugagcucauuggcuugguguaaacauuaaaguagauggcuggugugugaaaugacaccuggcagccagccaccuccaucgaggccacuguccugaggaugagccccuguguagccuaacagggccuguuuagcugugcguaagccuugugucucacuguuaaagcucugucucauugccuccuaguuucuccguaaacuuauauaaaguuacugggcaguucccguggagcucacuucgggagacagacagaggagugucugcagaguacagugugaguauagcaggcccuggggucgggugcggggcugcacagacagugaguuuauuauugacuagagagggaaauggguggccuucucucuagcuccucuucgcuagcuaaugcagguaaccaccggagggacagagcuggccgguguccacacugguaacaugguaucugugcuccugacugacuggcacccagugcuuucucccgucuuucuccucugucuccccuuuuauuucuuuccuaaucuuucuaaagagcacacucugagagucaaagcauagugcuuccaccuggaacaguaggugugaaaggagcuggagugcagaaugguguggggugggugugggugcacuggggagggacauacaaccugcagccucuaaggcagcugugugaaggacaagacugggcagagcuugcugugucucaggucacccuaaguguaacugggcacuguaagggugccccaucugccgugaauccugucggugacuguggagacagcaguguguugcccuguggaagcggcuugcuuucuaagagcugcccuguguucaaggagagaagguaauugggaagcuccccuuccuguaggugucuggggaaaacaugagccuuugggcccuuaugcagaguggcugcugcucccugacuuucuguaggcuccucaggccugugcgcugccccugugugcugagcuggacacuuuugggccacgcucuugcacaccaagggugcggacugggcuucaguuggugucuccucaccccugguggccuuguguuuuccaccaggccugcgggcugcagagcuugcugggaugcucucuggggagcuuggcaccugguguccuugcuagugaagucacagcuacucccaaagcucccugacaucaugacauucagagagaauggagcugugagcuagagucuagggcaggcugugggcagaccugcugagaggcaggagguggguuccuuggaccuggccuuuuuucccucuggcugugggaagaaaaccuuuggccccauguggcuuggccuucucauucuucugggucauaugcaauccaagugacagcucccugggccugcccugagcuaauguagggcucaggugggugcgccaugucaugggugugucuuacugugaugagacugauacccccuguugacagucacccccaguuuuuagguauggcccuguccuuucaccagcagcucagagcagcacuacuuuggcucaguuuacaguccucccccucugccuucaugaguucucuucuguuccucucccccccccuaguuccucucaucuaaaacgguuugucuucaggcugggccugaggcucggggaagaucccuugccauuccaggccugauccauccuuggugcugaggaaagaauuuaucaaguguguuccucagagaugccucauuucaaaggaugguuuguagcagcuuguucccguguggacggagcagaacaaggcuuccuucccugucuuuacaguuuccccuguggaagaccagucacacugucaagugggaggguguguggcgggagcugggcugccucucgaggacugcgucguucgcugugcggaaggaaaguggacacucacugaagucgucucucucgguaggacuugcucucgggguggagagugugcugacagcccugugacucauuggccagucucugcugauguggggcugacugaggugccaaugagacuggcuccaccuccacugccucuuaauaguuuuuguaaguaacaucaguggaaacagaaguuaaaagaaauguaaucaccuggggcagcugcugggcucucugaggggacgaagcuggucggugucaguggaaaacucccuggugccucugggugugccaucucagaacuuuaagcuguccugggaggagaggacaggcacagaugcagggcugugggcauaaucagcacagccccagaccucggugcacagcaagugguguuguccuggagcugccugaaaugaagaugagaaugcccugcuccuuucuuucagcaugccauggucaucgacucucgaaauucaucuaucuugccaagaagaggggccuuguucaaagucaaccagguagccucucgccacagcaacucacuggggagccaaugcacugugcauggguaacauaacgcuuugccuguaguuggcaaacucauccaguagugugugacucaguagugcacuggucuacugagcccaccugagggaggcccuggguuccaucccagcagcacagaugggaaaaccacucuaggauugccugcaaggguuguugacuccacccuuagggcucccggccuccgaaucagcccuuguuccuugcagcuuaucuugugucuucccccaaggccacagugguugacaugacagccucucugguggugucguacaacagccaagaacugaguuggaggaccagcaguaggcaggacugucaugcaggggccugcagggccaguugagggcagugcuggcgcugaugccuguggggaguaguguuagugccuaaaggugauguggucaguugaccugcaggcaugggggaccugggugacacuguggcuguggugguccacccagucucauccugcugcuucuagugcuuguggugagcaggacccuggggugccugucucagucaugguuucuauugcugugaugaaacaccaugaccaaaaugcaaguuggaaggaagggguuuauucagcugacacuuccauauuguuguucaucaccaaaggaagucaggacaggaccucaaacaggucaggaaccuggacacaagaacuuagagacaggagcugaugcagaggccuggaaggguacugcuaacuggcuuacuccucauggcuugcugagccugcuuucuuauagaacccaggaccacuagccaccaugaacugggcccuccugcacugaucacuaauugagaaaaugccuuacagcuggaucucauggaggcacuuccucaacugaggcuccuuccucucugaugacugacuugugucaaguugacauaaaaccagccaggacagugcccaaucuucauuuuuaggggagcaacuaguggugagauuuguauguaaaauguuccugucaugaaagcagcucacucuucagaugcugagcaggccagugccuucagaaaggcagagacagcaaaacugucauuuugugggcaagguagugcuuaguagcuagccccugugucccuaugaccuguggcuucuucccucaggagcuggcaggcuacacuggaggagaugugagcuucaucaaggaagacuuugagcuucagcugaauaagccgcucgccuuggacucggugagucugcggccuccgcuguaccugugagacacugugccuguggaacccugagcccggagcaaugguauuagcccagugcuguggugcuuuaacccguaggacuuaagacccuccagucaggccugccaggcugcacuggguccucacucucagguaccacagaauuccaucguccucugcugccccugccugugcuguggagccgugcucugauuucccugagccccuuccucccauccccgagccgagcuccccgaauugcacaccuuauccacugcuucccugugaguuuggacucaagaguggugcucggagcaccuugaucuucacaguuacaccccuccacccgccugugcacacaggcucugucagagagguggggcucuuccuucacaggcacgaguuguguucuucuucuuccuccugcugcuguaacguccuuuuguuaccuguccauguggcuuccugcuccaggcuuuuaggaguucggcacaggcaugucuccagccaccuucucuucucuuccagccugggggguugagggguggagggcuccacuguacuuauucuguucuuccguuuaccuaccauuuccaccuacccacgcaccugucuacacauccuucuuccaucuacccauucucuuacccacccauuugugugcuccccaccugcucccuggcugccagacacucuaggugcuuauaucaagaggugggaguaaggaggucaucguaguuuggguuucauugcugugaugagacacugugacauagcaacccuuauaacgaaaacauuaauuuggggcuggcuuacaguuuucagagauuuuaguucauuuuuaucauagcaggaagcauggcaacuugcaggcagacauggugcuagaggagcagagucggcaagcagcaggaggagacuguaccacacugggcauaucuugagcuuauaagaccucaaagcccaccuucacggugacauacuuccuccaaugagaucauacuuccuagaaguaccauucccuguggucaagcauucaaauccaugagccuauucaaaccaccacaaggguagaacccaaagagaacaggaaggacuaguggcugagaugggcagcguuggggcaggcagaguguagaacaggaaauggcagagacgcuagugaaaggaaugacuuagagcaggugggacccaccugucuccuggaggaggagaagcaucagagcaguuagugugaguucagcaggcagugaggagcagggggucccucagcuuugaggugaagccggcugaggaugaaccucugccaaccuaaggccacuucaaaauaaaaugcuuauuuuaagagauggagaggagacaacggggaauaaaacccagcaggugcuccuuugaggcauccaggaauggggggggggggcauaagaugggugggugguagauggaugggugggugaguggauggauggauggaugguaggaugaguggacaggaagaaggucgaaggcucaggauguuuggcucuggcaggaaggagcugggacuuucucugcuguugggaacauagaauguagaugccucugagugggagcaaguguggggcgagaaggaaggaaaacaggggccuggcucuucucagcugccuuccaggccagagguaguggugugugcaggaagagcuggggcagaggugggagucuuuugaugcucuuggucuccaagaagcagagucaggccucgucccagaggaagagcaagaguggaaacaugaacagucagagcaugagucccaugcugccagcucugucaucacugggcccagugaugagaaugucagacuagagcugugccucucgacuuacuuccugagggcgccacuuccuaggaaaccugcuauugaaaaugucugaagggugguguccugcugaaaagcuugcucagucuguccagucuucagacuggaggccuuagccuuccaaagucuacuacaaaggugacuucagacaaguguguggcuuccagaaggccauacagacaggugggcacaugagugugccguuaggcaauggugaaauugggagauuucaccccauuauugccauguggggacuguccugugugcuguguggcucugcccaugcucuuccacucuauagcgauagcccuucccacugaagcaucuagaaaaagacagcagcuauggaguuuaugaggacuggccaguccgacacaugagggccugggguugcugagagagccucgagcuuggcagggaguguucaggagaacugaggggcgaccuacacgcuuugaugaggguguccuugaaccuccuaacuggaugcuguugccccagauggggagcuagacucuauacugugugacugcaugagugguguagcucauauagaccuucagccugaggcgcagaccucaguccccucauguuuugggggucugagcagauguagggucucauauccaggguucugacugucuuccucuaucaguccugugggccagacuucucaugcaagaggguucuguccuggcaggaucacaagcuaaguuccuacugcaccucugggugacuuugacugaauuuaaaguggccucugacugaguucuucaaccucaccaccccugguccccauggcccugcuauugcucuacugugcuugccaagagccuucagagacaugcagaguagaaccaguuuccuguuggcucccauggagacagaaagaaacacuguguuugccuuugcacagguauucuccacgucucucugggguggaaugcuggugcccaucggugacaagccauccagcauugcugacaggucagugcggcagacgcuccccaccuccucugggacuuuggguuguuuuuauuuuuacagaggggagcaguauucacaucgcucuggauuuucauguggaaucagauuuugaaguauccaguacucauacuucauugcuuuuuuuuuuuuaagauuuauuuauuuuaugugaguacaugucgcuguguucagacauaccagaagagggcaucagaucucauuacagaugguugugagccaccaugugguugcugggaauugaacucaagaccucuggaagggcaaucggugcucuuaaccagugagcaaucaaucucuccagccccacuauguugccuuuuguugugaaacuuuauuauauuaaauuuuccucaggcgggcaugguagugcaggccucuaaucccagcaccugggaagcagagcaagggcugacagagaaacccugccucgaaaaauaaagaaaaaaauuuuccucuuuucuuuuuuuucuuuuaguuaucaugagagaauuugguuaguacuuguagaauugaaaauaaaggcacguuuaagaaaguaggaugcuuaguccuccuuggugauaagccugccucaccccgaucugcuuccuuuugaucaguuaggaguguguuuguguacagagagugaacugugucuuauaugcuguguugugguuuuuuguuuuuguuuucuuguuuuguuuuuucuuuugagacaggguuucucuguguagcccuggcuguccuggaacucacucugcagaccaggcuggccucgaacucagaaaucugccugccucugccucccgagugcugggauuaaaggcgugcaccaccacuacgcauuauggaucuucaccuaaugacaugacaccugucucuuugcugcagguuuuaccugggaggccccacgaguguccgaggauuuagcaugcacagcauuggaccccagagugaaggucagugagcuuagacuuggaggcauucgguacuuuccuccucuguaggcugucauuuguaggguccgaggugaugggaauagcagcuugcaacagugcgagcaguagcacuuccauucaguguguguaaggauagauccauuuccagcagcucugccagcuccugcacuucgugggcaaccuuugcucaaaacccagcaauccaaguagcccugugcccucagauguaucccuuucucugaagacucugcauucuuugcuccagaaauaucugcagguuugcuggauaauuugucucaccagguagaaacaauguagcucagugacugugaauaagacuuuuucuugauauuuguuuuguugcuuauuuuaaacagacaguagcucuaucuacgauugcaauaauccaaguucagaaguuauccugaaaacaucuacuuuucuuuaguacaauucaaauuuuauuguugaguaauauuuuccuucacuuuuuaguauuugcauuuuuuugucaagauaauauaaaagcuucuuuuuuuuguuguuuuuuuuuuuuuuuuuuuucaagacacgguuucucuguguagcccuggcuguccuggaacucacucuguagaucaggcuggccucgaacucagaaauccaccuaauccaccugccucugccucucugccucucgaaugcugggauuaaaggcaugcgccaccaccgcccggcucuuuuuuuuuuuuacuuacucacuucacauccugcuugcugccccccccccccagucaccuccucuuacaauccuuccccuaucuccccuccccaucuccucugaguggaugagugccccaccggaucucucccacccuggcacuuuaagucucuucgaggcuaggcaaauucucucucacugaggccagacaagacaacccagcuagaagaacauaucucacagacaggcaacagcucuugggauagcccuuccuccaguuguucgggacccacaugaagaccaagcugcacaucugcuacauguguguggggaggccuagguccugcccuuguaugcucugugguuggugguuuaguuucugagagccccauggguccggguuagucgacuguuguucucccguggaguucucuucugggccaggaacauuugcuuuuacaugcaugcacuuugauuucaaaucaggcaugccuaguaagacuucagcacucaaagaguuaaaaaaacaaacaugaaaagcagcagcugcagcuuugcuacucaguugcacucgguaggaaguguuaaugguagaaauagauuaaacuuggucuuguuuuguuuuagaugcaaaaugacaagugaggggcuggagagacagcucagcgguuaagagcacugacuguuccagaugacccgggugucuagcacccaccuggcagcucacaaccaucaguagcuccaguucuggggucugauugccuuucucuggucucugcaggcaggcacugcacucauguggugcacagagacauacaugcugacaaguauauguuugguuuugguuuuauuuuuguuuuauauuuuagcucuggcuguccuggagcucaguauguagaccaggcuggccucaaacucauaguuagccuuccucugcuucccgagugcugggaugaaagguguaggccuccauggccuggcugucauauacauuuuuuuuuuuuuuuggccuuaagccuagcuuuagcaggauucaucucuccagcucucauacacauuuccaaagugacacgugacaacuaugugcauuuggaauacauugguagauugauggcagcucagcuggcuuccccuggguuccacaaggccucacagcccucuaguacugcccacauucacacaugcuaugcuguuuaacagucucccagaaacccuugcuucucuauuuucuuacaucccuuccccacuggcgaccaacauaggauuaagagaacugaagcuuuccugccaugucagcaggagccccaggggcaaggaacauggggcagcucagaagagcaccaaaguagcaacagaaagggcggaggagcaaggccgaggcaccugaugaggagcacuaccgaggcucuggcuucagggccugcagaggccagauacuuccuuccugaguuugaguagcugcaggcugcagggcucagauaagaaagucaccccagcacuuuuccucuccugggucacucgagccagugacugacuccaaaggaacuuuucuccaggccuggucuucaccauugaaaccagggguuugggggaaagccugggcuccggcagccccagcaggcuaggcucagacaccaucuccaugguggucacggaggcucaguguggccacuggaggaggaggagcaggucgcuccuucccuccuggcccugcagacagugcaggcagcagccucauuccuuugggguaccccggcuccucagcugcaucauggaaggauccuguaaaggagagaggcuggccuugcccucgcaguuuguggagcagaacuggaagcaggagccuuaagggcugagucagcagguucuguucccuuccuuaggagauuaccugggcggcgaggccuacugggcugggggccugcaccucuacaccccacugcccuuccggccaggccaggguggcuucggagagcuuuucagaacucacuuuuuccucaaugcgggcaaccugugcaaccucaacuauggugagucagccccggccacgcauccuuccgauucagaacggugccaucccuuacaaugccguuauguaaaggggaggcugcggcuuacucuagaaacaagcuucaagugcuuccggggcccagagcucagcacagcucuguccagaggaugcucacagggcacugagcaguugggagcccugggcccucucugagguguggcaugggccccgcugcucugcuagaagagccuuucuaggccaaggggcaggguagccaggcccagagagucgaaaccuucagcuggcuguggaagagucgggugcccaugaugccagccccauaccugucuccaccagcuagauccagcuguaaggggcccugucagggagggccacaccucugcucaccaccuucacuguuucaggugagggccccaaagcccauauccggaagcuagcugagugcauccgcugguccuauggagcaggcgucguccuccgacuuggcaacaucgcucggcuggagcugaacuacugcauuccuaugggcgugcaggggggcgacaggugugugggccacugucagcucugcagcucaucggagcuucuguugcaagugguuccgagauggccacuucaguauaggucugaacuuaaagagagaauggagucaacuaaagaaugagagcaugcgguccgcugcugagcugcucuuaguuggagggggaagggaagacccaccccuucccuggagcacugcugcucugccucaggggcuagccaggggaaguguugacccugcuugcuggauguguaaagcaggagagagcuucccugugccaacccuggccuggggcugcccacagcuuugcucugggcuggaggacuccacccauggacauggagccaugucuguguuccuuggguggguuagaccaagggccauucaggguuauagagagagccuuacauuaccuuguaggcauugucuggaggcccagagggauuguuaugagcagggagcuuuaguaacaaagcucggaaagucagagguccagacaugauggugggaggcaguugcuaggacacuguaccuggcuuccaugggacgggccaccugcugacaggcaggcagccucacggggagccaaugcaagcaccuggccucucaugggccccucucuugugccuuuaucccagacagaucaauucccacgggccacaaggccagaugccaccuugccuugugguagggccuggaauagguuacauagcuacucuggcucuguuuuccugugcagagacuagaaggcuuugacagacagcucugagcuuucaggggaaauguugcauguccgagcggcccucccgcucugcuuuuguguggucugacuauggugucugucacucccauacugcuguguuguacuggcccacuguucuugucucucagugucuucuguccaccacgccugcugccuacagucugaccugccacaguugcugauugcacagugcagugaggagaggagggcugggcccuggugcgcagcaggugccuucucagccuggguuagcucugugcagccuaccauguagguggagcugaagcggagcuguggccagcugccuucacauacuguguuggggccaggucacagggguguggugggcuccagugccaaccacagcugcagcagcucucugagcagcucaccucuuguggcccaugcugcuguaauacugacagcagccacaggguggcagugugcaccaagcaguuccuucgcucuugagcuucuugcuaauuggcccuuuagcgaguguucuuuacagcucaggaccccucagcugcaaugaguuaaauccaagaagcauguuucaaagauaaauugagaacauacccuucaggaagaagaagucugcugugcugaaguggggaagacccuggcccggguuugccuggcagcuguuugccauugugaugguggcaggcagguguuggcuguggguagugaaggcuguccagggucagccuugaacauagagauaccuucccuagugugguuugccuugcagcuuuguuggcaagaguggaauuugaaaacauuugagggaaaugaccucaauuuuaucauguuucuaaaauuaggcaguuggcagguggacaguugucuguagccccacccccagaguuaagccaggugcucugaaacuggcaauuguggccuuugcaaagggugacaguuugaaguguucugacuuguguccugaaugauuucuggcacagucuucucugggaccugaguucugucacagcgugacuccucagaccaggucccuggagacucagcagugagucagccccgcuccagcuguuccuugagcuucaggagggacaggacaccaucauugcagcuggggagggcauccuguauguggguacagcuguccugggggagggguauaguauggguggacagagaaugugggguugcugaagccuuaagggaauggcuucucacaagugcgccucuuucuauucuccucccccucccccucccuucagccuuguuaaugucuuccucucugugccugucaagggcucuauuuggggcccacgagugcuguuugcccacaccuagcacaccauccaggguggaguguuuggggguuaagagaggguaucaguggacuucucggaugaccccugcuaggccugguauaagggugagcacuggcaccaugcagcaggaaggcagccuacaccuggccuagagguagaggcugaggaggccaacggggucugcagagcacugauggguccuggcccuguaacucuggaugccaccucgaauacucaugggcauugcucuguggugugugucauagcacaggcaucuuugacuugcuuaucucaaagcuuacuucucugaggcagccguggucccucuuauguaggccggggcugagggcacaggugcacugugcagcuuggcuugggucuucagccuccagagauucagcuucccuccaagcaggaggcuccuccccagggcagagugacugcuuccauuuaccugugccuugacauuccaguauggcacagcacucagaacuggguguuuggugccugcagccaguccugagaaggcccacacaggacaugguugagcuaagcucuccagagagcacaccugaggugacccuuuauguaugucauccugggucaagaaaagggcuggcugguggcuggccucucugaggcuggguugcuuggucauugugaggcccaggcucuacuugcuguccugacaacaggacagugcaccuuugggugggauggagcaacagagggucuugggcucuauuccugucuuuucuccuuucuccaggggcuaauuccuauuagccuagggaacugggggggggggggcaggggcaggguaggggugcguacagagccucucgaugguguaaggagcguccuguugaccucucucuuucuuuuuaggauuugugaugguguccaguuuggagcugggauucgguuccuguaacuugagucccaggggcagcuuggaugagaaacaggcaucucccaggcuccaagccuauuuggaggugacacgguugagugcuucugggccggaauccuuaugggaaaucacgucaauaaauuuuaaacgcucagcgguguccuggauguggucuguuuuucaggccaugcgucuuuauggacacaugcuuuuccugaggacaugugacagucugaccugugcuguccugggccuaagggcuuucaggugacuucucagagccuuuuccuuguagacuccuagagucuacuguugggaccccacuuaccagaaguagggcugagcugugggguggcccugaaggacacugaccuugucaugucacagguuaccaccucagugcagcaggaccugccagugcugguaugaugcuaggauuccgaggcagacgggaagugcgcugucugcugauagccauggcugcuccugccugucaugcuugugacucaggcugcacagcuaucgucuuacaggaaccugcgauguccagugggccauaggcucaggugcugcugggcaagacugacugcuaaagaccucugugcucucucuucggagcuggcaggccagacuucugccucugcucuuuuaaggacagucuuguaacaugaggucccagauggacccgauagcugcauuucaaggcuagcuggugagcacacccagcucugccugcgcccugcuccuuucuugcuccagcugugugguugugauuccucggucuuuaaaggggggucuguuggaagccacuccuguccccugcuuggaugcugguauccgcagauacgcagggcugucagauaccauguuucaggauugcuuugcaggcaggaggcaaaggucuuacccaggcuggccuugaacucucagggguccucagcuccucaugugcuggggucacccgugugcacaccacaucagagugaugccgggcaugugcacacggcugccucaggccuguguuaccuccagcuuacaguguggaggcuugggccagaggggcgguucauaucugugaucccaacacuaaggaaccugaagcaggaggauuaccuugaguucaaguacaacuugagcuauggaagacuccaucucagaaaacuuacuaaagauguuguacugaauugucucaggauaaaguuaagucuggauguguuuaggauagacacaguuguuguggguuuuacuuuguagccaagggugaccuugauccaauccuccugccuuccccucccaagugcuggcauuccaggcauguaccaccauguuggauuuacacaaugcuggggauggagcccagagcuccgugccugaugggugagcacucaacaacugaggcacaucccuagccacuccugagugcugucccucugccaggcugagagcugggagguggcgccuaaggggauguuagcuagccagcauugggacaugggagucugucuauucugauggaggucucuguaagugguacuuaggggauaauuuucuguuuacuauaagauuuauuuauuuauguauauggguauuuuugccuuguguauauauguauaccacauggguacccugugccuguggaggucagaaagaggguauuggauuccccagaauuggaguuaaaaauuguugugggccacccuguggaugcugggacgugaacccagguccucugccaaagcagccagugugcuuaacuacugaagccccuugggggauauucuuagcuuuaaaaaacugacauaagcugggcaguggaggugauacucaagagacagagcccagccuggucuacagagccaguuccaggacagccagggcuacacacagaaacagaacaaacaaacaaaaaauaauaaauguauuuuagaguuaauccuccucugaagucuuugaaaacaggaugugccugggaccucugcuccauggugucugcugacuccccccacccccauggucucaugcagaccagcuccuguccucccugggaccuuuuguuuacugaauaacuuuggggcuuggggaacagccuacacacacacacacacacacacacacacacacacacacacaccugucccuugcucccuuacuaccuucaauggaaacugguguuugcugagaauaaauuacuccuuucaaugguuggaaaugucagucugcaguuacucauugaugauuggaacccacuaaggaccugguguucagaauggggauugggagcugcagaaacugacacagauuugcagacuccaugaccuuugagaacccagggaaggcacuugugaaagucugguuuuaaucaagacugggcugcccccggugcugccuugggcucauuaaugaaagccgcugucuccagcguggcccgaccuguuugauuuuucaggcuucccuguaggcugcucuugggugaaggagguggggcaagguggaaggucagggugaaggggugaauucugucccuuuccagaggguugugguggacagaccagaaccaguugccugggagucugagaaggcuuuagggagcuuggguagaaagcugaggagggcaggcaacuccugagucggccuuggcccagauucuuugcagcuuaaugcuucauuuccccucagcaugcagaaagaucuaggcagagacagaguuugagauguguuuaauuaaccuuugcuccacucuguaagggagcagucugguagccagccugccuguucuacaaggacaccagauuccuugcuuggagugugcuggcguccugagcaaggcuguuuguccggaaccuuaccuugauacugagggaagagccuguguuguggugguggugcccaucccccaguguaugguccaaagccacucaggagcugccagccuucacucuuagcuuucugucucgagcuugccucauuucugaucuccguggaaagcccuuugaggcucuggucucccaggcuccguccugcaccaucgcaguggucacuggggcauggggguucuuaagugaucccagucuuucaaugcugacaugucacaauuacccagaauaaaaagaugacauuaauaccaucg

SEQ ID NO: 7915 - RNA, 83651 nt, Mus musculus
cggccggcgguggguggcgcgcacucgcuuauguccuccgcgccaccacggucgcccaccccgcgggcccccaagaugaagaaggacgagucuuucuugggcaaguugggcggcacacuggcaaggaagaagaagaccagggagggugagugugccccugcgucccuuuggcgccagccgggugccagcggugucccccguguguccgcucccugcccgccucggcggcgccaaugagcccuccugucgcgcucaggcuacgcgaccuuugggacaggccggucccuguccguaagacauuugcagugcuggcccagugcauaggacgugcguucugcucuggacacaggccuagcaagcuacuguuccugugcucauccuugucgugugacacucucgucacagugauuggacacaugcugguagagaggaccggcuacuguuugcgugaugccugcaagcauggcuccgucccuaagcugggagucaaugaaagggcacaggacacacaggccaggagccuggggaagccuggaaccagugcaagggcagggggcgggggggaggggcggggggggaggucaugcccccugcgcaggaaaguaauuuuaaaacgacuuuuuacuuucaaaacuuuuaaaaaacaaaacugcaagggauguaacuucuccgccucuggccagagcccuaagguaccgcaguucccuccccuccccucgcagaaacauuccugaauuuucuauuguuuuguccuggaggcucuugcccuugggcugagauuccggcagcucacgaggaaugggaggggcuuucugagaaaggacagguagaaagaagcuucagagacaacacuuccuggggacccccaaguuagggugugcugagggucuccuccagccacuggagccacacugacucccagaaagccugggccuccagggcaagcccugccuaagaggugacugauaaucacccugugggcccaaaggaccggcgugagguauuuacucauaaagggaccuccagguccuaaauuaugggcagacucauucuggccuuucaaggugucuugaaaggcagggcauguggggaaaugcugaacuucuuugauagaaccggugaagacacugugggucccacauucugcccagacuugccuucccaggccuucaaccccagaaugcccuuuaccaaccuagauuguccagggggcaggcaggccuggucuucuuccuaggguuuauugcuaaucaaaugggcucuuccccucucaagucuuccauuccagacccuucagguuggccugcaucuccaucaguauccuaaaugagaccgaaguccuugucucccuuggucacccacuguugucuuugguuucucagugccgacguugccauccugccuagaaaucuauuuucuuuucaggaguuaggacaguggcagaccugaguucuuuccaucaccuguuuuguuuuguuaaauuuuguuuuuguuucuuuguuuuuauuuuuaguuuuuuugagacaggguuucucuguguagcccuggcuguccuggaacucacucuggagaccaggcuggauucaaauucagaaaucggcccgccucugccucccaagugcuaggauuaaaggugugcgccaccaccgcccgacaguuuuuguuuuugagcuggcguuuugcugugucuggacucagcccuggguucaagugauccuccugcuucagucuugccugugucaggaacugcaggugugugccagccuuuuguggcuuaccauaugugugacuaugauguggcguggauacgucaaggccuuggaaagaaggggagaggcucagucuuccagggcccugggaaugggcgccacaguguggaagccuaugggaauccccaugauccuaagcuguagcugucaagagggcccgggaaugggggguggcgauguuggagauaaaaaccuaagaaagaaaaucuuucauagaaaagcaugcuuaagaguaugaaugguuacagcugcuguguguuucauguguguguacacgcguguacaggccagaagucaauggugggugucuuccucggcuucucacuauuaucuaugaacccaucaucuauguaucuaccaucuauguaucuaucaucuauguaucuaugcaucuaucuauguaucuauaaucuauguaucaauguaucugucuacguauguauguauauauguaucuaucuucuuuuuuuuagauuauuuauuuauuuauuuauuuauuuauuuauuccauguaaguacacuguagcugucuucagacacaccagaagagggcgucagaucuuguuacagaugguugugagccaccaugagguugcugggauuugaacucuggaccuucggaagaguagucgggugcucuuacccaccgagccaucucaccagcccuuguaucuaucuucuaucaucugccuaucugucaucuauguauguauguaucuacuaucuaucaucuauguauguaucuaucuacuaucucucucucucucucuucucucucucucucucucucucuagcucaucuuucuaccuaccuaccccggcuggccuggaacgaccaggauggcuuggcacuuaagagaccugccugguguugccuucugugugaugguauuaaaaguguguacuucuacacuggguuccuucuuguuuguuugaggcaaagucacucacugacuggagcucuuugacugcaaucagcaagcccugggguccucugucgucaccuccccugacuugagauuacaggcgagcaacacuuggcuuuugacucuuuuuuuuuuuuuuuuuuuaucaccagugcuggggauggaacucugauccucaugcacgcacuuugccaacugagcugccuucccaagcugccccuguuacagcuuuucucaggugguacuuacacuauuggaccacaagggcggcaccagugagguaaugagcuggccucaguuuccaauuguuagugcuucucugcuuugcuuuuaugagaucuuguaugacccggagauggagggaugggcuggcccaguuuaaaugcaccuggaaccccaagcaacaccuucccucugcuugcugcuucugcugguauugccauccugugaguuggcuuggcccucugccucaguucucaagguuagagagccugucaccccuauaaccagaaagccacaaacccuaauuggucucugaggcagggauggagggaaggcuuagccugggaagggcugaguagcuuccuugugguccucuggggaauggaggggcuaaugugaauacuguguaaugaggucuugaauaauugagcacugagagcugccaguauuucugcagaccuguugccuuggaaacuggcccuccugacugcucuuggccuugacuuugggccauaggagcuuaaguaccgaugccuacuagggaaugaccaguuggagggcaugggguuucccagccugcccguccaaacacuuagcuguguuuccuccuuuguuagaaaguccaggguggacuccggacauuuccugagcugaggacaccggagggggggggggcggggauggcuggugaaauucaagguuuggggaccuaugggcauuugaccccacccugccuugcagaguggcaaagaggggagggaccaacugggacaaaugcuuugucccauuccaggagguggggguaggauguagggugagcuaggauacccagcacaggaagugucuaagaaugaauagggcgugauucagcccagcggagacauuguggugucacgggguggccuggucagaaaagggaagugugacuaacugugcacauuggaaaacggaagggaacgccuacaacacucaggccucccuauggggagucugagcccgggcccugugaggucaggagccagcuuaaaccucuggaggucaggguguguguguguguguguguguguguguguguggacggacuagcuauugaaaucuaccaucuaucuguucuaucaauuguguauguauguaucgucuacguaucuacucuaucaauugucugucuguccauccauccguccauccaucugucuuuccauccauccauccauccauccauccauccauccauccauccauccgucuuuccauccauccauccauccauccauccauccauccauccauccauccaucuauccgcauguacuuuuguuuccuagcaaaauuagcaaaauggagugaagacuggaguuugcccucccuaccuccauucucccaggcacuguggaacuucauuucaguucuaaaccagcuuaagaaguuuuugucuccuauagcagacaguagggcugcucucacgguguauaaugaagggucccugcuccauugccugucuggcucucccauucccaagacccccaaacucuuggauuucauuuauuuauuuauaugagcacacuguagcugucuucagccacacuagaacagggcacgagaucucauugcagaugguucugagccaccauguggugggaauugaacucaggaccucuggaagagcagucagucaguccucuuaacugcugagccaucucuccgcccugguuuuguuuuuuuuugagacaggguuucacuguguagucuuggccauccuggaacucaacucugcagaucaaguuggccucaaacucacagagaucugacugccucugccuccaccucccagaguguugggagccaccccuggcugguaacgcuuggauuuuuuuuuuuuuuuuuuuuuaaauuuuuaacaaucuccacaguuuugccuuuuccuagaaucaugaacuggaauccuagugcuugaugugaggcuuuucauacuggccuccuucacucacugcccagcuaagucuccucccugugucugugggccacugcgccuggcucaugcagugcugagaguccaauccugcaccuaguguaugcuaggugaacacucuacccacggagcuauauccccagccccgaacccugaacuucugaaauuuacucagugcugugaaagaagaaaauauaaugcaaccaacuugucagauguccggggggaggggaagggggaggggggguacuuguaggaaagggggaggggaagcuaguguccccugaggagaagaguugcuccuagaucugagggcaucaggaaacagguggcagacagcuggcuguguacaggggaccucaggagccaaccuggcucaggccuccuacucgggacagcuccuagaagccagaccugccugccacaguggcucgagcccuccugcaccagucaucaacccagaccucucacagacaggucaaucugaucaaggcaguuaguucuucaauuaacgcucucucugcccgggugugccaaggucgacaaugaaaccuaaccaggacaugacuuugguugagaauaaaagacggcuguaauuaggcagaggaaggggagaguguccagagaagacccuuuaagaaggcccguuaggggaugugcaagggggugccuugugucugggcugugguuuagcguguggggccacagucagccacagagggagaucccugggggguacagcaagaaugaccuauuugggugacacucauuagaggccucgaaggccacaguuuugaggccaacugauguggauggaggagaagucugauucaccgcuguagccucagugugugugggggggagggagcagguggaugucagcaggugaggaaugggggggcauaugcgcugugguuucuagaauguucugguggaaaggggaacagggagcugcaaggcucuagagaccuaggcaacauagagaaagaaccugcuccacagagccuuucuccaaaccuagaccuggguacuggggauggagucagggcugggucaugcuaagcccuugcaguaccacagagcugagccccaacccuuuucuucccugaugaucauuaaggaggccaucuugcugggaagcaggaggcagcuccugcuucaugaaggaagguccaguuagguggaccaggcucucaugccugugcccucaggcacgccugcuaucccuuugcugagcugaaguccccaauacacagccagugcuaucugucacuuguuuuccugaugcugucagauccaggagcacugcugccccugguguuugggcaucuccugagaggacacgagggggauuuguaugggggcuguguguguggcuucaucaauuuucucgucguuacuuuucugaccauaacaucaaacccagggauugcuucaaguguccuguugaguucugugguccccggggaacaucuggaucgguagugggugcuuuucuuggccgccucuuaagacuucaaaaaaccaggcuucagcuaaaaaaaauaaaauaaaaggugccucuuggcccugagaaguucgccucuuuccaucucuaccucucagaccuaggccuuuucuucuauucuaacaccacgauucugcugccuacuggucccggguuuccccagaaagucaaucagccaucacauccagugauccuuaggagcaccgugcuuugaauucccaucucaccucucuggaauuaguguuuacugaacacuccgaagcugcucacccgguugcucucaugcaguccucagaauaauuaacggguguuuagacaguguaauggucccgcaccugcugagcgcugguucuaaugugcuccuuugaucgauuccacccugccgugccuggccgaggucaacuccaugcaccuagcuauuuucuucuuggcaaauaugagauucaucacaggaaaaagaaaaaaaaaaaaaaacccgcacucgaagaaaacgcguuuuucuucucuuugcauuggcugcguguuucacuuuuuaggaaagcgagugccuaaugagugcguuugggcuggaaaacaucccaguuguaugaaguggaauauaaacucagcuuggcuuaaugguguuaaucuugucuaugcaaauggcuguugggguaagagagugcagacgugagcaauccauugcuggcaucugcgucauuaauucuuaguaacacauccucaaaagaggggcuucugguuagaaguaaauacagacugaguuugcaucucgagcacguagcaucagccacgugcccagaccaagcccagaccaagcccagaccaagcccagaccaagcacgacugugacguggggacccacacuccaugcuaugggaucuuaucauucuucauucuuaccgggugggggcggggcggcgcggggcggcgaggccgguggagguaaaugaaaacuguuggcaaagguagaauuacugcccugcugaguugguucuaguugguuuguagaggugcagcuguuggaccuccaggauagcacuguggggggcggagggggggagguacacaguuuacagccuggcugcagagaucugugacuucaucucuaggagauucugugucugccauccugaacacaguagccucuuccuuaggauuugaggaaggagccaccaagccuugucagcaugggauggcggcugagagguguuaauuacugauggauacugauaaguggugcuuugguuuggugguggagcaaggggucaaguggacuuccgcuugggagcaaacuuggcucgauaaaagaauucugagggugugucagagccuaugagaaaagaaugcugggaacccagggucucccuaccugugugaguggccuugcuggaacagaaaccuuccugggcucagaucaacucaguaacccuggcagcgcuguccuucagagcuccaccgggcugcagggggcuggaugcugaguugcuaaaaucuuugccucaaggagugccgggacccuuacucuauucuagucacauuucuguugcucugggaaacaccguggcaaauacaacagaaggacccauucuaggucacaauugaguuacagcccucacuguugggagucaaggcggggucuugaagcagcuaagggcagagacgcaacaccagcaggcuugguguuuuagucaggguuucuauuccuggacaaaacaucaugaccaagaagcaaguuggggaggaaaggguuuauucagcuuacauuuccacacugcuguucaucacuaagggaagucaggacuggaacucaagcaggucagaaagcaggagcugaugcagaggccauggagggaugugacuuacuggcuugcucagcuuggcucuuauagaaccaagacuaccagcccagagauggcaccacccacaaggggaccucccaccuugauuacuaguugagaaaaugccuuacaguuggaucucauggaggcauuuccccaacugaagcuccuuucucuguugauaacuccagccugugucaaguugacacaaaacuagccaguacacuuggucuucagcuuucucuuguuaauggcuccaaccagggagugaugguauugcccacuuacaggccgggucuucccacaucaauuaaggccaccaagacaaucccuuacagcagugguucucaacccuuuauuacaguuccucaugcuguggugcccuccaauuauaaaauuauuuucguugcuacuucauaacuguaauuuugcuacuguuaugagccaugaugucaaugucuguguuuucccaguggucuuagaggaccgacuccuguggaagggguugagcaacccacagguugagagccgcuguuccaugggacuagcgugauggcucagugguuaagagcaucagcugcucucaaagaggacuggguucucagcguccucgucugcagcaucuaaccaccaguaacaccaguuccagggguucugacgcccucuucugauauccaugggcaccaacacacuuauaaacaugcaguaucccuugcaccccccccccccccagacaguccccuacagacacacccacaggccaaugucgucuagagaaucccucacugauacucuaaccaggcaauuuagagugugucauacugacaaugaauacuaaacauaugacccccgggcacucugacccguaagcacucucuucuuggaagcccuugcucagugccuuugaugugugccgcaagcagcagauacccaaacccugugcuggguaccacaacuucuggcuggugccaggaaagcuggaggcauuugcuccagccuggcucuccacuggggucagcccagccagagggucagggagccuuagcagacucgggguuauuuccugggcuuguguguugguuguggaacccagggguccucaggcuuagcucuucugaaauaccgaccuccgcuuggcuuguuauuugaacucuuccuuguuggccggcuagcacauauccuucauauggguuuccccaggcagugcccccuugggaguuaauucuuuuuaaaaagugucgcucuuuaggaaaaguuaggucuuuuuacacuucuuguuuaaaaacguacaaaucccaagaaucuaggcuuuaaugccaaguuaucgaaaaguuaaagaggccacaaagacuuuuuuauaucuccuagggcuuguguguaucacgugcuuaagucuagaggcuucugcaagcagcugucugguucagcgacccagagcugccugcucgguugccuaggcucagguuacuacagggagcuggaaccccccaggccuaagcucuaaauauacggauggaguggccuccagcucagcccaugugguguggguuaacuguuuuaguaucaaugggauuucagggacaucuugcccaaagcuuaauuuguacuucuucuucuuccuccuccuccuccuccucccccucgacccuccucccucuccucccucuccuccuccuuuucaacauuguccuucaaagugaggauuauagguguccauauuugaagugugagugugugugucuguguauuuguguauguauguauguauguauguauguauguauguauguguuuuaguuucauuucugucacugugauauaaauaccauaaccagaaacaauuaaaacaauucaaagguuuauuuauuuauuuauuuauuuauuuauuuugguuuuucgagacaggguuucucuguguagcccuggcuguccuggaacucacucuguagaccaggcuggccucgaacucagaaaucugccugccucugccucccaagugcugggauuaaaggccugcaccaccaccgccuggcuucaaagguuuauuugacuuauaauucuagaaaguuuccuaauuguguggcagccaggauaacuggccacaucacgucacaucacaucacaucacaucacaucacaucacaucacaucacaucacaucacaucacaucacauccacagucaagcgcagagagagaacaaaugcaugcgcacuuagcguucagcucaauuuuuuuauucucauacagugcagggcccaauucuagggcaugguaccacucacaguggacugugucuccuuacaucggccauuacaaaccaccgccacaaugugcauguauauaagcuuguguauuuaugcuuauauguauaaauguaugcauguguguuuguguacucauuuuuuuuauuuuuuuacuaauucauuuauuuauggagacagaguuuuucuccguagccuugacuguccuggaacucacucuguagaccaggcuggccccagcucacagauccaccugacuaugucucucgagugcugggaucaaaggcgugugcuaccaccacccggcuuuauucuugauagaagaaccuaaagcaggagagaaacaacacaugaauucaaaagcaaagcaagcugaaacagaagccacgugugcagugggcagucacagugacagggccacugagacucugggucccuugacauucaugguccaugcucaccuugugcauggugccuugaguuauucuacaugucuggaaagugauacugugcagugauuccugucuugugggagagcagaggcugggugaggugaaggucucucaucucuccucagcauggcuagcugggaauguaccuucucuuuuacuugcuccagcccucuauuugggugacacuuagccccagagucagaaagaugcuauggaggagacugacugcuugacuguauuuuuuucuccuaaaaagauuuauuuauuuauuauguauauauauauaucuuucugucugcauguaugccuacaagucagaagagggcaucagaucucacuacagaugauugugaaccaucagguaguugcugggaauugaacucaggaccucuggaagaacagacagugcucuuaaccucugagcuauaucaccagcccgauugacugcauucugugcugagugauguggaggacuggacccuggugguuucauucugcuacgggcugcugcccgagagggccugguuugguccugcaggccccacagucuuccuggucucagagcccugacuguccugcccucucuccagagcuuucugucuugucauuuuuuuuuaaguuucauuuuuuuuuuaaagauuuauuuauuuuauguauaugaguacacagacacaccagaagaggguauaggaucccauuacagaugguugugagccaccaugugguugcugggaauugaacucaggaccucugguagagcagucagugcucuuaaccacugagcuaucucuccagccccugucuugucauuuuuaugucacaccuucuguaacaugggacacuaugauagcauccugacaaugucugccuucaugagggguuggcuugagaccuauguucccacuaggugaggucaucugugucacuaggaggccaugaugggacguacucauccauuuccaucauuuguacucaucaagcccaauccuggguucugagaaaucucaggagguggccaagaaaagcacccaccagaugcuccccggggaccacagaacucaccaggacacuugaagaaaccccuggguuugauguuacggucaaaaaaauaaugaugagaaaauugaugaagccacacacacagcccccauacaaauccccucguguccucucgggagaugcccaaacaccaggggcagcagugcuccuggaccugacagcaucaggaaaacaggugacagauagcacuggcuguguacuggggacuucagcucagcaaagggauggccagagugccugagggcacaggcgugagagccugguccaccuaacuggaccuuccuucaugaagcaggagcugccuccugcuucccagcaaaauggcuuccuuaaugaucaucagggaagaaaaggguuggggcucagcucugugguacugcaagggcuuagcaugacccagcccugacuccauccccgguacccaggucuagguuuggagaaaggcucuguggagcagguugucuuuguuggcuaggucucuagagcagguccacaagaagguucuuguuggaggagagugagagguggcaagcagagagggggcuauggagggugccaggagcugaaaugaggaagccagaagccagaguaccuaguggugucccaugccuguuccauccccuaucucaaccucccccugcucccagcccggaaagcuucagcucuguagacaaguaguguuuagucuucugacauccaaaacuccagguuuuuguuuuuuguuuguuuguuuguuuguuuguuuauuauuauaugucaguacacuguagcuguccuuagacacaccagaagagggcgucagaucuuauuauggauguuugugagccaccaugugguugcugggauuugaacucaggaccucagaagagcagucagugcucaacugcugagccaucucaccagccccagaacuccagguuugcaggucugugugguuuuaagucugaucauuucucaaccuagucacuggacaccagugacugcugacaggcugaugggugaauccagagccgggagcuggggaauaugucaaccguggccuacugcagagggcgagggagucuucuguguuccuacaggcuguggauuuuaacauaaggcuuugcagggaggggagaaugucacaugagucacccaggugccaacaucuuuguguuagcauuucacccucagucaguccagugccaccccuccccauccaacagagaagaggugccaggagagaggaaaggcugagcggcaguccuuggagggaagccauaaagauacaaugggaccacccggcauggcgcuuuuggguggcugcuuuccugugggaaggcuugagugugagggcugaggacagagagcaggagcugggugcccagggcucaucucucucugcuuucuccuucccgggauaaccgucuccaggcaugugcgcgcuuccacagagacaaggggaagaugugucucucuuggggacaugaggacguccuucaacuuccuguguggcuguuugaaagcccuuugccagugggggagagaguguuguccugaaauguaugcaagagacuuguuauuaguauaaugagauuuuaaugauucgagauuuuguuggagcagcacacauggaauucuaaucuuguuguaggcagcugcugguguuuuuguuuuauuuguuugcuugggccucauugugaggaugcguuucuacaauuauuauuuaguuaugcucucacagagaucugcuuuuaugcugcucuuaauguucauguugagagagucuuggggaugggaggagaauauauacuuaaaauuguguauauauauuauaaauguauuuauguuauauauaaaacauauauaaaauuacauauagucuuuuuaaagcugggggcugguuugacagaacugagaugugaggguuucaauuucuguuccuuauucguaauugccacagaguagaaacaaccccagggccauuaacugaucguggggaaauaaaaugugguauaaucacaaaaugaaauagucuguagcagugaaaagggagggcuacagcauggaugaaccuggaagaugcuaagaaucuguucacaaaaggaugaacauugugugauggaaaaaaaauccagaguagucaaauucaugggucccaaagguggacaaguggucgcuagaggcuggggguuggagagugagugcucgcucguagauacuuuugggggugagguggauguuuuuaaguugaaggugguaaugguuaugcacucugaauauucugaaagucacugacuugggucuucaaauaggggaauuauacagaguggugugaauccugucacuguugagcaauuaaaaugcagaacaaagacgcggaguucuggcuugcuagcaucuuucuucagcugugugugugugugugugugugugugucugugugugugugugugugcacauaggcacauguguacagaggucagaggugucuuucagguguuguacacuguguguguguguguguguguuuguuuguuuguuuguuuguuuugagacacggacagucccucuggaauccacugauuguacuaggcaagcccuauggauccuguugucuccaccccaccucaccccaucccccagcugguggguguuuuacacuagccagaggcuagccuugaugcugagaguggaugauaauauucacuuagcguguggcuuuaagcagacgugauguucucucuggggucucaggacagagaaaccccagacaugaccugcuucuucaacucugugcugguggucagaaacuguagguucagcacuccaucaaauauagacaguggcugucacccuccuucccugggggcucuagagcuuaugcuggagcacagcagagcuugccuucgaggcaaacaccagaccccgagcugcauccccacccagggaccuagcuuuuuucuuuuuuucucuuuucuuuuccaaaaaaugauaaaucucaaacaaacaaaaaaaucuuuuccaaucauauauuuaucuaggucugucugcggagccccgccaagugcagagguacguacguaccuuaaucccaguauucagaaggcagcaagcugggucuggaagcuucccucaggccaggggaggguggggacugugccccagcugcaguggguacaggucuugcucauuagacagauaggagucacggagaauauggaauuagccucaggagaggcugaccagagagggagacagaggcacuuucuucacuggacaggguauccaauucucugaggaaugagcuagaagggccugucucuucguggguagaacgaggcagcauggccuuccuggguggccauucuaucucucuuguuccucuggacauuuaauuuuuuauguguauggguguuuugucugucuguaugucugugugcugugugcuguguauguguguguugugugugcaguaccuguggaggccauaagagggcacuagauccucagagaccgaagucacaaacaguugugagcugccauaugggugcuaggauuuuaacucagguccuagggaagagcagccauugcucuuagccauggagccaucucuccagccacugcugugggauuuuuuuggggugggguggggaggcaauggagccuuucuugguuuuggugcccucaacccagagagcuagauaguagacauucaccaaagaugcuccaagccagugguguccugguuugccugauccucaaaaaacaacucuccaggguuaaagagugaucagcgaucagagugagauuuauuaaaguuagaaguuccaggaguaggaggggccuuagggaggacugcugagggacugccggaccauggcuuuuaaagguuugccgcagggauuggacuguggauugacugucuucaggucuuuauugagauuagucaauuuggagcacaucacaggcugagugagugaggaguccauguguccugugcaugcucucugagaccaaccggaguggugcccccauuggggauggggucacaugcauuaugugacuaacucaugaccucccaugggcccuuggccuucacuuccuauaggaugcuaacuccuaucugaauaugaguccggcuauuugaaauuuucagagaaccaaugacauauuuaaggggucuugggaaucuuaagcaugccuacccucacuucccccucuucucccuccucuccacuacugccugcuguggagcccagcugccagucuaggccucugguccaaguucuuugcugccuucuucagccugaaaugaaucucauuuuacagauagggaaacugaggccuugagagaggcaagaagcccagucucucguugcgugaucucacagagucuuguccccaauggagacuucugugaggggucggcggugacagugaaggacaagcaacugugaccucaggcagcaugggcacucagucugagcccaaguuuagccucugucugauaaauugacacuuuggaggggauggcugagaacuggaugggggcugucacacaggccagccaagcaccaggacacugagcugugugcccauuccauggguucuacuuuuuuuuuuuuaauauuuauuuauuuauuauauguaaguacacuguagcugucuucagacacuccagaagagagcaucagauuuuguuacggaugguugugagccaccaugugguugcugggauuugaacucaggaccuuuggaagagcaguuggcgcucuuaaccacugagccaucucaccaggccggguucuacuuuuuagcaggcguauuuacccacugcaugaugguggugagggccacacagggugagcgugugcugagguugaugggagagauuggauucuucuagcaguaaagagcccucugaggccgugucccugaacggucaacccuguuugcugguuauuauuuuccuuguguuggagugaucuaauuuuaaaaacuguuucagagcaccuucuagggagcccaaggggcccacaacagcccuaggaaaggaacuggaaaucaaacccaaaguggcuccuugaaucugugaguggagacagguggcugccugggagguggcucaucaggggcuuagccaugcacaacgaagaaggaugaguguuguuguuguuguuguuguuguuguuguuguuguuuuuccuacacuagagaucaugcaccaggcucucgugcaaguuagggagcauccgcaccauugagcuggcugccuccuguacuuuauuuugagauaggaucucaccucauucgagguaguccgggcuguccuugaacgccccuguccucuuccucagccuccuguaugaugggaucgcaggggugugcacaccuccugagcugagggggcgugggcagaagaguuaggaaguuugccuuuccaucuguuccaccaagaaccaccccauuggaccuuugggguucuauuucgugugugcuuuggcuucuaguuuacacacaaggccccaggaaccugccagcuucuggacucccugauucuccauguguguaguuaucagugugaggacagucgaucucacuggauuugccucugggcagggugggacuaaucaagagguggucucaaggccgugccuucuuaaguuuauguugcuguagauauuggccugucuuuuuuuuagcucagcuucuuccuucuuuagucuuuaucuacagcuggggucuucuguaaaagaugcaaucuucaaaaugcaugcuggcucuuuugcugccacugaacugugcuguggcaaccauagaugguguggaaacugaggagucuggcuuuguuucaauaaagcuuuauugacaaacaccagcugagggccagcugcccugaagcaucaucggcugagucuuggucugagccauaguuuugaugccauagaucagaggcucuaguuaguccccucuccuuuucagugugugugugguuccaucugucugucucuccgucugucugucuguguuucucugugugagccuguguguguaucucucucucucuuuccuucucucucugugugcauguguguguguguuuaauacuccuaccuguguguggccagagaucaauugcaaucuucuuccucuacugcuuuccacaguauuaauuaauuaauuaauuaauuaauuuuuaaacgaauguguguauugccugcauguauaucuuugcaacacacgugugccccggugcuuauggaugucagaaaaaaagccucugacccccuggggcugaaguuacaggugcugggagucaaaccuggcuccuuuggaagaacaguuagugcucucaacucauggucaucuccccagcccuccaccuuauuuuuugagacagucuuucacugaaucugggccuggguguuuaggcugggcuagucgaccacugaaaacccaagaucuucccgucuccuccccuagcaaugaaggaguguugugugagccagcaccggcuuucaugcgguuacuggagaucugaacucaggucuaugagcuugacagcaagccuuuuaucaacugagcauccucccagaguguggguacuuuuuguggauugucuucaguaauuccaaggcuucugugugaguccccugccugcugcaagcaugguacgcaugauccuugguuagaaguucaaaccaugcagggcauggcaugcaagcaugaggaccugaguucgaaucuccagcacccagguaaaagccagguaccacuguggcauguaauccucugacccacuucccagccaccucuauccugcucaccuaguuuuuaaaaauaaguuccgacagcucuaucccucacacuguucuccgaggccucacguauuccagccugcuggcucagugaucuagguggggcucagucucauuccaccucccucgcccuuggugcaucuuuauuuguugugucuggagacagccuuaccauguagcccaggcuggccuugaacucacaacccucuagcuuccgccucugagugcuagggucagaggcuuucccuccaacauuaucucuuuucauuucuuugcugccugucucagcacagcagcaaugccugguuucggagugugugguucuauuaugagaaaauuaaacacauuuaagagcaaauuaaauuagaggauucaugaucauuagcuaaguaaauuauuuauuuuuuuaaguaaugagccaggcaggguacagcgugccguggcaugcucaauaaguauuuguuggugggagcgaucguagcaugagccuaucaaguugcacuggagggaauuauuucccucugaaacuaaugggauagcugaggggcaguaacggcuacuaaaaauaccccguguguuuauaaagccuccaaagacagagcgcuccaugcuggaucuuggccaagggagaagucuggggacagcuggcacacugagcccgugucaucgaaguggcuuugugaccuugguuggggcuguccuugcggcccuugagcauuugucaguauuaugagcagacuuagccccgcaacggcucucccuuggccacgcagggacagagcugguggcuaaaacuggugcucuggaaggaggagguaguuaaaacugugugauaauucauauauggggcagagccauucagaaucaagaccugucugguagaggagggagguccggggccagagagccugggguuggggcuugcgaucccuaagaccauaaguuuagguucuagggagucacagugcagucagauguguggugugagguaggacccagaauggugacccuucuguccagucucccuauugcccccuugccuaggauaggggucauucuuggcuauauagugagguuaaggccacuaucuuucagcuaacuggaaucuugaaaauaauaaguuuagucaaucccagugaagggaacugaggcccgagggucaccacaagucaaagccagccugcgcuacacagugagugcugaggccgucugaucuacacagugagaaauccaacagcaaccacaaaaccagccugggggguugcacauaccuauaauucuagcucucgggagggaggcagagacaggagaauuagagaaaguacaaagucagccugucuacguagugauuuccaagucagucuggacugggcagcgagacuuugucuaaaaaacccacugauguauaggcuggagagcaggcucagagguuuuaagaggaccuggguucaguuuccagcacccaugucagauggcucacagccuccuuugcuucuaguucuagagggaucaagggcucugguuucugcagguacugauacucaugaguacacaccccucucccacauccacauaauuaaaaauaaaacaggucuuuaaaacaguguuucacaaccuguggaguugagacucccuugacaaacuucuucccccccucccccaauauuuacauugcaauccauaacaguagcaaaaaauaaaaaaaucacaguuuugagguagcaaugaauauaauuuuauaguugggggucaccucgagacaccacgaggaacuguauuaaagggucgcggcauuaggaaggucgagaaacaccucuuaaaaaaauccacaagaaaaauaacaauaauuagaaaaauaacaagacauuauuagcucugcauuagcacccagcacugcuaucuggcuugaagaguggggcucgcuccauucccccuucugcggugaccacagcccagcuauccagggagaauucuuccugucucuuccagcugcagcuguugccugaagucugccuuuuugugacaugucuucccuguguaccucugccucugucacgaugugucugugugucuuuugacugugacagacaacaacuuucuuuuuuugggggggugguauuucuuucagccccacucuggccccgcucgcucuggucccggccauauuuacuucauauauguggguacacugucacugucuucagacacagcagaagacaacaucaaaugcccauuacagauggcugugagccaccaugugguugcugggauuugaacucaggaccucuggaagagcagucagugcucuuaaccacugagccaucucucuagccccaaaggccuuauuuucaaaugaguagauucucaggucccaaguggacgagaguuccaaaagacauuuacucaacucacagugaccagggcuuuguuagugacuaaaucaaaucacucccaacucuaguguagccaggauggccuuaaacucacaacaaagccaagagugaccuccuucuccucucugccgcuccauagguugacagguaccuauugucacgcuccugccuuauuaucgguuuucuugcuguuauuacccacaggcgagggaauggugggagauagagauagucaaaacagcugcuuauaauuaucuggguucugcgcccagugguucguuucagacucuugggcuccaaggggaaggagaggggauuugcccuugucuaaugaggaagacucagaggcccuguuugcauucacagggcccaaccacagaugcuguuggguucuguuaacuucccaccacuguguuguuccaugggauaugguuucagcaucugacaugcacgcuguuaaaaugaagagcauccaucucgagccucggggaucugaaggagguuaggauaccccuaacccugacaugaggguguucccuguugagggcugagugccacgcacugcacguggauggccucagcuuaagacuucgugaacagcuuccucucagaagucucacugaacuucugagagguuguuugacaggcgcagccugggugucauuaaacaugggcgagaccugcugucgugcggcuuuaaauagcgcuugacaucuuguccguggcaugcaugcugagcagaggggagggguagaugugacaucccaugacauacuuuccuccuuucuagccuuccucugcuuauccuguuggaagcucuguucuucccugaaucauagaggggggaagaauggucagagauacacagagcucagaguuaggacgucauggcugagugucauagaagcgucaugccaauaucaggcuaagaggaacugcaccaggacuguuauaaccagcaaucaccaacccaaagcacaacauguucaaagaccacggcacuaaggaggcagugacguggguacuuucuuagaaguaaaggcugaaaagccaggaggcagaggguguccauuugacuguaguggggugcuuguaccccaggaauuuaaacuuccugauucacugcaugcuccccagugacugacuaaguacugugagcaugcuucuucauucagccuuagggauuuuuuuuuucuuuuuuagcgaguggguuuguaaacucaaaacucgcagaaugauuuggacagcauuuggccaguuugaugggaacuucaggaaagccacugcacggacagauggcuacacaugguucugugucucugucgccacggggagguguguguguguaucucuuaccacacaaagcagcucucuggagacaccaccagcacguccuccagcucacugaguucccagggaacaucagagcugagggcugaggcucagccugcaaguccaccccacuuccacuucaggcacaagcgcaggcuuuagcuugugacgggacugcuggcacuuggauuggguucauuuguggaacccugggaaaugguucucuuugcuuuuuuucuauuaauauuuuuuuaaaaaauuguuuauguauauaaguacacugucguugucuucagacacacccaaagagggcaucagaucucaaugcagaugguuaugagccaccaccauguggcuccugggaauugaacucaggaccucaggaaaaacagucagugcucuuaaccgcugagccagcucuccagcccuucuuuguuuaagaaagaucaggaugagcaggggaacgaggaggcccugcugagucacuaaacauccuuucuucuggaguucagacaggccagcgucccagcaucagggugcgccuugugucuugucaaccagggagcccucccaaacugccacacaaagacgggacaggugaggaccucgggccccaguuccucuccucuccagaagacauggggagcugggguuuccgaguuucuagugcuucccuggucuuucuaggaccaggaaccuccacaaguugccuccuuagaacaacaacaauaacaaaaugcuccuguugcuuagggaaugccaaggguuuuaggaacuugggucaggaacagguacagacuauguauuaaggcaaaagggguuuuaucacagcaucagggcacagcccuccaggcucugcagugccugagcuacugcucccaaccuugaucuugugcaggcuaaggacgccguaaccauccucccuauucuucucccccucccccacggccaacucaugcauuucuccucuggauguuguguguaaauguucucauuccaccaacaaaaccccugauaggcagccuaagguaggagagguuuaugugggcuuguggggcagaggauuuuguccacggaugagggagguugcaauugcuaccuugcaugucuugguggacucucccacccugguccugaucugccgugaugcugcuuuggaccgccagucccgaagcuagaggauguugaccuccccgagggguggcucccccucugcuugcugaaccuaccugggcuguggggcaucugaggagcacugauagccugcucuaggcugacaggccagaaagacccugcagcuguuacggugguccucauggugucagagugcggcacuccuuggcaucugggcagaccccaugugggcaacucccgcucuuccagugggaugaccacacagcauauggucacgugugaugucaucgaaguucugucaaugcugcacuugggucauuagugccgagugugucugcugaucagggacggcugacugugaacuucugggggcgacacugcagccuaguguguuugucuagcauccuuugguggcuuugggagaucauguggaguaauggauccaugaugccuagguguuccuuaagcgugguccucagucugaaacugcccaccaggguagggaauacacaccgcuguaguuauacuuacaaucaauagcaucuggcagucuucugagaugccaggcauuauaugaguucaucggucacagaccgcccgagaggugcauggggggggggggguguuaccaucuucacucuacaguuggcugcagaguggcaggaagggcucagagcccagaguuuucugcgacugcagaaaagcggauauauugcaggcgaagagcguagaguucuauaguggcuuccucuucuccacuuccagaaccuucuuuugcaaaagacaaaagcagaaccaagaagccaggacugcugguacauaccaguaaucccaggcugaggcagggggauuaggaguuucgggccauucagaguuuauauagcgaucuguccccacaaaagcaaaacacaaaacaggcaguucugcuuggcuugaacugcugcucagauuugauuucuguuguccugguaacgaaugacaggcguucagcacccucuaguuuggucuucuguguacuugacaaccaggagaugcuugcugucuggcucuucgugccugugucaugucaccuucuauuggggcucauagagcugucccugagauaggacagaccucugcccuuccccagcuugcaacccagaccccaggagacacucagaguugggauuuuccuguucacuagaguuuggugagucucaagccaccccauggugcgauuggcccucuccauacucagugccacugugggcuuauggggccaguggguggaauugccacugugguucugaaguugcacaugauguggccaguggcccucacuaucuuaucaaacaacccuggccucuguggcuuccucaggggcuccgcgauugcaagucauggugaugcccugggauccuuauaugguacaugugcaucccccgugccugggcagugccaguagcugcuugcuguggguccagagaguacugacauccccuuggcugcacgauccugacagugaguuguccuccuccucagcagaggccucagccucagccagcccugcuguggcccuggucugugggaguugcuuugcaagaauggacccugggcugaccuuuuccugggaagguggugggaugcuagggucggggugacggggaaggaggacccguggucucuuguggcacccaagggagaugaggaccugacuuguuggcugaagcuuuugucacucgggugggccaugugggucuuuagggcgagaagaaugggaguugggacauugucagggacaagucauuguuaggaugacucugugugugugcaugcuaccacaagcauguggcagucagaggggacucuguucucucuaccacagagguccaauagacagaacucaggcuuggcgaguacgacauuccucugcagagccaucuuuccagucccaucuugucauuggaguaaccagugggaggcauuuaggaaggggugcagaccugaggagaagccuggccucuggucccauuguaaaguagcccagcauuuguguuuuuuuuuuuuucuuuuaauuuuggaugugugagaguuggcccaguugaugugcagagcacucugagaccuuguaacaguuuuucuuucacaguagaggaaacuggaacccagaaagguuaaacaaccugacucaggccccucaccaagugggaaugggggaguaggugcugguuaagcuaacuggcucucaggaggggcaccaaacuucccuuccacccugaacccaggcuguuagccuguugugugacuaugccugcuuggccuaugaaaugcuugguguucuuguugcugcuucggagucccugacaaaagccacucaaggaaggguuauuuugaggguucaguccaugauggcaggaaagcacccauaggcaggaagcaaagagaaguacucagcucuuacuuguuaggaugugugugugugaguguauggguguaugugugcgugcgcgugcaaagggacuucagaacugacuuggcugaaaugagggucagcacuucccugccuucccugggcacaucccugcucccugucaaguggccacacucuuccagccugcugcagucaauaacgcagaggaaguggguggcaggcuuggauagagaggucugcuuccugcuccauggagcugucccugaagucucuggccucucccacagcaucucucuggacuggggacuuacuuccagcuggaugcugaaugggaccagaugaagaaagaggagaaugaagaugggcuagcuuucucauggggacgacggaggagcaguacuuccugucccugguuuauaacaccccugcaggccacaggcccuuacaucgaaggauauguuugccagguuguucauaaguaccccacauggcagaaacaaaaggauggaaucucaucuuccuggcaggccagccaccuucaaaacacggcuccggggccaccuccuccagggucucacagaagcuaguggcuuguguguggauuugaaaauguccacaguucucaagaacuuguuacccggggaauggagcagaggagagaauaugcuugcccuguuggucaggggccaaggagguggccuuggggacaaagcagagaagacaaagcuucaggaggagggcggcuuauggggcucagcuguggcugcaaagggcaagcaauuagcacaccuccgacugcuccugugaaaacuauuaaauggccaggcaguguggaaagcuggagguagccugguccccaacugccuucaggccaaggcugcuggguaaaccuucggagaggcuagcucaggggagguggcuucaggugcugcggguggccguccuguggugucugcccauaaaagccaaugccuguugggaaaucuguuuucuagaagaccccccacccugaccucugugucaaggaccaguggcugccuugcuguguggaucagggaggggcggugcucucuacagugaggucaaacagcucuuccuuucugucuaaaguucugcugcugagugacccaggcuugucucuuucaacagcucuugaaaggccagugggagagucuaucuggaugugcaaggcuucugguagccacccuccuuguuuguuuuuuuccuuucugucuuuuugagacagggucucucuauguagcccuggcugucuuggaauucgcuguguagaccaggcuggccuugaacuuacagagaucugccugccuucggagugcugggaucaaagcaacgugccccccaugcccuuguuuguuucuguaggacuguggcaaugaggcaccagaaccucauuaguuagaacgggagucuguguguugccuuacagcccugaacgucaucagucaggaucagggcugggcuuuccagccuucuggaggcuucgaugaguuuucaucucugaccucuuccaguucugaaaggacccgugcuguccccgccauccccccagccaucagcacacugcaucucccagucugucucuguuccaggcuucucuuccugccuggagaccccaugggguugcuuguacuacccaagcuaacuucaguauacauucauuuuuuucaucacagaaggggaagcaccaugcaaccauaaaagauguaggagaaagagguccagggaguuacagcgagaauccccaggcaggaaugauggcagaugccuguaaucccacucagcaauuggaccaaugaggcaggagaaggccugugagucugaggcuagccugggcuacguaucaagauuguucuccaaagaccaaaauagggaaaauaacugcaaauaaaugauugauuaaagcugcagauugcuggcccaguugcuccugaacucacugaggauuagccagcuguucucugagcaguuugcucucugccugaugcccugaggagccaggagacaagcaggugacacgccugcccuuuacagaagugauggcagcuaaaccuuuggcgcagaugugccaaacugugacaaugccucgaagaaaggagcugucaagggaggccaauguguuggggaagugcgugggauccguggguuccaagagugucaggggcagggagcgugucuacauaggcucuuagcccuggcuccucaucugccaagcuugcagaguccagugcuaguguucugagcaccccuccccccguccccgccccccaacccaggucuuugcuuuuuaucucagccaaagaagauuaaacuggaccugccucccgaacgaagucucgucagacagccauaguacagaugaccacuagagggcgccauguacauagcguuccugcucucagcccaguuugggggcggggggagugguucuccccguggcagguguacaguagagcucuuuuguuguuguuguuaauggcuuaaugauuuaaucuucuuauuuucucagcagaaccgcuuuggacuucuggguaugugggaacauuaccgaucagauuaauuaccgcugguuccacagcugggaagcgggccucgccggcuccgcugaggagugacucuccugcugccauuucugcucucauuccuguucuacacagugcauuucucuaucuguauugagcuugaccaggcuuguucugccgcuucgagcgaccagcagauuucauucccagucugccuuggugagcaagcaaccuguauagcuuucucagagggauggcacgauguguguucaccaccggcagggaaaucugcauuuugcucuuuugcuguuuauuuguuuguuuguauuugggguguugcacgcucuucucucuccgaauucuucugcaccuccccccaaccaugauuaaaaucacuugucgaaaggcaguggaauugauugaaaggaagugggaucaaaagcaacccuuccuaaguuggggacuccaaggcuugcggcaaaaggccugcuguguggccugggguuaagagucauugaucaucagcaccugagcugagggucugagccaagagaacagaugaugaucaggggagcccuucugugcggggcugggguguagggugcagcuucaaaagcagggaaucaagucauagggcugaaguccucuagacuagccaguaugcugugugacucugcaguggugacacuggcuggacauggugucacauacuguagucccagcacuuugggaggcccgaggcaggaggauugagaguuccaggacagccugagccaccgggcuggcuaguuuuaugacaacuugacacaagcuauagucaucugggaggagggaaccucaauuggaaaaaggucuccauaagguugggcugugggcaagccuauuagagcauuuucuuaauuagugauugaugggggagggcagugauuagugauugugggcagggccauccccaggcuggugguccuggguucuauaagaaagcagguugagcaaggcaggggaagcaagccaguaagcagcaccucuccauggccucugcaucagcuccugccuccagguuccuguccugccugaguuccuguccugacuuccuucagugagggacuaugaucuggaggcauaaaccaaaccagcccuuucgccauagcaauaguaaccuuaacuaagacaguguccaaaaggaaggacuagggacguaauucaauggcagagcauuugccuagugugugugagucccuggguuugacccuagcggcaaccugggguaccugaaguugagguuccagcagucucugaccuuccccaguggccugugcuguuugcuggcccucacugcuccauagcugugguccacacuuccuuucccccuggacugggccugcauuuucagcuuuaccacagcccuuugagcuuagauggcccugagccucccauaggcacugugcugguuugagucugacaccugcucuuugcagggacuuuggagggccugugccucugcagcgucgucugcagccagggaugagccaugcuucauccugcuuauucccguagccuuggugugcaugugcggagaucuuacaacccacaccucaggagccugggcagagauuccaggagcuuccgaauugguugagccucgucuuuaggguggguguuugacaucuggguccuuugagaauuggugacguugguaccugcucuccgaauccccugagcauuguuuggugagguccucugcccuuggcacuggcuuccaagcugagccuuccagaacauggauuugacucaguucucuucaggugagcucaggugaagugaguaagugcccaaauguggcccagcuaugugauggggugaggaguaggggcagagagacuuaaaucuuauccuuagccacucuccauguagcggaaaguuguuacaacggcccugugauccugccuaccuacuauuaucuguccccugugguaagagaugcgguguccacagcuguuccgugaggcuuuccucccuguuucucugucuggauuguagggaccuucagaacuggaagaugacuuccgggcaugcauaggcagaugggaaauucuggaugcaguuccaacaguaacugugggacguggugccagggaggaugcccaggcugaguaaaggcaccguggucugagcucuuaggggaggcagugucugccagagggggcagaacaagaggugcuagaaaagucaguuggcuggggacacuguggcagguguggaccggauucuggaggcagaggaggacugugcuggggggauggacuggaugggucagugguuagggagcacacuggcuuggguuagaggagggcaaacccaagguguuagagaccagucaaagcucacaucuggcugacaaugggcucaccuccagaauucucccuguuguguuuagggcagugguucucaaccuuccugaugcugcgacccuuuaauacaguuccucaugcuguggugacccccacccccgcaaccaccaaauuauuucaucgcuacuucauaacuguaauuucgcuccuguuaugaaucauaauguaaauaucugauaugcaggguaucugauaaugcaaccccaaagggggucuugacccucagguugagagccuacaggauagaggguggauugaagaagcccaugagguuuugcaugugaggagacagcuaggcugccuuuuauccuucaaggaccguguucucugugagcgaggccgccuuggcucucccaccccugauucagccugcccagggagccuauauggaaagcuugacauuuuauugugaacccggaaaccuucuuccuauugaaguuauuuuuucuguaguucuaaaauuuuccugaucacccugggggacagaggggaagaaaaagacugugugagggcugaaggaauugucuguuuaacccuagcuccgagcuucagcuucacacacacacacacacacacacacacacacacacagagagagagagagagagacacacacacacacaugauaucaggcauugugcacuccucagaccuaguuccugagacagaugcauucugccuggcaugggggaggggagugucucugugucagggaaaccugugugaauacuuggucugcccuucaaaguagaggaggcugaggguggcucaaggcugccuccccugcccccacucaaccccuaaucuccuggcagcauccuuccucuugccucuauaagacuguguugugguaauuggguucuuggugacccacgacugcugggcuaaugugagccuuaaugggagaccucuuuuccaucagugaaauggccagaggugaucuguaggugacagucacugucugugcucuggguagcuaucccuggcugaagucucuuugcucucucuacuugccaugcauccucuguacacgaagccugggccuggcuuugugcuggaugcaugaccacggggaugaucugaggccugguccuggguaugaguauguccccaggcuaagaguuugccgcugucacaugaacggugaaucaugggaaccuagaagaguggcccuaguuccuuccaggguggcggguacacugagaggguauucuaggcacuuuuaaagagguaagauaagagaaggccucuuccaggguccgccaguaucgggguguggucuacaggaccuggcuccaacuggcuuugaggaagguacagggguggggaaggaggggauacugcuagauuuauggaaggccagucucucaucaggaaucucugggaacccccaagggcuuuacucuggagcucuccacccugggcaaugacugggacagcuuggggugcugagaagauggcugagucugaugggauccccucuguuuaacaugauaguugaccgaaaggcccagagugucccggugucagguauggcucucacagacaguuacaucacacugguaccuguggagugagccagugcaaacuuggcuauuggagcuggaguaugauggcagagaguggccauccgcaggugagcuggaggcaggcuccacccuccaacagccuuccuggaucccagaggcucucgggaucuuacuuagacagucucaacugggcgcaucugcagcaguggcuccugauguggggccacuggccuccuuuucaauguaccucauuaagaugcacacacuuuuauuuuuagugucugaaccuauuuuuuucuugugaaguagaauggaaccuuaugccccagcagaacaagcucauacaucaaugguucaaguccccguugcauccucuuccuagaccuugccaacgcaguguggaaauuacccccucuuagaaauuacugaguuaacacacuggaguauccuguggucacgaucugugugagaagaccggacccaucucucaugagcagcagcaguccaacugggccucuugauggugaagaggccauuucucugauguuuaccacacaaugauuaaacaucauuccuucuuugccgugucugggucagacgcucucccugggcuccuagccuugccccaauucacgcuggguguggccuuguccauccugccuguuguccucacguuuggcgcugaaccugguggguagagagcagccucgugcaucaaggucuucucgugugcaacugucaggaacaauucuccuucuggagucccgucccucacccuuggcgugucuguggaugccaggaaggucaccagcagcagucagccccagcugcccagccugaugguauuuucacucuuacuuagaucuuauuuaggucagaccuuggcuugucugagcuggaggagccucacgagcagcccaguuugauugcucuucagagccgcuuugaagaagcccuuccuggauggugaauuagaacgucuccggaguuagaaaauucacggcaaacucuuguuuccugggcuuguuuaucagagguguccuggggucucugcugcccgcucacaaagcggggggggggggggggggggcacugcgcaccccuugcugagagcagagauggacaaugggcuuuuuguccccuccauucuucugaggcucccguagagugcucugucuuugagcagaucugugcagggcauugcugggcgccagccuguggugggcugguuaaguggcccaaauugaggcagcuuugcuaccgguuucaaauuuuucuuuugaugugcggcagguguggcauggcccuuuuugugagauuuuuuuuuuuuuuuuugcuuugauccuggcuuagaguggguuugcugagauuuucccugccaugguccuuuguucucuguggacaccaagauguguuuauauggguauacaaggucccagugagaugaaguugcuacguggcccaucagugaauggagucaccauggcucugguucccagguccugcauuccugagcccccuuuaggcuuuuguguccuaguagacacuuccuuccacagugagggucuuguaccccacuucucccuuggaguggaaagcugagagcggcugaggugcuggccugccgacguuucuccuccaccuagagggagggaggcuuguuccucaaccagccugcuuucaaaguccuguuuuccuaauaaugucaaaaggaaacaaaaaaggcugcaccccccccccccaaaaaaaaacccuuuuuucuuuuuccuuaagagccuggguauaaauaauaaauaaauaaauggagcuacacaaagagaaggauaaaaaaaauaaaaucaaagcuguaagcucugcacuuggccugagguauaaauagcaggcucuuaggaggcgccugggugagcgucugaagucaucucuuccgucagugacugcaagucaggagaggcggcuuuuuuucuucuucuuuucuucuccagguugcuuucuuuuaaguuuuaauuaagaaaaaauugagacagggucuucaguagcccagguuagcccccaacucauucugggucugagaaugaccuugggcugacccuucugccuccaucuucuccacggcaggauugaaggugugcaucccccacgucuaacuuuuugcuuuaucagccuugccaagucuuuggauacccguggguagacaagggauuugucucagucacacucuggacucucguuucuucucuguccuccccucucccuucccuggccuccaaacuccauuccucucuggcccccaucucccuccuagguuccuccuuuugguccucagcugguauuuugguacaaccagcucucuccaggcccuggagacucggugcaguaagagggccccuuggccagaaggaguucguugguacccacuccucagcucuggcugcuggguugcucguggacaggacgcucaccucagaacagggaggaugcuuggugaaagccaggccagcaggcuccugugagugccgucauuagccuaccucaggacugggccugggcacggccagcagcaucucgcauccuugaagugugaauccuucuggcaucuggaccauaacuugaaacaucucagcuuucccgggauucgcugaaauccgccagcuuguugggcugguugcugaugggguagaaggcacuggcuccuggcggguccucugaagcugcccauuggcuuaacacuggaaacuguucaaugcagcacgggagaccuggaagauacaggcuggggcaauggacccuucuacccuuggugugggugggucccugggcugggucccucccaccacacauugcucuguagucccuaaggcugcuccugcuucuggccuucuuucauucauuggauucauuggguucauuggaugccuccccuagggaguuucccaugguucuccugcaugauaggcgggcaccucuuccuuguucuuccacggcaguggcucuucugagccucuuuggguacccaccaucagucagagcugacccuccagguuauaccaugucuguaaccuaagggauuauuaaaggcaugcaccaccacugcccagcccucuaaagacucugugagcagggacuucucccgccuuuguguucugauggggaaacugaggcuuggugaggugaggaggccuggcauguggcagagugagguuugagccgggacuugguggguuuggccaaguucuuaguacuuuuccuggacucugagucuguguuuccccaaggccuugaacaggaaggaccaccccaaggagagcguguguaucacagccuggcaggcucuggaguguuuauuaaggucacgcacgcagucccuggcccuguuuaguguuguuuuugauguucaagggcaguguggaaauuuuuguuuucugugaccuaguuucggugcuuugauaauggcauuccauugcaccccaccaacucugagauuucccaaucagggucacagucccacccaugcaccccccacuccccagccccaggcuuccugccccugccuagguagggcgcugaugcgugucauagcucgagggucuuuguugcuguugcuuuaaauuucauuuguguuccuguguuugggcaugcacaggugcauaugcgcuuugagggccguccaucggccuuugagggcuuuuuugugaugaggucucucacugggacuggggcugguggauuaagguaggcuggccugugagcuccagggauccaccugucucugccucccuaguacuaggauuacgggggccaucaugccuggcugguuuuguguguguguguguuuucccccggagauagaguuucucuguguagcccuggcugucuggaacucacuuuauagacaaggcuggacuugaucacagagaucugcuugccucugccuccucagugcuggggucaaaggcuaccacugccagcuacgccuggguuuuaagguugggcuuagucccuccucauggcuucucagcaaacacuuugcccaccaagauagcucccuagcucccuagccuuaucugggagacccuuaucccagggucuuucugagaggaauggugggcuccuucaugugauucuccuguguggcucacugacgucucucuggacggccuuauucucaacggaaacugucuuuuauucuucuuugacuguugcccuaagcacugaacauggccucagcauaggggacccgcuguaacucugagaaguuagcucgauggacuggggaagagcugggcaccuagcugguguggagcugaacuucccuggagaguuuucuuccuuccggacacucuccgucucaccuacgacaugcaaggauuugcuggaauuugguccguuuucuaaaggagccuggugccccaggauggaucuuugggaagugggacaaagggaguccacaagcccuugguggucaccggcuugugaagcuguuucaugucugugugcuuccuucuagagacguggcgaggauuaggggauuaagaaauggcucagcgguuaagagccuuuuucaagacugagucacguuucuggauccccacggguguggcugucacagaacauuuguguuguuuaucgcuuuuggcuguugugaauaucauggccuugaacauggguuuacaagaggguguccuuuuccaaaaaaacccugaacaucuacaucuuugaugauguuaggagucagcaucuguccuuuggaggcagaggacggguuguccccagaguugcauccacagucgugccaagagccuguuguguguccuguuccaagcuggguacugguguucuucagccugucuggagaccuaagagaacaaacaggaaacaccaccugaggcaguaggucagagggcuuaaccggacuggcuuggggucucccaggcagcagggcaggggcuccugucccgaagccuuugugguauucaugacacugucccuaucaccugcuguugugggugcugggugaccaacacauaaggugcuaaagcguugaggugacugguauuccgggaagaauuuagagggguugucucuguauaaguuccacugggaaaucacaaagucgugggacacuuggcccuggagagaucuccucaggcaagauguguggucagcaagugacagcucucucucucucucucucucucucucucucucucucucucucucucggcuguaagaaguggcagguggugaccugucucugucaccucuggaucuggggggcuagagucuggagacugaaguccagugguauagaagccauuauuucugguuucagggcuucagauuagguguggggugugugugugugugugugugugugugugugugugcuagagauuuauguaagcagaaaaaagccaagcccugcaucuguacaggcucuugugucacauuggguugcccccccccccccgcccccauggcugugaccaagggccaucagaguuucugcagagaugaagagcuccuguguggugccauaggacugggguacacacugacugaaccccauaacuacucccuaccccagccuauaaaccuacugcucaugugcaguuagcagucucugggcccauagacugucagcauggaaucugggcucgcuuccuuagucuguucuuuuuccuacuggcccugaucccaguccuguuaccuucuauagagauuuaagaucuuaggaggaagcgcgccuguccaggggccaggagagacagagaugguaauaaagauuucgugacuuaucaccaggagcccauguguguauauaccugcagaguuuguagagaaucuggggagagggagggcuguggaccaugccuuugcuggguucaggucaugguccaagcagacuuccgugcaggcccaagucucagcaagugagggcugguuguuaugaaucugugguguccagguggaaagugaggcgagaggcgacauccaggcugucuguggauggaugaccucugggagguuaacuauucccagggcagagagcugaaaggguugugcccagcugggaggaggcauguguccagcugagcuggcuucaggucugagacucuagccuguuuaaaaauagauucgaggaaagugcaggauguaagaguucaccgaaucuucaucagacuucugucccaaaggacauggcacacuuuaaauucugaucacccauguaugcaagugggccuguuuacaccucgagucuagauguccccccacccucgggacagcucugcccgagagagauggaacuuccauccaucuucuggggucuaagccuugucuaccaaagaagccucaggcaggucuggaaaccauuagaaacaaccagaagcuucuggaagcuuccaugucucagucacauguucuaaagaacaguguggacggacuggucacgauugggaggcaucaagagcugcuugaugucaagaaaaauggcagguguucugggcugggaauacuuuccccagccucucugggcugcccaacaugaaggaaugccaaacaagugacauguucgacacaugggacuuuucucuuggguucccugcauacugaccuggucucucuuugcucaacagugacugacuuacaggaagaaggcaagagcgccaucaacucuccaauggccccggcuuugguggacauucacccugaagacacccagcuagguacuguggccacuuggcauccuucggugucugucccugguguggcaccccacaugggugggugguguuugagaacuggagucuuauuccaagaucucuagggagaagccagcuucugccccagucuuccagugcagauuugauuggcauccagguauagaugauuagcauugggaacguggcugguuaucgucacagauccagggaguggcuaagcagggcugagcaaacaguggaggagacggaggaagaguuggcuugguuacugagcugaggacuggauagaugacucuaggagcuccaggcacaagguucuggcuugagauagcugauagcuggccuagaagaagaggaaagaugaguauuggcucaggguguggaccccaguaguccccuagaggaggaggcuaagggacagccuccccuggaggacaguuucccugggacgagugggccugucucagucaggguuucuauuccugaacaaaacaucaugaccaagaagcaaguuggggaggaaagaguuuauucagcuuacacuuuccacauugcuguucaucaccaaaggaagucaggacaagaacuuacacagggcaggaaccuggaggcaggagcugaugcagaggccauggagaggugcugcuuacuggcuugcuuucccuagcuugcucagcuuguuuucuuuauaguuauuucuuuuuucuuuuuuguuuuuucgagacaggguuucucuguguagcccuggcuguccuggaacucacucuguagacgaggcuggccucgaacucagagauccgccugacucugccucccgagugcugggauuaaaggcuugcaccaccacugccuggcucagcuugcuuucuuauagaacccaggaccaccacccacagugggcugggcccucccccauugaucacuaauugagaaaaugccuuacagcuggaucucauggaggcauuuccucaagggaggauccuuucucugugauaacuucagcuugugucaaguugaauacagggcccuaaggccccaaaguauaaagaaauuaauaaacuaggcacacccuguauaucuccuuggcugccacaaagauccauccaugcugggccugcggcuggccaugugggaacugugguuggggaagaccccuggcuccuugcagguugaugauagggugucuguccgccaggguacucacucuuuccuggcucuguguuuuggcagcaagccaauguggaagaagucaauguggaaggcauguuugggacacugcuuauuuccaaauccugguucagagggagaucccugucuaccccgauuugccaugacaaggccauuaaggucucgggguggaaucaggaguggcccaaccuguggcccagagauggcuugguacccaacaccacugguccgugaugucuuuucccacagaagggcaugccccucucacagcuucugcaggugcuuccuggcuacucuuugccuaggaagccagacuucccaguuccccacuguggucagcgggcccacggcauccuggcuucugugggccacuggucuuuucuguucuggcuccugugccuucauucccuccucaccuuccugucccgcucucccugugaacuucacuggacucuugucuguuagaaccagacauggaggggaaacacacaggggagauggguaaaaugucaccucucuguguguuuuggcuauuucuaguacuucugugcagauacuguuuuguauaugacacugccugcccaucuguuuccuugugugucccgaggccccacacggccuccuguggauuggugaauggugugauucaguugcucaaagcucucuucagcccucugguucuggcagggcacuuuugagaacacugugggugcaacccugugucuuuuuucuacccaugccaucuuggcuuagacuugcugcuagagcaauuggagucuagcuucaucgccuccugcugcccugugugauuuaucucugaucuuggugucuggcugacaaagcugugugagcuguucucacagagaacaugauggucucugcuuuuccaccagcuuccugacucaugugagagagcagggaguccuccacuccuagcaccccugucggccucccccaacccccauucacgcugauccuuucugucuuuggcagaggagaaugaggagcguaccaugaucgaucccaccucuagagaagaccccaaguucaaggaguuggucaaggugaguuguagucugauguggucggaacaucccuguugguuccaggucuucuucuggggggaagcaagauuccuguggacacaaggaggaccugagccuccaggcuccugaaagggccauugaggcuacauuagaaagggguggugagggcuggugagauggcucagcggguaagagcacccgauugcucuuccgaagguccggaguucaaaccccagcaaccacaugguggcucaaaaccacccguaaugagaucuggcucccucuucuggacugucggaagacagcuacaguguacuuacauauaauaaauaaauaaaucuuaaaaaaaaagauaaaaaaaaaaaaaaaagaaagaaaagaaagggguggugagggguagagugggcugaagaauggauggaacaugagucuucuaggugcuuccaugugcuaggguaugcugcccaaggccuuuaugggcuucacaugguuuucacaagagcuguguugggucuguuuugagccaauauaccuuaccuauaugcaugguugucuguagcuucaugggguguggauuuaaguaguuuuggggaggagguuguugucucccucuacuauagccucaucugaagagccuuugguguccuaguuagcuguaacugucaaccugacccagcccuggagcuaccugaaaagagagucucaauugagggauuuccaagaucagacuugaccuguaacaugucggugggagauggucuugguuguuaauugauauagguagacacagcccacugugggcggcaccauucccuuggcaggcaguccuagauuauauuaggaugcuagcuaugcucaagccagugagugauccagcaaguaguguucuucccagguuuuugcuucaagcucccucaugaguuucugcccugaguucccucggauggacugagcugguaguguaagucaauaaacucuuuccucccuuaaaaugccuuuggucagaaaguuuucacacagugacagaaugaaacuaaaacacuugaagaccaugugugguagugugacuaucagccagguaggaaagcaaaaggcuuuguucucaaaggucacagucacaggcagguggguuugugacucaguggcugccaaagauaccugucuccucuuuagcacauggcugauccugcccaggggcagccugaggcuuugauugcucagaucuaagccacagucggacuccugaaggccacccaucagagacagaggcaggcagaugguauccugccuuggagacccagaauuggcuugggugaccuaggugcuuugaaaugcugcaggugacagacaguguccugaaauagauggcucucuauugucuguccuaccuucacugcagcagagccugcagccacccccuugugaccgagcuuucauaagggcugauucaggggaaucagaguugcuugccagcucugcccuuguagaaacauauggaaauuucuguugcagucaucuaaagacagagauuaauuuuucuuuuucuucuucuucuuuuccucuuucuuucuuucuuucuuucuuucuuucuuucuuucuuucuuucuuucuuucuuucuuucccuucccuucccuucccuucccccuucccuucccuucccuucccuucccuucccuucccuucccuucccuucccuucccuucccuucccuucccccuucccuucccuucccuucccuucccccuucccuucccuucccuucccuucccuucccuucccuucccuucccuucccuucccuucccuucccuucccuucccuucccccuucccuucccuucccuucccuucccuucccuucccuucccuucccuucccuucccuucccuucccuucccuucccuucccuucccuucccuucccuccccuccccuccccuccccuccccuccccuccccuccccuccccuccccucccuuucuuucuuucuuucuuucuuucuuucuuucuuucuuuuuugacagggagaaaaugaguuuauuuaguuugcaguucuugguuacaguccaacacugugggcaugccaagguggcagggucuugaagcagcuagucucauccacagugagagcagagagaaugaaugaaucagcuugccugaugugugcagcugcuuucuccacucuuauccuauuuggaacccuauaggucuaggggcuagugccacccauagugggcucagucuucucacaucaacuaaugagauccucacagacaugcccacaggccaacccaauguaagcauuccuuucaacuaauucucgauuguaucaaguugauaauuaagauuaaccagugcacugggcgaugguggugcaugccuuuaaucccagcccaugggaggcagaggcaggcagauuucugaguuugaggccagccuguguuuuagagcaaguucuaggacagccagagcuacauggagaaaucuugucucaaacaaaaacaaaaacaaccaagagagagagagaaaaaaaagacagaacaaaacaaagcaaaaacaaacaaacaaacaaaaaaaagucaaacaagcaagaaaagacagaauaacgguugugccugugcagaggggccuaggcucucugcaaucggagacgucaaggaagggggaagcagggccccagcugcuggauuggaugaaggacgaaagcugugugccaaagucugugggagcuuccagaagcuggaggagguugggaagcagguaggguccuuuuagagucuccagaggggccaguucuccucuccugacauuugaccucagcuguguaacaggacagggcuucuugccuccagcauaugagagaguccauggggugguugcaagccaccagaguuguggaagucccuggagcagccauaggaagagaagccuccccauuguagcugaccauccacacgggccaggcagagugucuccacacccgcagcagugccugaguuccuacaaccaucccguuggcugcagcuauacacacagagaccaaacuucucgaaccagccugagaucucaucucagagcaggcuggucuugaucuagcacuuucuuuuuuuuuuuuuaaaagacuucuuuauuauuauaucuaaguacauuuuagcuaucuucagacacccagaagagggcaucagaucucauuauggaugguugugagccaccaugugguugcugggauuugaacucaggaccuucggaagaacagucagugcucuuaaccccugagccaucucuccagcccgaucuagcacuuucaaauaugaauguaaauaccauggacagggggagcaaucuggggacuugggggacucaucagcugauuuuguggcuaugcuggagguuguacaaagugucaaacuucucagccagggaggguucugagacacguguggguauaggguuauaccccuagguauaagguuagaagggacaguuuccuaaagacccccaggcaacuucagggggcccaugcuaucuuaggguugacaauucaccaaaaggauaccaggccccacaggaagcuguuguccuuaaggucacaguuauaugggggcuggggggaagacaugcuugggaccaggaaauggauugugggagaagaggagaaagggugggcucuggguaauugcuccucuaugcaaaugguucgagaacuuuagugcccagggucaucauaugcgugccaguguuucaggacauugucugugcugcagaccagugacccaacuucuagagguucucugugaggaucccccguggggauacacugugagggggcuguucaggagcagguuuuguguuuugucccuugccauuuccuacagcuggugguggcacccaggacucggcuccauggccgaaccauaugccugucccuacccccaauguauuuuaaaacuuaaaccugucugguauguuggccugagcaggucagaggaugaucuagcuggcaaucuugccuugcuggacacucagaucucauuguggcgucuguccuucacagacucucccagucuuuggggccagggcugagguucugaggaagccuggcugaccuuguuucuccccuucccggugucugcccucuccaacuucccucuggugucuuaguggccuuuucugucgcccacuacuuuacgauacaucuuugcagugcugcgggcugcccucugccuuuugucugaagucccuggcccuggcugggcaggcacuggaaugagguugacuauuaaaaacuauuuugagcaucugucgugcuuauugggcuauuaaggggcgaagguccaaucccaacucaggggaaaguggagugccucaaaccacggccauucauuaucugaugaugggcacagagagggaccaggucugguggggagcugcacauuggccaguugggcaucacuuuagaaguggaccuguauucugcggucccaggagccuccaagacccugguguccuuugcugggguuucuuccuguggccauuuacucuagugucugcuggaaucgacuagauucccuguugguggacaguguauuggagcucacagcugagauacuucacguucacuggucuguuaaaaguguccugcacuuuucugccagggagaggccucugugcucagugucugaugcggagugccguuuggaccuugucuccagggucuggcacagagcucugaaacucucaaaguuauccgagcgugagaucuccucuacagcacgcacacucuuggccacaccugggucacaguuaaugagggcauuuggauagcccccaguuagcuuccaaugcaggaggauccuaaggggacccacccaugcauggucaagggcuccacacuguugaucucugggagggugguucuuuuuuucugaugaccagugacugagcuuguaaccuggguacucgacuuugggcagugagugucacagcgcucugacuacagaccccugaggucagagaauugcuguuggggugaugcauccuggagcuggaaaggaaaacucaguacaaccacaccgcccuuaaaugaagcaaacuggccagaagcaucuagaugccucaugcuggggugagucuccuuccaaaaccagauuucacaucucacucuucaguuacugggcaaggcuuacccuuguccugacacuguuuucuccccuuuggguccggguccuguggaggggcucugcccugcucaggucucacagacucccacccccuucacuaaggcgcaucuccauccccuuggggacaacacagccaggucucuguuuggaagugauuaaaccguaacugucacggcccuggggaagacagacugcaggcccgauuauaauucagagggaacuaaggggaaaguaauuuuuuauucugguuagagcaagcucacagagcuggccaugauggagugccguguaaggauguaauuaauauauguccuccuuauucgcccgcaggacucggagcucgccgaugagcgcgucccuaaaaauaauggcugaugcuaucuuuaaaagcucuuuuguaaaaugaaagauuaaggaggauggccgggagcagaaugaugaggugaugggugguguccccaagucagcuccaccucuucaggguuggcggugaccugagagccuggcccguuguguagacuuuuuuuuuuuuccuuugagcuuuuggccuucuguucuugcuuagagcaggucagagaucuagcuuuagggauuuuuuguuguuguuguucguuuuguuuuucuucucuaaguuuuggauucucauagaggaagcauucucucgagauuuccuagcaggaccgaagaaggaagcauccggaagcaaaguccuauagaaaggucuaagcccuuucuagaugugaauuuccccaggccguucuuugguuuguuugagaccuugagucugcucuuguuguagccacuggggacaagugccgagcccagcagcucacucaucaacucacacaguguaccugggagaaaggcaugacgugggccaagugaauaugcaauguaaucagguggcaaggagguuucuccaagccucacgcccuucugccauucccugcagagaagucagggagguagcauuuaagcagaccuggucaggaccgaggcaaauaccauagccaacugcccaacagcaggugcaaagguccuguggcauacaugcuuggcauguucuagugauuacugcgauggguagagugacaagagccucgagcaugccggggagugaccagagacacggugguagauguccaacguguguaccuuccacaucugcacccuucucagccuaacacccaugacggguaacugcccuugugggcagggacuguacuacgucacucuucauccuuacugcccagcguggcaccugguguggacacucauucauguuuuauccucaggggagacccuggcaaugaaggcucagcagcguucgcagcuggagguggggcaacaaaucaagcacaugcuaccccgcccccgccaucuuggcaacaggcugagaagauucauccuuccccgacgucugaggguuucuguugcugugacggacaccaugaccaacagcgucuuuggagaggaaaggcuuacagcuuguagucauuaucuaggaaagucagggcagggacucaaagcaggaaccuggaggcaggagcugaugcagaggcuguggaggggugcugcacccugacuuguucagcucgauuuccagggcuaccugcccaggcguggcauuauucauaaugggcggggcccuuccaugucaaucaccaaucaaguaaacauaccacaggcugguuuacaggccaaaucuaguggaaccauuuucucucuugcgguuccucuuccaggcgacucuggcucuguaaguugauguaaguccagccaccacaguaaccacggcgaccucaucacaccaucauuuuuuuucauuccuugugaaguugagaucuuaccguuuuugugacuuggaaauccuugcugugguuugcagcccccagugugagaacaaaccuuagacccuugagcaugaggacaagcaggcauccaggaugugacccuuugcaaccuguuuucuccagccaggccuggcauccuggcuuucaucgcccacuggccagagagcacaagccagacuggagcccagucagccagagagcuggagagggcucugacucugucucccugccccuugugcuuggacacuggggcuucaaggguggcccuuuaccccagacacgggugagucauaggcucggcacucccugugagugucggucugggccagucuucuguggucacuuggaagcuagucaggacuugaugggucaggacuuugugacgagauuuuucaggucacugcuucggggagucaugagacacugcuuuuggauuuugugcacuuugauucuucugagaguggucacagaucucccccgcucaggggcuaagggguccgauuagguagcuuaguucauuuugcuggcaaggaaaagccacaaucugagucacagcggcacccugggcaggcaucugcuguauauucuggguguugacagugaauggguagcauccuugggaagccccuguccaagagacacucgacaguacaggugucuugcuuccacagcaugacucccaaugcacggaguggaaaaaccucuuaagaaaagccuucugguggugggucuggaaagauggaaccagacacuuugaccaguguucacagcagugugauggacagaaagugacaggaccccccaaugguccggcgguggggaagacaaauaagauauaccuacguuugugucaugcggugguaaagcauccuggcagaaguugggggaagguaggguuuacaguggagauggguuucaaacacugugcuaauggagcagccaggcgcgagggaggaguugcauacuguguaaucucauugacuacaagagagagaggggagcagagcuguggggggacaggccugaacucucuacagggacaggagacaaaguggauuggggcgaccaucgcacagcucuugggaucugaggggugcaacagguugauuugacauugaccaaauagucuacagggugcguugagcagaagccaugcugggacuucuuuuaugagccuggaacccuggcuggacucagggcugcuaaagagcaggcuaggaggggacaagaggggggguaauggcucaugguccccuuuucucucuuuccccagcacuuacucauuuagugccuguaaauggaauaucuguaauauaaauauuagcgguuaaugaaucuggcagguguauuucuuuaccucauaguauuccccaauaaucacgcagaaaauccaauauuuauuuaaaacugcaccucaauagcugagcaguuaaauggugugaucgaaacuuauaugcuaaucuggcuauuuccuagauccaucccaugauacuugcauaucauuauugaucuggcucuuugggcuucagguguguuuccaugaucuuucuccagaccuuuuccuuauggcuucaaauccuccauccuagcugaucugacucuuccucucuuccucucuccuuccucuaauugauggacaucccacccuauucuuaacucugcccacccacuggggugaucagcauuuauugacaaggcagaggauaaaagauaaggauuguuuacacaaacuugagacaggagauguuugguguaagcauuacaaugcuacgaaaugggaucugagagcagagaaaucagcauuugaauaacccaagggucaacucaacccaguguacaagaauauggcgccuccaagcgcccacugcucgaaggugcaccugcgaguucuuccgcuaggagauaggugucauccucucuacccaugcucucugcagguucccagccuacccggguucugccaggcucugcugggggcuguuaggaaguccuagcuucauguauggaucuaguucuccacucuuaccuuggccacggaccaagagacaccuguugucuuccguggucaccaggcaggugucugguagccccugugcguuugggccgcugcccacccgagccugcucugacccuggcuuuauuuagcaacucugugacaaugccucucaccugccccagguacuucuggacuggaucaacgaugugcuggcagaggagcgcaucauugugaagcagcuggaggaggaccuguacgauggccaggugcuccagaaacuucugggugagugccaggaccccgccauguagcaccauccuuccugcccuggggcucuugggaacagacccagagcuuggcguacaccuccugcuggccccaucugggguuucauugcuguccguauccaugguuucuuugcuggccagugcauacccagccuuggggcugcagcaggucaucucggaugcucaugcagucauggaccaaagaaacagcguucagugaggauucaggccccuuaucucaucucucaggccacccguguuucaucuaguuauaaacacuguuaggauggggugggagagaggguugaucuccaacaaacccaucugagaggacauguccuuguccugauucagaacaugucauuguccucauucgugcuuccaggcuuuauuguccccccaaguucuggcuaaggaugauugaguguguucuccagagagauggguggaaggaaagauggucagguggacagccucuccaucaaaugauccugagccucccugaacacuggcuucuaggucagugagucacgaagcagacaucgaucuaccccgcccuucuggagcugcagucugucugagcagacagugacagaugcugugggucucaaggguaguuaaaggccauacaggugccauauggcuaaaguggguggccuuacaaagcacuggggucugagccucagggggaaaugagggaagaguggcuaggagaauggagaacagagucgguggugagggguggcaauguucacgaugccuuacccuggggcagugauucaugccugucauccuacaccugggaugcugaggcaggaggauugcuaguuuaaggcuagccuagccuacauaucaaaagccccccucucucucucaaaaacaaaaacacccacaauggaugacagucucaggaccagcucugaugguggcuggcccuguugugagcaugucuuguaggcuaugcugucaccucuggccaccucguugccagagggagguggugagguauuggcucucuggcuuccgaaggcuuuucucucagcuguuugucaggugccuugggcacaagucguguucguucagguccuguuuuuccuuaccuuagcaacccaagggcgggaccagggacucagcaucuccaaaugccuuuuuauccagggcauuuugcccuguucuuuucugacuucuuccaacaccccacccccacccccuuuucucuucugccucuuggcuugggcaucuugaccacucuucuaauuuucuuuuuuuaagcguuuauuuguuuugauuuuaugucaugaauguuuugccugcacgagugucuaccacuugcaugcagugucuguggaggccacaagagggcaacagauccccuagaacuggaguuuauggccgguugugggcugucuuguggaugcagggaauuaaacccagaucuccugaaaggcagccagugcucuuaaccacugagucaccacuccagcccugaggugcuuuccuuaguguuaccaaauacgccuuugugccaggacuggugcagaguccaucacuuuacauugccuaaagugcuagguuaucgguggugauggggaaggucauguccuuagacaaggugauggcuggcaaaagaggugcugaacaucuggguggccaugguaacccauccgagaagcuuacgguccagcagaguuccuuguacaaccucagaggcagagggucuguggccaggcaagcaggauccagaggcugaggcaguuuugugagcagggaaggagauuggaucuagaauuuggcugggcugguagacaaaggguuuccuuccagucugucacaagagccacuagggguuugaacaaagccauacuaugaccuguguuuacaaaggucacuuaggcuuuugggugcagaguggguaggauggaggguuugggguuggagcugggugagugguguuagccgagccccaggcuucagaaauggccagaguggaauacagagguagacucaggaauggaguguggaggccagagauauggacggggcagcuagugaauggugggugaggauuuggguugagucuaacuguguggagccuguugcuggggcaggagugcucccaccggggagcagccaccuagagcuggcauuuagcaccaugggacuaaccguucccuggagugggguuucaaacuccucagugggcugaauaccaaauagucaagagugaauguggauguuugguuaagaauaccagaccuuaaauaagguucuguggcuuaaaaaugaagcugaugagaugcuggaagggugcuugcccuaagcugauggccuuugaugccugagaccuacguggagcaagcggggaacugacuucugaaagcuguccuuuggcuuuuacaugcaugcuguggcacacaugccuacaaaacacaggcucucccacaccuaauuaauuaguuaauuuggggugggagguugagacaggguuucucuauguagcucuggcuguccugguacuugcucucuacaccagacuagccucgaacucaaagauccgccugccucugccucccaaguggugggauuaaaagcgugugccaccacugcccaguuaauaauuugauuuaaagaauacggcuggaccaugaggaugguuuuguagacaccuagguuuuaucacgaaaacgucagagcucggcuuugcucuacaggcacuggugugcuggauacugugguacacucaggcuuggcucugucugcugccagcugcuuaccauauguucagacggagcaucugagaugacugacccccagcugaggcuaaggcugcacacugagcucugaauggugugccacaaggucacaguggauggggcggcuacccuggguggcccaccugccuccuuuccagggcuuggaguguggcaccaacuuaacuuuuuucugacccuuggacauggugauugggauggugauggcaaggcaugcgugugcgugcgugugugugugugugugugugugagugaaggucagaggucagugucagauaucuuccucaguugcucuccaccuucuuucucgaggcacagucucucacugacccugaaguucaccaguuaggcaagauuaacugaccagugagcucuagggagccuccugucuccaccuccgcaggcacccccaucugugccaagauuacagacaggcauugccacacccagacuuuccuccuggagcugaguucagguauuuuugagccaccugacuugggugcuggaaucugaacuugguccucaugacugaacagcaagcacucucaaccucugacccccauccccauccccaccccacccccgccaacucacauggcaaugccuuuucauuggagcaauccuccaguuggugcugcaucucagcaucacagggcaugcucugucuuugugucucuacuacuggccaugguugagcaucaacagcauugaugugucccugguccaucuuugagagcagguguuggucaccucuugggcacaucuuuuuugguuccgucuucugcuugccuggcagauacaguacuggccugaagcugaaggggcugugaaucccacccuguugcuucuccgggcccuguaaagugaggcucgaggcuugcccaggcucugcuguccuuguauugugaagugguuguuauucccucucauuugaauaucuccagucgguacuugaaagaagcagcuugcaagccucuuaugucaagugggcuggacagagaaaaggacaaugggaagaguauucagggcugaagaggacaucggugcaucuuugcacgguugugugggcagcacuguuucugacaggaugcagugauaacucacagggcccccggagaccagagauuccagaagugaccuugauguaagugguggcgucuugggcuuucugaaagcagagcuagaucaaauaaaguggugcuggccgagcagcagggccacaaggcugauuucagugguggagccaggccuggucaggaugaggggguagccagcaaagaaguccagugagaucagccugugggaagggaccccgaggagugucacaugggaggaggaggaggaagaggaggaaauauuccuuaguuauuugaauuauauauuuuuuugcauggguguguacaugugagugugggcauguggguaucauggugcacguguggaggacaaccucaggugccauuucuccuuccuccuuggcugugugacacucaucaagggugagccgcuaggauaccaagaggagccccuauucuugagaaggaaugcuggaagcaacaauuccuguggcaggccaggcauuaggguuuuaccucaaggccguaggcugggugggaugucucuguagaaugcugaggggcuccggggccagcugguacucacugggacaucuuuaguccuuucgaguuacgcuaucgcccucgguugcaugcugugcucgagcgucaccuuaaccuuucacugucucuucuggguuggaagaugaggccguggcacaucuaccgccccaaccacaucauuaugugauugauaggcagagaacucucucugcccugucuuguggaguuacggcaucauggacaccuagggcaagacaauggggaugcaagaccggcuuuuagggcuaggucauauccucuaaucccacguucguauauugacaccagugcuggcuacuuuuuaaugucagcuugacacugggucgaaucaucugagcagaggugcuucuguaagauuggacuguaggcaaaccuacagcgcagugguucucaaccuguaccuugugacccccagcagcaaacuucuagcuccaaaaaauauuuacauugugauucauaacaauggcaaaaaucacagcugugagguagccaugaaaguaauuuuaugguuggggggugggagucacagaauaaaaaggguagcaacaugagagagguugagacccccugcuuuaggacaucuucuuaauuaguaaguaaggucuccagggucuugcccuguuugaauuccggcccugagggaggacuaugauugggaugaguaacgaauaaaccuucuccucucaagcugcuuuugggcuuuaccacaacaauaauagccucaacuaaggcaacauccaaacccucagaccuuagaauguggcugcauuuagagacaugccuuuaaucccagcacucgggaggcagaggcaggcggaucucugaguucgaggccagccuggucuacagagugaguuccaggacagccagggcuacacagagaaacccugucucaaaaaaccaaaaaaaaaaaaaaaaaaaaaaagaaagaaagaaaaucucuuagcgcugcuucccugcacucacaggcucccuucuccccgucucuaacauuuccacacaguaagaaguuugauuggagauuugcugaguuugugacuaugucauuucuaagagcaagcaggaagaacucuggugagaauugucacauucacuucggaauucaauuaccuggacgagacccagccgccuucaauuuccuuugggaaugggggaggcagcaggugagagcaggcagccaagaugcagcagccagcgcuccugaggcuccugcucugagcaaggagcccuguucccuccuagucuuuaauucuaagaugugauguuuccugacaggucuccucugccaaccagcaaaggcccagacccagggugacuggaggcaauuuccuagaaugugauuaccgcauccuuagucgaggaugcacgccugccaucagccccauugucgcugagacugugaaccccauggaggucacacaaagcucuguucaacucauguuaaccgggcccaggacuucagugucuuuguccccgaauucuggcuccugcaguuagcagggucagcucuucugcugucugcaggaugcagcgggcggugguggugcucgcuuuuaaucccagcacucaggaggcagaagcaggcggauuucugaguuccagcccagccuggucuacagagugaguuccaggacagccagggcuauacagagaaacccugucucgaaaaacaaaacaaaacaaaacaaaacaaagcaaagcaaagcaaagcaaagcaaagcaaagcaaagcaaagcaaagcaaaacaaaacaaaacaaaacaaaacaaaacaaaacaaaaugaaaaucugcagugugggaccucacugggacaccccaccuccccagccucaggaucugcccucugcagccaacccaguaacuuccucuuuugcaucccucacugcaccuuugacuuugguuuuaaaauuauuaucaguaguaguguuauuguaugguguauuaagggaguguguguguauaccuguagaggucagaugacaaccuuuugagacaagguuucacuguggaacccugacacacccagaguuugaccuuaaacucacagaaaucuacuugccuaaauuguuuuguuuuguuguuuugagaauucuauauauaugaguacuaucuuccuuuuuaaaagauuuauuuauuuuucauuuauaugaguacacugucacugucuuaagacacacacuagaagagggcaucugaucccgguacagaugguugugagccaccaugugguugcugggaauugaacucaggaccaucuggaagagcagucggugcucuuaaccgcugagccaucucuccagcccccacaugaguucuaucuuaacaucauuucuaccuuuccaacucuucccaugucccccagucccucucgaguucaugacugcuucuuuauuauuuuuauccccgcucccggucucugucugucugucugucugucugucucucuguguacaaccuaaugaguccauuuccugcuguuugugugugugugugugugugugugugugcacauguagggcugaccacucgguacugaauaaucagguagggggaauccuccuuccuggaggagacugguauuccuucucucagcagcccaugguucuucaucuagggguggguggggcuuugagaugucuccgucuguguuggcaugucaccuggcguugucaucguugggucaugaggcugagguuucccgggcccagcuuuucaggcacaccuagaauguucuagcuagcagcaggccagaggacaacuuuugagucaucucccuccuuccacugugguuucuggugccuggcugucaccacgcuugguccccauauacaucuugaagguuucuuucccacuucuugcacauaggcuguucccagccuccauccuuaucguccccuuucaauugcagcguaacuuucucccaguagaaauggucucucaagucagcuuccuggcucagcguagcaccacuggcccacgagugggcuaagaggcuggauuccuagugccucugcuccagccaggguacagguggcuccagucccuccugcucugacacucugcuuagugacacguguccuugucuccacagaaaagcuggcgcacugcaagcugaauguggcagaggugacgcaguccgagaucgggcagaagcagaaguugcagacgguucuggaagccgugcaagaccugcuucggccccauggcuggccgcugcguuggaauguggacugugaguggccucugccuggggguugucacuguggccguugugucccagguggccuggugguuaagaaccaaugcauccucuugaccuauucuaccagagcccagguggcagaagagaggucugggaaagcuuggguggggagcacccaguuaagggcacaaacacacaccagugcucagugcuccccacccacccccaccuucagaggcacagcucuaggaguuguuuguuuugugugggucugagugcacaugcguggaaggucagaggucaaccucagacagcauuccccaagaagcuugccccuuguuuguuuugggucaggcucucucacugagaccuguagcuuaccagugcggcugcccagcgagcuuaggauccuuccacugccgacucuccagugcugggauuauuaggcuguggcaucacaguuggcucguuuuaaccccaacaugaguccucgugcuuguguggcaggcauuuuaggaaccugagucgucuucccaggacuuguuuuggagagucucauguagcccaggcuagccuuggacucaauauguagccaaggcugaccuugaauucucgauucuccuguuuccaccuucuggaggcugagauugcaugucuaauccaaggaauucuuguugggacuugccaccagacacccaguacauacaguuguacaaagcgaaccuaucuggcccauuguggguggcccacggaggcagaugcccagggacccaugauagcucaggaauguuacuugccagcuggcuugagggggcugugucaccacagagggagcaggaagggaugaguugacuaaaaaagccgauggcuucugucccauguuccuaccuccucugguucuuugcaaggcaggugugauguggucuggugcccgagacugcucuucagggcuagggcucuguggccugcauagagaacccagaucuuggcuguggagauggggcugguucuguccuugauuucuuggcauaacuuuagaucgacccauccuuucuccccaggugcugggccuauggguaggagaugucccaccaacugcaaagauuugcuccaacucagacugaaacuuuacauucagagagcaucagggcaggcagccaggacugacugcagccuagagcagucccuauccuugucacccauccccauggggacagccgauugccuaggagcagaagucagaaguuagcccagugccaaugauaauggcauguguuauuaugguggauauguggcugugacaggcccuuuucucugcaaccugcaauuccccucuuuaaaagacagugcucuuaaaaguggcuaccagggcccugcaugguaucauacacuuuuaauccuggcccucaggaggcugaggcaggugaaucacugugaguuuuuaggccagcugguauuggccugccagggcuauacagugagacccugccuuaaaacaaacaaacagaccaaaacauaaaaccaugguugucaaguugccuuggagcaacaggaaaagaauagagagaggucaggcaucagcaagcagaaggccccugggaccuuagcaucccugucuaucugaggucucuuuguccuucccuagagaucuucuuaagagauacccuugagggcuggcaaaauggcucagcagguaagagcacugacugcucuuccaaagguccugauucaaaucccagcaaccacaugguggcucauaaccacccguaaugagaucugacauccucuucuggugcgccugaagacagcuacaguguacuuauguauaauaauaaauaaaucuuugggcuggagcgagcagggacugagcgagugggguugacuggagugaguagagguccuaaaauucaauccccaacaaccacaugaaggcucacaaccaucuguacaacuacaguguacucauauacauuaaguaaguaaguaaguaaauaaauaaauaaauaaaucuugaggggcuuagagagguggcucagcgguuaagagcacugacugcucuuccaaagguccugaguucaaaucccagcaaccacaugguggcucacagccaucuguaaugggaucugacguucccuuaagugagucugaagacagugacaguguacucauauacauaaaguaaauaaaccuuuaagaagaagacauacccuugagaugggucccuugcucgcuaccccgucugaccugaggccucuguuugcuacccccccccccccccccgcagcuauccaugggaagaaccuaguggccauucugcaucuccucgucucccuggccaugcacuucagggcccccauucaccuuccugagcaugucaccgugcaggugguggucguucgggugaguacgcagggccauugucucucuguccaucucugcuggcgaggcaagccgacguuuucuucuuguaguuuuccagccuuuuuuuuuucccgccccccugcaucccaagagccuaccuuuuauuuuucccucuugauaaaaugcauaucucacccuggugcuucaagaaaugauuggagcagggacaauggcguugauuuugagagcggcacacgggcguugagguuuaauuucccagauuucuggagagagcguucauuucuucccaaagccaccgagucggaauucaauccccuugaacgugcuuauuacucacuggaggaggcugugaccggcagaaugaaauagacgcccaaauuaaaggcucuccacauuugcuccguauuauaagccaucauccuccauuauuucuuuuuuuagguucauuucucuugauuuacucagagaagggagccaggaccugggguccugcuaacgggggagugggggacaggcauggaucugcugugaggacugucuuguguuuuaguguucaagcacacaggugcuggccggguuugguuccugugcacaauuuuaccaggaaccacguauuaagcaccuacugggugccagacauuugccugaacugcuggggacccugggugaggauaaccaguuuuggccuggaagagacaccuuaucugccaaagggcugaggucacacuugggaccuguaugucgguguuuaugugucuggagacauucagcuacacucuguucucuggauuuuuaacuuaucuguuuuguggucugugguccacugggaccuggcugagccuguguuuucugaagccauuccgaccucucuacugcccugggagcuuagugguacccugccgggaaagccccgugucugacauuaagcggaaggucaccugccauuucucccugcuuccuuccccaucaggauauuuguggucagcgagagugacgcaaacucagggggaccauuccugcggcccuagacuuggcugcuggcuccuaggcagcgggccgggaaagucuucccaaggacacaugggaaaacgguuccuaaaccuaccuacgucaguccaggccucaagaguacugagcgggcucaccaucuggguauuuucuuucagucuugcacacugguccaagacaagcuggggguuuuuuggaaaaucugacugcccuugcaagcccccuccagcuugcugcgccuugacugggauuccgggguugucugcauugaguccaaaggaaaagaaacugggcaaggagauucaacuggauggcagccucucagccucccagugucuacugccucuccugagguccuccagacugucugugugcucgcucgcucguucgcucgcucggguggcccaccaacuuauuugaaaugaggccaugcgaggcuggaaggcaugagauccaagccuugcuuacccccccacccccaccccaagccuugcuuagcccccccccgcccccccccccagcaauggaaggauuucucauggcugcggugaucggccuacagacucggagugauguugcuaaccuuucaauuauccgguucccaguuuaccaaagcccggcaaccaacaggcaccucauucaugccuaugcaaauaagcgaacccaauacccagagucuuccuuggcaggcucuguugagugccagucagaaugagacugggaugagccauaugacguccccaguugcauuuacuuguucaccaggaccagucuacaagaucccuagagccagcucagggaagggugagagggcugccuggauaggacucagguuccugucccucaggagcuucaagcagggaccugcgguuauggcuacuuuggcuggccucugggaacuuccaguguaugcgggcugcuaucugccaucaucucugcuguccuaccacugccccgugugccugccagaguugccgggaugaaggaccacuacuaacuggagcuuccaauggcggguggauuucuccucccagcacuuccggacuuuaggaaagcagcucucuuuacccuguucuguuucugccaaggcuggcuguguucaguguccauguucgugcacugccacggcccucucuguuucuacuuuuuccuuuugggguaucccacucaccccagcugcagagcucaccacuauguggccauucuuaacuaguauuggaagccgagaaggaaaagcagguuccaacauccuggguagacauguuugggggaucccguuugagcaagugcccacauguucuuucucuggaguccuguccccccacccccaccccacaugacucaugaacuacccaucucuccugccucaaccgcagaauauggucucuaguugguguuucuugccuggaauguuucucccaagcuuugcuuagugaccauaucccaggguaccacggagaacaaugugaggguagucccucgugucgucuggaguauacccguccaggcgugaagugugcacuggggcacaugguucucccuuucuaggcuggcguccugcccagggucaccaugaagggauuucccaugagaucaguguuuguccucuguguugccccugcuccguggucugucugucuugaugauuuguuugcuuugggguuuucagaagcgagaaggcuugcugcacuccagccacaucucagaggagcugaccacgaccacagaguaaguggauggcagccgcuccucaggguucuguaccucagggacccaugccucaugcaaggccucaggcccaaggcccuggcuucagcccgggacacuagccugggggagccuguguucauuccuccauacucuuuagucuuagugugugcuuuuuuuguggagugacuugccugccuucuuucuccacacagucccucuugggcuucccauguccgucucucaccucaaagagagucucucauuccuuauuuuaggaggugaacugaagggauggguuagucagugaagugcucacugugugagcaugagggacccgauacucagcaccuauguuaaacacgcgcgcgcgcacacacacacacacacacacacucacacacacacaauucagggacaggguuauguaucuauaacuccaucauggggguggcagagacggguggaucucugaagcccauugguuagucuuucuacccaaaucagugugucucagguucagugagagacccugccucaaaaauacaacucacacacacacacacauacaacacacacauacaacacgcacacacacacacacacacacaccauauacauuauacacaauuaaaaaaaaauuaaaggaaugucagggugccagguguguuagcucaggauagccaccgagacucacgcucacacuggccagucaaguccugcuuguuuucuaguuuuccucuccccuugucuaucaacaguugcucucuuagagggagcuaccaugugaucagucagaacuguccuaagguggacacuguugaguccucuggucucuuugagcaagccauacuuuucaaaagccuagagaaacuugauccuaauagccaaccagauaguguaccaugugugagggcccacgguaccccaggauggaccggaggaacucgacaccucugauccuucugaagaaaccgguuucaguguuuaaaacauggacggugucagcuagcucaccaauucuguucacagagacgcuaagacugacuguguauucaguauggccuuuccacagcugacuggaacagaauccaucaggcauggagagugggcugacagauaagcugaagacauggcagugugcucugggauguguguguguucuguuccauguaguucccaggggaaggcagauaguuggggaggggguugggauuggggguguugggaggaacgacaggcugguguguguugugacagcaccgugggccuauggcugcagaagggcaaguucaaggaacagggggugggguaaggacuuggugggggcuugguggucugucucgugagacaucaccccuaaguucauuuccuuuccucacaagcccgcacucagcuaugaaugggcucagccaggcaguucuugcugugccugguccugugauauguacaucugagggcuugcuggcgucugacggaccaagguagccucucuuauauauuacuaaggccagaugccagcccccaaggcagccucuggaacacagcgucuguggccuugaggagacauuuucccagauuucaccuuaaugguguugguguccuguuuaucacagcugauccuucggucccagcugaccagagucacggauuacuuuaaaaauauugcauaaauagccccauagaguauuugaaggccucuuaaaaauccccucugaaacuucaccagccagguucuuccagccuguuuuccaaguucucacaaaugcucauuuaucguuaagcauucaaauggcuuuucaagccggaaguuccagacuccuuccacauuagcccucuaucucagugguucucaaccacacuaaugccgagacccuuuaauacaguuccucauguuguagugacccccccaaccauaaaacuauuuuucguugcuacuucaagauuguaauuuugcuacuaucaugaaucauaauauaaaugucagaugcaggauaucugauaugugauccuggggaaacggucauuuaauccccuaaaaggaucucagcccacagguugagcaacgcugcucuaucugcugggcguggcugccagaaucaacaggcucccaguucccacgaugcaaaugauguccucucuaaaugauacaccaggguggucacuguguugggaaugaggguaguuugcugucacucuugugcugauuagucgccugcacgugucccucacuuuuguuaggcuagagcaggguguguguauguguauccauuccuauugggggguggggggaagggggcugagugcuagggucugguuggcucugagacuuggucuaaguguccaucugacccuuucuucuuguucacaggaucaugaugggccgguuugguaaguacccugguuuggggugggacaaggugagaucccuggguaugcaccauccaacacagaaagcucugcgguucucaaggucaugcgugugaucuugugaacuugggcaggaggagugagcuuguagggacagaggggccagccuggagaacaucucuagcuuaccugcaggggagggagugggaggggagaaaagaagguaauuacucucucaccugacccuguccccugggcaagagaggacagacaaagagaucaaaaaccuacagcuuuguuuaaauucucagaggugauucuggcucccugcgcgggcugggagggaggcugaugugggcagaaguuuaaaacagaaggaaguggagaaggcugaggaaaaauggaagccagauagaagcucccagcucauuuccagauacaugucugacccuggggaauccuugggggcggggccagugccaccuccaaaacccaaugcccuucucugaccuggagguuguaaagaagggcugaaggaugagcaugcagcaugcugaaggaugagcaugcagcaugcugaaggaugagcaugcagcaugcagcacgcagcaguucugacagucaggaaggucuugaguuugagagaaagcuguggccauguagccccugagcccuucugauggacagguguuaugcuugcugggaaaguucccaggggaagugggguggcaagcaugggucaugugggaccccugcuugggguccaggugcaggcuaguuuagagauauguauaguuuagaggcucugaaccccuggggaucgcagaggcgggaggaugacgaauggggaccugagaguguggcgugguaacuuaugaguuuggguuggcucuguuucagguucagaggauuugaaaagaguuggcuuggcugggggcguggggagagggaggcaauccugggcucgguugguaucuugggagcccugacagcugggaaggacaccuggucagguacacagggugugucucccaaggggagagccaggugcaccagaacucagucacggugcuggggacaucugaggccacaagaaaccuccucugaggcuguacucacuucacuucuugcaggcucuggcguaagaugaaacaggcuauuagcuagugacaggcaauuaguuccgcccccgccucgcacuucugcugacgcaaggaggucuccugguuacgcggcugacagccuugguuuuggugcagugagccccugggcucccaggcauccucuugggggagcagcagauggcuaucccaggauuucuggucacuucugaccucacugccccgccagggucuggucacacugguucccacccagcaucuacuuucuggcuucagcacaagcuuugcugaggaaggucaaagcaucccuugucacgucuguuuccuguccacaguccaggaugcuccagacaucacauccccuguggccuugaucucucaccuccugaguguccaggucuaacccugcccccccuccacccccacuuccacuacucucggccuaagacacccuccugcuaaauuacccaggguucccuccugcauuggcucaacugucacucaccagggauccccagucacaaaccagcaugcacccgcccuacuacccucugguugucuucguuaugucuagaaccaucugacaaaccuggagccagcccugcucccaggagccucaggguuugugugugugcuccccuugacccggaacacuggugcaagugcuaugcuuguaggcacacccaugccuuuuccuuuguucagggaucuccaaguauccuggaggcagccgcucaccccaagccuguaugaucucagcagcccucccugcaccacugucaggcgugaggagguuccaagaccugagcaggcugagucuccuaggcugagucuugcuugaacccguucccucagccuccuuggccuucgagugcugugcaaagguggagcgucuccucucuggucacucuucccuaaggccagcagguugagggguggguacccagccucuucccaccagcgucuuguccugccugaaguauaagcugguuuuucucucccuggaaaccagucuccugggagcugggagguuagagccugaucuccauagcaacgccuuugccaguugccuuuucucuagcuaguggcccuuccucccugguucccccuccccacccccgacucaggagcccuuucuggugcugacaggauugggugggcaaggguggagucccccuccuaguuccaggcucaguuugcugagacccaaucucucccauuugccuucccagcagagccuguguuaaauuaaaacucugaccugacguucacaccccuggucauugugcacgaaggccacugcacuaaaggacucagcuccugucagccucccucccagaccacccugcucuugaauccacucuggcucccuguguuucucuuugcauguucucuggcugcaaugcccuuccucuucucaucucuccagccagccuggcucagacggcaagccucuuucuuccaaccucuuguccauggcugcgaacuugggugcugccagagaccagccggacagaguugcucaaaccccagaagcugaagguuauaggaggagaacuguggaaaauaggagcccccccccauccuuguccuggggguggcaccuugaugccaggugcccuguagcucacuguggccccagccucugcuuucaagaguuggaaauguagauuagggaaaaccuuccuauucuaaaugaggcugaguuaggcuccagguacagaccugggacccuccugucugugccuuuccaaacuagugacuucuccaguacaggagggaaauugaugggguccccagacaugggaauugggcuugucccuguguccccacccugauucuugaugcucacagaggcgguggggaacagaugugguuccauuuagcuagggaagggaccuaaagucugugggcuuucuagucacacagugaggauuugaacccagcucugcccuguccccaccaucccugguccuuccucuuggcuauggagccacauuuuguguccucuaggccccagguaagcagccagcgugggaggcgcccaacagccucccacgcggcacucugccagcccagcaguggcccagcuaaauaaaccggugacgucaagagccugagcucuuggggcuuugccuaagccgcuuugcagggcugcacuucuucugagaggaguaaagcuccuuuugccccuuuacagauuguuuucugggggauaaucugacuuagcugauuauggaagugagugacaucuggugcuaacugaggguggcuuuuuguccccaccaguccuuagagggaggcacugccuuuccccccuucccuaaccauccccccuccccccagacacaaaaggucccuucucucuguuuagccucucaccuuccccaaggcugaggaagaggccccagguuggauggagcugccuccagagccuggcuggaaucucuggcaccuucaucuuggggcuagguugguagggggcuaacuuuagaccguccuguuuggcucuucuccccagaacccuggcucucucagcucaccccagccuucuuugcucuccuccuuccucuuccucagcagccccugucuccugaggugggggaagccccccugugccuuaccccuagaaccaagaagacagaagucagggcccgggucccacucagugccuccccucccgcugcagcacuguuggccccagagcccccaggccucuacuugaccugggcuauagucaucuaucccaacaacuucugugcacccagucuuacagacguaaacagacauuuggguucagagggcaccuccagagggauuccagguuccugugucccugaacgaagagcagagcagagacacacagucgcagccagagcagacuaaggagcauccacuucugagggagaaugugccgcccccaagugcagagcugggcuuucaccuuagagccuggcuuucccuuccuuugcauagugaggauauuuugguucauuugaauagaguaggcuuuucugagugugugcuauuugucacauguaguucacacaaauucaugugucagcaugucucauuagcaucuuaaauuugccccuaggggugugccacacgguuacaaugagucccaggccacccgcagacacuuuggagugcauguguguccugagccagugacacaggcacauuuucauauuuggauuuguuuuccuuugucagcccuguugggcuggaaggugucaauugugguugggggggggguuggggguuccaguguuccucuuugccaacuuguuccuuucagaugcuaauuuugcagaggcuuucuguucucugguggccucaaguagggagggauggggacuucugugcuguuuguuuggguggcagcuugcacagaugugagcaggucagagugagcaggucgugguucaccaaggaagagggaggucaugggcuaccucagguugaaauaagcagccuucaggcuuccugccgaggacaccaaaggcucaggugccuucccccugagcuccuccgcugagcuugcccuguugcuggagucagaggcagggcaggaguaggagaaccauccaucucucccagagaguuaggagcugaagguccagcagacgguacugcgggggggggggggcagugaggcucugucaaaggcauguuagugcuugagggaugcaagugugcagagaggccauuuuguaaaggcugggagaugugugggagcguggccaucucauagccacgggagagaggauggaccacagucuaagagccgugagagguagggguuugaggggccaguggcgagaaguugcccaguugcacauucagagauucuggaugcugagggggaggaggcugguggagcuagauagaggcuguggucauccagagguaagaggaggcaugggggcagcggagcuggccaagaguagaagaagggggagucacagucagcgauaacgcuuagggaaggagagucagggaugcuucaaaugcuuaaucaaaacuugcaggcacccaaguacgaccugguaucccauacccaaagcguuacuguuaccaaggaagccccacgcagcuguugcucguuaaggcaacccucacgccuccugcugcacuccuacggggcagugucaaccugcaggcuccucugcucuggcagaaaccagggggaucaagcagaaccccaagggagagcaaccagagagggcuauuucuagaacugagagcugaaagguugggaaucagggccgccaaguccuuucuagaacucucuguguucucucuugcauguccugcagagcgggacgccuucgauacucuuuucgaccacgccccggacaagcucaaccuugugaagaagguagauuaucucccucccucccucccuagccugcuccccacccccacccccgugccuggugccugugcagacucugucuagacucucugcagacccaaggcaagccgagauggggaugagagacauuuggaauauucuaaagugugcccuuguguauugagaccucucccagcaaugugugcuguggcgaugcucucuuacaauacugugcuauuaacuagagccuagaguuugacacagccuuuuggcgauagccaucagaggaggguuuggaguaugccagccugccauauugggggcucggguccgggggguccggagaagguugcugguguaauguugucuuuaccucucugccuugacagucucucaucacguuugugaacaaacaccugaauaagcuaaacuuggaggugacugaccuggagacccagguaggcagggcuucgguggaggcucccucuggccaaugcuucuugcagcucucaacucagguggggugugggaauaaucaggaccaccuuguuucucucaggagaagcucccagaguguagcuugugguauugcuccagcccaaccaagcuggcugcuuagacccuucucuguguuuccuguaacuguggcagacagagauggaaggcugaagccagggugggaguccagaguuacagugugggcgggcuggcuccuucccacucuugcuguggcuccugcugcguuucugcaggcaggcuccgguguucuugcaucuguagauauauuacuuccaucuucuguggccuccuccugugucugcaucugagucugcaugucugcguguugcccaaggcucucugugccccgucugcuucccagagcuagagucuagaaauggaugccugagagcaaagaaaugacacgcuggaauagagcccacccugaugacacaaggacaacugagacccuuuguccaagugaaggcacagguuaggauucuagcuuauuuaggagagaaacaauucaacuuuuagugcccacccccaagacuccaucugacccugccacuggcccuuuguugugcgggucucugggucuagaacauucugugcccucugcuucagugguggagacauggcagccucacauuugaucccaugacaauauagagacaaugucccauccaaccugggcccagcaagauggcucagcugguaaaagugacugccaagaaaaccugaugacccgaguuugaucccgggggaccuacaucauaggagacaaauggcuccuucaagccguccucugauuacauagggacuauaacacuaaccugaugcuccgcccuacacgucauacaaauuacaggaauaguaauaaaauuagcauccguuuggggacuagggacaaaacucuuuugccaucuguaccucaaacacuccuuccucaagcuagagugcccuuguaguggugacagucucuaagcacacaacaugccuugaaggcccaacugaauuuuccccuggcuuaguugugugguugaguuuugggccggaauccuuggugcagacaucccuaauacgcagcugauccauccuaaaccccugggcauuuucuucuauugcuuucucuuucuuuaacuucuucucauuugcuuuucuaauuaaaaaaaguaauucagguucaucguagaaaugucuaaaaaugaagauaaggaaaauaaacaaaaguugcccuaaucuaucacccugagggcgcugcacccugggcuuuguuccauguacuucuggguauucuggguguaggcaguauagucugcuuuauggagcggauuuugugugagugugugagugugugugugugugugugugugugagagagagagagagagagagagagagagauugagagagagugugugugucuaugugcacauacgugugcgugauuugcaaaugcaucucuuauucuuggcuguuuguucaugcagcacgcuugccgggugacacuuuagauuuccugaagcuccggaagcuaaagugaaaagcugcuucucucgcucccugaugucccccacccccaacuccgccugggucucuuucaaagugcucaugcauaaaacaacacacucccuuuaauaacagucgaucacacuggacagcuguuguguaauucgcuguuauuuuuuuuucucccuaaauacaugggcaucuucuugagagagauggauaucucugucugaagcuauuucgcuuuucagucugucagagggcuccucccucccucccucccucccuccuuccaucuccuccagacaggggauucaccuuugccuuagauucacuuuguagcuuaggcuggccuuaaacuuuuggucauccuccugucucagccuccugagugccaggguuauaggcguguaccauuaugccuggcacuggucucuguuaaccccaaccuucuuagguugggaggugcggcucaguagcauagccauuugcugagcaugcucaaggcccuuggucccuuacccagcacuguuaaaaucauucccuucccuucaggugugaggcugcauuggcguuaagcggcccugugauuagacccccuuccuguuccugugcaugcugccuagcaggugcucugcccguggcuauucgugccccguccguuuccucgggggggcggggggguuaacaucuagaaaugaaaucagacaugagguuguaaguacaaagcagcaugcaccaugcggccugggaaggucugaucaugggagcuggcaccagccaugugggcagcugaccuguaucugcugucaucugccuuucuuuuuuuuuuuuuuuuuuuuuuuuuuuaagauuuacuuauuauauguaagcacacuguagcugucuuaggacaccccagaagagggcaucagauuucuuauggaugguugugagccaccaugugguuacugggauuugaacucggugaacucaggaucuucggaagagcaguaggcguucuuaaucacugagccaucucgccagcccucaucugccuuucuuaugugauccugcaaaauacacagccagggcaccuuagaucaggggaaaaccugcauuuuugcuuguuuuguuuuguuuuuuuuucuucugggcuaucauacaauguauaauuuaauuggauggugcuggcauccaauuaaaucuaugcuugguggcuggucucccuaaaaggccugccacccgcuaacaaaugaccugaugcccuuugcuuguuagagacaaucuccccacccccaccccccgaucccgguuuuuaaaaucagauauuucugauguucccuuuucuauguaagucuccaaaggggugucuggccuucuucggucucauuuacauauuuggaguugcuagucucugcaagcugaaggccuccaaggcuucccauccauccccuuaccucuccaggaguccugccugggaaucucagaagacugguggaggucuucuguggacuugccauucacuccugccaucgcuggccauguguacagagguugaaauaugucugguaccauuggaagcuaccuuuuguauuuuaguagguuuuucaagggccaaauucagggcucagcaaaaugguucagaggaugaagacgcuugucuccaagccugacaaccugaacuugauccugggaacugcaugaucgagggagagaacugacucccccaaaguguucucugacauccacaugugcagcaugguguguguguguguguguguguguguguguguguguguguguguguguguauacaaauaaauaauguaauuaaaagagaaucaaggggcuggagagaugacucagccguugagagcaguuguugcucuuguagaggaaggaccuggguuugguuccccgcacccacaugguagcucacaaccaucuuuaacuccaguuccaggggauccaauguacucuucugauuuccauggacauuagacaugcacauugugcauauacguacacacauacguauauacauagguacacacaugcauuuauacguacauauacacuuguagauagaacguucauacacaaaacaucuaaaaauuuuuuuuaaauauucaaucucaagacuuuugacuauuacuugcacaguagugauguuaucagcugucuuagucaggguuuuacugcugugaacagacaccaugaccaagacaacucuuaaaaggacaauauuuaacuggggcuggcuuacagguucagaggaucaguccauuaucaucaaggugggaucauggcagcauccaggcaggcauggugcaggaggagcugagaguucuacaucuucaucugaaggcugcuagcagaauacugacuuccaggcaacuggaaugagggucuuaaagcccacauccucagugacacacccacuccaacagggccauucccugggccgagcauauacaaaccaucgagcauauacaaaccaucacaccgcugucuacuuugagaggugaugacauauaaaucgccacaguuaagaugguuagacaggggacaaagucaacagagguugggauugagagggcaggugccaugugacccccaugugugagaucccccaggaauaaaaccccuagagacagaggcugauggcguauauuccuauuaucaacucccaguacccacacagcggcucacagcuguaugcaacucuaguuccaggguauucaauaccuucuuuggaccucuguggguacaugcgguacacauacacauauacacacauucauauaaaauaaaucuaaaagagcauucaaguuguguuaaggggguuaaguugguaaauuuuguguaauauauuucaggcacucauugcuaccucugcaaacaaagcuauugccucuuccuuucuugcucaaggaggaacaauaggugucaagaaugaggguccuuuguucucuaccccugaucccuuccugugggugacuagggcaccagccuccccuccccucccccuuccccuccccucccuuucccuccucuccccuguccuccccuccccuccccuccucuccucuucuuuuccuuucuuuuucuucaaugaauuuauuuauuuauucauuuuacaucuggauugcugcccuccccccuccccuccccucaucccauggccuuguuucuugagcucugcuaaggguucacaggacaggguuggguugcuggauaaaggugagguccuggaaugggcacugcaaccaauagagcagccccacauuuuccugcacacacgcagggggucuguccacugcacacacacacagagugucagucuacugcacacacagagggagucuguccacugcacacaugccccagaauugccauugaguuuucucuguaguuugcagaugguguguaccuaguucuacuucugggccuucuugaagacuacuuugucccccuucacaacuucuaccugacuccugacagcuuugaccagaagguaagugccuuauuuccugggagcgggcccagccaugcugccugggggagauagaagggaugucccuuggugccgaugggcaacuucagcuccucaguguucuuuagaaugugaagccacguaauaucugggauucuaucugagcuccucggagccagacugagaaaccccuuaguagcaugcaugccacuguaugaggcaagugugucgcuuggucaugcccccgacaugucuuucccacaggcuaauauuguuuuuaaugacgcuggucgcagcacccuggguuucucuguuuugggagccacuaaaugucaugucccgguaugacacacguguggcuuugcagcgugugccuccugcuucccgagccuggcuacgucaauuugcuucuauuuuuccuccuggcacauugggcuuuuucucaaauauuuacaauaguucuucugacucugcuggggacggguuccagggcccccuuagguaccgaagcaggcagaugcucaaguccuacaugugaaaugucguauacagcacaaagccuacgcauuuccuccuguagaugugaaauccugucugguggcuuaugauacuuaaugcaaauaugcagaugauauggaaaguagcugcuuucuguauuguuagggagcaauaguggagggugcuuguucaguaugcuacagaacccccagacacggucuauucagaguuggugucaucugaagcucuaugugugugugugugugugcgcacacgcauguaugcacacucgcgaaugugcauacaugcucauauuuguguguguuuaucuguaugcaugugucuguauguaugucuguauauguguaugucccacucuguguauacauacaugacuguauguaugucaguguguguacuuaugugugugcauauguauauacauuuauaugccuguauauaaauauguguguauguguauauauauguguguuuguguguauauauauauacacauauguauauguauauaugucuuuauguucaugaguguacacauauaaacauguauguguauucauuuauauaaauaauguauguuuauguauguguguauauguguucauguauucauguauguguguauguguccucauaugccuguguguguauauauauauauagauauauauguguggguguguguacauguguguguguguauguauauguuugugauuguguguauacaugucuguauauauguguguauguacauuuuauuucugugccugguuuucuagaacauuccuucugcagaagccuaugggcuggcccuugagugucucugcucauccugugcucccugcaguuaggucugucacugcagaguuagugccucacuucuggggacuuggcaaagacuagccuggguugcuugggacucauggcaccugccacuuuauuuuuccaaagugcgaggcccaugaggcacggaggcagacgguggcaaccgcggugggagccagggugacagcagagaacgggccaguguuuaucaaucugccgguuccuggcaccaagcagucugucugcuuguggccaaauggcguuccuaucgugccugcagagauagaauuggacagauuagaggggucuuggcaugcuggaguccacacuggggauggagggagaacggauacagugaggaaugagcaguacagagcucguuaggaccauggagcugcuggaauugcagacaccagagguuagacugucagaggugaacagguuugugcauauccaggccccuauguggcuguauuaucuccaggaaaucgugucuuucuuuaaacuaauaagaaggccggugagaacaguggauuuaaucagucgaacugggucuuuguccaaacaaggcuuuguacagauggcagaaguccauuccucaguuuggcuuucucuuugaaaccaggauggacaucuaugcaggccacugcccugaccuacaaaucaaggacaccuuuggugacgagcacacagcgagaggguccucccacucuccagggagaugggaggucaggguguuggacucugcaggcaccuggggccuccuccucaggcaggcaugggaauugggucccuuucuuacauauucccguguuuguucugaccuuuuccuccucgggguaguggugugggucgucacagcagugauugccacgccucuaugaacccugaccuguguauuugucuccuagucguaagggcugggaggaccaugcccugcacugaagcaggcagugccucugaucagcucuguggccugaagcugaggcuccuuugcuuuggucucgggcaucuuggugacaucucaagagugcugaaggagcaaagauuuggcaagcagaguagggaguuguacaagggggugcucccucaagcguagcagaagcagguaucuuuaaccaaagauaucaggcuggggaguguuguucaguugguagagugcuugucucgaaaacacacauucugggcuccgucccuggcaauguguaagcaggcacagugauaaacaccggugacugguggaggcaggaagauuagaaggucaaaguuaucucccuauacuuagaggauagccuaggcuaaaugagacugucucagacaaagacaaaagcaaacaguauuagguuggaggacuagcucagaggcagagcuugugccaacugcacagggguuaacucucagcacuggggugggaguggggguggguggggguggggugagccacaggacugggcagcccggacccuguggauuccugccuucuguuaauucauaauugacauuguaagggagauuaucgcuggcauuccuggcucacucauaguggaguggcagacagugcuacuacuggagagacgguuggucacuaugaacccuaaggcccguccagcuggcgccugcuauguccuugcugguuugaugguccaucuccccacccuccuuggcucagggcagauggaggcugcacaugguuugguuggucuugaccccuguagacuuuaaguaagacaaagaggaucccacucagagcuucuccagcaguuagcagaaaggaagccucaauuccauggguaggguagggcagggcagggcagggcagggcagggcagggcagggcagggcagggcagggcagggcagucagguaggcagauguuaguggccagggccagggaccuccaugcuggcccuugagcuaaccucaauuccaacagggucccccaauugccugaaggacaguguaccccacagagacacaguccaggcaugcccggcuugcccagcuccuugguuaucugacaagguagcaugaagcugcccugugcucagaggaguacccucaggggcugagugccuuugcaagggacuuguccucccucagacucaguuucccgaucugucauuucucaccauguaguagaugcuggcucagaggcagcacuuggaucugagucauguguggaggagggcaaacugggagcugccauucuuacaucauucuuucaggucccuggcaaggggaagagggacuguugugugguccccaucgacucccugugcccuguccuguguccuagugggcuuuguacaaagaggaagagucaguccuuucuauacagaaaaaaggauuguguggacauggccggguguuagggacauggaccuuacuggcgcugacccugcuccugucuugucccugacaggugcacaacguggccuuugccuuugaacugaugcuggauggaggccucaagaagcccaaggcacgcccugaagguaacacaccaccagagcagcuccaagcauaagacagggacagcaggggucagggucccaggcaaccuguauguccuguggauagauagguggcaggcaucuuucuccuacguggguggcaauagagccuguaguuccuggagucuggccucuucagucaaugcuguuucuuuuugcagauguggugaacuuggaccucaaguccacucugcggguccuuuacacgcuguucaccaaguacaaggauguggagugacggagcaacugauccuccagggacaagugcuaggccagaaaaauggguguauccauccacacaguccuugcuuucccagaaaacaccucccuggggaggccucaggcuucccuggccucugcucccuguccccugccugguuugguuuuaacacccccccaccccacccccuuccgccgugugguucccuagcugguuaggucauugagaacuuggugcuucaaauacccucucccguuuaaguuuaaggccucacuucuucuuuuucucugccuccccucccccuccccccccccccccccccccggagaaagaugaaaaagagcaaaggcccagccuagcccucggcuggagagggcuguccaccugugcuccagcccacagagcaauuacugcaacagcccuggcuccagggacuccgccccauuuguccucaggaauccccugggcuggccucuccuuggaagcaagggucucaguaaaaaaagauccucucaguuuuucacuccugagucucagaagauuuagacuccugaugugugucuccacacaccccauccccauccgucuugcgguuugcugcuuuuaacggaccuuuuacaugaacucucaggacccagaaugccuuggggccccgggguaguguguacggugcaugucugggucucuugcuggcucugaaugugcagcuucagagccggcuuggaguaggaaccuccugucucggaggcccuguuagggaauggacacauuuuuagagacuuuacaagaagguagggauccauuacaagggcugccugaccacaggcuaccagcgagcagccagaauuacagaggccgugugucugacugcucuggaggcugaggguagaagguggaggugcuggcaggcugccuuucucugccuucacaccauuccuccuccuccuccuccuccuccuccuccucuauuuaucuccucuucauuccacaguggaaccauccccugcaugaccucgcugaccccaugaugucagcaagccaccccucccuccccccgccccccagucgccaaaugcagccucccuccgaccagccaggaauugguuugugggcugugucucagcuggcagugggaccuaagagauguccacaucccuccuagacacugcugguauccccuacagcaugaccuauaagagaaaauccugcugcucccucaagcccuucaccacccacuucccuugacucuggagguggugccauggccggcuggcuccuugucucaggaauccugcuucugugguucacccccacccccacccccuucucacguuccuccugccucucaccugccuuacagcacuguucauggcagcuuacaggaaaccuuccuuuccugauucccaccuuaccacaagacccagggcuguggggugagguguugcuaccgagcugaacgccagcaaugauguuccagaaaacauuuuaauaucuucccuugguuccacugcugcuaagcuggggacgggucuuggaauagccgcuccgguggaggaggcuucccagcaggggagagagauaauuaaaauggcauuaccgugucucccugugggaugcggugacauuaaagagccacacugacaaaauacccgggacuggaagguucugugcugccuuccucgcagacacagaaccacagcaguaucugggagcugcugggaccgcuuugcucugcucacaggcggucuggggcggggauccuagaugcaaagaccuaccgugcugaagggagggaaagaauuggucugggacgggcgguggcuuccugggguucccuaucuggagggcacaaguccugcuuggaauguaagcaggcuccuuugccugaggcagaacuugggaagccaggguucuaugaaggugugaccucccccauugacugagcguggaggugugguucucacacaccagugaagggcuggccuuaccgucccuucacugcggagcugccauucauaccauagccuggacaaaggcaccaauaacuaagaugucuaggccaacuucagggccacccgcguaaggcaaggcuuucuucguagaaaaaaaagagagaacccccacccagaugaccucaggugaccagugcccacccccaaacuuucccacaguucucuggguggggggcugggauacaaauacuucucuuugagcuguuaauuugagggcauucuggaaccuucuacugcuuggaucuucauucucuccugauauuguugagaggucuggccacuaaaacucuuagaaaugucaucaucugucacuuccauggggucuugaggaaggggcaggcaggucugcacccccugcccccaggucugcaggccaggacuggguuccucccuucugcccugcccugauuggcacauccccuccagcucuccagccuucuguggaccugcaggcagcucuugugccaccuucacacucaguugugcaaguccugagcucaggcccccugcauccuuccucauuggcugaccaaggggaaucuuauauccaagcagccgaauccguuacguccccugugcggccgcgcuuuauugucuuuuuaauuguuugaaguaauguguccuuuggauuucuggauauuaaauaaaaaccacuaaacccccggcu

SEQ ID NO: 7916 - RNA, 1067 nt, Mus musculus
uagacaaaauggugaaggucggugugaaccguauugggcgccuggucaccagggcugcuuucugcucuccacauggcaaaguggagauuguugccaucaacgaccccuucauugaccucaacuacauggucuacauguuccaguaugacuccacccauggcaaauucaauggcacagucaaggccgagaaugggaagcuugucaucaacgggaagcccaucaccaucuuccaggagcgaggccccgcuaacaucaaauggggugaggccggugcugaguaugucuuggagucuacuggugucuucaccaccauggagaaggucggggcccacuugaaggguggagccaaaagggucaucaucgcugccccuucugccgaugcccccauguuugugaugggugugaaccaggagaaauaugacaacucacucaagauugucagcaaugcauccugcaccaccaacugcuuagccccccuggccaaggucauccaugacaacuuuggcauuguggaagggcucaugaccacaguccaugccaucacugccacccagaagaccguggauggccccucuggaaagcuguggcgugauggucguggggcugcccagaacaucaucccugcauacacuagugcugccaaggcugugggcaagaucaucccagagcugaacgggaagcucacuggcauggccuuccauguuccuacccccaauguguccauugugguucugacgugcugccuggagaaaccugccaaguaugaugacaucaagaagguggugaagcaggcaucugagggcccacugaagggcaucuugggcuacacugaggaccagguugucuccugcaacuucaacaguaacucccacucuuccaccuucgaugccgggcugacauugcucucaaugacaacuuugucaagcucauuuccugguaugacaaugaauacggacggcuacagcaacagggugguggaccucauggccuacauggccuacauggaguaagaaacccuggaccacccaccccagcaaggacacugagagcaacagagaggcccucug

SEQ ID NO: 7917 - RNA, 1067 nt, Mus musculus
cagagggccucucuguugcucucaguguccuugcuggggugggugguccaggguuucuuacuccauguaggccauguaggccaugagguccaccacccuguugcuguagccguccguauucauugucauaccaggaaaugagcuugacaaaguugucauugagagcaaugucagcccggcaucgaagguggaagagugggaguuacuguugaaguugcaggagacaaccugguccucaguguagcccaagaugcccuucagugggcccucagaugccugcuucaccaccuucuugaugucaucauacuuggcagguuucuccaggcagcacgucagaaccacaauggacacauuggggguaggaacauggaaggccaugccagugagcuucccguucagcucugggaugaucuugcccacagccuuggcagcacuaguguaugcagggaugauguucugggcagccccacgaccaucacgccacagcuuuccagaggggccauccacggucuucuggguggcagugauggcauggacuguggucaugagcccuuccacaaugccaaaguugucauggaugaccuuggccaggggggcuaagcaguugguggugcaggaugcauugcugacaaucuugagugaguugucauauuucuccugguucacacccaucacaaacaugggggcaucggcagaaggggcagcgaugaugacccuuuuggcuccacccuucaagugggccccgaccuucuccaugguggugaagacaccaguagacuccaagacauacucagcaccggccucaccccauuugauguuagcggggccucgcuccuggaagauggugaugggcuucccguugaugacaagcuucccauucucggccuugacugugccauugaauuugccauggguggagucauacuggaacauguagaccauguaguugaggucaaugaaggggucguugauggcaacaaucuccacuuugccauguggagagcagaaagcagcccuggugaccaggcgcccaauacgguucacaccgaccuucaccauuuugucua

SEQ ID NO: 7918 - RNA, 1144 nt, Mus musculus
guuuuuuuuucuuuuccuguuguauuuugcucaagauauuuucccccaaauuaauugagaaccaugauguugagaccucaaaacagggcgacugagcacagagggacagggaggaaaggacugcaacuugcucccagggacuggagaaaauuaaaaaauaaaaagaaaauaaaaaagaagguuggaauccgucagucuucugugccagucauccucgccuuugcccuccucuccuugcuccccuucauccucaucuucuucaccuucauccucaucuccuucuucaucaauaucuuccaaccccuccuccucuucgucgucgucaucaucaucuucugccucuccuucuucaucauccaugucgggaaccagauaguaguacugcacgggauuuggccagaugucaucuuugaugaccucuccuagcucgucagcaccugcgucaggguggucaguaaaccagguaaagaagcucucaggcucuccgugcugccucuuccugcuggccuuauucugcauuugacuugagcguuuugucaaauccuuuccagauuucuauuugauuucgguggacuuugaagacgggucaccacucucacucagaugaaauucuuuggagagaacuuuauuuucaaaguaaggauuuucaucaaaauaaaaaucuauucuguuaccugguuuaaugucuucaaauucugucacuucagcucuggucauuaaugcagcgccuccucguccuccuccccaggcagugcagauacuuguggaugguugacaaauguuguuacccaaaaauuugggauuuuggcgaucaauucugaccucuucugaaaaaugguugguggaauuuguaauauuuuuguucuacuuucaaauuuuccucacuggcuuguucauugagucugucuauuucauuuuguacuucaucaguauguucaauugcuucuugcuguucuuuuuuucccuucggcaggccgggagaggcccacuugcccuccagcuucggggcagcagccggucuggguuucuugggcugaggcaggaucgcagauugccucuuuggggccauggcgcgagggaggugaccgggagacagagcccagagcccugauguucacagcaggaagaaacucacaggaauucu

SEQ ID NO: 7919 - RNA, 413 nt, Mus musculus
ccuaaaagcgaagcuucuggaaaaacccuuuguucuucccugucuuguaucgcuccucaagcuugaccuuggccucuugccuggccuugcguuucaaagccgggucccugaacacauccuuguugacagcugucuuguccaagagaauagccacagagugccuuguggguaugaggugguuguaguuauaaacuuucacaauggacuugaacuuggaucgcuuggagauuuucuucuugcccauggcagcugucacuuuuuggggguagcagucaauuccagccaccaggacacggcuguaagggcgguccgaggugccauugucaauguucuucaugaugacagcuuuguguccggaguagcguccagccaggaccagcaccacuuucccggguuucaugaacuuuuccauu

SEQ ID NO: 7920 - RNA, 4728 nt, Mus musculus
ggcggaacuaguacugugggcgggccacgcaggcgcucugggggucccggaggggagguggugaguuugcggggcagugugcugcaggaacgcgcguggcuagcuggaaauguccccucuguguuccggcucgcuggaucuguccucggugccucuggaagccgaggggugggggugggggaggcguuagacacccagcacggggagggcugugcgcggguggcucggaccgugguguauauggucgccaggcggagcccuguugaccuggggagacucagagcgggaggaggaggcucuggcggagucccacuauccugggacugucuccugacugucaccugcugcaagggcagcgcgcccagcagccucggcgagggccugugacgugcgaauuaagauaccacuagcuagguucgcgcacacccaaaauagaauuuccguuuuagacgucagucgggacaucugucaguuuccaaggcgcacauaugcuccuuucuggcuccaaagcucgguucuguaggacgcaaaggguuagaggcgggcgcgcagcuggggcuggagcuggggaugggaacuuugaaaggcuaguaggaauuccgauacagcucgauacaaauccaagaaucgcguuuucucgaacucaucagacagcugcuguugccaucagaccacugacccagcaauuuacggagaggcggggccuccaaggccuugaauauagaagugccaucaaacaguuaagaaugcagccuuaucaaguggacuaggauacaccuccccaccccaaccuccuggugagccaauagaaacacccaccgugggcuuuuuuccagcaugcccugggugcugauggguaagacgaaggacagaacugaagucuuuauaacuuuccuguaaacugaccugggaaaggcugugauugcuguauaaauucaucugccuggaucuuucaaggggaccaaaguuucagacuaacuuugguagggcaggaaaguaugcucuauggcaagagcagauucuugcguccagugaagggaggcggcaggaggcacgugaaucuguccuuaaauaguaucagagaggccaguacaccuaagcacaaguaaaugcguagccaguguagcagaagaacaggaaaggcaaacccacuucacuuacuggguugauucagcaccaagcagcacaagccaagcauacguguccacaaugcugccuuuaccuuuaccaccuuaccaacaaaccccaguuuauaacucagauugagaccacaaggaagagcaaagaaacagcuuugcugccaaggaccaaaauaggcacagagccacacacaguggagauguuagauagaccuaucagauggggggcguuuaaagcaagcacaguuaagauguugaaugugcuaguggagaagauguauauaccaugcauauauggauggugauuucagcagauaaauaguagugggaaaaacaggaagaaugccuucaaggggccugccagcugaugugacugaagccacugaacuugaagguagucuauagaaauuauccaaaauggggcuggugagauggucugacagguagaggugacugcugccaagccugaccugaauuugaucucagaucccacacggugaaaggugagaacugacuccacguugguaguguggcacauugcauaccuaugcaaaaucagucaauaaaaauauaauuaaagggcuggagagacggcucagcagguaagagcacugacugcucuucugaagguccugaguucaaaucccagcaaccacauggugguucacagccauccauaaugagaucugaugcccucuucuggugugucugaagacagcuauaauguacuuauuuauaauaauaaauauuauuaauacaauaauauauuuauuauaauuauauauuaaacaauaauauaaauaaaucauauauauuuauauaauuaaaaaguauggcuagcaggauggcucagggguuaaagacauuuuaaagcugaugacccaagauuaauccccaggaccuacauuguagaacgaaagaauuucugcaaauugucuucugaccgauucaugaauuucaugaaugcaccacccucuucccaaauaaaaucuaguuuaagucuguggggauguaaaaucauacucucaugucacuguagcccaggcugggcacagucauuccugugcacuuagcaaucccaggccacacugaccagguguuaccugcuccgagcuugcgcuucccaguuagguaggcucacgcuuaggugagugagcgaugaacagcagucagagagaaaaagugcagugguucuucgguucugauggugacaccccuaucucuugaucuugcagauggcaucugagacagagccccgcccccugggcacguuugagugccagcuuugugccuuaucagcuccuuacagcuauguggggcagaagcccccagacacccaggcuguugugugaguauucguccugagccagugugcgggagacucugugcaguguuacucggcaggcgcuauguggagugugacaccugguuugaguguuguacuuuagacggguccuuguccuuguucuggaugccucagguauaucccaaggaagccccaggcaaggcuggauaucuuuuuaacucuucuucgaggacucucugcccucccuguggcugcagcugagaguuaaggacuuguucuaugaaugagguggaagccuuauggccugggccaaauagcaauggaggaacuugguggcuuuuucauguggggcuguguccucugcugucccugcuggugauacuucugggcuggguggguacccagugguuccuaaggaccaacuucucaagggucugauuccuguaggucgggagcagagaugguuacaagcuuuguuuauuggauuguggcucagccuucgugaagcaucacgugagaaagccggcuggucugggccucgugacacagcagcaggggaccaggcucaauuccuuuacucccuggauuaugcccuucaguugcucucauucugaugugugugggacagaaaagacugucccacgcugaccucaggaggccaccuaguggauccugcuugcucugggguucacugagaggcuugcacugaacacugaaccucgcagagcugaggcugggucaccuuucaguucucaccagucaguaguccuccggccuuucugccauuaccuuacugugcaggggaaacuaguucacaucugcugagacuccugcugcuguugcagcccuaccacggcucacaauugcaugucccuucucccugcagccuccuggaggagagcuacaucaugaaagaccccuucuccucagacaaggccagguuucugguccucggcucucggugcagugugugcagcaggcuggugugugugggcccgguggguacaccuggggacuuccuguuuuuuguuuugcccuccccccaacccccugccgcagaucugggaacuuccugaucaccagguggagagauguggggguucuuagaugaccuccuuugggacacaagcacaaaggaaaggggccagugagggcagcuagagggucucagccccgagugaguaaaaagacuuuaagcaguugggccucagauuagcccagggaucugagaaugcccgagcaccugcugcagguacagugcacacaaguggggcucaccacagguggugcccaacaacugucacuucuuuuugcugucuggcugauguacgggauggcaggaaccuugggucccacuagccggagggaagacuauggagggagcguuugaggucaauaggaaagguggugggcucugaugggccucaagugccacugcuuggguuugggcuguaguuggcaagcagaaguaguagggguugccccaagaauaguaggcaucuuccccuuucuuggauuaaacaauacauuguuagugauguuaucgucaucucaaggggcugcuccucagaacuucagcugggauggcuacccugccagcccugggugcaccuuccuggcucagguugcugccucuguccucggcaccuguggggguuugccugggagaggcauugcugaggcccuccgaguuccagcccucuucucacuuacaggacugcagccuguucuacuccaagagggucugccuucccuguguccaggagaacaugagugcuuucccucaggaaauccagcaggauguagagaagagaaagagcaccagcaagaagcacuccaaccgucccugacuggcaggggcacagcccuccugcgaagcauugggcugggcucagccaggauucaggcugggagcuguggacccggucuucuuugaacuggguggauaccuccagccucggaagcugaggaacuggccagggcugaggacagacaucagggguguauccagcuggagcucuaggucuggccucuggaggccaggagagauggagagggaccuccuuugauugacagcugguagacacucccuguagaugcacacgugggaagacaccuagcuucucuccagacuuccaaacaacacaauguuaucugucuagggaauucagccuccgagggccagaggguaagcaagggugacgucacaucccuguaacuccuuggagaugauuuaaaccuugacucuguaucauacuuaucauuaaaaaccugaaggauaag

SEQ ID NO: 7921 - RNA, 16869 nt, Mus musculus
gucaaguguaaacuccaagcaugcuuuaauaaacuuuauaauuuaauuuaaaucuagaguauuuaauuuucaaacaaauuuaaguguacagucauuugcuauuuuacauacaaaagaaucaaaacaaaauuucuagagagcuguguuucagccugaugaaaggcagggaucagggcagccacggaggugggaggcuuagguucauagggggaccccaccacucagacacgagcaguauaaagggcucccccugucaaauacaauuccuucuaaaauuuguuucuccaggucuaaggccacaucagaaggaaacagaaucaacagcagagggcugugcgcugcucagaacuugagaagcggugaguccacguucucuuugucagccucagggcucagcuggaucaguggggagcccaggucgaucagcuggaagagaauggagagaucagggugaacacagcugucugugccuccacacaagaagcugcagugacugagccaaucccaccuggcccaaggacaggaaacagcagcaguguggcaaggagacucagucaucaaucacgccuaagacucuuaggagagaaaccucaaacccaucaacacugacuuccugacagggcaggcaggcaggagaggguugggaauacgacugcccuaagaguuccuccagguccagccagauaccugacggcaacgggugaccauggagaagccaagcaugagucugagacagacccugugagcccaagggcaccaugcagcacccagcccugccagagcccugggcugaagucagcacgaauccccugcugcugcucaccuggcccagcucagccuuugcaggcuuccccacaucauuucuacccaugucuggaguguucauuaugaggucaaucaggggccagcugcuaggucccaaggccguguucgacucagggguguugcugaagucgaugagagggcagucggccaggucucugccuccugcuucaggggugauggugagcugguccagcuugagguccaggagaagacccuaagcagggcagagagggaaagucggugccaagcaaccacccugggaagccaggcuuugcccaugacccgagguucacggccuggagcccaagggaaaggcaggcgugggcccucaaugggaguaaguuccucuuugggcaguguaccccuacccacagcuaguauagagcuucagccugucccuacuccugaccucuaaccccugaccaacuccuuugcuaagcauuuuugcccaggguccugagcaccucugagucugcuggaagcaugggccccagccccaaggugagucccugcucgugacucuccauguaccucagauggcguguggcugcaaccaccuccaugcaccucacugggcagcgugucuucaggaggcucugcuucacccugagcugcuccuguggaggagccuuggggaggaggggaggcacucuucucuggagaaaaguuaagugcuugaggcacggaggauggaggggaagagcucucaucugaggacaggcccugggccugcccaccacugccgcugccgcugcucuccugcgucagcucugcucugggggaaaaaggaggaaaacguauacgaucgcucuuuccaccccgaucagcagcgacggugugaaagcagcuucugucgcagaggcuggccacaaguggccgagcuaugaggauagccucaucugucagauccugccaucugugcaagagaaccaaacauuuccaaggcccccuucaccucgcugauucaucagucuagcuucaucuuguguccaugucugcccuuuucuuuaguuacuaagucacucagcaucggcuccaccucugcacacacacacacuguggcgagccccuccaggccuaggugagccaagugccugccugccugagugucccuucccuccccacugcucccucaggaggccagguuggaacccccgucaugcauggccuuccacacuacagcaugcuuacacuaacaggcaccuguaguacggcgugcuucccucuagccucgacaccuagcauguccccugagcaccugauggcucaaagcugaaugaacuguggaaacugaacaggaaccauuuccacaaaauagaacagaauaccggcuucucauggcuuaugggguucggaacaaccugaguuccuucuguaguauacuuaaaacauacacacacacacaccauucacaugacacaacacagccucacccuacacacacacacacacacaccauucacaugacacaacacagccccacccuacacacacacacacaccauucacaugacacaacacagccccacccuauacacacacacacacacacacaaaacauucacaugacacaacacagccccacccuacacacacacacacacacacacacacacacacaccauucacaugacacaacacagccccacccuacacacacacacacacacacacaccauucacaugacacaacacagccccacccuacacacacacacacacacacacacacacacacacacugccuauuugcacucugagccuuuugcuccacagaccuucuuuuccuauuucuccuauuugcugccuguaccuuccaagcacagggagaccccugaagucuggggaacacucaagacaagcuuauuuuuaccuaacuguagaucuucuccugggcucagaugagagucgccgggcaggcacacacaguggggacaccagagcccugggcauggacugaggugccauuaauggaaggcuggagagacgccgacuggcagguguaggcaacacugacauccgucuugugcucagagggguccucauacugccgggcaggccuuguggaguagucccugaugagcgucucacaggagugcugcugaccacccuggugaagacauggaggucuucaacacagaccacuguaguugaaagggcagccagggggccugggugggcucuguucuugagaagggcuccagcaugggcaggacucaaggcgcuugcagcccccccacguaaccuuggaugagugucaaguuccucagcaaugaugccuccauccuaguccacuccacccuguccccuagguaucuagaacaucuuugaacauggcuauauucaagguacccuccauugagggucagaagggaauuaaagagauacuugugauagaagacaucuaggcuccuaucagacucuggcuaagaagugaauugaugaugguuuuccccacuggccuaucaugcccaggcuuaagaucccugagucagggcuugggagauggcucagcaguuaagagcauugacugcucuucugaagguccugaguucgaaucccagcaaccacaugguggcucacaaucauuccuaaugagaucugaugcccucuucuggggugccugaagauagcuacaguguacuuacauauaauaaacaaauaaaucuuuaaaaaaaaaucucagaaucaaaggugagaacugagucggggagcuaggugcuugcucccuggcaguucggugccuuagccaccaucucacccaaauguuauuuuguuguuguucuuaaugcggagguugagucagguuguuacuagcuauggacuaaauguuuguauccuccaaauuuauauauugaaagccuaauccccaagaugaugauguaggaggcugggcuucaggggugauugggucagaaguuagagcacccaccaaucagcaugaugagcaucauuauuaagaaagaagcccagacacuguguuugucuuuccaugugaagaugugaugagcugagcaauggacccgcaucagacacucccacguacagaugcccugacccuguaugccacacccacuuaaauccccagaugcccugacccuggaugccacucacccacuuaaauccccagaugcccagcaugguggcacaagucaauaacaacaaggaaagggaaaggagacagagugugagguuagcccgucuacacagaaagauccaggcauuggcaugcuuguuacaguagccccagagcacuaagacacuguagugaaacaacucuaggucacaggacuaacacuaagcccuggcaggcuuagaagucaucuaccaacuuuaccauccaucaaggacaacuucugugucuuucagagucuggaaacaaacuuuauaaauagcacgagaugaacaccgggcggcuuacucacaucuaggcacugggugcucucagaucaaggcccaggcccaccgcccaagcaccuucuacuguggacacuguggcucugcuacaagcgccaaugaagacaaauaugcccacaaugggaccccugaugggacccggaaggcaggaguuauuucacuuuccagguagcugagacaugggggugagauagucuucuaguuugcuuucugucacugugauaaacaccaggaccaaggcaccauggggagcuuauguggcauacaguugcacaucugcgcucaucucugagggaagcugcuaccuugcucuggagcugguucuguuaacugcaugggaggacggccccucagcauggcuacagcuuuacgggaagcugucuagucuggaaacccccagccccugaaguguacuuccauggucacccugaggaugcaaccuaagacgugcugauggccucagugaccagggaacuucugaaauauauugaugcugggcucugcucccuugucccaacucccuccccaacccacugagucaggagcuuuggggguggucuaggcucagcaccuaaagcaauacugaagggguuucugugaucuggccuggguucacccagcacacagugagugugacagacggccucuaccucagaagcuugaccugcagcccagguggcacuccauggagccuacagucacaucaguagcucucaaaagguaagaaaggaggcaaacuccuguuggcuaccugcucgcugguguccaggacugcagccgauguguccgugagaacuuugggguuacuccuccaggugacucgccuaagaacagggagagccaaucagaagagagcaacgccaggcagugguggcccacaccuuugaucccagcacuugggagacagaggcaggcggauuucuaaguucgacgucagucuggucuacagagugaguuccaggacauccagagcuauacagaaaaacccugucucaaaaaaacaaaaaacaaauaaacaaaacacaaaaacaaaaacaaaagagagggagaacaacauggcaagccuggcaugugcaguaccaucuaggcacucuccucuaaacauccccacuuucccaacuguccgagucaaguaaagacagaaggccaaugagacacucaggaaauccucuugagaccccagcuggggccagggccaggucugguacugagagcacucuguacuguuaggccagcuacuuucccuaacuggccugggccugaguuucauggcaggcuccucccuagucuccucuucuggcaggcugaucccugcaccccauguccacggaaaucacguggacagagccccagcaagcagcaaagccuucaugucccugagcuguggcaccccuagcuccaagcacaucacauacacauucuauaggugacaagaaucuuuagguggaugucccagcugcuauuugacagucagaauucagcaugggcucacuagccacuaagcaaagcccagcauaacccagauggccugucauaccacugucccuccaccacacgauuccaugugaaacacaaacuugccucccaugauccugagagucaaucuggggcuccaaagccucaggagcccggaccuccauguauuagcuugcugucuuagaagccacgggcaaaguggccccagccaugaaaggggcccaucuuagcaagcgauugaaggccagaugcgcuccaaaacaauacugcugaccacacauuuucuuaauuaccgacugaugggggagggcccagccuaccaugggugguuccaucccugggcugcuuaagguaugagcgaggagagcagcacccuccauggccucugcaucagcuccugccuccagguuccuguuucgaguuccugcccucacugccuuugaugaacugucauuuggaacucugagugaaauauaccccuucuucccaacuugcuuuuggucacggugcuucaucucagcaauaguaacucuaagacaggcuccagccuaugcaguccugcuggccucagcagaugcacacagcagggucauaguguccucuauuuagacuuugacacgggagggaaaucaacauccuuuuuuuaaaaaaauaaaaccagguugugcggcuugcaguagggucuauuccaacugcauucuugccgcuaucuucccguuccucugggaacucaagcacauuuccgccauuggacuuuuccagcaucauuuccuccaccugagcguucucuuuggguucuuuaguggcugccucuucagugggcuucugaucucagcucagcauuguugcuuggggugacuauucuagccaaaagaaccaccccaucugugccugguauucuuaguugucaccuuguuacaugugagugagggaagccuccaucagacuggcauuuucuccauugcuaacugcuguaggaaagggcccagcccacugcgugugguaccauccuugggcauuccuccauggucuuugcuugaguuccugcccugacuucccucaaugaugaaacuaugacguggaaguguaagccaaacaaacuccucaaggugccuuggucuugguguuuaucacagugacagaaagcaaacuagaacacuaucuauccuuuuccccagacagcuggagcaaagccacacagagggaagaacucuagaagacucuacaacaucuccugaaagggcaguugcacagcgcagcgucaggcaaugccucaaggucaaggcgagcaacuaguggagagcaaggccgaggaacagcacaucccacccagccugaguggccggagcaaaccaauaggacacuagcagugucugcgcagaaccccacgccugugacaggcuaaacugcacccacccuauacccaucuguggcaggcugcaggguggagcaggcuggacugcauucacuggcugccaaguucagccccuuaaggaaaacauaauucaggcggugaaaaacacagaaccacagaaacggaaccaccaacaucaacagaacaaggacgcucuaaccccaggugcgacaaaagccacagcugcagacauaaugaccacacugaggacaacagagagaaagacgcaggccaagagcaguggcucaucuagagggauggacacacaagugggcggcagaacacacccuggacagaguaucagagcuaaagaagcccaacagcaccagccacaccaggaaccucuccaaaaccuuaaagcccgccacgauguagcucuacucaccaacagaaaacuggggcacuuuaaauggguuuguugugguagacacggccucugucuugcagcucagauaggagucccgucguuuuaugcugacaguuuuauucaacugaggugucucggugucgggguccagccuugguccucuuugcucuggagucugggguuguugggugagaggacucaggguggggaccuugggcugcucagccacugucugggcagcaucagccuuauuggcuugucugccaaacacccuggcaggggcugcuggcaaagccuggcgugacgcggcggguccuauucugccugacuugcugguacucguccgacgcugggagccgcuagcaggaauacuugaacguuguucacuggacuuugcugcaagagucgaucaucaaggcugguuacucaagccaguuuccaaacaguuuaaacacacacacacacacacacacacacacacacacacacacacacacacuuuagacugucuaccuaacaucagacccaucaggcaaugacuguugggaccagcaggaugcccaaaccugagcugaguaccaucuaccucucagcaggagugugugcauucacaaggcuaagcucuucuuucuucacuuccuugaugagcagaagaaaguggacagucugcucaacuagcaauggaccuacucugugaguccacagugaagacucaaggggaaauuuuagggacuaaugcuguagccaugucuaugccauguguuagcccuacuagguccugccccacaaucucaucugacccuacaguuauuccauaaacaacacauggugccagugucccaagucaguggagaaagacccaucucagcuccugggcagggcagccaugcauuguccugaucauggacucauggaccucagaagggucguugagcacuuccagacucauaggaacuucccccaaggccaacaggaucaccugacuuaaagguaagggcacagaugguuguuaaccaccgaguagcagucaggacuccagaccaggcugauucgagagcucagacuucucauaucuugugaaaagcccucaccaugcgccaguggacaaaaccagaauccacaggcaaaccccagaugcauucuccggucccuauaccacuccaccacuagauggcagccuuguuuaggcagguugagcccaagggcccaugccccaaaggacucaggcugggcucaauggcccuguguucucacggaugcauagcucgugugaacaaccacauuuucaugucaguucaugagucuguaugccuccagcugagaucaccucuccuuacaggagggaaguauucagggcagcaggacaaugagucuaguccugccuagcccucagcccugagcuguaacucuacagcauucugugcagccaaaacaaguggugcucagggcucccagggagaguggagcugcucaccuuugccugcuacugaagaccuguagacaccagacucgaggcuugaagcagacccugagguagaggacuuccuugugagauugccaguauagccagguggcuuuaacagggucuucuuuagccccaacugagagaaaaguugaaaaauuagccaggauuuuguuaacuacacacauacuuacuucugcuaaaguaggauuuuaggauaaucuuuagugggauuagagagauggcucagcagguaagagcacuugcaacucuugcaggaaaccuggauucaauucuuagcacacacacaauggcucacaaccaucuauaacuucaguuucaggggaucugacacuugcuucuaaccuccucagguaccagaaacacacauggaauauaaacauccagacaaaacucaugcacauauacuaaaauuuaaaaaucucaaaaaaaaaaaaaacuuagaacaauaauaucaaccaaccagaccccccagaacucccagggacuaaacaaaggagaacacauggcuccagcugcauauguagcagaggauggccuugucaagcaucaaugggagaagagguccucaguccuaugaaggcuccauagaugccccaguguaggggaaucaagagcggggaggcaggaguggguggguggguggaggaauacucucauagaagcagugggagggaggauaugauuggguguuuccgggagugggggaaaggggauagcauuugaaauguaaauaaagaaaauauucaauaaaaaaaaucucaguaacaauuaucaucuuuauagaaaaaaguaauauagucaucccucaguuucugugggauccuguggguacgaaacuacauggauccuccaaauguaauagugugauaauugcaugggaccuacacagauccaccauggaccaguuaccucuagaugccaggugguggugguucaugccuaauucgagcacuugggaggccuggaggcaacagaucuaggcucaaggccugucuggucuacauaguaaguuccaggacagccaaggcuucauaaggaaaccgugucuggaaaaaccaaauaaaugaauaaauaaacaagcaaacacccucuaggagauucuaacuuuaauguaacguuaagacugcuguuggaccauguaaggcagccugguuccugguugagcaaaggugagaaaccccggugacccugaagggauggaaggcgguuugcacugcuccugggcacccagcuucugacacucccacagcccuccauagauuuauggccaucagccacuuaagggcuacaccccaagccccuucacagguagaggaccuauggucaagacagaucuccauuuuaaugagguaccuuaaaggccuggaggcuuagccaauaaacucuucuucccagacacuccucccugaaaaaggucuuuaaccucaggcccacccugagacaugggguguagccucccacaagccugaagcaggcugaacuagaccuugacuuugcuuaccacuaaggagaucaccuaggguggagccugccucccuggaucacucuauuguucugccacugccgcaguuccggagucuacauccgauccuacacguggucaccugcagcugggcuccaaggaugauuuggcgggaaugggcuuuccccucuccuuuauaaagcguguccgccauuaaaaauuggaaccuugagcagauuagcuugucuugguuccauuauuucucuacccacauagauucccuuucucuuccaguuacaagaugccuuccaggcucgaaccuggacaugagggccgcaggccggccccaacaaugggguaccguuuuacccauccacuuuccaccaugacaaaaaaaugucuuaaaacuauggacugccucuuuucauugggauccgcuguggggagcaauagagaaggcuuucgccuaaagagucaccaucuaaucucccacagaggggccucucuggguccccagccaugaccaccaagccaagccagccgcccacugucaagccuaggacucauucccgugggaucuagccauagcuucuccccuuaccccccucggcccugggcuagauccagcccgagggcccccacucuguucucaguucuuccgagacucccagugguaccugggugcccaagagccugagagccagacggugccagccuccuugcaggccugggaccccugagccaguucugacuguccugugcuucaggcuguguuucccuacccccggagcuuccccaccccuggagugcugucccugaggcuucccugcagcccaacacuuggccggugacagcgugggguaagcgggguaaguguagucaaacucccugugucuuggcuccccaagccugugguggaguggacacaggaccccaauaacccuccacugugcaagccaucacacucauucaggcacacugauggggagaagcuauacagguucaggacagaggcaacuucucuuuuaaauagcuucaaucuggaggcccgacugcgucuagaacguaauguguaaaccucugcuagaggaaugugcagagaacuagcagcaauuaagauugcagacuuccaacucagaccucaaaucagcuccuauaggcucaguagcagcuuuaauacaugcuuucuaauaggcagcucagaguaccagaaaggugacagucucuaugucugugagcucugaacacagaacacaaaacccaauaccucaaguucccauagaggcggagggaucagugagaaucagcugcugggaacaacagcccaagugacaaggccaguucacugcacauggccaggccuguccucuccgcagucuaacacacacacacgaagauuaggggacaauugcagaugacuucccauucuuacauuuacuuuggauacagggucucacuguguagucccgguuggccuagaacccacuaugcagaccagguagagacccaccugccucugccuccaagugcuaggacuaaaggcauacaccaccaccauggccagcuacuguguaguuuuaaagacagggucucuggcuggccuggcacucaccaaguuggcuaagcuggcuaaccaacaagcuaaccccagggauccaaguguccucugccuccccagugcugggauuccugguaccccaccacacaaggcuuuuaaaaugugaguccuaggguuuaacuuauguccaugcauuuauuaaauaaaaacaaaacaaaaccuugaagaccuaauuguaaucaagauacuaaacuggcaacacguuccuauagaacaaguggcagcccuguagugccagccaacucaccuugccaggaauggggagugaccgcuugccuggguggccuucucgacuggcagcaucuggagcugugcuggguuuguccuggagcacgucacucugggaucccuuuucauucacgaguuucguccucugaaugcuggcuggcaccucuuuuuugagcugaaaaugucgauuugagaggugaagacuaccuggucugacaauuccagagcuggcaccgcucauccuggaugcugccccucucaacccauccacuagugugagagaaggagcacugagaugagacuggaccuccucacugaagcagugucaagacuagggcaggcggccugcagaaggaucuccaaggcuccuccuuugucaggcccugacuuaagagugccaucgagggguccagacauaugguacaugccucuaauuccagcaccuggaggcuaaggcaggcagacuucuguagguuccacaaagccagccuggucuacacagugagucccauggcaguuacauaguggaacccugucucgaaaacaaacaaacaagccuauacucucuggccugcaagcccagagcaaagcccugacauagugaugcaagggcaucaggaccuucuccucgugcacacgcagcaaggaugucgagaaggaaggcggugcaagcagucgcuucagugugaggccaacagcaaugcuccccuuguagcgcuuccugugacccgaagcuccccccugggacagacucagugauacugucauucuuuuacuaaaaaaaccuaugccacuaucggaugugucguuuuagcuaucuguucaucgguuaaugggcaucugggcuggcuccauuuguuggcaauucugcgguugugaaaaccucguguuaagcugguugaugacacuacaauccugccugguauccugcaugugcugugacccacagccaugcauggaucacacacaaauucuguuccauauccacgugcugcuagcaaucccacccagggugucuuggugucagauguggucaggagagggcucacagauggggagaggggccgugcagggcuucaccuucccaccaccucaccgucauuccuuuaacuguacccucaguacaaaugaggcugcuauggggcugcuuggcccuacacucuagcgagccuuuacucuguguuuccucucgggagaccuccgucccccuccucugcaaaccuggaaguaaguuaucucugacaucugccuuucuaccuacccccaacuaggccuccagggcccugaguuucccacaacuggucaacugccauuucccugacauucauguaauacccgggcagaagaaguauaaagucccagccauagagaacagccagagcccaaugugaggggcagugcuccccagaggggcccggccgggcagcuccccaucacugcugccuucgcuguccagauucugguucuauucugggcuuuccagugcucagagcgcugccccucccgagaggcuucccuggcagggcaugggcugaagagaggcaaggaggcuguguacaucgcaacuguacuaugccuggguuuaccuucucuguagccaggugaagguuucuuccucucacaggcaaagcccgagguggcuggagcuugcuggugauccucuuuugaggcccagccugacuuggaggcugggagguacuugauucucuuggcaacggcugagaggaacagggcagacccugguugcucugggucugagcagggccugcugagacaggggagcugagcaggccuggagaagccaggagcuggggcucccccaugggcgguugcacccucgaggauggcaggcagaaugucucucuuuuaagugacaugggacuucugucucucuucuguucuuucucaaagaggcuuacuuuuaacugugaguccugcacaaacguuuccuugcccugguucacaggauuuuggggcguggcagccugggccaccucucuucggcugugacuuucuaucuguaaggccaguaagugggcuucuuuguacaccuccacaaacuucuccccagugagagggcucaaggugcaagggcuaccagagcccggggcaagaggcugcccaggaacccggcgguuuaaguccaaacuggcagcaaugcaucuuucuuuauguccaacaggcccaaaaaagacuucaucaucuucauuugugcugcguuuaaagaaaaagauuaucagggcugaaaucacaccagcaucuaggcgaggggcuuugaugaaccugucuauaccagggguuagggaagaaaacgcauguuuaccuugaagaagacaaggaaagaucgaagucaaauuuuucaucuuccaaaagaagaaagucugggguggggauggggagaaaaaguucaguuauuuuaggguaacauaaaacaggaaagcacugguuucacaguugcuaugaaucucucaguaaaguaauagauuguugccugaauucaaucaauugucaugggcaccucaaguccuucuuauuucccauuuccacucucaaguuccaggagccacucugagugcacugauccaccaucaaaacacagaaccuuaccucuaugauagaaucuaggguuuccaagaaggcuaagucaccuucaggcacaggcuauuuucuaaagaucaacuacuuuagcuagccuggaauucaauuaugagacaucuaucagcgaugaguucaaagaugguucaaacucacaguagagaccaacgaguaucuguggagcaccacugcuccucgggucccuuuccaaaaaaacaaaacaaaaaagaaaacaaaacaaaaaacaaaaacaaaaaaaaccccaaaaccuaaaccaaaaccaccaacaaaaauuuugcucugccuauccacauuccuagcauagccuugguugaaccaacuguggauuuauucagcucucucucacagaccagccacuucccaguaguacuuaaaggucugcuucaccggagggaaccuacauaauucaggacaaaauccuaagguggaggaaggucauaggcuucauuaaggaugcacguuacagccugguuaaguugcauucuaaaccuuuauguuuaugcucauaaauuacuggacugggcugccagccuaggucauuagaggugcuucuuauaaugggcaucacuguguuaagcagucuccuaaggugucaaagaggauacauaaccugauagggugcaaaggcccagugcucagcccuaaaagggagaaaauaauuguaaacccacaucaacccucuaagacucaggggagcaaaguuacuucccaccacaucugaugaccugaguucaagcccugggacccucaggugcuugcacaccuugguuaccacccccaaacacacacauacacauacacacacacacacacacacacacacacacaaaccaagucaucguaaagauuccuccuccccucuuuuagacaggguuucacuguguagguuuacaaagagaacuaacuguucuggaacucacucugucgaccaggcuaggcuagccuugaaauaaaacucaagagaucugccugccucugcaguuggggcauuaaaggcgugugcagccaccacguagcaagucuugcuuuucaaagaauuugccagcacucagaaggcuuccgaagguggcucucgaugaauucaaggccagccuggacuacagagugaguuccggguuacaaagugagggcucaaaaaaacaagcaagaaaggaaaagcaaacaaaguaagucaguggaggagaaaagaaugaaccacaggggaauggguggagugagggacucugcgcucagugcaagagaaagcuguugccauuuugauagcacagcaacugugauuaaccacaggagacccucacaagauuaagacccccacuuaaagcccuucuggaaguggggggaggccccucuuaagauuacauaagugguuuuaaaaaguggguggggauguuguaggggcuucuuuggugguggagcuaugaauugcuaauguccuuguaaguaacuucaguuaaauuuauuugcuuaucaauccagacuucguuucuuugaucuguuguagcccucucuauuuuguuuggggugaaaaggaauacacuccagaacagccuuacgaacagaaaggacuuaccuucuuuuuuacuaccagcauccaucuucaccucucucuccacugguuggccgaaggcacgucgcggccgucuccuccuuccacagaguucgcugcaggaagcaaggggacgggagaauuaggcaagucagaggcaagccccaacuugcucccgguuucccagacugugcgccccgaggcgggguaacggauuuccggcucugagcugcagagcuggcaccgcagcccguccuccccggaucucugcggcucgggacccgguuccccacucuccgggaccagcgcuacgaccacuccuuaccccucgccucugaccgggaaggcauaaaauccagcugggucuccggcaccgguuuaaacgcggcgcccggcuccgccggccgccgauug

SEQ ID NO: 7922 - RNA, 1431 nt, Mus musculus
cagucugcccggcggugacgcggggaggcgggagcgggaggcggcgcugcgucacccgguacgcagagaggguggcggggacccgggaggaggcgaccagggugaggacaggagaagcuagacuuggggccagagaagaaucagaaacagaggagucuagggagccuaggaugaggagcagaaaaggccuaggaaggaacgggagggaggggucagaggaggggacugagggaccuggcuguggggagggcggucggagcggccgggugcccugaaagacacuagucugucgcucuggcugccccuggguccugcugggucugcacgagcgacgggguagggagggcugcaaagggacgggcggagucccagcagcgcagaaauguugcccgggcgguccugggcaggcgauaggaggccguggaacugcuggugugcgcccaggagcgauuugaccuugggcauccgucucuuuuuaggucuuggucuccuggcggcuagcaagaguccugcagguuagucccaguaggcaaaggaaggcuaggauggagaggacagggguuaccuuccaggggaguggaagcuucauguguggaugguugugggucuacagccaccagagagacgggagaaggcgucuucuuaucagucaccugacuguacccucccaaacaggccuagggaaccggaguugcugcucuugaugcagcuuaacaugggacaagcugaacauauccaccucagggaggucuuccuggacuccgucucccccagccaaagcaucccaagacacagcagggcaaaauucagcacugcacucauugcauaucuacccaucuuugugaaaauuccaugggcaugugggcuugucccuuacugggucuccagugucuaaaauggucucugugcauaauguguuacucagauauugguugcgugauagcaucuguucacaucugaccaaggaagagucuccucggagaugcuaacugguccaagagugcagggcucuguggugugacagagcuaagccucacagcggagucagcuuucaagaagacaggagagccuucugcccucccccucagcucuccugcuguugcagacugggguggagcuggccaagucuaccuugccugugccugguaccagagggcuaagguacaggucugauccugucggugcccuguguccaucugcagggcagggacaaccaugaaucacuugcuuccuggaagcccagcccaaugguaggcucccugacagcccuggaguguugguuaggcccaggcagaauccuagccccacccuggagcaagcuggaccugaccuagcucaguuguuaguugaagcaauggcugucccagcucuuuccuuucacggcuaucgggaugaggcuuggggaauguggacaugaaacuucuucagaaa

SEQ ID NO: 7923 - RNA, 910 nt, Mus musculus
ugucuagaagucugggucuugagaauauagucagggccuggguuaaacaggaagaccauaucaaaagcagaaaaagugcacgagacagcugucgugaauauguuucucaguaguaaaggccacaaguuggcauuaccaguguuucacuaaagcuccggccugagaugccagccucucacccuugagucuaagaucauagaaauuuuacaccaaucacguaaguaauuucaaguagcuacacuacacagcaaaaagugaaaguaaacauaacaauauauucuacagaacccaauauauauaaaguaucauuuaauguaaacuuauaauuaacauuuccguauuaagauuuuuggaucuugaauguaucuuacaauuaagcacacuuuacugcggucuuggaagcacgcaagcgccggcaagaugaagucuucgugucuccgugccuauucguuuuucagcugaagcccaggcagauccccgccaucgcuucagaugugcuccgguggaagucgcuuccuucaccucacugugcaguguuuacugauccggggucaaugcccuggcgaugaggcuuggaccacacuacagcgggagaagcucuccauccucccgcucgccuguccgcccgcagcagggucccgaucugccugugcuccuucugguucucgguacuugcugguuggcugcgagcaaauaagaccgacucggaccccagacgcacgcggcuccggaguucauggccggggaucagaggccgggauccagagaccucaguccgugccgcucgacccgagcgcucucagcgccgccagaacauacgcagcucgcagacuccgcuuuccucccugcgcuacagccacgcacauaucccagcgucgccuucucauggcgucaagcacugcccgaaacg

SEQ ID NO: 7924 - RNA, 910 nt, Mus musculus
cguuucgggcagugcuugacgccaugagaaggcgacgcugggauaugugcguggcuguagcgcagggaggaaagcggagucugcgagcugcguauguucuggcggcgcugagagcgcucgggucgagcggcacggacugaggucucuggaucccggccucugauccccggccaugaacuccggagccgcgugcgucugggguccgagucggucuuauuugcucgcagccaaccagcaaguaccgagaaccagaaggagcacaggcagaucgggacccugcugcgggcggacaggcgagcgggaggauggagagcuucucccgcuguagugugguccaagccucaucgccagggcauugaccccggaucaguaaacacugcacagugaggugaaggaagcgacuuccaccggagcacaucugaagcgauggcggggaucugccugggcuucagcugaaaaacgaauaggcacggagacacgaagacuucaucuugccggcgcuugcgugcuuccaagaccgcaguaaagugugcuuaauuguaagauacauucaagauccaaaaaucuuaauacggaaauguuaauuauaaguuuacauuaaaugauacuuuauauauauuggguucuguagaauauauuguuauguuuacuuucacuuuuugcuguguaguguagcuacuugaaauuacuuacgugauugguguaaaauuucuaugaucuuagacucaagggugagaggcuggcaucucaggccggagcuuuagugaaacacugguaaugccaacuuguggccuuuacuacugagaaacauauucacgacagcugucucgugcacuuuuucugcuuuugauauggucuuccuguuuaacccaggcccugacuauauucucaagacccagacuucuagaca

SEQ ID NO: 7925 - RNA, 21581 nt, Mus musculus
cucuugcucuccuuugggaugaguggagaccugaagcaucuguggcuacugagaaucuagagaggacaggaaaggguaguucugagugugagcuccaggcuguguggucccuuguccucucggccuccauccacguuugcugcauuugcucaguagucauccccagagcgcugcuuggcucagguccuguucccacccucaagggcagcucaagcgggaaguggcuugaggugggggcaacaugagacucucuguuaugggcaccugcagaggggacagggaagagaaauaagaucaggcaaugaggaguaacaggagagaaaucagaaguguguugccauuguagccuagugacuacaauccugcaaaaggagaaggggaagacaggcagggacagcuuccuuuuuuguucccacuggagacccacugacagacaucaggcagagcucagggaauccugcaggagagagggaggaaggauuguaggauccagaggggucaaggacaccaggagaacauggcuuauaacauuaacuaaccagagcccauaggggcgcacagagacugaaggaugacagucagggagcuuguguggaucugaccaagguccucugcauacauguuaggguucauagcuuguguuccagugggacuccuaacagugggagcagggacugucucuaacucuuuugucuacuuuuggaacccuuuccucccacggggucaccucauccugcccugaaugacgguauaacuauaauuugcuauauaguaagcaaauuaacaggaaacaggcggggauggaucugggagagaggggagauggggggaaggauagagggaggagagaggagaaaagaguaaauaaauaaaauuaauuuugaaaaauaaaacagacaccaacaagcugggaaacagaugaccaagcuuuggaauuaacacgggucagggugaaaaugaucgugagguuacagaaaggguuuuagucaugggaaauggccaguaccaggcuuguaaguagaugucaaacucaugauucuauuuaaaacuuuccaaaauaaacaaaguucaccuuuagcuuaaaaagaggagaaaugaggucuguuuauaaugguaaagaaaucaguaaguaaaaacguguggguuaaaagccagagucgagggcgaggaacaugacuugguggguaaagcacuugccugagcccaugaagagcacgcccguccuccugcacccccuccccagcugugagauaggggacagggcaggagaaucccuugagagauggcuagucuggccuacauagagacccugucucugcaagauggaaggcaaguuguccuuuggccuccaccugcaccuuugacacacauguaccuuuacacauaugaaaacacacacacacaauuaaaaagaaagaaauuggagcugauaaguaaguugcuagguguauuuuagaggauuuagaacugccagugacaggcaggccacuaagcaggugugugaagaaagaggaguuuagauauuuggggagaacaugaaguccuaagauugccuuggugauuuuuuuucaagucccgcagucugguagauccauacuuuguggaugaguaagacaaggcuggagcaugccuguugcugcaggcauguguccuucugggagcuugucuccacaguucccacagagagaacuucauguuccauuucacugagcucaggaacaucagucuguguccaucuuggacacuggacugcugugcagugugccucugucugcccaucagucucccuccaugccuguauccaucccuggccuccauagaucucugagaugagauaauuuauagauaauaggcacacauuuuucaugguucuggaggcagggaugccuaagagcucacgggcaaguuuggggucugcuucuaagcuggugccuuggugcugugucuucacauggcuaaggcugagaauggaagggacuaaggcucaaugccuugguaaggguguugcucugcuugugagggggacuaaauuccuggaaauacuaacuucucuuaguacuagcacguugaagacugagugccacuguaugaaugcuggaggcaucgaaacugaaguguggaguaaaauguggguuacaugagguucacaggucaggcaagguucacagauuuacucaccagacaccagguaggaacacaagcaugaccgaauagagguaacgaguaugaaagcaagcccgugugcaggucagauaacagucuaauuccucucugucuaaagacagauacucuugaguuuaucaauguacugaucuaguauuuuauaaucuauguguaccuagguguguugagcuaguucguuguuugcaagccuguuuguauuggagucccccagucacauacaucugggcuccaaugagaagagcuaaugaccaagccuugaucauacucaugcugagugggaaugucacugagaccuggccagaucaguaauaggaaggaaaggcacacagggcaggcuccccacauauuccugacaagagauacaauggaacaugcucucccaagaguaaaugagggaccacacccguuagggauccaggaacuuaggcuuuuauugugggcuggccauggggcaucgucuacccucuaaaaucagguaagaaacucauguuuugccacaugcgugugaguaguucagguaaacuagucuuugccuuuagcaccuauaaaauaggucagaagcuauguucccagaugccaugcaagggguaaccacuuucccaccccccucuauacaacauccugacagugaacuaaaggcagaaucaucuggucuccuacaauguacaguagcauuccccaaauguaagagaaggaagaacagcucuguuuuuaaaucgacauagcgauauugucuuuagagugcugagaugucugaaacuggcagccuccacuccaguccaagggauggcacacacuucuuugugccgugggcccauccccuauauaaauagcuggcacaggaccaggggaagccgacuuagcaaaggugagucagacccuuccccugauguaagaguccagaacccugaaucagcucuaggacacaggcuggauuggccuccuugcuugucuguggcuuagaugaauggaacaagucagagcugcuucuagaagcaccugcugcagcccacucagcacacauuugggguagcguuuacaucacuuucaugucacuugauacuaaaauguugguuuuuaacugacaagagccucgggggaagguauugcccuagauuauucugagcauguacugacaacguaaauguuuguuugaagugucacaaauuaaagggcagguaagaaucagaaauagcuuguuuuggugggggaugggucucagcuggaacuaaaacacacccuguguccuuaauauacagggaauucacacagagaaugaauaaaaaggaaauguccccauggaaaaugaaugaagacacccagaguggucagacaugucacugaaaaauuacgcaaccauuuagaaaaaaaaucuagucauuaauauagaacugaaaaugaacacaggcgaugcuguccgcaggcagcacuuuguagaguguacuucaagaucagcagguguagagcagagcagacugcacugucccuccuggaggcccacauauagagccuuucuggagaccucaaguccucagcggaccucugaucccacaccagccugugguccauggagaauagguuacuuacagucugucuccaagccaugugaauugcuguuugaaauacuuuguaacuacccaaacuggucuuaaauaaccucgauggcuuuggagaugcugggcacauuucuguggagaaaccugguccagaauuacguuccuacucacaggaacagcaaugaaaagauaaucccagauuggcucguguucaaagcucagagaagucugaacaaaaggagacccaguauaguaugaucauugcucagauugggcuaguaguaucuagauaauuuuuuucucuugguuggcccuuucccuucaguucaucugcuucuggacauuaugcacaguugugauucuccaacuagggcagugccuacuuucagagcagccccugcucuguggguucauggcuuaagauugguacugagggaugguaggcucugagagugggguggggucaugagaccacacagcaaggcaaguggaugcagcaguucucccacagaucccaagcuguaugaaguacugggguggcugacgcuuuuucucucugguagccacugaggaaaccucuagaacuguugccuauccagggaugacugucccugcauagucccugugucacuacccccugggacaggcuucuuccuggugucauuggugucccgucugcagggaagagaguuuuaagaaaucacgucugagaaauggguguggaaucuuuauccaaauggaucaaaccucagcccaucaccuuccaguccccuuccaucagggaugagucccagagccuagcuuuucucugggauccacccaaagaucuacacagcuccauuccugaaucagagcuuccuuaaguacccagacuucaaacagagggagcucuggugagaagccaccagaaagacuacacccuguuccgcccccccacccuccaucccacccccuaucccugacaaccugacuuuaccaaagagaaggauucuggcagaaacccaacagcugcagcauguagaugggcccugccugcugggcuaagauacuaucuaucccugaggaaugcacagccucuugggacacagacccugagcuccccuuuguugccucccgagcagccucagagcaguaggcuccauggcuaaggccuuggccuguuagcauguauggugucucaguaauugaaguugucuucagccuggugacagcuuugaaauucugcuugaagguguugggagaucacuuacuccauacucugaccuacuuauuagaaggaccauucauagguccuguggauacuugucugcugggagugggcugaggcggagcauucccugcuaccuguccuguaggcguaaauccagacaacuucuaggugucugucucgagcucagcuuaggcgucagagaugcaggcagucgguauguuuuaacgcagauuauuguucacacauaaaaggagaaacaacucacagccagugaaccugacagcugaugauccagcuggaggugaugccacugggauccagagcggggcucgcucccugacagcagacaguggggagagauggcacaguuuucaaguuccacuucccagcacacagcaagccuguguguccguccacuggugggaaaagggacagcaugcacccugcagcagguguuccuuugaguggcagaggcuagggcuuuuguguuugugaggccaggucagccaggaugccagacacucaagggucaccagggucagagcuaggccagagacaagagauccugguggaacugagguagcuagaaaggucucuuacugcuggaguaccugucuugagggcacugagguguauuggagaccagugugugcuggggcugacugcagccuggguuuuacugcccuggggaggcuuaucuugucugggcacucuugugcccugcuucugguugccguucccagagugcugcuggccauacucaggugcuugcuucugaugucagcucacuaugaugucagagcaccgacaugggugcuuccaccuuguuuucuuacuuucuguucuaaguguucacuaccguguguuuugccucccucucuugaggagucugugcacuuguacuugaaccgcuguccuugugccugccugcccuuuucucucaagcccuugaaccacagcuucccaucuagggcuaggagcaaacauggaaagaccacuugaagauggcaggguggauggcacugguccugacauaccugcaucuguauggcuuugcuggcagggccuuauagcaucucucugcauggacuacugcugaccuuguaauuauucaaagcccugcccugccuccugggccaucuagcggacuugaggcagcaugcacuuuccuguccagugccuaacugaauguaugaauagccacuguaagcuaauggcuuuuacggguugaugucucucuuucucucacacaguguacccuuaaagcagcaaaugucacaaaaugccaaacuaaagaucaucuuccucaucguuuccagacauuuuuaaagacaaaauuggucaauagaaaagagaucuuugaaaugaauuguuauuucuucuuugcuucuggcagguuguugcaaagugagguguagggguagguagagcugccuguggugcugaguagggagggcccugugcuguagugugaggguguugcugugccuggcuagugcacugugguguggugugguguggugugguguggugugguguggugugguguggugagugaugcugugugggcagcacugugcucuaguuuguguuugcuguuguguggggcuggugcucuguagugcaguggauauguugugugaggcucucaugcuguagugggguguguugugugggguuugugugcuguggugugggugaguuacuguguagggcuugugugcuguaguguggguguguuguguggggcuugugugcuauaguguggguguguugugugggguuugugugcuauaguguggguguguugugugggguuugugugcuauaguguggguguguugugugggguuugugugcuguagugugggugaguuacuguguagggcuugugugcuguaguguggguguguugugugggguuugugugcuguaguguguuauguggggcuugugugcuguaguguggguguguugugugggguuugugugcuauaguguggguguguugugugggguuugugugcuauaguguggguguguugugugggguuugugugcuguaguguggauguguuacuguguagggcuugugugcuguaguguggguguguugucggggggcuugugugcuguaguguggguguguuacuguguggggcuugugugcuguaguguggguguguuaugggugcuugugugcuguagugugaguguguuguggggggcuugugugcuguaguguggguguguuacucuguggggcuuguaugcuguaguguggguguguugugggggggcuugugugcuguaguguggguguguuacccuguggggcuugugugcuguaguguggguguguugugggggggcuugugugcuguaguguggguguguuaugggugcuugugugcuguagugugaguguguuguggggggcucgugugcuguaguguggguguuuuguggggugcuagugugcuguaaugggaauguguugcuauggggcucccgcaguugccugguguauuuuaacuacuuuuaacuucuugaacagaacuguggggcccaugcccuggccugccauguccugaugagauauagugagaugcaugagggacacugccuauucuuucuggccuuguaucagaucaguuguggauacuuccuggccucagacauccuugcagagagaggacagauucuuagaccacauacauggggagacccuacuggcagguggguccuggccugcaauagggccauuggacuaacagugagaugggccaguuaugauguugauaguuaggaggaggggcauuuuggaaaauaagagacagcaguucuucccugaguuggguagcacacagacacacaucuaaguauguggggugggcagguuacagucggcaaacucugaguaugugggcuauacauacauacagcagaucuuuacccccaggcuuccacggagccuucucuaguucucugucucacucuugcccagugagaacauccucagggucuggggccaugcaacgcaggugacagagcaacaaaggugggagucaggugcugcugugucuccuagaaagagagggccagauugcugaggagacagcauguuuaggcgaggcugugagcacagccugcaauagagcaagguagaagugggagcucugagcagagccccugcaggccugcauuguggcugguggcugguggcugguaaggcagcuggguaggaacuguguugaagaggcagagggauguccagaauagcugggcccagaagcaggggagcaguggccacaggcugagggaacaggcugcuuggccccgugggauggcagagggagaugcguuuggguucaggugagagcugucugagaggagucaguguguagacaugggcugguaguucuaggccacuggcaauugggaagacagguaaguucagauauagagcagaacagggccugcaacugcaggauuccuaaccgggcagcggcaggaguguagggacagagaaagucagagcagccaaaagaccugcuagaaggaagggccaggccaagagauguaggagagggcuggaaguguuuguguucagggagagugggagacuuggguaugggggacagaaauuugugccugauuugacuagcucccccggggggacucagccucagguagucaucucagcucuaagcaaggccugcuucuuugaggacagcuguugugcagagccuaccaucccaaauucauguuaugggacacaguuuucauggagaaugagcaggcugagugucuugugucacauccauccuugucuguguucccugccaccccugugccccgugccaugguacaguguuuguuuccuggccugcacauucaaauaugggcagucauuuucuuucagaccucagaagauucgcccuccuuauuaagcccuacugcucauuaugguaauagcggcaggcauugaagaucugagccauuucugagcgaaguauccugugggcuacaaaguugaauagcaacuuucuuaucaggagaagugauuaaaggcugaagaugaggcacuagggaagaugaaaggagcagauugugggagaggcccccggugcuguacaguccuuacauccgagagaaguaaugagcgcugcguuccuguggcucagcggaacgaggaaagcacaagcccagcccaagaucagccuccuggcugcugcgcugugacuugcaaggacagccugauguccuacggaggucuguaccaggcuucacagcccuagcuggagugaacuuaguagcauacuagcuucaggaguguaugccaucaaagggcagugccaagcacagcucuggagcagcgccaggaagccauacccuggggcuugcugcccaggaaaguggcagugcugaugcaggggcaugccucuuuccagccuacugccgcaagugauggggauggggauggggguggggggcaggaacagaaacucggggacugggaggggacaugcaacuccucuuuccaccagccucuacccucuugcaaacauugagggguccacagaaagagaggcagcacagagggggugucugcugugucugaauuucucaucugagaaggaggggcucauccugcagcuucuucacaaacuugaaaacacacacacauacacacacacacacacacacacacacacacacacacacacacucucucacggagacauguauucacaagcaugcaugcaugcccucaguauuucuuaggaaacacgauaugaagacuguggcuguucuuuuccuucuuuguguggaaaaccaagccuuucucuuuacaaaugggaaauucaugcugaaauagucauaaggaaaaaugauuucuguuagcacaaugaacccugugcuuuagccauuuaguuauuaugucuuuuagggacaccugacuuucacauuaggccagcucacucuugugugcauaaagaaagauguaugcuugugugugggaagggggaaccucuguuucaugguccugcagccaaaugucaugagaggcugggacuguguguucucuagagccuugggaggcacucggaguguacuugcagagugugggcuacccauggcagggauggccaagucauuugccuucuucguaguacuuggacccuuccuuuggggacauccagacuucaucuuuguccugaguugccuuccuaacacaacacuguccucaguuucuuaauguuugcaagaggguaguggcugguggaaagaggaguugccugucucuucccagucccugaguuucugcuccuaccccacccccacucacaacccuugcggccgaggguccaccugcccuuuuaguagucaccaccuuggagagguaugaggguuguguuaguucagaccuacugcaaucacuucuuuaagaaaugaacccccagacaguucucagagaaagaaauggaagucuagcggcuauagaaaaucaguuugagucccgugauugugcucagacacaccuacauauuuuacuaagccgucucgcucuguguuguaguuuaccuucuuugcgggaugagcagcuacaacuucaugcauaugccugaccguggcugggauaauggucaacacagacaccugaacaugugacgugguuguugaagguggucagauguuggcacaccuccaaaguacaugggagagcccagugcuucuagaguuagguguaguaggugaagaagugugaccauagccagauaucccuaaagaucauccguggaugguauauacccaugucugaagaggcugggcucucaucucccauaccugcuuaccaggucuauccugcccuuuuuuaaauauguugcuaaguccugucacuggguguuucagugugcaguguuagagcuuccugcaaauagcaggaaaaguuugaagacuaucaaccauuuaaccucauugggcauaaugaagaucccaggaccuucaggaugugccuguuccccaggagguagccagaguggaacgcugcagggcagcauuuccuuagguuuuuaagcagggcucagccgaggagucuggguacugggggaugcaggugggguaauggcccagguucccaagucuggaguuagucucccucucaucaaacucauccucaguguucucccuggccggcugcucccacaugccacccuugugugaugucaccucccuacauucuacaggagcuggcuccucuguucugcucugccuccugccugccagagugcagugggaaguuuccuggaguaucuacugaccucaccacuccucugugucagacuuccgugucacauacaugaaaaacugggcuaagaaacauggguggcuaacgagagcagugcuguuacaguuaguaaaacaagaggccaugaauuugaagaguaucgaaggguauauggggcaguuuggagggaaggaaggggaagggagaaauguaaauuauaaccucaauaaaaacauaagggauuuaauucauuugaaaaaaaaaaaaccaaaaaaacaaguacuguuuuaccaguacagugggaaagcugucuuccgggcaucaugagagcccugugggucuaaccuguccaccugaagcccacucuguucugcauagccuuuccaggacaggggcccugcagcaugcugccugaugaugcaggucaggagcugccugccccuccccugugucuucugcuuuuccucagcucuuagaguaguuugcauauaaagaaucccccaaguucuguuuuaaaggcuugaucccagcuggagcuagucagugagaagugauuauuagguucuagggcucugaccuaaucaaugggcuuauccauugauggguuuguaacagggaggugguggagaccaggagguagagccuaguuggaggaugugggucguuaggaaggguguguuagucccuggcucuuuucucucaaugacuuccugccccccccccccccccccccccccccccggugauuuagacaguucugcccaccgugcucucccauggugacuuuucugccuugccucaguccugagagccauggagucagcucacccagucaaauacacuuuguaucuuaagugauuuuucucagguguccuggaaauaaaaagcuggcugcauggacaguuguuacaaguggucauugcugugauuacccgaccauguaacugguuggaaaagucuggagaggaagguucucagccagcaguucucaacccuuucacaggggucuccacgauuauuggaaaacacagauauuuacauuacaauucagcacuagaaaaauuacaguuaugauguagcaaugaaagaaaauucugugguugggagucccccuaacaugagguuuaaagguacagcaguaggaagguugagaaccacuguucuaagcagagcuuaguggguuguucucaagggaguuuagaacccauaauguggcuaggaacauggagaguaaagacugcucauaggcuuccaaugggagggaggacucuguugggaagggaaccagaauccauuuguguuauacugcggaggggaacuugucugcauuuuauccaugccuggagacauuacaugaagcugaacuuggaaaaaaauucaagaccacaaagcuuccaggcuuuggaguugacaucgcuggcugcuucuagguuugcauugaagaugguuaaaacaaagaagggugaguaaaaccuuguaacuuguccggaagagaagugcaugccaagucaagacugagaaagcugcugccuaaagauauuaguaacaucagaaagaaaccaaggacuuugcaccaggacaggaguaaagcugccuccagggcaccucaggaauggcaggauccuuccuauggcacuaaagaguauaaaaguauuaauacauuaaaaagacuuuccuuugagaaagucaucccacccaggcacgcugugcacaagggccaccuaugaagauucauuucaucauucugggaagcccagauguccaggcuauuacagcuguggucuuaggagcccuggcagcugcuuggaaucacugccccaugugcugaugacuuuuuagguauggugaaugcagguggaggccuccauccagguuuuaggugaaauacugggaguacagguaagauguagcagaagcaucccccacaccaaagggcagcacaugaagcugugauacugaagcuguuagaugcagugaagacccaaggaaacuggagaugccagggguauggagugucugucauggaaagcuucagacagugaagagagccauccagggagaaaagccauguguucuauggcuuccagagcuugugugaagcuuccaggcucauuggagcuucuaccauaccacugugacccugaaugugcacuugaagccacaggguuugucuacacugcuagguuucagucuucuucuuuuucuuccuucuuugcccugucccuugcuuuuggaaugagaguguuuccucugggccauuguguguuggaguuacagauugccauguugaaauagcuuagcucagaauucacagagaaaauuuuaccuggguucuugaguugaauuugaaccauugaggauuccuggcuauggacucaaugcaccauuuaguuugaaauguaugugacccuuuuagaggccaggguggaauguaaacagcuuagacaugaaguacccccacuuuccccauggacagcacgugggauguguguauccccacuccaucauuacauugcuauuuaaaggggugggaagugcucagaauguagagaugcuuagcuucaacauagcacaucaccagcagauccagcuucucagugcguuucacuuugagccaagacccuugaugucuucaugguagaugucaguccagguagggauuucaacccaaccugcauguaaguguaugacaagguaucugguacagcuuuaggacauugagacuugaaaauagcaaauaccagaaauagcuuuagcaugcuuaggugauauuuauaaaaaagcaauacccuguguguucuaguguacauucauaaaguggauggugcuugaacauaaaauguagguuagaaccggucacuucaacucuaggugugcacaaaaucuuagcaucauagccaauuucaaacuacucacugcuaaauuagaaaaacauuacugcuaagaaccaucuucagcuuggagaggggguugugagggaggaguguuuggaagcagugaaagaaaugacuugaagucaaaugaugggguguaaaaugacagcucuguagucugcucaagauggcuuccuggacagcuuucuguagauagcucuuagcuuuguggucuguuugaguuaguguucuacuggagauagcauucuacucaagacagcucucuugcuagaaaaaauucuaaaaauccagaaaagcugcuagaaaaauucugaaagaauuguguucacucucuaaacuguucucucuggguagcucucucuaccagaguucccuuuugguuaucucaugaauuagcauuuuaugaccuuagcccuuugauucuuagaagaagauaacaaguauauuguuuuuuaaaaccuggcaaaugauuucagagaucugccugccuuuauaagcauacacaauaagcuagcugggugggaucuuauccugaaauugccauucccaccaugccuggaccuaaauuugcucuguccuaggcugaccaugaacucaggaaucugacugccuuuguaagcacaaauaauaaacuuagcuaggagggaucuugcccuuugaacaccacuccucaauuuucuuuuaucuccuuccuuaguaucuuucugacaagcugacucauagugcagcugccucuugucuuugaggucuauuaagccucucauauaauucauauuguguccauauauuuugcauaguugagaaauuauacauucuugaacucauguuuucagaguucuuucccacagucauaaggacuauccugaaggucacaacauuuacaauuuuaccaaggacauuagacauacccuugccucccaggcucaugcuucuaauuaucaugaagucauuaaucuuggcagagagaacaucuccugaaggagcaacauaaaguaaauuauacaaacaagccuuacauuuaacaacccuagcaacugucaauacugguugaggccuuaugcccugcuaguucugcuccaggggcaggaacugugucuugucaucccuucugcauggccaugcagaacuaggcacauuaccuuguucuuaaaagagaaaacaucuucaccauggaguuuuggcuguguuuugguucuguaggguaggacucugguacagggauguggugcuuugaaugagaauggaccccauaggcucauauauuugcauuccuagucaccagggaguacaacucuuuuauaggaguaggagguggggcuuuuuuuuuuuuuuuuuuuuuuugcaagaaucucaugcccaacccagguucucucucucucugucugugaaucaggauguaaagcuacucagcuauaccugucugagugcugccaugcuccccuccaugaugaugaugggccaaccucugaaacuguuagcaaacccccauuaaauguuucauuuuauaagaguugccuuaguuaugguaucucuucagagcaacagacaaaugacuaagacuauagcugguaccaaggaaugggguuuuugcuuuggcaagccagauuaugcuguuuguuggaugaguauagaaaacuuugggaguuuggacuagaaaagugguuggauacucuaagugggacuuaaugggccauccuaguaugaaauggaagacagcacugagggcugaacuguggcaguucaguaaagaaguuuuagagggaagaauaguagguggcuucagacuauucuuuugcuauuuuagugaagaaagugaguaguuuuuguccuuguccuaaaaaaauauauaccugaaguauuuuuggauuaauggcguuggcagaggagacuucaagacaaccuaguauugacuuugucauaugguuauuaguagccacuguuauacagaucuacaauguaaaggugcaagugggccagggagaaauacaaaauaugcagagugaggaaaaaaaguagugccagggaaggugaugcuggagccaggucccgugcucaagaaggaaaaaaacaaaaaacaaacaaacaaacaaacaaaaaccaaauaaucaaaaacaaacucaaagaaaauccuggugccaaaagaaauaaaagcagugguggccucagggcaagacccagcccagcuaagcuuuggacuugugaaagagauuaaaggaaaacuuaagcagggaagggaaccaucagcaauugaaagcugguacacauuuaacugaaggagggggcuaaguaccauucccagcaagcaucagaauuuggcagcuucugccuugucuuggcuucauuagagucaaagauacaagaaaaggguuguagaaucuuccugcacagcuaaagaaagccucugaggccagguguaugucaggggugccccuguguggacgcccacacgcugaagcugugaaagugaagccuggguuguguuaggagauccuaagcugugaguuaccugccaaggagaauugcuaacagaaugugguaccagcccaagagagaauguguugcagucaacagaacuaaaagaguuggugaucugaagagcacuuuagcaucaggcauggagaagcagaaugcuugucuugcuaguuuucagucuugcuuugguccaguauuuccucuuugugcuuuauguccucccuuuuggaauggcaauauauauucuaugccauuguauguuggaaguaugcaguccacauucugauuaggauuuuacagggguuacaguugagagaaugcuuugagucuuggcagagacuuuagacuuugaagcagucuugagacugaaagucuauggggacuuuugaaguuagacugaaugcauuuuugcauaaugauguggcgacaagucuguagggaccauggagcagaauaugguguuugaauaagaauggcccccaagggacaaaagccauaccagcuguuaccuggccaugcagaggucccagaaccugugcuugaugugaugccaaggacucugccacuugagugacagguuggacuguggauccugguuuuaacuucuauuucagguacuuugaaaugccaggcaccagaaugaauugcuuagugauaaugcauauuuaauaccaugaacaggugauuccaucagugugugauccucacaccaugugguugcacaagcugagaugguuauggcaucacuggaugguauaaucucauggggccauuguccuguguguuguucaucacugacauauuuagggucugguugaaauuucagcuccacaauagaacugaaaaacguaggaagugacugugguuguggacagucuuccuugggaagugacugugacuguggaguagcuuaagggacagcccuccuugggaagggacugugguuauguguugcuugaguccucaguccugcccugcguccccuugggggcagugggugagaaggggcgaaucaacugcucagacuccaggagccggugagaaugcggcagaaagcucuuuugauuaauucucagggagcacccuuuauacccuccacccuagucccguuggucccaagcaaguguguccucuuaaguggcaguucccaauuggcugucauugucugcgucaccaaucucugggcucucagacaggauucaguuuagcccucauguggaggaagcuggcuccgcagcugcacagccacacucacuauuuaccagaguuucuguggaagcagucaccgccuuggcagcagggccuuucugcuccuccuacaguuauguagacuggggcaguuuguagaugggaaucaguccucaggggugacuauuccuauggagaauagcugagggacagccuuccuuggaaagggacugugaccauauggaguaauguaggggacagcuuuccuaaaguaugucaggccccuaugugcauugccucacugugguccgugcaucuccauuugaagcucagggcuggggcuggcaggagggcagcagagcuucagcuaugccuccuggagcauagccucugccugggcaugugucagugaauccugucucauacagcagcagccuuggccagcugcaguuauuccggucccauguaucucugcaggucuacauggccuuaccugggcgguuuccucagauagguacacuuuccuccccacuucccuuuauaagagaacucucguguggggugaaguuggcaccuggaccccaggagccuuuucccuaggcagaagggcaacccaagucugcaucagaagaaaugugcccaccagugagcuggagggcagcugaauguucaaaacuuugccagcaucucucgcucauuugccuaugaauuaauccugccauuaaggaaaaaauuagacucaccacucaaaucauuaauugagaggccuuauuaucucauuaaugguguuugauauugaaggcagaugaacuaaaggaagcuugccugcuuggaccucgaagaaauguaauuacaauuugggcauuauuaagauguccccucugugcugucacaugucccauuuugcuuccuuuuguggacacugagaaaagucuuccuuggaaauaaaaaugacacagucuuagagaagcacugcuggaggcuggugggccugcagccugcaguuuccuuggacccaaggcucccugcuguccuugugggccaccugcugaagcaggucucaugggcagagcucaucacugccagcauuuggaggauucagccaaccuugguacacacugaccugcaaaugcugagaaggagagggccugacacucuuagaggugacccaaaugaaaagcagcaggcagaaacuggcuggacugguguguaccacgacgccaagcccugcagcaaucacuuccuugauuagcaaaccccugggcuucuugguggagagcugccgguacagugugggcgauaugguuuuguuuauuuagcauccagagaaggggcucaggcugggagacagccuccuggggcugcuggggaggggcagcucgcaccagaggggcuggcaaugcagugcagcccccugcuagcaucuaagacugacugcuagggaggcuuaguugagugguaagagaagccuagggugccaggcugaagacuaaucuccacucuccaagccuuagacaccuuacugugggacccugaacagccauuugacugcugucccccuuagacccagguagugcuaaggaugagcagccuccugugagggcacugcugaugcccaggcugcagacgccuucaguggcaagugcuacugaugcccagauuaguggugguggguuguugugguuaguguuuaauaucaauuggggguggauguuaugccccaccauugauuauuuauuucccacauaaaagacaccaaacuuuuauauuuauaauaagccuuaaauagcacuagagccuggcagauaccaaacaucuauauuauuuugucuacuuuccuauuaauaaccccgagauaugacuugccauguuccgccagggccucucuuuccuuguagagcuaggguuuccaccugucagugagguauacguagaggugugaggaaugucuuggagcauaacuguccauggcccgucaccaccuugguuacuugucuaucacccagugggccuucuagucucccucuggcccagaagcuaagggagaccaucaagcagaggaaguccagcagccaucucaucccaugucagggaaaaagucccuggaguuacagcuuaucaagcaaauauaccuagacucuagcucuguuuccugugcgccagcugaggaugcaugaucugaggcacucuguccgggaugagcagggguguugugagaagugcaggaccacgucuucagccccuagucuaccgugcugcuuuucuucccugagacgucagagcagggauggccaaagcuuauccuuugacugccuccuccaucuggcgcccauaugcuuccagugccauccaugugaguuagccaugggcuuuguaacagcacacccuggcucaggagccuguaaacaacgaacaucuguuucucaacaucuggaggcuagacauccaagaucagggcucuggggucuaacggcagaauuucuuccuguggccucaguuggaagaaggggcgaggcguuuguuuuuugagucuuucauuagggcugccgacccaugaagacguauucugugaucucaggucuccccuugucgacauauucagaucauagugagacaagagaaaagaccuggcccuaucaagggccugugcagucaggagcccccuucuccaugaccuagcugacagucaucaccacccuccacccccaguagccaugucaugccucagguuagguagaguaugagaugagucaggacugugcugacugcaaggcuguacacaggccccagccaccagcacugcacugacuggggcaacaacugccacugcugccaucaccaccucaucagcuucuguggugaccacaggugccacuucugcugccacggaccuaaugguggaggugacagucaagguuugccaaagaaugugaacaccucugucuuagauugauguggagguguugcaaaccugguaccaagggcaggggacugucacuggagcauagcagcucucagcuugugucagccagaccaccucaggcucuguauccuucacuccucaguccugagggagccugucugggagcuccaucccuuucugcuacaguauaagccucaggauaguacuguauagccucuucgugacuucuaacacagcuaagagcuggugacacagcagagaguagcaucagccuuuuuguaaguucugagugaauugugaaacuuccacucuggggugacagcagcaccuuuguucauaaacucagucaucccucccagcuuuuugaacuguggcuacccucuauggcuggcccaccuggguuggaacccucuggcuuguuugcuggguggcugucuuuacucguccaucccugguuugcuuggguacagugauccaaagccucuggagagcaguuccucuaaacacauguuuaagacaguuuaccaaggccaguaccucggcaaaggccuccggcacgagcccagguaccaugguagucacggcucccauugccucaugagucagaaacuuaccuuggugucuggaggacauccuggcugggauggcccuagauccucauugcucaggauaaccaguugcccagggaagcugaucaggacuguccuuguaggguccugcaguccugcugggcucuacccagcuccuucacacaggaugucuucccagcucuugcauguagaggacaggauacaagggccucccacuguuuggauaaggggaagcaccucaccugcagugugccagagaucuccacuga

SEQ ID NO: 7926 - RNA, 1135 nt, Mus musculus
aggcugaggcaggauccugugcagcagcccugggugucgaugaugguggugaucaugaacaucccaggaagagaaaaugacaagaagacaggguuuccccaugcagaggagaccuuccaggagcacugggaaaugggguaaggauugucucugcugagugggccuugaguuggagacccgaauguuuaucagucuucaaaagaagcagaugacuaagaggcccucucguuugguguuacagcagacagggacguuccuuggaacccuugacgucaccuaugaacuguaucaacuuuguuucccaguucaggacaugauccugaacguuugcaucuugcaaagcucucaaacacaauaggaucugggcgccuucacacugaggacucaauccauucccucaaccaagagcaagaaaaccaggaagggccugugauucuggcuaagaaugccagcccugauuccccagccccuugguaaggaugccuuuguuccucaaggguccuacgcccgugaugaaaacucugaacuauauagcuuuguuuaaaaaacaaaacaacaaaaacaaaaagccaaaaaacaaauaaacaaaaacuucuucagccccaccccaacccccaccucuacccuuugagcaaucucuagucugaccacuaucagaagccaugcagagagugcucagcucuguuccucccacuaggggaucaaaaguaacacaugggcuuuauccaggccuggcuggcuuuaacuugcucuacacaugggaacagcaucucucaucuguauggccucugcucuggcuccagcugaccaaagauccaccucagagccuuguaccuuccaaucuuaccccucagcacagcuuggggcugucuugguagccaggaccacacucucuucuguuugguccuuacugcuggaaugcaguaggaccugagccuugacuucacauucuguuucugcccaacacuuagggccaagauugguccacacuggcuucagcuggugugaugaagaagguaccucagugcaccugaauggccacaccagaggauucuguuuuuaaagaccucccagccccugccacagaaggagaacaucauuugcuuggcuaaugaaaguccucuucacauccaac

SEQ ID NO: 7927 - RNA, 33065 nt, Mus musculus
gcagcguccggcggcgucgcgggcggcggggcuggggcggcgggaggggcggcgggggcagacaaagcggcuaaugaaugggcgcgcccgucgcgcuguucgcagcccgcgggcccgcgcagcgcagcgcggagccggcgccucaggugagugcgcgcgggacgcuccaguggcgucuucgacggccggcgccgcgcagggguuggggaaccgcgccauuguccgugcgcggcgggccggguggaggcugugucccgagacugcgcccggcccggcccagcccggcccggccucugacagcugcgccucgcgccgcgggcgggcccaggccgcggaggggagcgaccgcgggacgccccgugggaccuuucgucaggugccgggcucccgccacgucguggcgucccccaagccggugccggugggcgcgcguguccaggaaggggcgcaggcaggcggcacggcggugacacgggucggugucacgcuucuuggugccugccuagcuugaagcgugugcgucugggucugaccgcggaggcuuaacgaaacuuaacucaacgcuuuggcuccguagcgucuucacggucgcaguaccugccgucauuuuuuguuccuuuuguccuuuuuggugcgacccacucgcuucugcccgggauggcugcggguccucgcucuccgucuggagguucucacgaggcuccagcgcgucuuuucaagucccugcagcgccgagccucaggaggagcggcugucgcgguucuggcguuuguaaaaagggaagucauuuguuuuugaaguuaauuaggauaagauuaaguguaguuuuuaaaaggacacuugugccuucuggcuucguaaagccagucagccaaggcaaguacauucuugugacuugguaggaagaaagaaauuuuccccuuuauaucguggugauaaaaauuaauaagaccagggaaauuuuaguuuugaguuuuuuuuuuuuuuuuuuuuuuuuuaguacucugaauaaacguaguugcaaggcacgaauuaauuccaugcuaagcagaauugagaagcuacaaguuuggcucuacacccugagggaguggcuugugcaugaagacauuggugcaugcuuucuguaaucuauauaaacuuuuuucuauauaaauuuuuauauagacuuuuuguguggcuuuuauuuucaugagaagaucuaguuaaaaauuuuuuugaaucuuuaggaaguuucaaagucucagugugcugauagguuuucaucaauuuacacaaaccuagacauauuuuggaagagggaacuuuuuuuaaucucuuauuuuuaauguucauugguguuucaccuacaaguaugucucugagggaauguugaauccccuauaacuagaguuacaguuucgguuguaagcugccugugacugaauggaauugaacccaggcccucuggaacuguucuuaaucaucucaagaggagccaucucucuagccccagaagagggacuccguuuuucuucuucaaaauaauuuuugaaaauuauuuacuaauugggugugcuuugguguucugcuugcaugucugucugugugaggaugucagauccuccuggaacugaaauuauagauagcugugagcugcuaugugggugcugggaguugaacccaaguacuuugaaagagcgccagugcucuuaacuguggggccaucucuguagccccagaagagggauuuuuuuuuucuaaauaauauauuuuauguguguugguauuuugccugcauuugugucuguguggggauaucagagauugaaguuacagacaauuguaagcugucaugugggugcugggaauugaaccccugucuucuguaagagcagucagugcucugaaccucugagccauuucuccagcuccugugaagaggaaaucuuuuguuucuuuguuuguuuuugagacaggguuucucuguauguaguucuuuguguccuggaacucacuauguagacaaggcuggccucgaacucagaaauccgccugccucugccucccgagugcugggauuaaaggcgugcgccaccacgcccggcucuguuauuuauuuuuuauuuuguuuauuuuuuauuaaugaucaauguaggcaaguccagccaaggggcuauuaugccaccccuaggcaguugauccuuaaugauauaaaaaaagcaagccaguaagcaguguuccuccaugacuugugcuucaguucuugccuccaaguucuugcccugcccuuccucgaugguagacucuuaccuggaaguguuaagaugaaauaaacccuuucuucccuaaguuacuuuuuggucaugguguuugucauagaaaccgaaagccucaugucuuuuaggcagguaugcagacucuuauguugaaagaaagcacagugcuggagagauggcuuacugguuaagagcagggccuuucuuccagaggaccuggguuuaauucccagcaaucacauggcagaucacaccuguuuguaacuccaguuccagggcuucugacaucuuuacacgggcauacgagcaagccaaauaccaauagacauauguaaaaauaaguugaaaaagaaagaaagcgcuuaguucauuugauagcgauuaauugaguguguccccaaccaguuaauuucugauuuggauaauugauguuuuuuauaagugaaaacucagggcuggugagauggcucagcagguaagagcacccgacugcucuuccgaagguccugaguucaaagcccagcaaccacaugguggcucacaaccaucccuaacgagaucagacucccucugugucugaagacagcuacaguguacuuacauauaauaaauaaaaacaaaacaaauaaagucauuguuuaugauaaacacauauuuaaaaaaauaaaaaauaaaaauaagugaaaacucuuugacguugauacaacacagauacacagaaagccccaaacacuuuugaaaagguguuuagggaauuaggggacuugguugaauuuuguguauguguacaugagcugauguauauaguauuuguucagugaaagaagugcauauguguguuccaggucucugaugggccuagaguuuggagcgagaacugggaagcagagcucuagaagcauggagaccauaagugaccauggucacugucucuucaccccaugucugcacuuuuuauguaccuggcuucaaauacuuuaguuucuacuucugguugaccuacugagaggagggcauagguaagugacucuuuccuuggccacagacuugguuagcccugugguagagccaucuggggcaagaggcauagucacuaaccagaggcuccuccaaccagcaucauuuccuucugaacagaccaguucagagccagcucugucauucuuuucauuacucuuugaagauaccguugcagguguuugucauuccugcagauguuuuguaugucacugcaagucuagcagcaagaaucucucaguucuggccuucacugacaucugggaaguguagcagcuugucagcgguugaaccccauuuuuucagauacuccuagucccacucuugaaugucuagguuuuucuuuauccuagauaugccuguaagcagagcccuagcccagaggcucaacucuagguuuccagacacuuagcccuuaagaaagcaaacaagucaggcaugguggcauaugccuuugauccuuuaaucccagcgcucaggaggcagagacaagcagaugucuaguuugaggccagcuuggucuacagagcuaguugaggacauccagggcuauacaaagcaacccugucugggcugguggauguucagacagaaguaagagagggagaugaaaggaggcauuuaagcccagggacacugacuugagccuuacguguaagccaaguuagguaggggcaagagguaugcacaguuaaguagucuugguccccuguggccuggccuaccauuaucuuagcucugguccugcaaggcggugagaagacagucucaguuauccugagaugaguauuccugcuggggcaggugugugugugugugugugugugugugugugugugugugagcguguguguguguaaguaagugugugugaguguguguguguaagugugaguguguguguaagugugaguguaagugugaguguguguguaagugugagugugugugcgugcguguguguguguguguaagugugagagugugugugugaguguguguguguaagugagagugugugugcgugugugagugcgugcgugcgugugugugugagugugugugugagugugugagugugaguguguguaagugugagcgugcgugcgugcgugcgugcguguguguguguguguguguguaagugugaguguguguguaagugugaguguguguguguaagugugagugugugugcgugagugagugcgugcgugcgugugugugcgugcgugugugugagaucugucugugggguuaggagaacugcagacuugggaugccucuguggguuuggagcagcacagugucaaagcuggcaguaagauagcucagcuacucucugcccucagccuugaaggaacaugaaauggauuagccaccaucagcuuguagacagacuccuagaggacuggauaugucuacacucaggauuaaacaggugagggacucagaaccuuaagacaacggaaacaugcagaaagagcccaggaauuccaggcuuuugucugcuuuuaguaacuguguggucucugaugagaaauuggugcuuuuuagcaaaagugguuuuaaaauaccuguuaauagcaaggacuuuuuuucuaauuauauuuuaaauuuuauuuauuacuguguaugccacacuucuccaaagauaguucucugcagaaucaguuuucuucuccuacuuuuauauucauuccagggaucaaacuuuguuguuagguuucuauggcaaguaccuuuaccugcuaacauuuuaauauuccaucuuguuaguuauuucuaauauuuuuucuuuuauuuauauauuuauuaucuuguagugcugggacuugaccucugggucuucgaaugcuaaguaaaugcucuaccacuaagcuacacacauaacucacagccuucuuacuaauuacuuaauaugugcuuuuugcacuaguucaaauuuugaaagauauugguuuuuguuuuuugagacaggguuucucuguguagcucugucuguccuggaacucacuuuguagaccaggcuggccucgaacucagaaauccgccugccucugccucugccucccgagugcugggauuaaaggcaugcaccaccacugccugacugaaagauguuguuaagaacagugaaaccuuuccuauuucuaaggaagaggacuccuggacuagcagaagaacuccgcugccuggcgggccauccuugccucuacccugcacuuggcacugcacuaacugcucucauaguggugucuucauaauuuccuguccucagagaauuuuauaaugaugguagggaccuaaauaacuagagaaaagggcccuuccuguaccuguguacaucuuuuguucccaucuauagacugagaaggcugaagcaagaggauuauuugaacgcacaaguucaacuuaaaauaaagagauccaauucacaaguaguauucugggggaaauuauagacagcuaaaggcaggcuuguugcuuuguguucugucucagugugcucugaaaugccucuggcacaguaaaggguuucucugaggggcuggugcuggugccacagaguguguggugcacucagggucuggagcacucagggucuggagcacucagggucugcugcagcuuccuggucagcucuccaggguuguguuuugggaagucacuggcuacacaguuuaaaugccuuggugugaacgaauaugcugggacaguauguguccaacaaggugugaguucugcuuccaggcgccuccaugugagggcccaaguuuuucuuucucuuuuguaccaaguuacacuaccagcauuaguaaggcugugguaggacuauccugcucuacugcccuacaaaggugcugucaugugauugauguagccaccuauuccuugaucugggacccuuggccuggugaaccagcaaacccagauuugccuuguucaacuaauugccuuaccucugcagacagauacugugagcagcugaauuucaucuaaagcagucaucauggcugcuuacugaagcucaccuuguuuugcuccaccugccagcuacagggauguaacucuguccacuguaucaugaaagccacgucucacauccugugauggacauuuaaagacuuccagcaacuuucagccgaaacugugacuuaggccuguuaguguugacuccuuauaccacagaggguaguuggugaagaugccaguguuaaguucaggggaaacacagagcaaccagaaaaauccaggcuugugguaugugacccagaacauuacggggacugaacagggaccaagugaccuuagugugggguguuugcuuacuguggaaugugcuuuguuuccaagguagccuuaucaggguuucugaccaugguggaaauaacucugguuccagauuucugagguuuaacucuuugcacuuuaaucuuuuuuuucccccucccgccccugcacuuuaaucuuaaguguucaguuuuggacuuuccauuuugggacaggcagccuuagugguuagcugucaucucuaucggcucagugacucuguggcauuuauagcauuaaggcucuugauggcaaugcuuccuuuagaauguuaguuauacaguacacccaguagguuaaaguugcccucugguguaggccaggucuuaauuaaggucuuuggaacaaagacaccccccccccaacccccaaacaggugucccugauagcucugugagggcuugucccuguugaagacagagguugggucuuuuuuuguuuuuuuccaugcugugaaguuacugaacuacagaguugauguuccuagauggaaccgucaggguuaacugucuccugauggacuuacaaacguuggaggaaacuguggguguuagaacuauucaccucaaagacuacuuuucuuuccacuccauuaccagcacugauagucuaagaaaugaaauaaaaaucccuguagucacccagcggauaguguguacauuucucauuugucucaaguagcuauuucuuccaaaccagaaucucgugucaugguuaguauuguguccugcuuucugccucuguguagaccuugugaccuagcauuuggagacuugagucacuguagguagcacguauaggacacaguugcaugggugaugggauauacuuugguagccagcccacaggagagaucacagccugccccucacaacuccuagucagugcagcauauagucaguguguaguuaucaacucauccuugaggguagcaggccugccuuccuuguggggaaggucaugugccugaagauuuucuaugugcucuuuauuugaggaacauagucuucuaggucuaaucaauccuaguaugggguggcuaaauagaaagguaagugucauucuguaaaccuaaccuccccuccccucaccuccccuccccuccccuccccuucucuccccuccccucccaccuguguuaaccauaaagggcacucugguggcuaccguugagaaguggcauuuuuaaauggacuucauuuaauguguuacaguuugaaugcgaagaaggaaaagcuaaugcucccaguuccccauguuggauguagucagggagucaaagcauuugaguugacaguggguggcugggguggaagucucugaguggccccacugugcagagaguaucauccucacuggcugcuugugaacagcaaagcuuuacauggaaagggacguuuuucucccaaaucagaacguaggucuuaaauuuagacaguuccauaccaugcugucuaaauuauggaaaagauaaccucuuuaaauuuugguguuggugguguuucuuggggcaggagggugagauaggguuuuucuguguagccuugacuauccuggaacuuuguuugucuugaacucacaagagaucugccuaccucugccucccaagcacuggcauuaaagcugugagccacugccacccagcuucagagauuuuguuuuuguuuuucuuaauuguaauguggccaguuuuauccaucuccuuacaauagguauuuucuguuuugcucuaacuuaagcacauaaggacauuuccuauacuacauccuuuacuguuuugucuuugccucugcuguugacguggacuucaguucuagagugguacgagccauaggguaaagggucauagcuuccagaaagaucuaauggacuaauaacuuugucuaccuuuuucuuguucugagauagucuuccuggguuucccaaguuguuccuaacauucuuuaagugauuguucugcuucgguuugcccauagcuaggguguaaguaugugucaccaugcuggcaagagguuuguuuugguucuaagcucugccucagaaucuggugauggccuucuguuggcagaacccuauagagagagcaugguaccagagucauagccagacuugucucuuauagcggacagcugcagacaacucauuaacccauuggucacaugaauguuauuaagccauucauuagugcaagguccucaucaccucucagggaccaccugaucucacuuucuaucuaucuauuuauuuauuuauuuaaugucugagugcucagugugcauguacaucugcaucucagaagagggcgucagaucccauucuagguaauuaugagccaccaugugguugcugggaauugaacucaggaccucuggaagagugucagggcucuuaaccacugagccauuucuccagcccccuggucucacuucuucuuuuucuuuuuuuuuaauuuauuauauguaaguacacuguagcugucuucagacacuccagaagagggagccagaucucguuacggaugguugugagccaccaugugguugcugggauuugaacuccggaucuucggaagagcagucgggugcucuuacccacugagccaucucaccagccccuggucucaguucuuaauaaacauaaugaggaauagauuccaacaugaguguugguauacaagaguaaccaucaugaucugaacaaggacaccacaauagccaugcuaacacuaauagggaagggagaaaggucacuaggccuuaaaagaacuauggaaaauuaaagacugcugagagcuggauaaauaaucuucuucagagaagaguacaccaguugauuaucuaauacuaaacagucagcccucaaaacagauacauacaaauuaacaccccucuccucccccacacauaaaagaagagggcuuaggcgcuggagagaugucucaaagguuaagagcacuggcugcucuugcagagaggggacuugggaucaauucccaggaccuaaauagugguucauagccuucuguaauucuagucccagugugucuaauaaccuucuucuggacuccaugggaaccaggcaugcacgggguacacagauauacaagcaggcaaaacacuuauacacuuaaaaaucaaucaauuaauaacaacuuuuaaaaagaaaaaggucaugaauuugagagcauauggggggugguuguacauuggaguuguugaagaaggaaagaagggaagggacguaauuauguucuaaucucccccauccccacccuuuuuuuccccuugagacagggccucucuuuguguaguucugauuauccuggaauuuacuguguagaccaggcuggcuucaaauccacagagauccaccugcuucugccuccugaguucugggacuaaauguaugcaccacugugccuggcuuaaucuucacacgcacacacacacacacacauacaccccaccaacaugcucagcuuaucuuaucaugcgcacacagacaugcauacgcacaugaguuaaauauauguuggcauauauauguaugcuaaaaauacaaaauuuuaaaaagauaaagcagugucccucccacacugauuuagaagagccugucucagugcuguacaguguugcuaccaguuucuuggggaccauugcuucaauaguuccauagccuaacggaggguaacaaguguuucuuuagaauaucuucauucuugccaugauagcuacauuccuuacuuguuguuuucauaccugucucaugguggaauaugccugugauugaaauuguuauaaauacaguguaaguaguauccacaguuggggugucagguaccccuguguaagaaccauuucuccaaaacaacuuuucuuuugucuuucuuuuuuuucuuuugaggagguaccucacugcacagccaugacauggcugguuuagaacuugcuguguagaauaagcugccuuagaacuccaucugcuucgaccuuucaagugcuggguuuaaaggcaugaccacugugccuagcuucugcgauguggcuguacacacuuuuggaggugguuccuuuugauguucgcuuuggaauaggguuucuauauggggcuuaggcugaccucagacuugagauucuguuucaggcccuaagagugcugagauucuaggcaagcagcaucaugcucagcagacuuuauucugacaucuucccuaccuuguuuaucaaaaauacucugaaaacaucacugcuuaaccauccagggguuuuauuucagcucccccucauuggcagguugaggucuguccugguuggucucaucuguucccguuuaguagggcaaggaguaugugacugagauugaugucagugacuuaguaccaaaaacuuuuccauguucaguuuucagcaacuaagagguuuaacauuuaggaguccauuuuucuccuuaaauucuggcugcccugugggugauguucuguuaucucaaaaauagccacgcaggggcuggugagaugucucagcuaauaaggaacuuugcuggaacccacaugguggaggagagaacugccuccuggaaguugucuucugacuuucauacauauucacaauauaagaaauacaaacaucuuuuuuaaggggccagugagacggcuuguuaagggugcuugccacaaagucugacuguuggaguucauuccuagaaacugauagaagagaaccaacuccuccaaguuguccccugaccuaccuauguggaugcgugugugcacaugcaaauaaguguaaaacuaaacuaaaaacacauugucagguccguuuguuagaaguuauaccucuauagaaaguuaacagacagcaguuacaaagauuuacaagaacacaaccagugagagcaaacauuuaaagaaaacugguuugaaauuaaguacuauuggagaugugcuucuuagaaggcauccaauuccuuuaaaauuauuaggcaggguauggcauuaggacaggucuaauucucuuucuuagccaagucaacaauuaagaauacaugaacaggccugggaaagguuagcaucacugagaauucuaguuuggaggauaacagcagcuuuguaaaauagugucuuaagcuuugagacuucuauaacacacuucagccagcagaacuguucagaaguggucuguauaguaacugggcuccuuuugaagcaaaauuuggaaccuuuggcccaguauguuguugauaagucuauagcacugacagaacuugaaauauuagaccuuauaaguuuagggaacagagcuaguugcugcagacagacugauuguggugugcagggugucucaugugcacaguaacaaaauaucgaggcaaacuucugauagcagaguuggaagauuuguuuuuuguuuuuuugguuuuuuuuuuguuuguuuuguuuuguuuucucaucucagugguacuaaaguaaaauaugggaaggucaagggcuggagagauggcucaguggauaagagcacugacugcucuucugaagguccugaguucaaaucccagcaaccacaugguggcuuacaaccauccguaaugagaccugacacccucuucuagagugucugaagacagcuacuuauguauaauaauaaauaaaucuuggugcuagagugaguagaagcagagauccugaaaauucaauucccaacaacuacaugaaggcucacaaccaucuguacagcuacaguguacucacauacauaaauaaaucuuuaaaacaaaaaaugggagcugggcggggguggcgcacgccuuuaaucccagcccuugggaggcagaggcaggcggauuucugaguucgagcccagccuggucuacagagucccagaacagucagggcuacacagagaaauccugucucaaaaaaaccaggaaaaaaaaaaggguugaaagaauuucauuaguuguaguauauuuuguauacaaaagaacauauguggucacuuuuuuuguuuguuuuuguuuuuuucaagacagaguuucucuguguagcccuggcuguccuggaacucacucuauagaccaggcuggccucaaacucagaaauccgccugccucugccuccugagugcuaggauuaaaggcguguaccaccaggcgaggccagccuggucuauagagugaguuccaggacagccagggcuauacagagaaacccugucucgaaaacaaacaaacaaacaaaaaaaaguuauauuuuguuagcucugcagcgugugugucuguccuuuugucugucugucugucugugugucugccaaggaggaccuuguuuuuccucaguuguucucauuccuuuuuuuuucccccuuuuuucuuuaaguaggcucucucccugaacccaacccugucaauuuggcuagucuggcucaugaauaagccucagaaauauaauauguaucucaccgguccccauacucccccauaguauauaauauauaucucacuggccccuauaccccccauagucuauaauauguaucucaccaacccccauacucccccauaguauauaauauauaucucaccagcucccauauccccccauaguauauaauauauaucucaccagcucccauauccccccauaguaugcauugcucugcccagcuuuuugcauggguucuagaaaugaaauuucagauccucauguuuguauggcagacccuuuaccaaaggagccaucucccagcuugcaaauguuuacauaauauauaaaguucagauucacagcuccauacauaucuaaucauagauaaauaugguauuauauauaccauauucacauuaaauauaccaauucauauaagacuaguugcuuuuaagugucauuuaaaugcuuaaagccaggcuuagcagcacaugccuuuaaucccagcacuagggagguacagucaggcagaucucuggcauguucuagagugaguuccaggacugccaggacuagacagagaaaggucaucuaaacaaacaaauaaacaaacaaacauaaagcuauagagauaggagcuagagagauggcucaucaaguaagaacacuagcuguucuuucagaggacccagguuuaauucacagcacucaccuggcagcucacaacugucuguaacuccaguuucaguggauccaacaccucacacagacauacauggagguaaaacaccaaugaccauaaaauagaaauaaaauacuaaguuuaaaaagaaaaaagaaaaaaacaaaaaaccgggcagugguggcgcacaccuuuaaacccagaggaggcagaggcaggcagauuucugaguuugaggccagcccgguauacagagugaguuccaggacagccauccaggucuacauagagaaacccugucucaaaaagcaaaaacaacaaccacaaaaaacacuauagagauagcucugcuguuaagagaauguacugcuuucguaaauaacuugugacuucagcucccuucaccagggcaggcuuuuuagaguugccugcaauuccagcugcuggggaucugaugcuaucuucuggccaccaugcucuacuccacucacaugcacaugccccauauagggacacacacacacaacacggggcuaaaaaauaacuccugggugugaaggcacaugcuuuuaaucccaguacagaugcuucaaagacagccugguuggucaauaaaugggaauuccaggggucagggcuacauaguaagacccuguccaaaacuaaauaaguaaaauaaaauauuuaauauaaacagauacuuagcugaaccuugauuuuguaaagaaauguaucuaaguaguucuuuauggcgcacgccuuuaaucccagcacuuggcaggcagaggcaggcggauuucugaguuugaggacagccagggcuacacagagaaacccugucucaaaaaacaaaaaaacaaagcagaaaauggugcuggugugguagcucagugguuaagaguauuggcuguuuuuccagaggacuggguucaagcccuagcauccacaugugauuucauccccagaggauccagugcucucuucuggccucugggggcacugcacacauauggugcacagacauauauucaggcaaaacacccaugcacacaaaauaauuguuuuaaauacuugcagaaaacaggcagguuuuuuuguuuguuuuguuuuuuuguuuuuucgagacaggguuucucuguauagcccuggcuguccuggaacucacuuuguagaccaggcuggccuugaacucagaaauccaccugccucugccuccugagugcugggacuaaaggcguguggcaccaccacccggcucagcaguuauuuauaauauauaaagucuggaugauuuucuuuuuuuuuuuuuuuuuuuuuuuaaagauuuauuuauuuauuauauguaaguacacuguagcugucuucagacacuccagaagagggcgccagaucucguuacggaugguugugagccaccaugugguugcugggauuugaacuccagaccuucggaagagcagucgggugcucuuacccacugagccaucucaccagcccgaugauuuucaacauauauacaaguuauuaagauaugcaaucucauaauauuacaauguuuuguuguauuauuauguaauauuacaacaaaauacuauuuguuagcaauuuucccaaaauuauuccaucucuucauugacauguauacacauauacauauauuucuauggaccacaguauuuacauacaaauuaauccaaaaauuaauuuuaaaauauuucauuuuaaguaugcuuaauaaaacauauaaaauauuuuagauuauugaaauaauauuccccaagaaauuagaauuucccccaguaauuucaugcuggaagaaguaaaagcugaggucugucccagcaccuggaaagcagaggcaggcggauuucugaguucgaggccagccugguauaaagugaguuccaggacagccaaggcuacacagagaaacccugucucgaaaaaacuaaacuaaacuaaaaauuaaaaaggggggggggcuggugagauggcucagugguuaagagcgccgacugcucuuccaaagguccugaguucaaaucccagcaaccacaugguggcucacaacaauccguaaugaaaucugaugcccucuucuggaguaucugaggacagcuacaguguacuuacauauaauaaauaaauaaaacuuaaaauuaaaaaaaaaaaaaaaaaaaggaaaggucuggugccaacaaacaaaagcaaucugucuccaagagucuauagcacaguucugacuugcugaaccaccuugcaggagaguggagccuauauaauggcaacucagugauggguagguccacauguucacuaggacuuaguuauguguaucucuuugcuuuccacauaaaccuuagccuccugucaggagcccagagauggauuggggugggggguguuguccuggucacuggaccucuuauuuguuccuuuccccaauggguccuuaagucucucucugcuuuuuacuguuguguuuaguuggccuguugugacagguggcuaagcuuagguuguuaggauugacaggggccagguucugauccuaacaacucugguaacaacuugagucaugggcaggagaaaaagacauauuugucuaucagccacaucagcagguggacuccagaaggaaagagcaagcagugucacacagcuguggggacaguuuauuccagagaugcaucuucccaucucagccagcacugggugcugucuaacucuacugugugaagcagggaaugagugaguuccucccagaucagugcaccucauaguuugccuuguuagcuuagacucccuugacuugucugggcucuuccugagcccucucagcaacugccacuuggagacugaauggcuuuaucuuuuuuugagucccuuggagccacugcuuauuuagcugguguauuauuucuaugacaggccuuuucaguuuggaacaacuuuugagaaaauuuggaguucuguugaaugacuugggauaguaucugucaagugaaaggaaacaugggaauuagucuuuugggguucuacugaaccauuuggaacagaugagcagggugcugaagaaaucucuacugugauuuauauaaccacagaaaauacugccaguauagucuugaugcuccuaaggagaacucaaguuaaccagucucuuguaacuuacuaugggaaaaacuuaauuggcccagagaguuccagaaaauaacugggcagcaaauccuugcccacuuccucucccauuuucugaaacuugucacacacugaaaucacuguugcuagcaugccugauuuagugcaguucugagugcaggagagcaugugggaaugauuucuggacuauguuaauauauaagaccuuuugccucuguuuguuuuccucucccuuagaaaauaauuaacagcuaacuauagauuuggggaacugcagaaaacuggcuaggucggacuuuaccagagacaggccuaacucaaauauuaacagaaauguuaauuuucagcuuucuuccaggugggauaguuugagucuggugcuuucaaauguuaauucuggaaacugaggcugagaaauaaccuguuccaagauuccaaagauauaaaugcucuucuaaaacaguuauuuuagagucaacaaacaucuaaaauacuuuuuaaaaaacauucauuggcaccaagauaaaagcuucaguaagcuauaaaauauauaguacugguuauagagauuucgaguaagauuuucuuccaaaacagauucugcaaagaaacugaguuuuguuuauuuucuaagagugaagacuaacagaaaauuaggcuauaaaaaugcccgugagguggguuagcaguuaauaccuagugcuugcugccaaacuucacaacuugaguucuauucccuauccucaaccauaggauaaaaggagaaaaacaacucccacaaguuguccucugaccuuaacaaguacugugugcucccacacaugcauacaaauaauaaaaauuuuaaugcuuuuuugcucaaugcacaaaacauuuguacuuccuggcaggacaguuggaacaucaccuuuauagaaacaagaagggcauauauauccuguauauucuaccuuacccuugagacaucagucuuaaugcugcagugccacaggguucuguugcuguguguguauauguguauuacauguaccauuauuauacaugcgcaguuucacauaugcauucuuuuuaacaguuguuguauaugaguaugaaugugucacuguacauguggacgucagaaaauaaccucuaccauguggauuucagggguugaacucaggccaucagacuucuuggaaaaugucuuuaccugaugagcuaauuuguaggccuauguauuuuuguuaagauaaagucucacuucauagccuaggcugaccucaaacucauggcaguccuccugcuucaguuuuccaaguacuaggauuacaaauauagaccacuauacccuauauguauauuccuaagcuauuuuaaaguauagugcagauguugaaguuaaauaaaauaggugugucucaguggguugcuauaugaugagcacaugcauaccuggcauuuagacuggaaagaacauccuuucauuuucuacuuggccuagacucaugaccugcccuugaagugaaaguacccgcuagccugaauucuauggcaagaacuuccagauagguaggaggguggguagauagagauaguuuguuuuuauguuuuuuauggcugaauugaucaccucuaaguauuugucaaguuuuagacuuuuuuuuuuuugagacaugguuucucuguagcccugguuguccuggaacucacucuguagaccagguuggccucaaacucagaaauccaccugccucugccucccgagugcuaggauuaaaggcguacuccacccccgcccggcaauuuuggacuuuuuaaaaaugacaacucauucuugugcagguuguauccauagccugccuccugugguagcugccccuugucuuucuuccagucuagauuaugcuguaggcauuccucugagcuuuacucuuccucguguuuucuggcuuuuuguaaaucgguagguauauuuagaggccugaucaaauuagaauuggacuucacacaaguuucuuuuucacagguguuucguugguucaaguucaagaagaaucucacagaguuggagagguguaagauuguucuguucccaguacccauagcaagcagcucgcaagcagccaaccaccuguagcuccaguccaaagggucugauaucugcacagacauguacacaugcccacacagagagacacuugaaaaaauaauuaaagaagcaauucaagagccaggcauaguggcauacagcuguauucuuagcacucagggggcugaggcaggagaaucaaagcuuuggggccaaucggugauuccuaguaagacacuguugaaacaaaaccagcaauaaaacagccauagucccaugucugggaaucuuauuuugauuauuagugcaguuauuggugugcacuaaaagauaccuacagucagacuucuuucuuuccaggaacuacuacugcaguuguguuacaguucugacccaguuuucucaggugucagcaagacuuacacaaagaaagaaccucuccuaguaccuaagguagcagcaauucauguaggaaacuaaagauagugauucuuuguaucuaccaguuuacagaaucauaauuuccuaaucaucuuuaggugucugagauaaccugagauuucuaggaguuuccauccaagauuaacuacuacuguuaaucccacagacaugaggagaaagacuaccaaccacaaauuaugaccaaaucaaagcaagcuuuauuuaugcacagcagagcgguauuuaagauggcauuuuagagaucagcucagagccaguuucucggucuucuuuuauagggcuuuucugcaggauggguuuguaagcaagcaagcaugguuacagaagcaagcauguaagcaagcgugguuacagaagcaagaccagcagcuaaggaagcuuagcuuuugcuuugcuuuuuuuuuuuuuuuuuuuuuuuaagauuuauuuauguaugugaguacauuguagcuguacauaugguugugagccuucaugugguuguugugaguugcauuuuuuaggaccucugcucacuucagucaaccccacucgcucagucccugcuugcuccagcccaaagauuuauuuauuuuuauacauaaguacacuguagcugacuugagaugcaccagaagaggacgucagaucccauuacggaugguugugagccaccaugugauugcugggauuucggaccuucagaagagcagucagugcuccuauccacugagucaucucaucagcccaggaaauuuuucuuuacagaacauucuauggcaguaggaguggggcauaacccaauuccaagaaacagaaauuucaaguuuuacaguaaacagaaaucuaacugaacaaugaauggcuccugguuacaaacuggacucugguuuuucauccccuccccaaacccuaacuugucuuaugugucccugucaaauccuuaauagggaacuucccuuuuuagcugcuguaaggacuaaugguggugaugaagggcaagauuuuagcaguuucuaucuaucagaagacaaaauuugugaggcauggacugaugaugauggguugugaagaacauuauugggaggauuaagggaccuacaaguggcugaaagaaagaguuguuaaccagggggcuaguugguaccaaucuuuuuccccuucugguagucuaaauauuuaguuugagauuguuucuaauuauuccugccugccuggcauaaaaacaacagguuucucuuaagccuuccuugcuucauaaagagcagauucaggccuuuuguaaaacuacuucugccagggaguauaccugauguuccauuauggagaaugagcuuugcaaagacccuaaaucuugcuucacuuguuugucaggguucugaaucccuggccuugcaggacuagggcugcuguuccuggugccacagauccugugaucucugcacccaauaagaguggaaucaauauggugacugcucauuuuggccaagaguggucaagugccauggcuagaugcaaguggccuguguccucauaaauauaaguuugugagagucugugaguaagugcaaaaaguggaugugucccauuaucaaugagggagauugagagacauuggguaaugccuucuguauagguccaucauguauuagagugcgcugggaggaauagcugcuggcuuuuaguaccugagcuaguaagguucugaaaauaguugcacaguuguccaaauaaggagaagccaaguuaucugguacuuuugacaugaugaauacccuuguauaucaccuauaauaauuuagguugagaccaggaacaagccucaguaguggcucauggcagugcugugaguuacagauuguaaggcaguccuacauaguaagggucaagacagaaccagcaaucuuguguuagguuagauacagagugguuuagggaagaaaagguugccauuaucguggucaggaaaggcaccuccauuggagggagaguguguagggggaugucuuaggggagauuagaauaggcaagacaguaguugguagaucuaugaggugugggcaugccaggggaaccugaggcauugggagaagguacauacauaucaggacuuguggguuuaguuaucucagacugaaccuauuuucuuuggauuguaagugaaguaccugggucuuucacagagagauauaaccugauuccccagggcuuuuguguaucccagaaugacuaggcuagggaaacauagagguuccagaguuuaagugugaaaguuauggggcuucaagaucccuguuuacaauugggauuaaucugugggcuugggagaaaugguagauuauuuuuguuggacucuucccagggggcaauagauacacaacuucacaaggcacaaugauaggugucauccaccuggcaggaauuagaguuuaggucaaggcaccuuguaaguuuuucuccaguuuuaaauugccacaaccuuccccaacaguucccaaaugaaguuuucauucuucaguuuaguuccuucuccccaaagggagaaguuugcagagauuuguuuuuagcggggguugaaauguaguuauuucugugagaauccagccugaccugaccacagccuucuaacugaaaacugccacaguugccugagugauccuggugcuuuucccuaaagcacuuucuagcacacuagaaccaaaacuaugaggauguuacaugcagcuuugugaguggauguuggugauguguggcucaggacuguguggccugaagucaguacuagcuugagauaaacaaccuuggauggugucacuucuauuguacuugcaagaccccuuccuuugacugaaauugugagggccuuugaucuuauugcugcccaggaccacacuugugucagcuggugucuugugugaacauuucuuuugggcagugcagugauuuaaugacccccauagacucguguguuugaauacuuguccuauagagaguagcacuguggauguggucuuguaggaaguguaucacucugacggugggcuuagaagucuccuaugcucaagcuguggcacacagucuucugcugccuguggaucaggauguagaacucugggcucuuccaauaccaugucugccugcacacugccaugcuuccugcuguggcaauaaugaauuaaaucucugauauuaagcuagccccaaauuaaauauuuucuuuuauaagaguuacuauagucauguccuuucacagcaauaaaacccuaacuaagacagguaguguagucguuugagugagaacagcugcucuaagguuuauguuuaaauguuugagcuacaguuguuggaacuguuuggaaagauuaggaagugugaucucuuuggugggguuugucauggggggcaggcuuuaagguuucaaaagcccaugucauuuccaguaaacuguauuucuaucugccuugugauuguggaucagauguaagaauucagcuaguuuuucaguguugugccugccugcuccagaccacaaguccccaauuaacugccuuuuauauguugccuugaucauggugccuuuucauagcauuagaaaaguaacuaagacagguaacauggcagugggucugcuggauggccugagucugguuagcugcuuuggaacuguuaagcuucuucccagaguacuuaccuaucuucucucugcagacuauuugagaguuuuguugcucugucuuuuuuuuuuuuuuuuuuaagauuuauuauugcauguaaguacacuguagcugucuucagacacuccagaagagggcgccagaucucauuacagaugguugugagccaccaugugguugcugggauuugaacucaggaccuucggaagagcagucagugcucuuaaucgccgagccaucucuccagccccugcucugucuucaaauggacacuuaaauuuuuauucuguccaucguagugugucacauuaauguauuaguuugauuuguauauauuucuuuaauugcuguuuaauuuuccaaaucuagcauuuagugucuuauuuugcucaauuuuguuuucuauauuaaaaauacaugugcauaguuauguaugaaguauauauuguuuuauguacagcuguuuguaauugauuuaggccauauguguaaugaguacauuuaugcuuuuucuuucuuccugaguuguauucauuauucucuccuaaacaauauaucccaaccacagcaucccuucccuccauuccucccagucccuccccuaccuccacucucccucagauccaaugcucuuccauuucccuucagaaaagacagggcuccccagugauaccuacuaaacacagcacaacaagauacaauaagacuuacuggcaaggcaaccaguaagaggaaaagggucccaagugcaggaaaaaagucagagacacccccucuccuacugucaggauucccacaaaacccacagcaaccacuucauguaugcagaggaccuagugcagacccaugcagucuccgugauugcugcuucagucucugugagaacccugcauaguugauacugugggccauauucuccuaguguccucacccuucuggaucuuaaaauucuuccucccccucuuccacagggcuccccaaacugccuaaugucuggcugugagucucagcaucugcucccaucaguugcuggaugacaccaaucuaugaguauagcagaauauuguuauauuguuaggaagcauuucuuuuugcuuuugucaguuguguuugguucuaucuuaugucucugagucauacagccuccaagcagugucaggcauggguuccuucucuuggcuuuggccucaaguuagucaucgguuugccacucuaacaagcucugagccaccauugccccaacacaucuuccaggcaggacggguaugguuugaagguuuuguggcuggguuggugucuugguuccaccagguuacuaaagauggucaguucaggcccaguguuugccauuacugugaaucuuccucagagucccuucauuugaguuccagaaguuucuacugcaccaggcuucuauaucauccuaagugccccuaucucagucaucccucccauuccuaucugauccccuccuguuccgaucccuuagccaaccugaagaaucuauuucccauuuccaaggagauuccacuuucccaccccuccugugugugacuaugcuacaguguacaugaacaaacauguagaaagccagaagucaacccugggugucauuucucaggaguuguccacauugguguuuuguuauuuguuugaugcagggucucauuaaacuuggagcuuacugaguugaccagacugucuggccaacaagcccaagggaccggccuauuucugccccucaccccucagcucuaggauuacaggcauacaucaucauacccagccuuuuauuauugucacaugcuugugugugcacacccacacuuauaaacaaaaccuguuguguucauuuaguguugcucaucuguauauggguuuagagcuggcuacuugggauuaggucacauauuccuucuaucagcagucaacaguugccuaugauuuuucaucuaagguagaggucuugugaaauuuacccccaaccagguugguaugucaacuuguguuaucauuguauaggacucacuuauguaaccauauugagauuuuauggggauagcuuccugguuuuuuuauagcacuaucucagagcagaagcccugcuucucuggcucuuagucauucugccaucucuccaauguuucuugagccuucaauguaguggcugcauuauagaugucucaguuggcacugggcacccauggccacuuauucucugcagucugacuaguuuugucuuuguauaaugcugucuacugcagaaacaaacuucuuuguugaggaaugagaauuccauguaaucuuuggguauaguauuuagaaugagguugggaauaaugcugguuuagggaaguagugggaguaaaaucuccuuuagaguucuuagccuuacagucacacauagcaugcacagcuagcuuggggucugaguauuaaacucaguucucauguuuacacagcaauaucuuguaucgcuccagccccuuguauauguuuccggguaguuaaucucaaugcugauuuuuuuuucuuuuuuuaauguggugcugaggauguucuacccauaacuauuuuccucagcccuugagugauuucagccaauuuuguuuauggcauccauuuuugagauugucuucuuucaggaaaacugauaguuuuggccuaagcuuauugucaauauaaagucuuguucuaaaaacugccugauuugaaaaaaagugauaagucagggaauugccugguagcuuugagugcugcaaguucagagguaucaugcuuaaacccuuccccaagaugcucaguaugggucuuaguagccauucagacacugugcucaagagccucucagcaguuucccgccugcuugugcccagcagcgucucaugaaguaaguuuguaacagugucuuggcauuugugcuguugugggaucaccaccgagaagccuguucagagaugguuuaaaccaauagaaagucuuagccagccaugacuacacuggcuuuucuuuuuuuuuuuuccucgagacaggguuucucuguguaguccuggcuguccuggaacucacucuguagaccaggcuggccucgaacucagaaaucugccugccucugccucucaagugcugggauuaaaggcgugcgccaccacgcccggcuacaccagcuuuucaagaccccacacccaucccuuuucagggcgagccuucaagcacagaagccauguugcaguuaacacauuaaccagaagcccaaaagcaaacccaggcauuuagagacuuucccagaaguggagacuuugauggauugauuaggucuuuauuuucagguggugcugucugccauuguuacagcuagaugcuacuuacaccauggagcuaauugugcuaaggucugggguccuguuuacauuguugccacaugacaguguuagcuuuggcugcuuuguuuuuacauuuguuuauuuuguguugaggguguagaugccagaagguguguuuuuugggggguggggggaggcagguacaggacaucuuggaagaagaauugguugucucucccauguggauucuggggagcaaacuugaaucgcugggcuuggcagcaagugccuuuacccacucagcaaucucagcagcccuuguguugcuuuuuaaacuguuccacagacauauauucuccuuuggauuucagucugaguuacucugugaauuauuauuucauaagaacauuuggaacucuuuauauauucuacuugaaagguagaauaaauugauuucaaggaauuuaggauuuaaaguaacacuguguggugccucugguaaacugaaagguaagacgggccuggagagauggcucagcaguuaugagcucuuguuguuccuacagaaagccugggaucaguuccuguucacaaucuucaguuauugcaguucaaagggaucuuacgauguacuguucuggccucuauauguguguggugcacagauauacaugugugcaaaacacucauacauuuuuuaaauuauuuuugucaacagggucucacuaugcacugugauuaacccuaagcuuacuguguuaaccaggcaggccucaaacucauaaaacuccucuugucccugccuccuuaauguugggauugaaggcaucugccauuacacccagcaaaaauaaaaaaaaaucuuuauguuguucuugguggcacauaccucuaaugucagcauuuaagagacagaagugugugacuuucuuggaguucaaggcaagccuagucuacauaaugaguuucagaucugccagagauacaugaugucucaacauaaauaaauaauuaaucuuaaggaaaaaaauggggugggggcugugauugggauguaaagugaauaaauuaauggaaaaaacgcaaagaaggcuguaaauuccuuguaaaauucuucuagugucaucacugcuuuucauucauauucucuacuccuuuagugguagaauacuggaauuuaaauuuauaucuuuuggggguuuuguuuuguuuuuaugugaauggauuacaaaaugucacuagcaagguuuuugacuuuagcuuucuaucauggaaauuuuucuccuauauauuuaggccgaucccuaugauaaaauaugucuugaauauacaguuuaguuccaugcuuaauuugauauccucuguuacaggaaaugaaggacugugugugcccucaagauggcggggcuccugacuuggagaagaggaagaggucuaugcugcacgcauugguuuauacaagaaguauuugguugcaguacuccuacagaacagcacuccaugcccugugacagugugcuugugugagcuuuccagugacauucauggucagccauaguaaacagccuagaaaaugagauuaugaaagagugaauaaaaucuacauuaggguucacaaguggacauuauaagcaguuuuuauuaacguaagaugucaggaugauaaagcaaccaggauaauuaugguuggucauggaggauaagcaagaaacuugucccaagggggacagugauuuuguuucugacaaaguaaauuucaaaacggaggaagaugaugaucaaacuccuugucacaguuuggaacaaguggacuuuaaaagugagucagaggauaugagacagacagacaguggcgaugaacaggcagacaucagggcagcgagcugugccugucagcccucugggaaguucuuagcugccgagagugaggaugacuauggcucacucuucucccaguauaguagcacacuguacagcguagccauggaagcugugacccagagccuucuuuccagucgacacauaagcuccaggaagaagucuccagccuggaagcauuucuuuauuuccccucgagauagcacuaaggcuaucugcacauacuguaugaaagaguucaguaggggcaagaaugagaaagaccugaguacaaguugccucaugagacaugugaggcgggcacaccccaccaagcucauucaagaaaauggaagucuaucggcaggguccuccuuuuccccucccucucuguugcuuccaccacagccugcagaugugggagaccuuagcacugugcucucgccugucagacuuguccagaaaauggcucccaagaucccauccccugaccaaauaauggaagagucugugacuguaguuucuucugaagaguuguccucugaugugucugucacugaaaaguacagcagagaggaggccuuggcaggcuccucccccaaccucuccaugcuccauuaugacgacgcuucagaaaccauggcagacagaaaccuuucucuucccaaaagcacaucuggguccaggaggaggucagccgucuggaagcacuucuacuugucaccccuugauagcuccaaggcugucuguguccacuguaugaaugaguucaguagagggaaaaaugggaaggaccuggguacaagcugccucaucaggcacauguggagagcacaucgcuccauuguacugcaggagaacgggggcaacacaggcaucccaccauuguacccuaugccccccacccugcugccugcccugcugcccccagaaggggaucucaacuccgcaucguugucuccaggcaaacaagucaaagaguccccuucugccuccucauccccagaaaggcuuccggaggaccugucaucacacacuaauccuggggauguaucccgggaagauguguccauguugucauccucugaugacuugggggaggccucuguagugucuucuccagagaagcagccagcggacacgguaaauccaagguuugaaucagguacuguuuuccagcaaaauaagaaggugaugagaagacuaaagucagaagucuggcaucacuuuucccuggcccccauggacagucucaaagcagugugccgguacuguagcugcguuauuagucgggggaagaagggagauguuggcaccaguuguuugaugcgacaccuguacagacgccacccugaggugguugggaaccagaaggacuuucugggugcaaguuuggcaaacucuccauaugccacuuuggcuucugcagaaagcuccuccaaguuaacugacuugccagcaguggucagaaaaaaccaucaagguguguuuccuacuaauagcaagaagaccucaaagcuguggaaucacuuuucuauuuguucagcagacucaacaaagguggugugccugcacuguggccggaccaucagcaggggcaagaaacccaccaaccugggcaccagcugucuccugagacaucugcagcgguuccauggccauguacucaagaaugaugucucagaggccacucugucccguucuccaggcauccggaggccucugggcauagagcucucagggccuuccucuuuccgugacuccacagagaaguucuaugacucucauccaguugccaaaaaaaucacaagucucauagcugaaaugauugcacuugaccuucagccauauucccuuguagacaacguuggcuuuaacaggcugcucgaauacuugaaaccucaguacucuuuacccuccccuuccuacuucucuagaacagcuaucccagguauguaugacaaugugaaacagauaauuaugucacaucugaaggaagcugagaguggugugguucacuucaccucuggaauauggaugaguagccagacucgugaauaccugacccuuacagcucacugggucaccuucgcauccgcuguccgaccacauugugaggaccaccauugcucagcacuuuuagaugucucacaaaucgacugugacuauaguggaaauagcauucagaagcagcuggaguguuggugggaagccugggugacuuccauuggccuucagauuggcaucacugucacugacaauccaagcauagggaagaugcugagugagggugaacacucaagugugcagugcuucagucacacagugaaucugauugugagcgaggcuaucaagagccagaggauggugcagaacuuacugaguauugcccggaagcugugugagcggguccaucggucacccagagcaagagagaaguuagcagaacugcagaaagaguacgagcugccacagcaccagcugauccaggauguaccgucuaaguggagcacaucguuccacaugcucgaacgucugauugagcagaagagggcaguuaaugagguauccauugaguguaacuucagagaauugaucagcugugaccagugggaggucaugcagucugugugccaugugcugagaccauuugaugcugcaagccgagagaugagugcccacaugucuacgcugagccaggucauccccaugauccacauccucagcagaaaaguggagaugcuguuuggggagaccaugggcauugacaccaugcuuaagucccugaaggaagccauggcaagccgccugucugccacacuccaugaccccagguacaucuuugccacacugcuggacccucgcuacaaagcuucccuguucacagaggaggaggcagagcaguacaggcaagacuuaaucagggagcuagaaauacugaauucuaccucagaggacacugccaccuccaauggcugugacucaggguccccacuuaaagacacuggcacagaggagagccuguggucacucgcaccgauaaagagagaucagagagagaagcuaccugaagacauggugcuugcguauuuggaggaagaggugcuggaacacagcugugacccacucaccuacuggaaccuaaagcggucaucguggccugggcugucuaccuuagcaguucgauuucugggaugucccccaaguacaguccccucagaaaagcuguucagcacacccauggaugcuggcagcuuuggccagcccaggcucaugauggagcauuuugaaaagcucaucuuuuuaaaagugaaucuuccuuuaauaugcuuucaguauugaacucagagauggagccaccagacuggaaacgugcuucagagugcuagcuauuguaccagggcugacuugccuggcagggccauguaggacaccagaccaggcaucuggggcuaccugccaguucucaccauaauauccacaugugccuuacuccuccuucaggccaggugucaaggugcguuuucagaagcccacuagaaacagucuuggcaauuaugaaauaggaugaucagguuuaaaacuauaaagguuuuuuguuuuguuuugaggggauaguaaucuguuuuacuagaaugaaaggaagauguaaacaauuuuauuauguaggguuuuuauucaguuguguaaaaaccacaaaucaggugcuguauuuuaauuaaauauuuuaauugcaacaaaacagcuuuuguggcuguuaaaugaaaccuguaaauaggagguggagguuaagccauccugacugaacaguucuuaaccacaggcuccaaaaguauguccuagagagaauauucuggaagcuguuuacagaaccaggcauuugaaaacaaaacugaacuugggcauaucauggagugucaaucacauggcuaauuggucaugagaauggucccaugucagguguugcauucagguuuuacacggucaguuaacucagagauaucccacuuaucaugagccccuugaaauuggauccagguuuuaaagucaugcuuaggacuucaccagagcaugauaugacacguuuacaacagauggccugcugauccaaucuccaugccucugguuuacuuuuugcaucucuauacaauaaagcuaucucauaagaaguaugcacugaccccucaguuugaccagauagcgcucagauucuacuuugaggagguagcuugucgacagggaaagcgcuuguuuauugcagucaugagaaaagccuuaggcauuuagauuuuuuuuuuuccuaugauagggaagccucaaccaucacugggacauuauagagucccaaggauaccaacaugaaguaucagcuaucagacucuuuaccagacuccaaaguuuuugcuuaugucuaaaagaaaaaguuuuucauuuucucauuucaaaucaguuaaauauucugggugaaacaaaucacucauugccucugaccuuuuagaaaacaaauguuguguugaaauacugugugggcucggucugaguuugccuggacugugcuuuaguguauuuauaaaugacgaaccuggauucugaaauuaaacuuuuuauuugcgauuuucuauugcugacugaugauggcuuuuuauuuuuaggauaaaaugcuuuuuuuuuguuuuguuuuguuuuucgagacaggguuucucugugcagcucuggcuguccuggaacucacucuguaguccaggcuggcuucgaacucagaaauccaccugccucugccucccaagugcugggaucaaaggcgugcgccaccaccgccuggcuca

SEQ ID NO: 7928 - RNA, 3544 nt, Mus musculus
ugcgcgugcgcagggcgggugagagcgccgugaaagccgcggaacgccgugcaccuccgcgacucuacuacggcaagcuaguccggacgggucgucguccccgcgcgccaccagcccuuggugaaacgacagggagcguccggcuuccccagcaccgcccugcgagacucaaaacagccacaccgcaaagcgagccucgggcggaaggaggcggagcuucaggcggccccgccuccgcggaaggauacacaucuccgugguccaaaaccccggggcgaggcggccggggcgugugagcugcucggccagcugccgucuacgcgcuuucgcgcggccaccgggcaacugcgccgcgcggcugccccgcugagcgcucggccucggggccgugggauccgccgcgcugucugcggucaggaagaccgcccucccgcguccuugccggacgggucagaggcggcaccgcacgcgaggccacccgcgaugcugcuguccaaguucggcucccuggcgcaccucugcgggccuggcggcguggaccaccucccagugaagauccuacagccagguauguguggggaccagggagggggccugggcgggggccgggggguggcuuugggucaucaucaacccgauuguuugucccacagccaaggcugacaaggagagcuucgagaagguguaccaggugggcgccgugcugggcagcggcggcuucggcacggucuacgcgggcagccgcaucgccgacggacucccggugagucguggcuccgggcgcacccgcguggacgaucgccacgcucggccgcccgucugaccgcucgcgugucgcccccucuuuuccccgcagguggcugugaagcacguggugaaggagcgggugaccgaguggggcagucucguaaguaugcgggugcggggcgugcgggugcggggcaugcggguguggguugccuuggcuuuguccgaugaccgccuugucccccagggcggaguggccgugccccuggagguggugcugcugcgcaaggugggcgcggcgggcggcgcgcgcggcgucauccgcuugcuggacugguucgagcggcccgacggcuucuuguuggugcuggagcgacccgagccggcacaggaccucuucgacuucaucacugaacgaggcgcccuggacgagccgcuggcgcgucgcuucuucgcgcaggugcuugccgcugugcggcacugccacaauuguggggucgugcaccgcgacaucaaggacgagaaccugcugguggaccugcgcucgggagagcugaagcucaucgacuucggcucgggcgcggugcucaaggacacggucuacacugacuuugauggugagcagguggugcggcguuccggcgacuguuaggcggccacgcgccacgccuggcuuacgggaggggugggggggacuggggacaccgggguagcccucugcggugugagggcgcagggucuggggacgguggguggcagccagggagacccgcgauacgcgcgugacgcagggcccccgccagccgccucggcgccguggccccucccugugccggggagggcgcucgcgggccucccuugcgugcgugcgugcgugcggagcgcgggggcgccgcaguagaaauccccgcauugcggagcgcggggaagccggggcucccccacuccucuccucccuccucccaucucucccgccccuccucuuucuaagcuccucuccuccccuuuccgagccuugcagagcugagcaaggcgagccggggcgggaggagcuagaacaccaggccugguucccaguggcuuacguuguaucuguuuguugugaaacuggagccggagcucaugugacgcgcuccugccuuggggccuguuaggggugggccuucaccuccccuucacuccuguuccuccccugcccuccaugucccuccuuuccugagucccgccugcagcuguguugggguuuuuccagggugaugacaagcaagauucucagaggccccauggaggcuggcugagagcuaaugaaggcccguuguucaguguguucaccccccaguguguauauauccugauguguaccuaaucccgauucuucccucaggcacccguguguacagccccccagaguggauccgauaucaccgauaucacgggcggucugccacuguguggucucuggguguacugcucuacgacaugguguguggggacauucccuuugagcaggaugaggagaucuugcgcggcaggcucuuuuuccggaggagggucuccccagguguguuguagaagcuggcuggggccguguugggggcagggcaguguugcagcaggacucugacccccuguucucucugcagagugccagcagcuuauugaguggugucucucccugaggcccucagagaggcccucccuggaccaaauugcugcccaccccuggaugcuggggacagaggggagcguuccagagaacugugaccuucggcuuugugcccuggauacugacgacggagccaguaccacuuccagcagugagagcuugugaggaggagaaggggccugggcucggccuagccagcgcucucccagaauugaacacuuucugccugggaugucugcugcaaaagcagugaccucugaccccuggugaccuuugcucucggcaccgggccuguuuccuuugcuuugagugccuuuuugaacgcugcuccacagggccuggguuuucuugagcucuucuguccaaagauggcugcgggcuaagcaagguccugcccuggguggauacuugaaccagagaucccgacccugcugcuccaucucaggaggcagccuuccugaccaaguguguuugacauggagcgcccuguggugcccaccuccaacccuccagucuccugguguucaucugggcaugucugcacaagcaaugcaacgcugggccacugcugcccgucugccuccccggcacggcacggcuccgcacgcaaccuaagcgugccaccacggucucuuauuuauggugugaucacccuggagggcgcccccgcccugcuggggcuauuuauuguuuaauuuauuugcugagguuccuccaagcaaccaccuucuccaggccccugggguguugaaagucaaauguggcuguugaguccacagacccccauccuaauuccugcaccuggaggaguuccccaacccccguguuugcgggaggaagcauuuguacaguggcuaauuuaaggggagugggagacccugucacccugagcacucugcgcuggggagggguuuaaauuauugaccuuguacagucugcuugcuggcucugaaagcugggguugggggacagagucucaagcccuuaauuuauuuuagcagcuguguuucugugacccuggugugacuaagcaucaggggugggguuguauaaguucaaaagugugaaaugucugaagaucauauuuuuuauacagguauuucaauuaaauguuuugguauauaauggaua

SEQ ID NO: 7929 - RNA, 3544 nt, Mus musculus
uauccauuauauaccaaaacauuuaauugaaauaccuguauaaaaaauaugaucuucagacauuucacacuuuugaacuuauacaaccccaccccugaugcuuagucacaccagggucacagaaacacagcugcuaaaauaaauuaagggcuugagacucugucccccaaccccagcuuucagagccagcaagcagacuguacaaggucaauaauuuaaaccccuccccagcgcagagugcucagggugacagggucucccacuccccuuaaauuagccacuguacaaaugcuuccucccgcaaacacggggguuggggaacuccuccaggugcaggaauuaggaugggggucuguggacucaacagccacauuugacuuucaacaccccaggggccuggagaaggugguugcuuggaggaaccucagcaaauaaauuaaacaauaaauagccccagcagggcgggggcgcccuccagggugaucacaccauaaauaagagaccgugguggcacgcuuagguugcgugcggagccgugccgugccggggaggcagacgggcagcaguggcccagcguugcauugcuugugcagacaugcccagaugaacaccaggagacuggaggguuggaggugggcaccacagggcgcuccaugucaaacacacuuggucaggaaggcugccuccugagauggagcagcagggucgggaucucugguucaaguauccacccagggcaggaccuugcuuagcccgcagccaucuuuggacagaagagcucaagaaaacccaggcccuguggagcagcguucaaaaaggcacucaaagcaaaggaaacaggcccggugccgagagcaaaggucaccaggggucagaggucacugcuuuugcagcagacaucccaggcagaaaguguucaauucugggagagcgcuggcuaggccgagcccaggccccuucuccuccucacaagcucucacugcuggaagugguacuggcuccgucgucaguauccagggcacaaagccgaaggucacaguucucuggaacgcuccccucuguccccagcauccaggggugggcagcaauuugguccagggagggccucucugagggccucagggagagacaccacucaauaagcugcuggcacucugcagagagaacagggggucagaguccugcugcaacacugcccugcccccaacacggccccagccagcuucuacaacacaccuggggagacccuccuccggaaaaagagccugccgcgcaagaucuccucauccugcucaaagggaauguccccacacaccaugucguagagcaguacacccagagaccacacaguggcagaccgcccgugauaucggugauaucggauccacucuggggggcuguacacacgggugccugagggaagaaucgggauuagguacacaucaggauauauacacacuggggggugaacacacugaacaacgggccuucauuagcucucagccagccuccauggggccucugagaaucuugcuugucaucacccuggaaaaaccccaacacagcugcaggcgggacucaggaaaggagggacauggagggcaggggaggaacaggagugaaggggaggugaaggcccaccccuaacaggccccaaggcaggagcgcgucacaugagcuccggcuccaguuucacaacaaacagauacaacguaagccacugggaaccaggccugguguucuagcuccucccgccccggcucgccuugcucagcucugcaaggcucggaaaggggaggagaggagcuuagaaagaggaggggcgggagagaugggaggagggaggagaggagugggggagccccggcuuccccgcgcuccgcaaugcggggauuucuacugcggcgcccccgcgcuccgcacgcacgcacgcacgcaagggaggcccgcgagcgcccuccccggcacagggaggggccacggcgccgaggcggcuggcgggggcccugcgucacgcgcguaucgcgggucucccuggcugccacccaccguccccagacccugcgcccucacaccgcagagggcuaccccgguguccccagucccccccaccccucccguaagccaggcguggcgcguggccgccuaacagucgccggaacgccgcaccaccugcucaccaucaaagucaguguagaccguguccuugagcaccgcgcccgagccgaagucgaugagcuucagcucucccgagcgcagguccaccagcagguucucguccuugaugucgcggugcacgaccccacaauuguggcagugccgcacagcggcaagcaccugcgcgaagaagcgacgcgccagcggcucguccagggcgccucguucagugaugaagucgaagagguccugugccggcucgggucgcuccagcaccaacaagaagccgucgggccgcucgaaccaguccagcaagcggaugacgccgcgcgcgccgcccgccgcgcccaccuugcgcagcagcaccaccuccaggggcacggccacuccgcccugggggacaaggcggucaucggacaaagccaaggcaacccacacccgcaugccccgcacccgcacgccccgcacccgcauacuuacgagacugccccacucggucacccgcuccuucaccacgugcuucacagccaccugcggggaaaagagggggcgacacgcgagcggucagacgggcggccgagcguggcgaucguccacgcgggugcgcccggagccacgacucaccgggaguccgucggcgaugcggcugcccgcguagaccgugccgaagccgccgcugcccagcacggcgcccaccugguacaccuucucgaagcucuccuugucagccuuggcugugggacaaacaaucggguugaugaugacccaaagccaccccccggcccccgcccaggcccccucccugguccccacacauaccuggcuguaggaucuucacugggaggugguccacgccgccaggcccgcagaggugcgccagggagccgaacuuggacagcagcaucgcggguggccucgcgugcggugccgccucugacccguccggcaaggacgcgggagggcggucuuccugaccgcagacagcgcggcggaucccacggccccgaggccgagcgcucagcggggcagccgcgcggcgcaguugcccgguggccgcgcgaaagcgcguagacggcagcuggccgagcagcucacacgccccggccgccucgccccgggguuuuggaccacggagauguguauccuuccgcggaggcggggccgccugaagcuccgccuccuuccgcccgaggcucgcuuugcgguguggcuguuuugagucucgcagggcggugcuggggaagccggacgcucccugucguuucaccaagggcugguggcgcgcggggacgacgacccguccggacuagcuugccguaguagagucgcggaggugcacggcguuccgcggcuuucacggcgcucucacccgcccugcgcacgcgca

SEQ ID NO: 7930 - RNA, 5551 nt, Mus musculus
cacugaaguugcagccuaagagaaagagacaaugagagaaagagaggcagagagagaaagacacacagagcgcgcgcaaucccaggggagcucagccuuuuggucuacuccacccuaaucucgccuaggggcgggccggagucuguaaaagaggaagccggaaguuaggcguuuggcgucacgcuuaguucaguuuccagcgguucucuucugacaaucgggcgggcuugagcccggaccugggccuggggugguuuccucuugcccagguccagcgugcacaacccaguucgucccgagugaggauuguuuacgugcauaguuaggugagaccgggcagugcaauuaccugccggcagagggcguguugcguuagagcggaucaaagugaccacgguguagcuaugggcacagcacuuguguaccacgaggacaugacagccacucgacugcucugggaugaguaagugugucuugacagaaguagggggccgggagggaacccugaacacugagauccuugucugcuccagccccgagugcgaaauugagugcccagagcgccugacagcugcccuggauggccugcggcagcguggccuggaagaaaggugccuguguuugucagcuugugaggcaucagaggaagaguugggcuuggugcacaggucagacuaugacagaucuggggacccgaaccuuuuauagcuccgcuagcauucccuuggguucaccguggugugggcuaaaagggauuacugggugggcacucccaccaggaaucucugcuccuuuccuuccuguccugcugguggcccgccugcugaucugcagcccggaauauauagcccuggugcagaagacccagacccuggauaaagaggagcuccacgcacugucuaagcaguacaaugcugucuacuuucacccggugcgagccagcauacacgcccauucacccagauuuauguccauaugccugccuaggugcauucacacccaagucugcucaccugccagugucuccuuguuuaugcuuuaugaccguacccuaccauguuuugcuugccaaugccccagcccugucugcucagcagugggaaaccugcaaccugggacaagcaggucaggucccaggcucaauugcacucuggcucacaggacaccuuucacugugcccggcuggcagcgggggcugcacugcagcuggucgaugcugugcuaacaggagcugugcacaaugggcuugcccuggugaggugagaaccaccuuccuccccuagcugucugugugugacccugugaggggacagaaugacucugacaugcccgguguuuccuuuuuuuuuuuuuacacccuaggccuccagggcaccacagucagagggcagcugccaauggauucuguguguucaacaauguggcucuagcagccaaacaugccaagcagaaauaugggcugcagagguguguccaagcuugaccugcaagugugggggacccaaacuaaauaggaagagguggaguuggugguuaagaggucccacccagcucccuccacuccuggcugagcuccuagccuaaagguggaaaggcagccacuuccaguaauccccaguacuguccgaauuuaggauucucauugucgacugggauguccaccauggccagggcauccaguauaucuucaacgaugaccccaggugagcugggguguggacacagcccuucucugccgcucaccauuuuggggauaaaauuccaguggugagacuaggggucuuaagaguuaggguucuuugagaagcuguggaguugcuaagggaccucacuucugaccuggccaauugucgacaguguccuuuauuucucuuggcaccgcuaugagcauggaagcuucuggccguuucucccagagucugaugcagaugcaguuggccaagggcagggccaagguuucacugucaauuugcccuggaaccagguaccaagucccccuccccccuccguccagccuacgucuccugugaaugucuccuggggcauucugcaagagucucccuggacuuuggaucccaggggugaagaccgugauguccucauuugcagggcugguccccugaugccugcuuugcuuuugcugcagguugggaugggaaaugccgacuauuuggcugccuuucugcaugugcugcucccacuggccuucgaggugacugugugguggguguccuccuaggcuuacccagagucccacugugaagacuggagaguugaaagccacuccaguguaugaaugggaguagggaaggugucucagaaagucuaaccuuaugugaguggguagcacugggaccuccccuucaccugggcuauugcucucuuugguuccuucccaccggauccugccuauaguuugauccugaguuggugcuggugucggcuggauuugacucugcuaucggggacccugaggugagaacauggccuggcuugggaguaauguaagguucugggggcccagguccuuaucauacuuacuguguuucaggggcagaugcaggccaccccugagugcuuugcccaucucacacagcugcugcaggugcuggcugguggccggauuugugcuguguuggagguaagugcccaagggccaggggaggggagggcaccagaugugagagucagucgagauuagguguucugccugguacggccacucacacuagugacaucccuccucugucccauuucaacgcucuuccuaggguggcuaccacuuggagucccuagcacagucagugugcaugauggugcagacacugcuuggugaccccacaccuccccuucuugggcucauggugccaugucagagguuugaagacuggagagccagugggagggggggauugaggcuggagggggggagucaggcuuacaacucuacuucuugccauagugcccuggaguccauccagaguguccagacagcccagaccccuuacuggacaagccuccagcaaagucaguauggcuuggaccuggguugguggcuccacucugagcuucuuugcagugacugugacucugaaccguuuagauguggccccaguucugaguuccagcacccacucuccugaagagagaucucugcgucugcuuggugagagccccacaugugcaguagcagaggauucacugagcccccuccuggaccaacugugccuccgcccugcaccuccaaucugcacagcgguggccucgacuguaccaggugcugcucugugcuuaccuccuggagugcuccaucaagaagggucagucuugagggaggagaccgaagccugggccaggugaggagagcggaucugaggacggggcuguacaugccuugcaccugugucacugauacaauuuugauuuccauguguccuucuggccugcccguuacaggcuucacaaaucccgguuccaggaugaggaucuugccacacuggggaagauucugugucucuuagauggaaucauggaugggcagguagagucgccggggcuacagcugaagaugguggcgguggcauguacaagggguugacauguuaccuugggcagggaaaguggacgauuuaaaguguaguuuuagggcuggagagauagauagauggcuuagugguugagaguacugacuccucuuccaaggguccugaguucaaaucccagcaaccacaugguggcucacaaccaucuguaaugggaucugacgcccucuucuggugugucugaagguagcuacaguguacuuacauaugaccauaaauaaaucuuaaaaaacaaacaaacaaaaccuguaguuuuaagcaauuuggcuuuuagaaucgggggcgauuugaccuuguaguguagggaaaggagguuaguaucagccauuuggaaaagaccagaacaaagcgugaauggguuuaaccuaaggucugggagcuggcauugacuccugaaaguccuccaaagagugugugugugugccagccuguuguuuauucuguagauaagaaaugccauagcaaccacaacugcccucgccacagcagcaacauuggauguacucauucagcgaugccuagcucgcagagcucagagguaaacucugcuugguugacuugaguccccaaggaccugggaguacccacucaauggcauagggagggcccucaaauggauacuggacaaugugagcccagcccauccugggucaacuucuuagggugcucuguguggcccugggacaacuggaucgaccccuggaccuugcagaugauggguaugauucucuagcuuauacaucucaguugugcauggacagguagugggcaugugacugggaauccagggucaccguugggugagaacacugcuucccauaggugcaguuugagaguggaugccccagaacacagugccauaccagguugacagucacuuacgcccccaccccccuggccccaagcucuccucugucuuuuauugauaagcccugggaagggugagcagggucuccugcauuaugugucuauggcccuggugcuuucucuugagaaggagaauucuguggcucaacauccggggcaaggaugcagccauccaguccauguuccacuucuccacuccacugccacaggugaguggcuguguugggguuggagagcuucuccgcccccccccccccgccggucucucuggggguuccuguucacaacccagggucccugagauuggggguggggugggcgacaggagccacuagcagugcccuuuagaugagagucugaggcucugcuauugucccuacagacaacuggaggguuucugagccucauucugggucugguacugcccuuggccuaugguuuccagccugauaugguguugauggcacuggggccugcccauggccugcagaacgcucaagcugcucucuuggcugcaaugcuucggagcccaguagggggccgaauucuagcuguaguggaagagguaaacuggguaggguggcuacguuauauggguggaaggugggcagaaacaacugucucauugcggcgcccaaaccccacucucuccgagccaggaauccauacgccugcuugcaaggagccuggcgcaggcauugcauggagaaacaccucccagucuggguccuuucucgaaggccacuccagaggagauccaggcucugauguuucuaaaagcucggcuggaggcucgcuggaaauugcugcagguggcuggugaggcacacaggggcaaaggcgacgcccuacguuagaacuacguggagccagcuucaccaacgagucaacuuugcuuuuccagcuccuccaccauaauaacagugauugccagucgcuugaaaucggucaaggugggcgauucacacgugaaaaauagcacacucgggccccagcgaaccauggcccgagaccuacgucccgucugcggcccaggcguccucuaccuccagaacaauaaacaucggccaaacacaacacau

SEQ ID NO: 7931 - RNA, 2669 nt, Mus musculus
ugaacauacacuuucaucccuuguuuuccuggggcaaucuagcuucacagcagucuucaguguuuuuaaguggauuggcccacuuaggauuagauuuaaggcccauggggugcuggcuuccccccuuaguugaaagcugucuaacucuaucguuugcuucucuucgcuucccgcaggugugacuuacaaggaaguucucagcuucaagccuccuaggcagcuaggagccagaguuccaaaggagacggcucugugacgaccucugggugguuugggggguauccaaaggagguuggcucggagcuucacggcaccuuggcuucccuucucuggaaaaggaauccugguuaacaccccgacagugccuggagcuuguaucccaagucuuccaccuggacaugcuguguagacccuugaaucaugaacccuccaucuccaaaccuguucuucggcuuucgagugccccagaugacccuggaagaacaucuaagcuuucuguccaagaccccuacccaacaugggacuagccuuugaauucuggaguuguacaugaaaucaguauucgugaaaaagcuucagagugagcagagcuuaggagacaagugccagaccugagcucugcucgcucuggacaaugccaaggccaacuccugagacggaaugagacagagguuuuggggacacugacucagggacaucaucucuucuggaaguggguggauucucuuacacccuuagccuggaauucgaaccagccauuugguguugccuaaguggcugggggcaaauaaacccuuuuguagaucucccauucugguuguguggccccaugccuugagcacccaucaguucuccaagcugcucugugcacaaaaaggagcuaaccugagcucuauguccuccagcuaauagaggugccaguccccugacucuucccaggccacagugcuggugccacuuaguccuugccaaugcuucaagccacauuagggcuuggccccucccuucuugaaugacuguacucuuaaggcucagagucugagcaggaggucuggagacugaugcaagggaggaugguggggaagaugauguuaagacccagauagagggaugccuccuucuuucugaguuugcagcauuugucuuccaaugguccagacuucuagugaggaaggucuuagcucucuaccagcauuucccuggcagccucccugaacccauacugucaucugcaagccauuagacacgagaccacacuugggcugguuagaugguccauguucuuccucaugucccaaggacaggugcgacagggcaggacauaagggugaggucuuucauucccuucauuugacaaguucugggcaaauacacuuugcccagucuaaucuugucagaggagaugccaugaccauggcuccacugccugaauccccuugugauaaccaugguccaaggcuucaaauacuucacccaguuacagagguguggcucaguucaugcccuaccccacaauauacauaaaccaggguaguuaauuggcuuuuagaagauggagaagcuuugggcuccuccaaaauccuugccugaacucccaacuccugaguauggcagagggcaccuacuucuaaccacuccagggcucuuugguuuccccuguacaugauaguuguauguguuccuaucacagacgucagcggcagccuugcccccuuccccucaucauccugggggugugucuugucccuuccccccaucuugaggcaucuguaaugccaacacucauuucggaacuggagacaaggcuggacuauggaaauguguguguguauauauauauauauguauauacauauauauguauauauacauguauguauauauguguauguauauauguguguauauaucuguguguguuuauuuguguguguguauauauauauacauauauacauacaaacauacauauauauauauauauauauauauauauauauauauauauauauauguauagucuuagcugguauuugagcucaugucuccuuuguuccuccuuuccuaaggcccccuucccugcuuccucacccuuccuugcucagaacccucuacccuuccuagccucacacugugcugcaguuuuccuggcuggccuggcgucuuauauaacucuucuauuccaguggccucuuucuuaccuguggccuuucugucagucccuucuggaaguucagugcuuugauccagcccaggccagcccccgcaggcacucacauacacacccugcucacuucucuccucuccaucuuucaccugcgggagcaggcaaauugguugugauugacaguuggcauuucugacucuguggccuaaacuaccagguuaggcuaggaggaugcugggggcaagaaggaagcauagcugcggcuguagcuauggauggccugaggacaggcagcccugucuuccuauccauuucaagaaggacacuggaggcgguacuggucguaggcuccgcgccacacguaguugucgguggcacugaaguugcagccuaagagaaagagacaaugagagaaagagaggcagagagagaaagacacacagagcgcgcgcaaucccaggggagcucagccuuuuggucuacuccacccuaaucucgccua

SEQ ID NO: 7932 - RNA, 7149 nt, Mus musculus
cuuuugcacagacaagagcaagagggaugccccuuuauugugcacacucuuggugcaggcacuugacauccagagccccuuggucccugauaagcaagagaucauugucucuucagggaggcguuacacccccaacgcguuuucaaacagggcccuaccucaaaaguuacuuggucagcuccucucugggggauggggagaugaggggugacuugcaaaccauagcaccccagaccagcugcagaaccucaaggguugguggagguagaacguggacagacguuugucaacuuugaaucaaggucccggggcaagaauguccaugcucacauccgugggugcuggccaccuagcauccuugagauuagacccccaacuucaucagcucuccagcuggcauugugcccuugugacucaggauccugcugcugcuccuauacccuuacauuugcuuaaacuaauggaucuuggcaccucucagagccuuuggucuaguucacagcugggauucaagacccauuagaaaacaggaacuuggggggagaggaggcaagaguuaucuccaacuuaggcaccagaccagaaauggcugcugccucuugggugcucagagauucauacacaccagcacaugccugcauuuguucugauguguaucccagggugcauacucaugcccaugugcccacauaccacaggcaaccacaaaucuucagcaggcuuuucugacuagauagauaaucugaugguggucucagcuuucccauccccagaggaaacgccacucaguuaggagggacacugggcuugccucugcuuucagccacucacuuccugguugagcaucuccaaccacugugacucccccucccucagagucuccagggaccauggcccauuagccuuccucccaauccagauaguccucaagagcagaagagaccuggacaaggacagggacacacucagaucccacacacggaggucccaaggagaaccuggguggaccaagguagguccagaaacacuacugcccagacuccagcacauaaugggagggaggcauauguacacauccgugcauuccucuguguguguguguguguguguguguguguguguguguguguagaguuucucaaggcaagggggucggucccagguuaagugucagggcugccugagaggcgccucuugaggaaagccggaaagcugaguagaggggacaggcucaggucucccacuucaggcaaugccucacugcucaauuucaugggugccagggagcugugaggguuccaggggcuugaagcuaaggacuucuugguaaguaagcucuggggaggggaaugaaaaaggggggaagggugagauuaugcugucugcccacuucccuccaaaccucugcuacacacacacacacacacacacacacacacacacacacccuuacaugucucacucagaaacagauauguuuccauccuccuucccccaccccacccccugcuuccccuccccaucccagaccuuuggggaaguucuggggaguuccugcaugaaacagguaaaaucuugcucugagaaaaggcaacccucagguucacggacacugcucucuuucccauccucacgccccacgccccaucccugugcucacccuuccacuccuccagcgugcgcuccuuggccucaacacuuucaucauagggcucugccucuggcucaucgucagggucaugguacuggcugaaguaugcgugggccaaggcuucggccgcacugacccucuggucgcugucuaguaccagcauucuuccaaggaggucuauggcugcaggagugagugaggcuuagcaccauagccaaugcuagaucugaagcccagccuagauccaguaccaguccuuacccaggggguuggcuccauggaagacacugcugagguccuucuggggcaugggaggcagagacuggauguauguccgggccuggagacacauaagaagagcuuggagggcuaacuaacuucuauuuuccuggcccaaacugggcagaaggccuuuagagagaugcauucauuccaacaggccugguagguaccccagcaagccagacuccugcucucaaagucggggcagggugggcgcucccuagccgagcaguggucccacacaugccuuuauucccagcauucaggagguaaaggcaggcagaucuccgaguuugaggccagccugaucuauagagugaguuccaggacagccaaggcuacacagagaaacccugucucaaaaacaaaacaaaacaaaagucuggggggcuccaggacuucauuuggcuucugauggugccuacaaaagccaaaagcucaacucuucccugccucaauagugucuauaagcaggggagucugucagcacugucucugcuaccugaaauggccuccugguucaccugcuucucucugaagggguuggauguuccuaguacaagcuccaucccucccugcucacauuccucaugcgaugccauuucugcuuacuacucccuccccagcaugacuggugcuuggucggaagagccaacagauagacggauggccacuaacucacaugcuccgaggauaucuuugccagaaccucaggacugggcgugcccaccaccuccaugauucgcuucagcuggucgaugucuaccuagcucaggaaacaccugguggccagcguuuccggucccagccccugguacacuguagagcuguggcucaggacagggagccccguguaaugugugauauggcauagggcagaggaaagacguccaaaaagggccagaguccacucccacccuggagaaggggaccccagcuggacccugcuccccaaggauacagucguuuccaggaaagagggccuuuccuugcagcaguucagccaugaugcagcccacagaccagauguccacuguugggggagaauaaggagacuaucagucugccaaccccaaauccuuccugugagccuggggaggagccagcccagugacccucaggcauaaccaggcccaaagagaccaguagaagccuuacucuauacccuguccugagaagaggcaugaggacagacacccaucagcuuagaagccuuucuaaaagcuggucccaccaaucccuugcuccucucacagagcuccagagaugcucuccuccccuucagccuuucuuccuacccccacggcuuugucauccucccuaaacagugucagcacagccugcucauccuuacaggacaaagccacugcuuuaaggguugacagcaccugucugguuguagugcauccaguuuagcaugaucucuggcgcccgguaccaccguguggccacauauccggucaucuccucaucagccuggcgugcuagcccaaaguccaggaucuggaggaccacggggaucucguguaagacccccaccuaccucucuauguggccccacugucugugcaccccucaaccgcccuuacccucagcucgcaguccucguucaccgcuacauugcugggcuucagguccugcagggugcaccgggcauugaguguggcgaggccaugagccuaggcagaguggaugacccucacccuugcccacagcugcaccuacccgguggaugaugcccgccgaguggauauacugcagaggagagcagaccgagugagcccaggcgccaccucgcucugcccucaacccagagcggucgggggggggaggggaccccagagcccacaugccccaccuucagcccacgcagcagcugguagacaaggaauugaacaugcucaucgcucagggccugacacuugacgauguuauucaggucggcgcccaucagggucgucacgagguaccugcaggaucaggaguuaggacagucucaccaccccaucuccgacuaagcuccccagacuaccaccgcgccugcccaggacgcucacacuucgcugaaauccucgauggauguggccggcgugaagacguccaaaaguccuaugaccuggucagggaaccgaggcaggaucacagcuuagccuuaggcaacgucccguuggucuggaccccacccacaugggacuguaccuccagaggcuccgccccuauaguguaggucccgccccccaggcaggaugcgucccuuguucagucccaacaucaccggucgguccccccucucacguucucgugcuucaggugcuugaguaggcgcagcucacgguauguccuccucgcguggaucagcgauuggaaagggcgagacagcuucuuuacagccaccuucuggcgcagccgcgcgucguaggccgagcugcaaggugggcgaaugaggagagcaagcgccuggccugaauccacccgacgcugggugcgggagugagccucuguugcuagcucuaaaaccuaggaagccuguccccgccugcucgccccgcgcugccuccacgccgacccuccugauccucccuuaggagaccccuuugaguggacaaagcguucucuggcagagaaccggugauucuagcccaaaccugagcgccccccccccccccacacacacacacaacaaggccacggcauggaaaauaccacgacuguacccacaggcgcucccacagcaagcagcccuccuccuuccucacggaugccgugggaggcuuaccuacaaagcccuggacgccccacccccacgccuccgcacaucagauugcggaagcaagauuauccggagguguuuauugcuuccugauuuguaauugaagccgagugugguguucaugccuguaaucccagcucuuggagagagggagaggcgagagaaucgagauugaguucaaaaccagccggaaaaccuagugagacauugucucacaagaaaccaaaccaaaacaaacaaaaaaauacacacacacacacacacacacacaauuuauaacucagcaaauggauaguaggaaauguuuaaccccagugugaagaugucucugacacacuuccacucccccagaaacuggacccgccaccucugcaccucuuuacccuucuauccuucaccuggagagccucgaaagagcaaaugagagcacgcuuucuuugugggcggggccuaggccacguggacugagcggugguccuaaggcuuuucaccagguucugaucccucugccucaagacccggagcagcugcgaagccacugaaggagcccuggcuacaguaccuuuacacagccugcuccccuggugauuccuguuccuucucucccucgauucucuucgucucaggaugcacccuucccuugcaguggugaauggagacaggguaccacccauucccaccaggugagggaagauggggaaggggcauggugguuugggaugcucacggaacuagagaguuguagaagaaagguggcuuuccuaugauaagcagaaugucuaaguaacuucugggguggagguggguggggaguggccacuagaacagcaggauccucuuacuugacugccucuguacaaucaaguuacaagaaguuggcaucccauggccugccucagcagggugacugaacaaacccagggucacggaucagcggagacagaccuaggucucccuugggaaaucuggcuuuucccugguaacuccuagaugguccagccccgagacaacuccaucugagucaauguccaaguccccugcaaaguaucugcuucaccuuccucccugcccccuccaaguccucccuggcucuccuucccucuaauuuauuguauuauuuuuuuaaaauguauuuucguguaaccuuauccuccuccacuugcugagucccugaacaucccagacacaacaugucccaucaucucuuccucuguccgacuccuuggguauguaugggugauggaguggguguauccugucucuacucacuguggagggcugggguacagccugagaagcaagaauaaggagcgagugucggcagaacaagccuacccaucucagugguggguuuacaggcugcagacauggggcgagaucccaugaccaacucacucugggcccuguaaagcaggacuguuugccucuauaggguugcaguagcaguaccgaggcuucggaugacagcaccggauccaagaugugagacucagcccccauucccgguguggggcacauaccaguguccacacccuugaucagcccgucaacaagggcuaucuacagccguucuccaaucccaggugccuggaugcugcccacgaucgagacugcaaucucuggucuccaagcccuaccuauauucugagauccuuuguuggguaaacugggguaggguguagacaagagaguagguguccgcuuaggcucaagccgcugagcuucuaggaaucuggaggcgcggguaugauccacaggaaaauuuuggugucuuccaaauuagaaaggucuccucaccccgcuggggguccccuuuucaaauacuuagucugaggggaacguuagacccugcagcuacuuagaccuugcccgaaauaacccggauggcugacuguuccauuuagcggccccagagacuugcucucccgccagcugugacgccgcaauauucagucuuuuggggaaaaacuaggaaagggaucggagaugggggggggggagagggcauuagaagacccccccuaccugccagcgaguggaaucuaguaggaaaguuuccuccguguccccucccccccauucauucaucggaagcgugcagaccgggggcggaggcagggcgaggccccuccccacgccgggaaccccacgucgcgcuggagggucgcacacgcuuucccgcccagcucccaccagguccuugccggccccuaccagacugagccguaggcgccggagcccaccgggcguaggcccugcagccgcugcggcaccucccauacuguuuuguucagcucuugccgguagaaucccgcgcgcggacccgacauauccacagaagcagcuggagcgagcgccccggauccccgcgcgcagcacccggcccgcgccccacgcccagcaccgcugagcaaagcggggugggggcuggggggcggcggcgcag

SEQ ID NO: 7933 - RNA, 500 nt, Mus musculus
uuuugcacagacaagagcaagagggaugccccuuuauugugcacacucuuggugcaggcacuugacauccagagccccuuggucccugauaagcaagagaucauugucucuucagggaggcguuacacccccaacgcguuuucaaacagggcccuaccucaaaaguuacuuggucagcuccucucugggggauggggagaugaggggugacuugcaaaccauagcaccccagaccagcugcagaaccucaaggguugguggagguagaacguggacagacguuugucaacuuugaaucaaggucccggggcaagaauguccaugcucacauccgugggugcuggccaccuagcauccuugagauuagacccccaacuucaucagcucuccagcuggcauugugcccuugugacucaggauccugcugcugcuccuauacccuuacauuugcuuaaacuaauggaucuuggcaccucucagagccuuuggucuaguucaca

SEQ ID NO: 7934 - RNA, 40954 nt, Mus musculus
gggcccuucuggccuacggcggcagcucgacugcuccgaggcggcccaggugaaccccugcguuucuccgcaacgugcccggguaccgcuggagcugcuaccauggaggugccggugggucccgggccccggcaagcuggcggaggacuaggcgcgacaagauccucguccuccggccgcgcggcgcggaccgcggagaugcccugggcgcgcuucucugccuggcuggagugugugugcguggucaccuucgaucuggagcugggccaggcgcuagaggugagcugaugggcuggcugacccuccagaacugucuuaguaccucuccuucggcggccugaaccucuccagaggccccuccucuccggacgucccuccucucccgaugccccucccccucacgcuccucccuucucucgccugcaccccugcuucuuuccucccauuccucuaagccgccgcgcgguuucucuacccggggcgcccacccuccaggaagcaggacuuuucgccuguagccuuccugcuuggucuagggucuucuuaggagccucucggaauauuuugcacccucaggcugaccuuucccccacuuccuucggcuagugacuagcuuagagaccuccucuuuccuauugccugucaccucuccaagaggagccucuuccucagagcucuagaaacccuucccaggccaaggaaggaaagaucuguaaagccugacugccuguccaucaauguauccuacgcagcaucuaacauggaccuuucuccaaagaggcaaacauaucuccagccccuugguugcucaagccagaguccuaggguuccccccaccuugcccccgccaccgcccccaggucucacacugggucugcugcagucuucagugucacugguaguucgcuucuggcauuccucuugucuuucaauuagaaucagauccagacccugugaggcccugcuugguuccugugucuugagcucuucucaaccuuuggcaucuggucaccagcugugagcagcugggcagggucuuaggcuuuugauguggucuuucuguggucugaaggccuccaucccccuuacccaccuacaaagaaaggcagcuucucuucuacuagauaagaugaaaauaucagccaggcauaguagugcgcgcaaacccagcauuucggggacugggugggggaugggagguuggugaagcaagaugauuaguuugaagcuagucuggauugauagagucccaaaggagccugagcuauagaaucagaccuuguugaaagaaagagaaaggaaagaaugaaagagaggggagagagagaacacauuguggcacaugucuuucuuuaaucuaguacucuggaggcaaaagcaggcugaucucuaugcucaaggccaaccuggagcaggcaagccaaggcuacauagugagacuuugucuuuuaaaaaaaagggagggggcuggugagauggcucaacggguaagagcacccgacugcucuucugaagguccugaguucaagucccagcaaccacaugguggcucacaaccauccguaagaucugacucccucuucuggugugucugaagacagcugcaguguacuuacauauaauaaauaaauaauuuuaaaaaaggaaacaaaaacaacaaaaagcaaaacccacaaaaccaccaggaagauaggaggaggaagaaaguguuacaggcucaaugaagcuuuugacagguccaguuaagguaaugacuaugagccgguggugguggcccacgccuuuaaucccaggacuugggaggcagaggcagguggauuucugaguuccaggccagccuggucuacagagugaguuccaggacagccagggcuauacagagaaacccugucuugaaaaaacaaaaaaaaaaaaccaaacaaagccuugguuaaaaagccccacuuucugcacuguagauccuuuccuguagaguuacaacagaaguugagagacuuuuccuuuaaccaaagggaaaaaagaaaaagaaaaccuggugugguggcgcacaccuuuagucccaacauucaagaggcagaggcaggcuuaucucugugaguuugaagcgagccugaucuauauaggaaguuccaggacagccaggacuauguaaagagaccaugucuccaauaaagaaaccuucccucgcccccucaccccccaccccaugcauucucauuucuuguucucuaaaagauagccauuuaggaacuuaauucuaagcaaaucccaaaggcuuuuuuuggagaaaggauguagaguuguuuuauacaggguaucauauagcccagacuaaugucauauucauuuguauucaaggauccuguugucucuaccuuauaauucugggaugacaggcgugugccaccacaccugagccuauggggugcugggggugggacuuaggguuuugugcagguuagguaaauacuagcuaugcccccaggcuggguuuuuuuuuguuuuguuuuuuuguuuuuuuguuguuuuuucgagacaggguuucuuuauauagcccuggcuguccuggaacucacuuugaggaccaggcuggccuugaacucagaaaucugccucccaagugcuaggaucaaaggcgugcgccaccacgcccagcucagauaauuauuuauuauuauacauaaguauacuguagcuguuuuaagaacacaccagaagagggcgucagaucuaauuacgggugguugugagccaccauguguuugcugggauuugaacucaggaccaucggaagagcagucagugcucuuaccugcugagccaucucgccagcccuuggaauucacucuuuaggcuaggcuggcuuugaacuuguagcaguguucuuccaucuaccuuucacauucugggcaugcaggcguacaugaucacgccuggcuugaagguaaucuuaaaggcuauggacuuggacuccugagccuuugcuggacaguggguguuguacugcagcuuguugaguauuagagacccacagucacgccugaaaugucccacgguagugccaugagucuuucccaaucucugacuguauggagaagcccagcaguaagucuguggggugagucacgcaugucacccucaucauguuugccuccugacuuuccuccucacccuagacaucucaggguccuacagccuuccaaagagcuauuggcccugcacucauucucagcucagccugacuaaguuguaggaaacccaggauugauuguggugugggcauauggaagaaagacaguccaccuccaggagauucacccaggcucagcuacguaaggaugggaagcaggcagugagacugaagacauuucuguuucaggugacccuucccuauugaaggcaaaaaguggcccauugaugcauucauucaucaaccaaucaaguucugagcagccaccaccagacagguccugcugugucuaugcucagcucaugguucauaaaagcaaaagcagauauagccucauugcccugcaggaguuaaccuuugcuagaaacaaaggguaaguaaguagcuuggggccuguaguacucacagaacucccgcaacacagggcaacccucagcagaugggugucccaaaaccugcgugcaagacaggguaucuagcuuuacaggguaauggagaggaugagaggagacauguguugggguaccuguaggccagcugaagaaagggccugacugggccaucucagucuaucugggguguccucuggccaguauguccaaagaaacccuuuucuguggugucuacagccucccaggagguagcucucacaaucccagaacccccuuuacaguuuuugguaguggcagggguuccccccaccccuagacaggguuucucuguguggcccugauugucccauaacuugcuguguagaccagacuggccuugaacucagagaucagccugcuucuccagugcuggaauuaaaaggugugagccaucauugcccaauaauuucuuucuuuuauuuuguuuaggggggagggggcggugggggaauggagaaggauggucacacuuugaagcccugccuguccugguacgcguuauuuagaucaggcugcccuugaacacacagagauccauccugcuucugccucugccucugccucugccucuagaguucugggauucaaggcaugugccaucagucaguuuguuguguuuucuuuuuguuuguuuguuugucuauuuuguuuuguuuguuugaaacuuucucuauguagcuuuggcuguccuggaacucucucuguagaccaggcuggccucgaacucagaaauccgccugccucugccucucaagugcugggaugaaaggcgugcaccaccacugcccauuuuguuuuguuuuguuuuguuuuuuguuuuuuaaaagauuguauuuauuuauuuuauguagacacuauagcugucuucagacacuccagaagagggcgucagaucucguuauggaugguugugaaccaccaugugguugcugguacuugaacucaggaccucuagaagagcaguaggugcucuuaaacaccgagccgucucuccagcccccaccauuuauuuuuauauguguggauaaggccaggcauagcggcccauacccucaaucccuucaaucccagcacucaggaggcagagaccguggugggaggaugagaggaggaagaggaagaggcagggagacccaggaucuucauuuccaggggcucuaaaguccuuucccaaccucuacaggacccugcauacacacaaacucucgaaggcucccauaugugcacauuuuuguuuguuuguuuguuuuugguuuuuguuuugagacaggguuuuacuuuguagccccagcugugcuaagacucacuuuguagaccaggucgccuuugcuuuuauuauuuucagugaggcuuuuugagggagggggucaccugacacagaaccuucuucagucucauggccucugccucuuaguacuaguauugaaggcuuaagccacccuuccgguucucagcuugguuucuuguaccacccagaaccaccaguugagggauagcugcacccaccacaguugggcuuucccacaucauucaauucagagaaugcccuuauugacuugcccacuggccagacuucucaguugagggucacucuuccugacgacucuagcuagcuagugucaaguugauggaaacuagcaagcacacuggauauacacuaggggugaaggccauggagaagagggucugauguaagacagccucuagaggaggaagaugucaccaggaggccagaaggaucgccugcccuagcaaaaaacaugccuguggcccugcugagcugucuuaguggacuguaccacuaagacagacacaggaucaccaagugcucucugucuuccccugcagcuagucuacccaagugacuuccggcucacagacaaggagguagguucuggauuucuugggaauggauggccccgggagugagucagcccucacuggguucuguuuguuucagaaaagcagcaucugcuaccuggccuucccagacucgcacucagguaggugaucccguaccccuuagacacucacucugagacuggaagguaauagggaaagguggacgacagggccuaggcgcaugguaucuaggcuaccagcaguguacaagguucuaucaggauggacccucaccagagcccaagcugcaguaagguagccagguucucuaaagcccauggauagccauauaucugcgcaaucuggccuccuugacgccaugacagcagcugacccgugagcacuguguaguggauucuccugucccaggcagacugagucaggcuccuucagggaaacugaaagugauucucuguguugauucauccaaggcccauguguugucugcaggaucaggcuaggagucugcugggaaauagauccucaagucuguuugcccuugaucggauauuugugccaacaaaggccagcccggugcacccuuguaccacagcccucagcccugacaaugggaggagauucucccacugugacuuguauggugggacugccucuuuccagggugccugggagacacucaguucaguuuccguaugcgucagugugggggacaaaggagccucuggcagguggaugaucggucguauaacaacaaggcccccuuggcauugcagguaaguaguggggugucucucuggucugugucuucucucccuugguggggggcuccuggcugugaaccugagcuuugugugauggaagugcuggccaggcucauccugagaggucaaugacaguugcagguccugcugauucugucuugggguucuccaccuaggccagcucuuaugggguucaccaggaucacugaaguugauucugugcacccgauuucccuugcugggcaucuguguggcuaaauaagcugugguucaaugagcaaaacccggagggaccuuccaggggucuuggagcacucucagauuggcuaaauucuuucugaaucagcagauguccucuagaccggaucagcccacuuucagaacuagggaauccuaagucucacugugcuaggcagagggcaggcccuagucucaggggcaagugccuccuagggucuccuagauucuuagaccccacacauauacccuuuccuuuaaagacagggucucccacauagccuuggcuguucuggaacucacuacguagaccaggcuggucuugaauucacagagauccaucugccuuugccuucuaacccuaacucugaguccugggauuaaaggcgugugccaccaugcccagccuuagguuuccuccuuaaugaccuuugcuuaugucacccuggaucuagcuaaugcccuagguaugcgugacuaacacugcacuccuuacagagggagccagcacacuaucugggcuauguguacuucagacaggugaaggacagcucugugaagagggguuacuuccagaaggugagcugccugccacuguggaguaguauuguggauagguagcaaaugguagacagcccaagaacagcaagugaggagucccaagccucccuggguuccuguccaucugcagcccaccuggguagcaggaccaaggaggagccaccacagggcccaggacuuccugaagcccucccuugccuaguauggcacuugagaccuuucuguccuuugguccagaauaucucagcuccucaagucuugcuggugucaucacacugccaggguaaggaacuuagccagcccacauuuuccucugaagguccccggguccaguucuaauccuguuguugucuggggcuaucuacuccauggcaaaggcaucaggcuuuuucuuguccaguccugacacaugaguuagggcuugcuauucuguggcagcuguucaaugggguggcagggaugugcugccccagccagcuguggguaagcauggcuucaggguugccaugggcuccugaauuauaggagugaugucuguagcugaacccccucugauuggcccugccucaucacagucuuuagugcuggugucccgccugccauucguccggcuguuucagucacuccuaagccugauugccccugaauacuuugagaaguuggcacccugccuggaagcaggugaguggucaucagauguggccaacacggucucaucucagccuuuugggagggcuacugacauuggccaccuguguccacaguuuguaaugagauugaccaauggccagcgccggugccugggcagacccugaaccuacccaucaugggagucgucauucaggugagggcccacggaagagugagcaaugcugguguugauggguggagaggcucuacuaccuuccuggcagcugcuucccuccuccucaggugcgcaucccauccaggguggacaagcuggaauccaguccuccaaagcagugugaucaagaggugggaaauggggguagaagggguuguauggggguugggcauuaccuguguucuuuuccugggcuggaugguugucuccucuaccucaccggcuuauuuuguggaugcucaaaccuaggcaaagccauggugguggccagcauguugcaauguggagccugugcuguggggagggaaauggcagggggaaggaguuauugucagauagagccuuccuccaggccugaccuaccuucccuucccuucucagaaccugcugccagcuccaguuguccucacuaguguccaugaacuggaucuguuuaggugagcccuggaggguaccacagccauacacuauugucaugcagggcacaacuugccaagagaggcugccugucugagugacccuugagacgcuugcacacaagaagaaaccugcgcccaauuaucugacuuaggggaaaucagggaaggaagguucuguguguggagagguugccagggagacauugcucucugaggcugccccuuugugcuuuucuaaguguccucaaaggagccugggcuucagucuggagacauaagaggcaauaguaggggcuggagagauggcucagugguuaagagcacuggcugcucuuccagagguucaauucccagcaaccacaugguggcucacaaccaucuguaaugggaucugaugcccucuucuggugugccugaagacagccgcaguauauucauauacauacaauaaauaaauaauucuugaagaggcaauagugguagcagggcccuagauuggcaagcccuccuggggcuuuggaucuguaacaggguuuccaggcccucacaagcaggguccaggucgcauccccuaggucugucagaacauagguggugacucuggugaccugagcuaccacuuaugcugugaccauccuuccuacugucuuugggagggggaguuggugcucugcucacaacagcaccuuugugacacggccgccugaccgcaccaggugcuuccggccagugcucacccacgugcagaccccugugggaacucaugcuucuuggggagccccucguggugcuggcacccucacccgacgugucuucagagcuggugcuagcccuaaccagguacagacuuuacucacuagacugucauggcugugccugguuacccuagccuuacacagcccuugcugccccccccaacccccgacagcugccuccagccccugaaguucugcugugacuuccgccccuacuucaccauucaugacagugaguucaaggagcuuacaacucgaacccaggcuccguaaguacgcguccucgcacccugcucacacacugccugccucuaggccugucucugccucuucucugucugucugucucucucucucucucucuagaccaaacgugguccugggagucacaaacccuuucuuuaucaaaacacuccagcacuggccucauguccuccgaauuggggagcccaagaugucaggugagaggccccagggcuaugaaccucaucagcuugggacucaagguggaguucgguucccaacaccuccgagcccaccuuacaccuuaggcagagcuguggguacugagccuuggcugcugggugcguuucacaggggaccuuccaaagcaggucaagcuuaaaaaacccucacggcugaagacccuugacaccaagccaggucugugccucccccuugggcugcagccccaucuacugcaguaaggccuguccugcacuugguagauuccuccagugggagagguggccaggcuuucugacucuuuuucuuucuauugaggccccaugauggcggggggcgggggggggggcauugcccucuuuagcaggucccuugagucucaggauggauugggugagagaugugcagguucugcaagggaauggggcugcaggcagaucagaccaccaucuucaucaucgguagagcucugggguuguggaagggaggcagaagggacagccacagcucugaccuccugucaggccucuacaccuccuauacugcccaccuccaccgggacaaagcgcugcuuaaacgacugcucaagguacagccuacuggguagggccuggacgcggggacuugguguggugugaaggaugcaggguaccagucgauguugagucaguccccugcuuccucuugcagggcguacagaagaagcggccaugggaugugcagagugcccugcugaggcggcaccuucuagagcucacacagaguuucaucauuccucuggugagacaggcaggagugugccaguauugggcaugagggagacacaguaggguuuagugacuguagagccugugacagggcuuguggcucccauucauugccugucucucucuuaacccuccaggagcacuacauggccagccucaugccgcuacagaagaacaucacacccuggaagguggaguccagggacuucuggggggggggugucaauuuaguccccauaccaagaagggaaggccugaggcagguguccacauguaacagagagcguggcugagauacagagccacgagggcacaaaguugacucugugccugucaggcgucccccaccaggcagcgaaauuagaauugcaaggaggggcaccgauagaaccccugaagagauguccagggaucugucccaagcaggguggggugaagaucuuuagcuauguucucgagggagggucccaucccgcugaaaaggaggaccugugcucauggcucaguagcacccagcucaugugaccuuugucucagagccccccgcagaucugccccuuccgccaggacgauuuccugcgaagccuggagcaugcgggaccccagcucaccugcauccucaagggugacuggcugggccucuacaggugggagaagaggcugcugugggugcccccaaguccgcuagcucagcuccucagcugccucuugccaucacaggcgguuuuucaaguccccccauuuugauggcugguaucggcaacgacacaaagagauggcccagaagcuggaagcucugcaccuggaagcuauuugugaggcggugagggaaggcagaggcgggggugggggacagguacaggcccaggguaggugggaggcuuagugagaagaaccagacggaaauguuccuaacagaacauugaggcuuggaugaaggacaaguccgagguggaaguggucgaccugguccugaaacuucgggagaagcuggugagaagccuccuuguauuguccugccccccacuugccaggccagaaguuuguccaccccuuaccaccauugucucuccagguacgggcacagggccaccaacuccccgugaaggaggugacacugcagcgggcucagcuguacauugauacaguuauuggcucccuucccaaggaccugcaagcaguccugugcccucccuaggacaaggccaaccugugugguccuggggggguagggaggcuaagccugccaaguucccucucccuugaaaggcaggccuccaagcuggggcucucagccuuaggcuccuaccucagcuucagcccccucccagaaccacccuugucccagcaguaaaaugacauuuggaaugacagucuggucccugacuauugggggauucugugcuggcacugccucacuucuuccugggccacaccuguccuccacagcuggaggugggaguggccuaguagcccuuacugauguaggugccuucaccaccugcugccuccuggcuccaucugcccacacuccaggaugccuuguguuggggguccuuuagcccagcaggcuuccccgcucagagaagagggaggcagcugccagggccagccccuuuccuuuacaccccacucguucugcagagggaugaagggauggacagagggugggaagggguacuuugccuaggcagcuacuugagagggcagaagcucuuuguccugagaggaucuaauucuccuuccugcugugauuggccagcaugagagaaugagggauggugugggggccuggcaccccacuugcaaaagcaagcucaggcuguucuuggagguccucgccacaguccuuauucccuuucuuggaacacccccugaacaccugcuccaugcauuucacccaugcugccaagggcuacuccagcuuuucccccugugucugccccuccuccugcagcuugcuugagaggcguugggcuguagccugaugcuauauucucugcugucuuggccuuaggguacaauugaacccguaggcagagguaucucuuggaggugcuguucugugcucuuccuaaagggcuaaaauggcucuggggaccuaagucugccaagcuucccuuucccuucaaggcucuagcuugucuucagaccuccccuccccccaaagaagcacuuuuguccuagcaguaagaaugggacguggaacacagccuggucccugaauguuggaggauucuguguuaguuuagcccugucucacccauuccuggauugaugcuauugugcaguacugcuaauccuggguacagcgcguuacaauguuacaaccuagcaucacaaccuggcccuuggggugguccagacugaagugaggaccuggagcagcagccaacccucagcugaguaucagaaaccuguaggugggucuccugaccacuuaagacugcuccucugagggacugggccauguggguucacugggcagugucagugucaggcaguaucagggaaaaggggcauucugagaggaugggccguacauccugugaugcuuuaaagggccacuagcaaaguaaguugguuuagagcugcauggugagcguuuguuuucuuagagagcugcugaguagcauggccaugaccuguucuggguucuuuggacucuuuaaucaaaccucaaguauguacugccucgcccuuccccacugauccuggcuaagccagacacagcgaagguaucccagugguaacaggugucagcacugugccuagaucuuugcaugugcucaguuguuuaccccugaccuuagcccaugacagcuugucacacugcccacucuacaggugagcagacagaugagauagaugggugaauuuacacagugaucuaggucagucuaaugcaguauccaaggaggugaccuguuagaaaauugagcaaaggcagguugagauggagaccuuguccuuaggaagaauggcauuagcaucuccuggaacaguggugccagccucaccacuaagagccuggucucuaagggaucuucagaaccauggcaccauccucugugacagcuggagcuccccggcuguggggacuagccauuuggagucugcagaacugugccuuccaugugccagccuccuauccgagugacaggucuaagccuccuccgucuuaauggcuccaccguaaaaugcacaucucaaauaucacugcaguguguuucucgugcuaguuuucacuugacuuucacacaguaggcuucagggugccccaccccacaccaccccaaggaccucagccaccaucagccuaggacucuucaugggaaucagcagacagauuuagaggaggggcugguggggagguagaaggcuauagacacaacagugcugcuuagggcacaaacccaaggcugacacacaggaaugagcaaaguuccaguuucuucgaggggcuuguccugguuacugguagaguauaccgccugccugcuggcuuccuaccagcuacauccucuccgacucucucucucccaggaugggaucagcugaguuaguggagcuucuguccaaaguaggcucaagcccaucucuuuccauccaugccaagggcagagccuggagggaugucgagacagauggcuccaaagaggugcuccccuccccccagcccagaggucccuuacaguuuagaugccuggagagugagaagcuaauccuggagauugugauucccagagcucccuuguguggccaguugggagagcgcagugagccagcauucaggggaucuaagaggguuggguggaggucaugaggcagccagccccagggacagaccggaaggacaggaggacucuuuuacccuccagcuuccugccuuuucuauuuugagcccuacucaguucagaauacuggccuucccacaacuuuguuauuaaaauaucuuuuuuuguuauacaauacuugucuuuuaauauuuuugauacaaaguuugcagcuguguuacuggauauuuuagaguuguguguguguguugggggccguaguguugaaaucacugaauauuuuggagucucuuguauguggggggagggggcgggguugcugguggaggggagaaggugauucaaccaagccuggcugcuugagauggggcaaguucaacuuccuuaaagaaacagugaaguccucagauuugugaaguuuucagguuggggaagacauaagaauuggggcagaucuccaaagcuggggagauguuguuccaagcuggcucagucagucacgggcaccccaaaaggcucuccacagagaugccagaggaaauaggaggaaguaggcagacgguauucaaggagggcaaaucuggaggcuggcgagauggcucaggggguaagagacugcucuuccacaggucccgaguucaaauuccagcaaccacaugguggcucacaaccacccguagugagaucugacgcccucuuguggugugucagaagaccgauacaguguacuuauguauaauaauaaaucuuugggccugagcgagcagagauccuaagaauucaauucauaacaaccacaugaaggcucacagcuagaguguacucacauacauaaaaugaauaaauaaauacaucuuuaguuuuuuuuguuuuaaaaaggagagcaaaucugggguggaagagacagcuauuccaggguagacaugaaugagcugggguuuggggacuaguuccaaaccuuguccugagaucgccaccacaacuucaaggccugaaguaggaacccuacgguacuguccuacccuauagacauuuugggggucgguaaggccaaggggccgggaaggagaguagaacauuccauaaggagaacagagcggcuaggauuuggaagaaagaaucaagguucagcagcccucacccucgggaacgggaugagcgcguggucccgccuguugccaaugguggugcgguuccuugcgccccgcccaucuccaagaagacacuugaggccucgaucuggcccaggcgaagccacccacuggugccgggccgcgugcgccauucaguucggccuggggcacucccgggguugugcccagccugagcgaacuccucugaugacggggcagugggaggugcgggggaacuggugccaggagacgagacugcagcaggcagggagcgcggauugcuacugggcgcgaaucuccaagcaaagcggugugcauaaguggcucugagccgagggaaacgcgggguacgcuagggacgccagccgccccuccuucccacccucuaccccuuagucucgucccucccucucgcccgccccuguccuccccgcccuccuucuccccuggcgggggcggggccggcggcucccgcgcgcuccggccccuccucggccacacaaaggcccgucuccauggcagccgcgcgggccggagcgcaacgcagagcgcggccccggcgccaucgaacgacggcugcggaggagcagguacggcacucggggacgggaacugugggggcgucgcgcaggcccaggcuucgccgucuccgccacucggccucggccugcgcccccggacgcgggggucuuagggcagugccgcugcgcggagggcgacgcgggccugcgucuuugccccgcgucugucugucuuuccaaucggcugggccuggcuguuccugccuccccgauuggcgacgaggcccucagcgcugggaugcugggagacuguccuggcaggcaggguucccacgacccgguggagcugcacccgacccgguguaguuucaaacccuccuucacggccggcgucccuaccgaaucgauggaccagagcaagucaucucugucgugcuggaccuccaggccccaguucucaagcuaagcuugcucagacgcugggcucugcuggggcuuuuuacaggggugcucaaccaaagcagugcccacaccuucugggacagggaacaagagccagagagaacuaacacucaguaguaguaccuggugaggccccacgccucccggcaagaucuccgcaaguuucuaguguaguucguuguugugguguuuggagagacacuuaggauucagagggcuuagaacuugugggugcuuuuacacaguccaguccuucacuuccauauaccuucuuaagggagauucauugcuuccucuguuuccugcuguguggcagguuuguguguggguggguccuuucuaucuggggucuucugagccuaagaauccuagaguuucuggccacgucacuuaauuccuuuuucuaguuccuuggagaaggcaggaagggagaucggauuauggccaccaugguggugguggucagaacuguagcugaagccaggucccaaagccagugucacguucugaugaacggaggcccucgggggcccucauuugccuuggggagugccccccucuaacgucucucuucaauuuguauugaugauuuuaaagcugaauuucucagacugcucacaaacaccuagagggugggagcugucagccugaucccacacccggaugcugucuuggaacauagggaaugucaucagaaaguuggacugucgcuagcaugaguccuugcucuuuggucaggaggugaaguuccuaggaagguagagccaacgcgugaguuguuuuguggaaugugccaaaccuuauuguguuguauggaaauugcucgagaagacuaaucaccagguagacuacagagccucggccaccuagucgcucacacccucccauggaaguggggaggccugaggacuggccagagguuucuagccccaggaucugagggaaguuacuuagaaaaacaagaguuuggaaugugaguuccccccucccccacgggcugccugccaaggaggaauuauuuuggauuauccagccgaguccagcgaguccagcuacccaaagagcaggcugaagcagaaggggaggcugaagcagccaugggagagggacccacuuccgggcugaguugagaaccccaggagggcgggguugagaacuccaggagggcggggcuggcaaguccaggcagcuccaccaccucgcucccauggcugcucagaccagucaggggcgguguaggagggcaugugucaccuuggguuggagaaggaccucaaggucggcuccuuuguuggcccugcccaaccuggaauaugcccaggcuccucugacaaagcucgugggggaggaaguauuuuagaucucucuggacgacucgguucacuucccaaagucauuccuacuauguuuaaggauaccuuggaugggucacacuccuggcagagaccccuuaggaagcacaucccugagggcuuacuggggcugaaccgcaggcuaccuucuugccuucucacugaccagagucucgcugaggggcugccccccucccuccucauugggaugcgauacuggucaggacauccuacagguggacaaauaagguguucuaccagaagccguugggguguuccuggguuggcuccaggggcuuauggcuuauccaggagcuugcguggagagcacacugggagggagagcccacagcugaugcccaagagcaagaagccuagggacuuggcccuggccccugcuaguggagcagaagagauuggauuggaagggauugagcugggcugggcuggcagcccacaguggcguccauaugucacauguccccccuaccagaucuguagcuauucuagaacauccccauguaaugucuucugcccaguaccucuccuaaugguuagugcuaaugguucuucagggauguuggacccuugccugggggucauugguggaaggaucuucuagcacuaucccuugcuugucacuacgugcauaucucugucacagaggacugucacccugccaucggacacuccuuacauccccuccaacccucuuguugcuuccuguguccagccuuguucuugauauucagggaggaaguguuuugucccuaucgagggccucuuguaaaaggauuggcuuggugaggacaaggaggaaaguugauuggaacuccaaccaaggcuugguaguccaggcucuggcuagcuuguggauaggacugaggcugucccuacuagcuucaccaacccuucugugccaagccauuggaugauuagauaggggguaagaguuggguaacccccuccaugcuaauggcuguuuguguuuagggugggguuguggguggggcggggcuggguucugacuaauuauagacugggaagggcuguaguguguguugggggggggggaggucggaauaggguagaaggagcuaaugccccagcucuucucuucccagaccucaugugacuccucuuucuuccucuccaugguuucacauccccugacacaagcuucuucucccugcccccagcugagugaggcuaaugcuacccucuguugacauagcaaggacucugcccucuucugagcucucugacuacaggcacugccucuggaacaccccacugacccuccuaugcuguuagaacaucuaaaaggauaggagaggccccugcucuccuguaccccaauccagagggggccuuccuuccccugaaauucaugaacccaugacagugauugggcuuaaccucccagacagaguccagguggucgagggugguggacucucuuuagagcaggucugauccaaccucccugugacaaucuugucuuagggaagagcccuagcugguccagacuuggagcugguagcacuauuuccugucuuuugucauucucuggucccgccucuguagcccagugucguccccucccccagccuggcucguugccuuccucauggcuggcagccuucccuggggcguccccaaggacuggcugaguucacaccugagcugccuggggucccaguggacuacccacagaaggggcucaaccuggauuggaacacugugccugggggcagggcugggcuugguguccauaccuucuuucuuucuucaucucccucaggucccuggacuugaaacccagcaguugcccauucuggugccagcuggguucuggcuccaggacuuaaggacaggaaaggggaaagggguaggccuuaggggcauagccuuaguucuaacuccaguucugccugcagcccagcagccugaucaccgagguauguccugucuggacacagggaucaggcaauuaauuggugguguugguuuguguguguuacucuggcacagcuggucaguaguucccccgagggggaguccuuggugaaaaagaaaggaaacagcuuugauguuggucuuugagguaguuaccuguaucaagacagcucauggagccccucagggaccuccuaagagggucuccagugugcgcagcuagcuagaacucucucaccacgggacugcucauaucuuuugccucugaaccagcauaccaccugugugguacugcauugguccaucuguagaacuaauggguucaugccaaaggucugggggaugcauuagaaaccuauuaaguuuuuuuuuuucuuuuguaauuuuugagacaggauuucucuguguagcccaggcuggucucaaacugacagagaugugcaccaccgccugcuaggaaccuauuuauucugucuuuucguaggaagaaugccucuguucccuuuggugccacaucaugugugaaaguuuuccuuggggcauuucagaguuccugggucaaugggagaagguucuguagguggcauggguggcuguggauaaguggguguucugggauugacacauggcccacugggacugucacuccaucaucaagggcuuucucuaaccuuuaaccugggcagccuccuaggacaacuccagcacaggguguguguguguguguguguguguguguguguguguguguguguguguguugggaggaaccagguggcauuugugcggugcagaagcugagggcucucugcccucuugauagauagcagcuacguugggacacagaguagaaccugcuuucggucauacuccgcuccaucaucaucaucacgcacuugauaccgggaaccugcccagcaaguaggaaaaaacuguuuuaaauugagcugggaaaucugccaggagugagggguggcaggcagaaaggaaggggcucucgaguggcccgcucacucuuccggccucagaaauaguuccuuagacuggccucaggagugggaagguccagccucccugccuccaccuaaagucaggucugauuuggaguaucacccugggaggccucagggccucaaaccuaugucaggauuggggagggaucaaggcagcaccucccuugcccagggagugcucccuggaacacaccucuuccggguguggguguaccauguagacuucuagaggacuccaggggggaagucugguguaucacaccucucaccaaacaggaaagaacugggucuaggggcuccaaauucccaaccccauguacauuccuuccacucugagcugggcauuuccucauuggaaaacccccgacuaucuucccuccuaagcccugaguguuugccucuugugucacuuggacgcagggcgggcacugcucaccauuucgcucucagacucuucccagcacuccauaaaguaucaugugccugcuaguuacuuaauguggauggaagacucaccaaugaauagccccaucccucaaggccagucccagcuccaacagaucucuuagggcauccugggaugacccaguauugggaccuauguguaucccaccuuuucaaagccccuuauaguucacgcuuggggauugauucuagguguuggggcaaggccuuccugucagcaagaaucuggcaacaucauggacaugugugugccuguacauguguggucaugugugagucguggcuggcacccaggcuuggcaaggugcccuaagcuaauuguaggguucaacugugaugggggaggaggggcuggggugaccgaugagacacugacaagcugacagggagauuacaggccuugucggcuccucguucacucgggcccucacccauccgcccccaugccacggaaucgcacccccaacccccacugcugcugggguuagggacucuguggaacugguucugagcaagccgcagccuccaugaacagcaucuagccggucccugggugagcugagaagagcuguagguggggcaggaguggagaaaggugggagagaaagguaaacaagguaacagccgcucagggucgaguccccauagaagccuuccuauggcuggcaucugagcauuccccaucccagugaguugacugugaugauaguaacaggacccauuuguauccucccuuagugugcugauuugguggggggggugucggagggagggcccuccaggagcacaguaagucgacagagggugacuuguugcaaaaugaugaaucuggaggcuggcaguguagacauauaaagacgggaggagauccuagaaugggugggguacagcgguccccaggcaggacacugugguaguugggucuuuaaagggauggagaaaacacuggugacagggaggccagccagcucaaagguucacuguguggggcacucacccuaaguucccuacaauauacauaguccacagcugguucugagggaagagacggcuuugacagguuagcucuugagguaccugagcagauauggagauucugggugaucaacccucugacgggagagguggcuuggaugcaccccagggguagagggaaaaagagcggacaaucugcgcuggacugacccagaaccuggaauggcgcguaggauaggcacggggcuugggcugcuggggaaaggccgcagccaccugggaggcguccuuguuuggagccuugacucagguuagcacaucagccuuucucuagagccccaccccugcuccaggucagguggcgcaguuuccuuagggcugggucuucccucgaggagucugggcggauauccccguggucuagcccgaggcugcuugaaggcaaggucgugccugguuugcugaccaagggggacggaggacugggacugacccugggcaggggcggagcuauacacaguggggcggagccgcgcguugcuuuccuuccccggcuggaaggacuuagguagguaauggccgguccugcuuucggcuguuucugauaccagguuagcaacgcaaggaaacggcucuagacuuuugacaguugccucugcugucauugucacccgagguugggcucccaucuacccaucgccuugugagcuucccuggugaggcucgcgccaaaagcucaguccacguguucccucuaggugugcgcuggggugcagggccaaaauguggaagcagaccugaauagagcgcggggggcggugggggggcaucccuagguuccaggaccgugggcguggccaggucccuaggggagcuucggccgcgcguccuagcccaccucugggguccgccuccggugcaguucccagguaaccgucuugcgaucccggaggagucuggcggaaacggcgccgagggaggcggggggggggggugcugucuaugaggaaugaggccagggcuggcuccggggugcggggacugacccagccuccuggacuguacucugaccagguugccagguggguggagcuggguccgcgggcacaggccccgucccccucggggucuucuaugcgaucaccgcgucgguuccacguacgauccguucucuguggcugcggugcuccgagagacgucgggcuccgcacggacccuugccgcagccccucccucaggcuuguuuugaaaacagcggaggcuuggauuugcgggcgccgcggccuguuuugucucuuuugauuuguuuaacgcucgcagcuaauugcagauuuucguagccuuccgagagaggacgccccgccucauggcugccagcugcggcgggggaugggcagcuucgcuuucucugaggcccagggcccccgagugugguccgcuguucaggcgccccuguccgguccugaggguggugcaguucccacccuacuuguuagaaucccggcuuugguggaaaucguuuccuuucucccugccaaucccuggugucucuaguuugcugucuuggucccuagagggaccgaagaagcucugcucuccuguuggaccacacuaccucaggguugauuugaucugagccuuaaaaagccguucguacucagaauauugagaggaaaggaaccccggcucuaucugacacugcccuaugaggcuguuuuagaguuagggaacucagacuggcugccugcggucucugugucaugcauaccccucaagccgccauccgaucgcccuggaaucggcaucgagccuagggcaagaagaggaaccuaaagaagaaggccucagggcauccagcugaccaggggcuuuuguugcucucgaagcaguccaggauguacaagagacucagacccccgcuggcccucagauuucuggcugaggcgaggcuguuuguuaagauacagaccuaagagcugcuggcacagacuccucaauccucacagugcauucccauuggccgcccccagccucgucccugagucccacccaggaauuccccuagagaagaucauagaggacgggugacuguggccaggaugcugaggauaaagagucgcccagccuucugaaguggguauuauugucauacccaacaugcauaugggaaaauggcacagagcagcuuuguaaaugacccauguaacucugccagaaagaggcagggcuggauuugaaccagaguggugugcucuugaaguaaauuuacuaguagcgaguucuugaagacaaacaacucgagacagaguucuuugucugggcuggggugggggucacuccuaggagacagagauggcugguugggaacaucaauccaagaugguggugaucuaaagggucucggcgacauuaguuucacaucuaagaaguguuagcccagaggauccugauagagaagacaauagcuggccaguggaccccgauuagucaguggaagguucaucagacccuucugaaauauguauggcaaguugcuuagaggaggccagccuccuuuggcucugccuucaggagacucccaaaagggaacuggggccuagaugaucugcuuugagaagucuggagcuggaggaagcugaggccucagaggaagcuagagcagcccccaggcacagagagguugcaagugaauucucagggggcugacacuguccugugguuugccugcugugucugaggaacagucugugguugguucaacaaagccucuguugaguccuggggggcaaaaaaagaugcccucugcuccaugcagccucuuguaggggcuggggacacugugguguggggccugauaguuuacuuggacucaccauggguccaggcaugggccagcucucugaggaaaugggccagcggaagcauggaaaacugcuacacaggacaagcggagagucucggugggguuagagguggacagcgccuggaagaaguggugucugaccuacagcuuuguguaccuuacucccugcccccaaaguucuaagaguuuucagguuggguugagggcuuugagaacucaggagcuagcacacugguagauuuggaugagguggauucuuugucgguuggcacagacccuuugccaugcaguccggugucguccccccccccccccaauacucuggccugcagcuggguaaguugcuaaauuguugcaucugacaaaccugcuuccccuugggccuaccaaggaccacuucuaggagaagggcuauuauaggaagaucugccaggaguuacaguguaacacuuaggcuuuucaugaaugaauuccuuucacccuuagaaacccuaguguuaauuuacuguuacuguguccauuuugcagauggggaaaugaggcacagagacauuaacuugcccaaggucacacagcuaguaaguagaguugcccuguuguggaugugcaugguuuucagaaagcaguuaugcauagaguggaauauuuguguguguguguguguguuuuguuuuuccagaaaggguuucucugugguuguccuggaacucaaucuguagaccaaguuggucuugaacuaagauccccuagccucugccuccugugugcugugccacaccacuuagcuacacaucuaguuuuaaagagcagauggauaccuuagacuuucaaugaaaagagcugccuacuucugagcagaagagaaaguagcauggcuugcuuauguuuuucagacuggggcgaaugugcuugcuuuagaagcugggcuagaugccugcaagugucuaaaggaguaagaggauagagauagguggcaucaggacagccacccagagugacugacugugcucucucucucgucuccuagcgaguccugaugccagccuaaaacagagacggagaccacuggagccuuggugaguccaugggauaagccuucggaacuugcugaaaaucacggugggacccugaggcuguaccacuguauguauauguggcuucuuggauguauaccuccaaaccucagccagcauaaggcugacugguaccccugaggaaauccccaccagccaggcaagcagggguccuggaccuaguccaaaacaggaaguuccucuacuugcccucccauuccaggaacaucagcagcaggaagcauuagcuggcugugccuggcgccuccaguucucucgcugccagagcaccauagaggucaggugcucuuugcuccugggccuggccaagcaggucacucaaggccuuguuuguucaggaaguagaagggagcugucaccuacagugcacaacccaggucccuuuuaucacccagaagacacugggaccggagugucuuuaucccacugugguuaucuggguaugugggagugcuugaagauggaagucaaaauauuauaugugccgggcaaguauuaagccacugagcuacaccccagccucaggugugugggccuguggaguuuaaucaaguuacuggugaccagaugucuggaaggcuucccuccuagaauccuacaccccugugagcuucaagcacagggaggagguggccagucuccggccagaaauuaaauggagagaagcccaccuggcagauuuccuaggaaggccccuggggggcaguuggagaaggugccauuauggguccaguggaagaguagagaggucuccuggccgguuagcuccagguucaagccuugggcuuagauaccaggagaagucaggggcggaggcuggcacagccacacguaagcgggugacugguuagguuucagcugugcugagacuguagcuccgcccacgcccacgccucacccccuuccacccccuccuggcugggaacauuccauucauucucugcuccugggagcugacaagcugcagugauuugggugaguuagagccagccggugagcuacauccauaagccccgaacaagcuggccuggugaucaggccuugcugcgguggccuguggggaguggacuugcauggaagaaggcugggauggacauuaauuaguggaccacaggacuguucccauggagguggaguuuggcugcuucuccaggcgcuugagcggagccuuggaaucucagacuggguugggcacggucuaaguuggggucugaaagggcuugugaagucuuccuggcucugacugaagucacugucuucuccuaaccucaccuccuaacgagguccuugcccuuggcuucaccacacuuucuacuggaaaugugccuuuuccuccauugcugcuaccuccgagguccgaggaggccaacgaaggagcagaacagaaacggagggcagcuggagagcugcagggcuccugagaaaaagccacgaccucguuccagcaugcccguuuuuacacgcaguucagcuagcucugccuuccuuggcaacaggcagcagaguccuucuguccuguaggagagggauaccagcuagggauucucaaagagagaguaaauggaguaguuggagguaggucagcaccccagccccacccauccaggccgccuuuaggcagguuacuuccucucugugacguuccuucaucuauaacuggaaaguuacagagcccagggagugugaaccuggauuugcuuuauguuuaaauuguaauuguuuauggagaauaagggauguuugaggugauaguuaaaguagucuuuuuuuuuaauuuaaauuuauuuuaugccauggguguuuuguuggcaugaaguaucuauggaccaccugugauggaccaccugugccccugcucucuguggaggcuaaaaaagguguuagauucacuggggcuagaguuacagaugguuaugagaugccacguaggugcugggaauugaacccaggucuucaauuggacuccugacccaggcuucuagacagaauauucaccuacaugucuuacacacacacacacacacacacacacacacacaggcucuuagugcauguauccaccucucucucucucucucucucucuuucuuucucuuucucauaugcacacaugcacacacacacauaacucugaacugguagacuuagagcugcugaccccgccccagcaggcagcaaauggagaaggcgaaauggagguggggccaucuugcaccaaggagcucuggaggugggcaugaauagacugugcuuaccugggucaugcguaugggccuucauuugcagcucuggcuucaagcaggauggaucuacauguccacaagucugcccaucugcacccugagaccaccuguagguucuugagaggaauacguagggauagcugggagucuaccuagagcuauggauaccuuagcucuaggaaggggauuaugucccucucugucuauuguggacacucagggcagggccugaaugaagagaagccucgguuuaucugacccuuacugucucuccccacagaguucugggggcaauggcucugccacucugggcccugaccuuucuaggucucacgggccuaggguugagccugcggucccgaaagccggagaguuuccgcagugagacagagcugaaccaccuggcuguggaugaggucacaggugugguguaugucggggcagugaacgcgcucuaccagcugagugccgaccugcacguccagcagcacguggucacaggccccuucauggauaacaagaagugcacaccacccauugaggccagccagugccacgaagcggugcucacugacaacuucaaccagcugcugcugcucgacccaccggggaaacgccugguggagugcggcagccucuucaagggcaucugugcccugcgcgccaugagcaacaucucggugcgccucuucuacgaggauggcagcggcgagaaguccuucguggccagcaaugacgagagaguggccaccguggggcuggugaccuccacgcgccccgacggcgagcgcgugcuguuugugggcaaaggcaaugggccgcacgacaaugguaucaucgugagcacccgccugcuggacagggcugagggccgggaggccuuugaggccuacucugaccacaccaccuucaaggccggcuaccuguccacgaauacucagcaguuugucgcagccuuugaggaugauuucuaugucuucuucgucuuuaaccaucaagacaagcauccugcuaagaaccgcacgcugcuggcgcgcaugugcaaagacgaccccuccuacuauuccuauguagagauggaccugcagugucaggaucccagugacccccaagacucugccuuuggcaccugccuagccgcuucuguagccacaucgggugcuggcagagcacuuuaugcugucuucagcagagauggccggagcacugggggaccuggcgcgggccucuguguguucccgcuagauaaaguccgugagaagauagaagccaaccguaacgccugcuacacaggugcccgagaggcaggccgcacuaucuucuacaagcccuuccacggagaaauccaguguggcggccaucugauaguacgugucuugccuguucauagccauagguguauguccgucccccccacccccaccccuugaauaucaguagauucguguuguggaagauagggucugacuccuauagcuuggagcccuaguagggaaaagccuaggagacagggggacugguccugaugcugugauccacagggugccagcgagagcuucccaugcggcucggagcaucugcccuauccacugggcagucgugauggacucgucgccacagccgugcugcaccgcgggggccugaaucugacagcagugacaguaacugccgagaaugaccacacuguugcguuccugggcaccucagauggccggauccuuaagguacuggucgaggcagaggcuccaggaggggccaaugaaccauucccccacccccaccccguucucauggaccgucuugguguuggcagguguaccuugcuccagacggcacuucugcagaguaugguucuaucccaguagacaucaauaagaaaaucaagcaggaccuggcacugucuggaaaccuguccagucuguaugcuaugacccaggacaaggucagccuaaagauggccccaggaggcccugugaaacugggccuugcuuuggaugguugggcggagucugggcuccugucucugagucuucauagcaccauugcuaucuucccaaggguuuuauuuugggcauuaggaauuagaaguaggaucuuaugccugccaggcaagagccacgucacugagcuacaucuguaaucuuccuucucucuuuucugauccugcccuaaacuuguagguggucuggcccaggagaguccuggccacuugucccugaacagucuaacaccagggauggggguggggugggggugucuaguaaguccuguucccccacggcccugcuaucuuaccucuagguguuccggcucccaguacaagaaugccugagcuauguaaccugcgcucagugucgugacucccaagaucccuacuguggcuggugugucaucgagggacggugagcaguuuguccuugcccgaacggcccagagcccaaggagugccggagcugagaguacucucuguccuugcagaugcaccaggaaguccgagugcucacgggccgaggaaaccggacacuggcuguggagccgggagaaguccuguguggccaucacugaugccuuuccacagaacaugagccggcgggcccaaggagaggugcgugugacagguggcaggcugugagugcugugcagggcgggguggaauucuccuuaacacagcugcuggcugggugcucagacaugcaaggaaaccacggguugccugguacccaggcccacaugaacauccuaggcaaagcagagucagguucuagagauucucagcugcacgugcugagagcagggcuggagguacuacuauucuagaaaccuagcuuugcccuccuucccccuccaagacggagcaguguaguacuaggaucagaggucaucguuugagcuguucuccuccugcagguacgccugucugucagcccccugcccacccugacugaggacgaugaguuacugugccucuuuggugacucaccaccccacccugcccggguagaggacgauaccgucaucuguaauuccccaagcagcaucccuaguacaccgccaggccaaggugagaccucauccuucagucccuggaccugcacagcuuccuuuucucuacgcauagcuuuuucuauguucuaucuacucucacauuuuuagaucacugagcacugugugugagccaauccugggugcaggcuauuguuggggaagaggaaaaaaaaaucccaacuuugagagucccucagucuuagacugaguucuguucugaggagaccgauuccccugccaaguucuuugcacagacaucccuccucucugcuguguccagccugaggcagcuggagcugucuccugaggcugaaggccucaaucugggcuaagacaggugcuaugucugccugucccuugagcauuggggaguaacaaggccgugaggccaugaugugacgugagcagggaccuggaaggccuucccacccagacucagaggagccacugcccucagcccuugcaggaacagagagagggugcgaaagcagccaggcccaggggagaaagaugagcccagccuugggaguugacaccaaagcccagauuugacaagcagcagcaggccagcugagccuacagcagaccagcugggccuaaggcugggguauccauauuguauccccuggccccagaauagaccuccucuccgcugggcacugggcgaggcccaguuccacccuucugcucuaacugccccugacccuguucccaccuguauucugcagaccauguugacgugagcauccagcuccucuuaaaaagcggcagugucuuccucaccucccaccaguaucccuucuaugacugccgugaggccaugagccugguggagaaccugccgugaguccuggcuaccuugugagagguuccccacccccaccccuggggcuccucucaugcuuccgggccccucacauccugauugacccuccugcuaggugcaucucuugugcuagcaaccgcuggacuugccaaugggaccugcaguacuacgagugucgggaggcuucgcccaacccagaggagggaaucauacgugcccacauggugagccagccaccauggcaggcacccaggcagaacugugguuaggacgauggguggugcugggaaauccuccaccucacuagcuuugcucucucucaggaggacaacugcccccaguuccuggccccugacccuuuggucauccccaugaaccaugagacagaggugaccuuccagggcaagaacuuggagacugugaagguagagaaggccuggggugaggucuagcugguagguggguugaggcuugcuugaggcugcuugguggguucuuuuucccagccuucauccccucaucccuuaucacugcacaggagagaaacauagaggacagaaacauaaaaauagaucccugaagcuaauuucuuccuguuuguuucuucuuugcgcaugacuacuaacaaaccacucacccccacccccaaacgaccaacaacuaccagcccucaccucucagggcucuggcaucuauaagacuccccagaaaguucccagaauuccaagcguuacacaaucgcagaaaauacuccacagcuggcaaacugugccucugcuagagcacgaggcaaaucauagucagcugcuauggacaguccaaagcagccccacaugugggacuaaaacgaaagcacacucuuacaauaguccugugugguuuaaagaaaccaaaaugccauaauuguugcuacagagggaggcaaagggucuucggaggcacccgagcauggggcagacuagguggugggguauuucgggagcuucuggagauacagauucuaugcccccagagggcagaacaguuagccagcuugaguagaaaaugcugacuggacucuccacagguuucuucccuguaugugggcagugagcugcugaauuuugaagagacugugaccaugcaugaaucagacaccuucucuuuuaggaccccaaagguaccacugcuugucuuaagggcuggaggguaguggguauuaccccuagcacuggagccuagccuagccuccugcccugugccuuguggucuccaagcaucucugccuaugucccugaacaaacucauggucccauggugugugugugucugacucuuccccagucccugccuaccuggcaaccaucacugacuuugggcaauugagagauucccauggcuuuuggugucagagggacagaaaguacaguuugucccugugugucccaugcagcuaucccaugaugguaaugagacacugccucuucaccuguauguuaaguccuuuggcaagaacauugacagcaagcuacaagguaggggguggguggggucuggggaaggcgggagagggaacagaacaacagcuaacucuacguccuccuccacagugacucucuacaacugcuccuuuggccgcagugacuguagccugugucuggcugccgauccugccuacagguguguguggugccgugggcagaaccggugcguguacgaagcucugugcagcaaugucacuucugagugcccaccaccaguuaucacuagggugaguuuugucaccgucugaccuguacccccauacccccuucacguucacccacccaagccacucaugcacccggcucugcugauuucagauccagccugagacgggcccgcugggugggggcauccuggucacuauccauggguccaaucugggugucaaagcagaugacgucaagaagauaacuguggcuggccagaacugugccuuugaaccaagaggguacuccguauccacccggugagugaacuccgagcagccugggcuccuagcagcugaacagaugcagcagugauaaugagcugacaccugccugucugucaccaggauugugugugcaauugaggcuucggagaugcccuucacaggaggcauugagguggauguuaauggaaaacucggccauucaccgccacacguccaguucacuuaucaaguaagugccugacugagcuguguuguccagccucugcugcccaccccagcaaguuggcaucuaacgauaaucacucuccagugaccccugaguccuuggcccuaacuaugcauguguguugcucucagcaaccccagccucucaguguggagccacgacaggggccacaggcagguggcaccacauugaccaucaauggcacucaccuggacacaggcuccaaggaggaugugcgggugacacucaaugacgucccuugugaaguguaugugucgcccauggcugcugagcucgccuggcucuggggagagggugggaagaccugagucugccuuggggggugggguugggggugagggggcaguggaacuggcuugauggacugacagguaccucccacccuaggacaaaguuuggagcacagcuacagugugucacaggucaacaguuggcuccaggccaggugacacuagaaaucuacuaugggggcuccagagugcccagccccggcaucucuuucaccuacugcgagaaccccaugauacgagccuuugagccauugagaagcuuugucaggugcggccucuccccuuucuggcuagugcccuccccacccccgcccgcugaccugaggaauguggcagaacugggcugggcagggcaggaggagagaucuucuggaaaaccccacugcacucugaugggcuuccuccuuagaacugagauggcagggucagagcagggccacuuccccgacuuaacucgccucucccucugaugcacauuuaccacccugccaugccacuuccugccugggguauaacuaguaagaguggaagcucgaagcugacugagcugaacucacugaagcaugccccuccucaacccccccagugguggccggagcaucaacguuacuggccagggcuucagccucauccagaaguuugccaugguugucaucgcugagcccuugcgguccuggaggcggcggcggcgggaggcuggagcccuggagcgugugacggucaguccuggcuuggggguggugggggcucaguucuaauggggacaggggcagcugggaagcaggagggaggagcaagaucuucaucaaguuuugggacccuuuccacaggucgagggcauggaguacguguucuacaacgacaccaaggucgucuucuugucuccugcuguccccgaagagcccgaggcuuacaaccucaccgugcugauacggauggacggucacugugccccgcucaggaccgaagccggagucuuugaguauguggcagaccccaccuuugagaacuucacggguggcgucaaaaagcaggucaacaagcucauccacgcccggguaagaagaccccuacggcuggcauggggucccgggucgggcggggcaggggcucacgcugaucacgcugaucauuccuccgucacccauccccccuccagggaaccaaucugaacaaagccaugacucuggaggaggcagaggcauuugugggugcugagcguugcauuaugaagacgcugaccgagacggaccuguacugcgagcccccagaggugcagccuccacccaagcggcggcagaagcgagacacggcacacaaccuaccugaguucauugugcgugagagcgggagggcuguggagggccuggggagccucucaggagaagccgccgccgcccacaccugccugcgcugagcccuagcuuccacacaggugaaguuuggcucccgagagugggugcuaggccgaguggaguacgacacgcgugcgagugacgugccgcucagucucauccugccucuggucaugguacccaugguguuuaucaucguggucuccaucuacugcuacuggugaguccugcccccgguaaggcuccccucaucccucccgcaucagcaucagcgcuucugaccgucauagcugacugauaccagagagccguucaaugccccacaggaggaagagccagcaggccgagcgcgaguacgagaagaucaaaucccagcucgagggcuuggaggagagcgugcgugaccgcugcaagaaggaauucacagguggggcugucccccucccccggcagguggagccacagaguaucccuggaucuucuaggccaccccuuagggccagaaacugcaggagggcccggguuaagagcagcaggaguagguggccaggggucgccucacccaggcuugcauccccuucucagaccugaugaucgagauggaggaccagacgaaugacgugcaugaggcaggcauccccacgcuggacuacaagaccuacaccgaccgcguauucuuccugccauccaaggauggugacaaggaugugaugaucaccggcaagcuagacaucccugagucacggcggcccauuguggagcaagcccucuaccaguucuccaaccugcuuaauagcaaguccuuccucaucaaugugagcagagggggcucaggggcggggagggggauacagaggaggggggcagaaagauaagguuaagguaagggguggggcaagguugcagcccaggugcucaagugugcacucccuggcugccccgcaguucauccacacccuggagaaucagcgugaguucucagcucgggccaaggucuacuuugcaucacugcugacuguggcccugcacgggaagcuggaguacuacacggacaucaugcgcacgcucuuccuggagcucauggagcaguaugugguggccaagaaccccaagcuaaugcugcgcagguucgugggaauggcgggugggggugggggugggggggaugcuaccuaaccauucaggauggcacgcccacucacaagggccauagcacccuuugcgcacaugugcauugccgugggcuccuggagccagccgggccuuggagaaugaggcaucuguuuacccucaggucugagacagugguggagaggaugcuguccaacuggauguccaucugucuguaccaguaccucaaggugagcccagacccuagagcuaggggugggugaaucgguggcaucccucccgaagcuugccuaagugccuugaaggagguccagccccgugccucccacucacacagcccccucgcuccaggauagugcaggggagccucucuacaagcucuucaaggccaucaaacaccagguggaaaaggggcccguggaugcugugcagaagaaggccaaguacacccucaaugacacaggccugcucggggacgauguugaguaugcgccucugguaagucccccagagccagaggcugcagagaggaaggcagagccaggaaccuggacuccacaucugaacuucgcagagcgaagccaaacuguccugggaaggguuucugcgaugcugagguacggucacgaggguccuccucagcuggcccuucccauccuguguucccucgcagaccgugagcgugauuguucaggaugaagggaucgaugccaucccgguuaagguccucaacugugacaccaucucucaggucaaagagaagaucaucgaccaaguguaccguacucagcccugcuccugcuggcccaagccagacaguguggugcuuggugaguuccacuuguucgugaggccccgugugcccagcucugccugggaaugagcagagcauggccccggguuccagaaacugagcuaugcccuucugcagaauggcguccuggguccacggcccagauucugucugacuuggaccuuaccucccagcgggagggccgguggaagcgcaucaacacccugaugcacuacaacgugagugccgaggucccuuaagcagggggagguacccuaagcaagggggauagugcugaacuccccagugggaacauaacccucccucaugacucuguccucagguccgggauggagccacccucauccugucuaaggugggagucucccagcagccagaagacagccaacaggacuugccaggggagcguaagucuaugcugucuuucuuaucuuguucuucuagucccuaaaggucuguggagaccuccccucccucugcugcccccuaguggaccccaagacccugcauaccaaacuucaggccacacccaaccugaacugggacuaggucccucagcugccugcuccucacccccacccccacaggccaugcccuucuggaagaggaaaaccgcguguggcacuuggugcggccaacagaugagguagaugaaggcaaguccaagcgcggcagcaugaaggagaaagagcggacuaaggccaucacagagaucuaccugacgcggcuacucuccgucaagguaauaaauagauaacacucagucgcaggaacgcaucccuuuacgcuauugccuccagugugucccgggggggggggggucacaucaagccgcuguccuccauagggcacacugcagcaguuuguggacaacuucuuccaaagcgugcuggcgccugggcaugcggugccacccgccgucaaguacuucuucgauuucuuggacgagcaggcagagaagcaugacauccgagaugaggauaccauccauaucuggaaaaccaacaggugaggcuucugccugcccugccuccgcccugucugccccaaggccacagcccagcaccccccccucaacucccuugaccgucuccccgcugcaguuuaccacuucgguucugggugaacauccugaagaacccucauuucaucuuugauguccacguccacgaagugguggacgccucccugucagucaucgcacagaccuucauggacgccuguacucgcacggagcacaagcugagccgagugaguaagccucugugcucauaggcgacaguggccccuggacaggaccgaccguccaggaagggguggagccucgauagugcucugugacaacugaguagucaaggcuagcccagugucaaaagcuuuugucuuccgcaggacucucccagcaacaagcuguuguaugcuaaggagaucucuaccuacaagaagaugguggaggagugagugauguggaggaggggcuggggaaucccuaagagaccccaggguccagcaacccccucuuucccaugcacucaccuccuccugucuccauccacaccccucucccucugcagcuacuacaagggcaucagacagauggugcaggucagcgaccaggacaugaauacgcacuuggcagagauuucccggguaagggccacagagcucaagagcaagggcgcaugugcuauugcccacugcugagccaggcacgggaguacagaugcuacagcaagagggguggaggguagcugaaugggcguggcaagugggacaggcaagcugccuugaccauaacugagucuugaggagauagcaaacauaccuguauguagaggcugauauguagccacugaggugcuuagaacccuggugcccgccauacuggcugcuguuaagcacacgcugccacgugcgugggcuuggccuguggccuuuccaggaugugguccucuuacugauguaucugucauggugccgcacggccaacacauugcagcuugcuguucuguggggcuggccuuggggcuccuauacucuccucacacugcguaauacugucauuccuaggcucacacagacucccugaacacacucguggcccuacaccagcucuaccaauacacacagaaguacuaugaugagguaugcuccaggucccuguggcgggaugcaggacagcgugcccgcauguaccccccaugaucugacaugguuuccucuguguccaucucuaccucacccccaaccccaccagaucaucaaugcucuggaggaggacccugcagcccaaaagaugcaacuggccuuccgccuacagcagauugcugcugcgcuugagaauaagguuacagaccucugaccgucaaugccgccucaggaugcaggugugugguaccauggccuugggcagcccguuggccugagauggcacuggcuguagccgggcucuucucucucuccaguagaggaugcacccaaggcaucuggaguggguguggugaacccaccucuuguagacuguagcgucuuucuccugagcaauacugcccgggcgcccgagucagcaccagcuccuuccaauggcaccagcaucggguguucucuguguugucuccugagcaauucgcaaaugugccuuacaaagccacacugggccacugggggcgguggaggcauggccuccccuucccacgcaccagcagcccagccgccucagaugcccuggguuuggccuguagcucccacagccgguuccuggacuguaacugucugccagacggaaggagaagaaaaagcgguacaaugccuuccugaccucaccuggcccuccucguggggcgcaggcacuccaggugggcuugagggucaucacuggcuccaccucuaaggucaagcuggacgucagacgucagggcccagguggccgccagagggacccagaaaacugagguccuugucucagcuguuaaacaggcuguccuggaggcccugccuggaucugggggugcuggagcagcaucuccccccaggaccacccacccuuuuuguaaaucgugauuguaaauccaauacaguugucuuuuucacucucuggu

SEQ ID NO: 7935 - RNA, 612 nt, Mus musculus
acaucuuuaguuuuuuuuguuuuaaaaaggagagcaaaucugggguggaagagacagcuauuccaggguagacaugaaugagcugggguuuggggacuaguuccaaaccuuguccugagaucgccaccacaacuucaaggccugaaguaggaacccuacgguacuguccuacccuauagacauuuugggggucgguaaggccaaggggccgggaaggagaguagaacauuccauaaggagaacagagcggcuaggauuuggaagaaagaaucaagguucagcagcccucacccucgggaacgggaugagcgcguggucccgccuguugccaaugguggugcgguuccuugcgccccgcccaucuccaagaagacacuugaggccucgaucuggcccaggcgaagccacccacuggugccgggccgcgugcgccauucaguucggccuggggcacucccgggguugugcccagccugagcgaacuccucugaugacggggcagugggaggugcgggggaacuggugccaggagacgagacugcagcaggcagggagcgcggauugcuacugggcgcgaaucuccaagcaaagcggugugcauaaguggcucug

SEQ ID NO: 7936 - RNA, 76400 nt, Mus musculus
cgccgccgccauuuuggagcgaucucgcccgcggccccgagccggucccgagcgggucccgagccucccgccggcugcgcccgaguccgaaggcgccgcgccgcggggucgggcccaugugcgugcggcccgcuccaggccguccgcacuucaccucugcgagcguccuggccucgcuugggccucccucggaggaggagucgcugcgacccccagccugcugggcaggugagugcggccgcgcgcccaccgcuuccugcggcccggggacaggagggacacccccaccccccaccgccuucgggccgucagcguccugcugucacucagcuugugcggucagcgcccugucaguagagcagcgccuuugucacccugcgcuucgucagggggucagcgccuccaucagucugcuucccggucagccagcacucuccacugccgucauucauucauccauccauccauccauccauccaucccuucccuucccucagcgcucacccuucuugacagucaacaucccuuuuagcuacuaucccagcuccuggccugucaguggucaguuuuuccccacucucagaauuagucucagccucuuaguggccgccugguucucucccucccaguuguccaccucugcuccuaucaaggucccucaccucugucgguggcuguagagguggggcggaccuuggauacagggccuggggaguugucaguguucccuaucucaucuuuggguuuuuuuuuuuuuuccacccuccucaucaggggccccgcugguggugaccuuuccaccuaucaagcguucccuccccgcucgcucaucuccuccuaccagugcccacugccaagcgcucgcuuuguuauuguccuuuauuuccaucccauuccucuuccgggucguuccccaguugucaucaucacccacugucuuucucccacuccccccccccccccaucaucuuuugcuucucccaugcgccucuucuuucuggaacuucuucaccugcuacuuuguauccucacagcugacuacucacuuagugaaggcuguuuccaaucuauuacggagcucuugcuguucgcuaucagcucucaguccagucacuuuccccaauucucgcuuucugcuguagccccuccccgcaauuugucaccauccucaaccaugucccuaggccuuauuccagacagguuuucagguuuucacugacaccuucaucuguguccuaccugacaaugcugcuugcuggcuucuuaccaucucauuccauucccuaucccccccccccccuuuccgggacuguuuuacuguguagccauagauguccuggaacucuggccuuaaacuccauagagauccgccugccucugccucccuagugcugguaucaaaggcgagggcuacugucacccagcuucaguccucauucuuaucucuucacgccucucucccuuucuguuuuucugagacagggucuugcuauggagucuuggcuaucuauguagagcaagcuggacugaaacucagagauuugccuaccuuugccugggauuaaaaguuuucccaaccaagucugauguguucaucucuugauguucuuauguucugggucagcccuuugaccucucugguucucaugugagcuaaauaagcucuuggaggcaaaaaagaggcuaucgccgggcagugguggcgcacgccuuuaaucccagcacuugggaggcagaggcaggcggauuucugaguucgaggccagccuggucuacaaagugaguuccaggacagccagagcuauacagagaaacccugucucgaaaaacaaacaaacaaacaaacaaaaaaaaaaaaaaaaaaaaaaaaagaggcuaucuuuuguuuguuuuuuuucuagacaggguuucuuugcguaguccuggcuguccuagaacuagcucuguagaccuagaccaggcuggccucagacucacagagauccaccuggccucugccucccaacugaugggauuaaaguaugcuaccauugcccaguaagaaauuagcuuuaaggaggagggugggagagcaggccagagccuuucaacacggacaucgggaggagauggaaagggcccagaucucuugcaggaacuagauaauauuggugugucuagguuggcugagaauguuugucuucuagucagccuuacagcuugagggggguggggggugaggggggugguucuaggcuggagauugaguuguggggcauuaugacuaucuggauaggaggggguguugugguucaaaccucaguaguuaauuuagggagguauuuuggaggaaaagcuguugaagcuucuuagagccguaaguaacaauugaagagggguaugagagagugagagagcucagagagagucccagacuucucgguagaagugaaauggcuggguaguagcaucgucuaauuaaauggagaagcuggguugaggcagugauagauaugagggaaugguuacauguuagagagagcaagcaagguuuuccuucggcugagacuagugggaaacuucuaagaagcccaggggccauuagggagaauguaucuaaccgacagaugugaaacaggagagguuaggcugaacauacaauuuugagcagggagauaauauuuaaagcguugggaauagcucuuuacuuagugcacaugauaaaugugcugaguauuucuugugugccauugcauuuaguauugauugauucauuuauuuauuuggagacaaggucucucucuguagccucagcuguucuggaacuugcuauauagaccagacuggccuagagcuagcagagaucucccuaccucugccccacaagugcuaggauucaaggcaugcaccaccaugcccagcucuguauuuaauuuauaugggaauuucucaucuaauccuuaagguaaccauagacuauaggagcuauaauuucccuguuugagagauaaagagacugauguaagagagccagaauuuguacuuacggcaguuuggcucugcaucccuccucucucuuucuccuuauggaaagggugcuguuuaaaauauuuaaacuaauaacaauaaugacuggucccaguccuaccaugcuuggcaggcccaaacacuuuuuaagugucuuaccuguaucaucuuguguaaucuucacaaugauguagccaugaaauugcucuucuuucaacucuuuacuuguuuacuuuuuugagacaggaucuaauuuuacccagucugaucucaaauauuacuuuauagauugaggguuacuguaaacuucuguuccccuuccucuguuucccaagugccuggauuacaggguguaccaccaugacuaauuuauauaauguuugggauuaaacccaggguuucaugcaugcuauuaagcauucuacuaacugagcuacaucucagucccucuuuuuuaaaaaaaaaaaaaaaaccaggaucucauguauuauaggcugaccuggaacuuggcuagguaacuaaggccuugaacuccuucuguuucacaccuaaacugagauugcagccauaugcugccaucccuggcuaguaguuacucuugacauuucuauuaauaucauaugagggcuagagagaugacucaguggguacuugcuacauaggugagagagcugagcguaaauccccagccuccacauagaagcugggcguagcucugugugccuguggaauauuuauccuuucaaauccaacuaauauuuauaucaauaaagacacgggagggguaaacugagguaaaaacuugauagcucagugagguaacuuuauuuucugaacuauauacaaaauauguauuuacaagccuguuccuaagacuaaacugcuagcucuuuagaaaucucucuguaucugugucauucuaccuagcuagccucccuuucucuggagccccuccaaagucaagggcuccguagcucucuucccucccuaggagacuguuuugccuguguccugccagcugcuucugugugguuccuucaagccccgucuccuacccagaguuccuucuaugaaguucuuccaagccaagacagugagagggcuagagagaguccucucaaagguccaguugcuauaaaagaagucucuagcuccuccccuacucccuuggcaggcuaagccuugucacugucaugggagugcuccaagccaagucauaggggaacacagagccauuucaccuuuaccguggagcagcucaaggccagccagcugacuuugccucuggucauagagcaaagaccacaguaucucuccccagcagcuugccuuaaacuagguaagaacuuuccauucuuaagcauucuuaucuguggaggcuuuuagggguacacccuaacaacaucucuucuggacacaccuaacugcaucugacaagcuaucuaagcuuuuuauauuuugccagcaauuagguuuucucuguacaguaaucacauguaacaugccuguaacucaagggcugcaggguggaggcagguggcucucagggguccucugaccagugagccucuucaaaacuggaaccaaaagcaacgguaaaauccagugguaagcuucuggccuagugagauagccuaucuuuaaaaaaaagaagaaaaaaggagaaugaagaaugaaacaucuucugcccucugcauucacagaugcacgccccgaaccaccccucccccauacgugccacaaucaaaauaaucauaugagaauacugagaugcaaacaaaguauaguauuugagaucaaaacaaauaaaccgaaguauugagguuuguucagacuccagagccugugccuuucacagcuguaguuuauagguggcucauacaaauggaugaugugaccucucagggugcuucaaauccucuuccaaggcaauugauguugcuauuuucuuuugugucauucuaaagauaguuucuaacuaauaauucuguguauaaauuuauuugagagaaagagguauacauuuuauggaaacgaauuauguaaccagggaugacacacuuaauccuggcagagggaugaccaaggagcauggucuacauagcaaguuccaggacagccaugugggacauacugagacuguuuuaauuacuuuguauugcugugacaaagcacccaugaccaaggcaacaaaagaaagcauauaauuggggacucauaguuuggugguccagcaggcaggcaugguguuggagccagagcugagagcucacauccugauccacagacaugagucaaagagucaaagagaacugacugggaauggugugugggcuuuugaaccucaaagcccaccagugacacaccuccuccagcaaggccaugccuccuaauccuucccaaacaguuccaccaacugggguccaaguauucaaauauauaaguccauuguguguguguccucauucaaaccaccagagauccucuccaaaaaaaguaaccauaaagcagacuucacacauuguucuguaucauuucauuauuauuuuaaauuuacauaauuaguguguauauuugugugaggucaguggacaacuugcugaaguugguucucccuuuccaucauguggguuucuggggucaaacucacauccugagccacauugcuggccccuuuaugucuuguuuuuuaaaauuauuuuggaaauuauguuguauucauauauagcuagcagcuuucauccuuuuagcuaaacuacauucuuuuguuuuuauuuuguuuacaguauuguauuuaaaauuauucaaguauauuucauacccagggaaaucuuaucuuuuaauuuaauaaguucuaacaaguaugaauauuaauguugccagcugagguggcucauacuuuuaauucuggcaauaaggaguuagaagcaggcagaucucuuugaguucaaagccagucuaaucuuuacaaugacuacugggccagccagggcuaccuagugagaccuaccugucucaaaaacaagcauuacuauggacaucucucaugucaauauauagaacauuuucuaacacccuugaacauuuccuggguucuuuucagucauuacaaccaucgucucagucuucaaguaguugauguucuuauucugucacuauagauuaauuucuaggucuucagacuuuaaauggaauuauaaaauacaugcaccuuguguggaaugacacacaccugugauuucagcagucuggaaucugcugaauaaaaggagacucaugaagccacccugguguguguguguguguguguguguguguguguguguguguguguguguguguguguguguguauaaacaaaauaaacuacuuuuuguuuguuuguuuguuugucuuuuugagacaggguuuuucuguguagccuuggcuauccuggaacucacucuguagaccagcuggccucaaacucagaaaucugccugccucugccucccaagugcugggauuaaaggcaugcaccaccacugcccggccaaaacaaacuucuuuaacccaauuuguccugcuaguuuuagaauaagcuuuuaaaugugagugauuaauuuugcuauaaguuggauugguauuauauagaaucuauagaucaaauucagaguuaaauuauuggaucuuuuauguaugcauuuaauuugauuucuuucuuuauuuagauuuuuaaaaaagauuuauuuauuuauuuauuuauuuauuuauauguauguauaugagugcucuaucugcauguauaccagugugccugaagagggcaucagauucuaguauaaaugcuugugaaugaucaaaugguuacugggaauugaacucaggaccucugaaagagcagacaguguucuugacuacugagccaucucuccagcccuagauuuuuuucuuagcauuauuuuuguuuucacuguaagaguacuuuuuucauuugaauuauuuugagcuguuuuguccucuuggugauaucaugaauguuuuuauauuuuuuuaauuguuguaaaaagauauauuugcuguuauauucugcaacauuguauaacuuauuaguuuccauacuauaucccuuuggauuuagauaauuaaaucugcaaauaaagauaguuuuauuuucccuucucaauugguaugccuuucguuuuacuuucuucuauugcauugaguaaaagccuccaaacagaguuacauaaaaaggauaauacugagccuucaaugguggagaaaguugccuuuguuuccacauuguggaaugaaacauuuauuauuacuguguguguaguaugugaguaugugugugccaugguugcauguauuauuacuguguguguauggcaugugauuaucugugugcuauggcugcauguguuaugacugugugugugguaugugaguaugugagccaugguugcauguguuaugacuguguguguguauagcauguaugugugccaagguugaauguguuaugacuguguguguguaguaugugaguaugugugccaugguugcauguguuaugauuguguguguaguaugugaguaugugugugucaugguugcauauguuaagacuguguguguguauagcaugugaguaugugugccaugguugcauguguuaugacucuguguguguguguaguaugugagugugugugccaugguugcauguguuaugacucuguguguguguguaguaugugaguaugugugccaugguugcauguguuaugacuguguguguguaguaugugaguaugugugccaugguugcauguguuaugacuguguaucuguaguaagugaguaugugugugucaugguugcauuuguuaagacuguguguguguguauagcaugugagugugugugccaugguugcauguguaaugacuguguguguauaguaugugagugugugugccaugguugcauguguuaugauuguguguguaguaugugaguaugugugugucaugguugcauauguuaagacuguguguguguauagcaugugaguaugugugccaugguugcauguguuaugacucuguguguguguguaguaugugagugugugugccaugguugcauguguuaugacuguguguguguaguaugugaguaugugugucaugguugcauguguuaugacuguguaucuguaguaagugaguaugugugugucaugguugcauuuguuaagacuguguguguguguauagcaugugaguaugugugccaugguugcauguguuaugacuguguguguauaguaugugagugugugugccaugguugcauguguaaugacuguguguguauaguaugugagugugugugccaugguugcauguguaaugacaguguguguauaguauuugagugugugugccauggugugcauauggaagugauaggacaaguucaugaggucagcuuucuccuuccacuuuuaaguggguucaggagaaucaggucaccuggcuuguguagcaagugacuuaccugcuaaguggucucacuggucccuggaauguucuuauaaugaaagaguguuguuggaucuugucaaaugcuuuuucugcaucaauucaaaugguuauuuuacuuuuauugaucugugguauguuuuauugauuguuuuuucagauguuaaaaauaacugcauucuuagaauaaauucugagugauguacaauguacauucuuuucaugugugugauuugcuuuuguugaggaucuugcaaacuuaugaagagcuauuuauaaaugccaaguuuuccuucuuuucucccuuucuuuucuuucucuucuuuccucccuucucucccucuuuccuugucuucauuucuguucuagggucaaaccuuguauaugcuugacagugcuguuuugguuuugguguuuuuuuugagacaggcuaucacucuaguucaggcuggccugaaacucaguuguccucuugucucagccuucaaguacugggauuaaaagacuugagcaaaauacuauauaaauaucuauacagucauuuuuggcuauauuggauauugaugccagggccuuuuguaugcucauucuaugacucuggcuggccugaagucacagggaaccuugucagccccuggauuagugagauuucaggugugaguccuggugcucagcuccuggccuccuuuugagcugagguuuugcucagguugauuuugggauccuccugcaucagcuuccugaaagcugggauguacuuauguagagucguguucuccuguacgcccaggcugacuuuaggcucuuggcagagaaugaccuugaacuuccuaacuuggauccuucugcuguuaccgucugagcugggcuuacagcauaacuguucguuuaugcuggacaagcauucuuucaacugauguauauucuuagacccuaccuguuuccuuugaaggauucuuuugcuggcuguagaaauccuguuugauaacucccccugccccaagacaggguuucucuguauagcccuggcuguccuggaacucacuuuguagaccaggcuggccucgaacucagaaauccgccugccucugccucccgagugcugggauuaaaggugugugccaccacgcccggugccguuuuaguuguuaaacauaucaacccaauagugcaaaaaugauaaauauacauagaauauuacaguuaaauuaaaggggaaauauagaaacuaucuuaaacauagacaaaaaacauuauuagauaaccaauaauagcugacuuaugacaagcagggacuagaaaacaaugaaauaaguucuuugaagggagggccaaaaggcaaaaaguugucaaaugcugauucagaaaggauagaacaacuauguaucagacuaaaguaccuuuccuauagauaauaauuguaaguucugaacaaaauauuaaaaacagauaucugaaggcacugaacauacaaaaacgaggauaauuagacaaccauugaaaggaaacaagugggccggacagugguggcgcaugccuuuaaucccagcacuugggaggcaguggcaggcggauuucugaguucgaggccagccuggucuacaaagugaguuccaggacagccagggcuguacagcgaaaccuugccucaaaaaacaaacaaacaaacaaaaaaccccuaaaacaacaacaacaacaaaacaacuaaaauggccaaguauagugguauacaccuauaauccuagcugaaacugagacaagagaaccugaaguuuggagcuggacuaugcuaaaugagacccugucgaaagggggaaaaaaaaagaacaaaaguuggguagaaugacacagauuguuugcuuuguuuuuuguuuuaucuguagcauugguuggccaggaacccacuuuguagaccaggcuggccuugagcuuauugaucagcuugccuuuuucuaaucaaaaucaggggcuggagaaaugguucagaaguuaggagcacugccuguuccucuagaggaccuagguucaauuccaggcacccacauggcagcucacaacugucuauaacuccagguccagggauccauggcaccagggaugcacauggugcagauauagaugcaugcagguaaaauaaaguacacauaaaauaaguaagucuuuaaaaaccaaaccaacaacaacaacaaaauguauuuuuuaaaggugucacaauaacuauuucuaggacuaaauauuuuccccccuaagugagaauugagacuuuuuucuuucuuuccuuuuuucuccuuugauacaggggcucacguagcccaggcugaauguaaacauuguagcugguguuggccuugccugccuucugaucugcuuagucucccucccauguugagggauuacaaguguguuccaccaugccaggcaaagauuuucuauugcuguauaccagcauugugcuugguagaaagcuggcaacaaaauauucuguccaauuuuaaaaaaagaauuauuuauguguagacacuguagcugucuucagacacaccagaagagggccugggaucccauuacagaggacugugagcugggaacugaacucaggaccucugacaagugcucuuaaccgccaagccaucgcuccagccuccccuccucccacuuuuuguuuuuuguuuuuaacugcugguauugaacaggguuucuugugcaguguaagcauguacuguaucacugagcuacauccccaauaagaauguugaguuuuagccuggugcaugccuuuaaucccagcacuugggaggcagaggcaggcggauuucugaguucaaggccagccuggucuacagagugacuuccaggacagccagggauacacagagaaacccugucucgaaaaaaccaaaaaaaccaaaaacaacaacaaaacaaaacaaaacaaaccaagccaagccgagaauguugaguuuugggcuggcaagacauuuuagcagguuaaagugccugucacgcaagcuugacgaccugagucagaccucggaacccaccaaacauggaggaaaagaacuaacuccacaaaguugccuucugaccuccauacagaccggcaugucugccugcacucucucucucucucucccucucucucucucucucucucucucucacacacacacacaccuauuuaaauuuuuuuuaaaagaauguugaauuuuguuugguuaggcuauuaaaucauggggacagcaccuuaauaccaucaagacuugauugugaccuuugucagguugggccuuuuugguuugaacauaaguuuuagguaccagucacuagucaugguucucauaaauaguaacucuuguguauugaaaugaaaaauuccucuaauuggcaguucugacuuggauucccaauaucgucuccucaguucuagauggcucugcccguggggcagcugcucucggagucagacauauaguauguuccaccucgggcccaccgauagccacagcaacugcuuucugcuuuguucuuugcaaucucaucuguugucccaucuggggauuuggagagaaguuuaaugcuaaccuaggauuuccuuauuuguuagacuuucuuuuuguucauucugaacuuuguguguguguguguguauguguaugucugucuguaugcauguguguaugcguguguguguguguaugcauguguguaugcguguguguguguguguaugcauguguguaugcguguguguguguguguaugcauguguguaugcguaugcaugugugugugcauaugugagaagacagaccuaaaaaggccagaggccagauuccccaggagcugggauuacagguaagcuguuauguguagguccugggaacugaacucaaauccucugggagauuaguaccugcucucaaccacugagccaucucuccagccccacuaacuaugaacuucuguuuuguacucuaagugagcugagaagcacugucaagucaaagcuauucaucuaguugcuuucuuucuuucuuucuuucuuucuuucuuucuuucuuucuuucuuucuuucuuucuuucuuucuuccuuucuuuuuuuuuuucgagacaggguuucucuguguaguccuggcuguccuggaacucacucuguagaccaggcuggccucgaacucagaaaugcaccugccucugccucccgagugcugggauuaaaggcgugcgccaccacugcccagcccacuugcuuccuuccagugguugucuaauuauccuuguuuuuguauguucagugccuucagauaucuguuuuuaauauuuuguucagaacuuacaauuauuaucuauaggaaagguacuuuagucugauacaaaguuguucuauccuuucugaaucagagcucugccccccacucuguguaugugugugugugugugugugugugugugugagagagagagagagagagagagagagagagaaagagagagagagagaauuuuuuucuuuuugagaugagauuucauauuaauaauccuggccauccuauagcuugcuauguaaguaagguugaccucaaauucacaacaucaugcuggcuuuaaagguaugugccacugugaugaccaaucuugguugucaacuugaguacaccucgaaucaacuaaaacccaagcagguggguacaccugugaaggauucucuugaucauuuguagcaggaagccagccuaauuuggauuauuugaggucugaagacccacccuaaaucuagaccacaucuucugguauggccuacauaaaagagcaaggaagaagaaggaagcccuugcucuuugccugcuugcucucacucuugacagccgccagcucaucugcucugcugaggcaguaguaugguauucacugcuauuagaagcuacuucagaauuccaacuuaaagaucagccaaggcauucagcuacuggacucuuggccagccauugauggccuagucagaucacaguaagccauucgaauaaguauaccuuuaauauauagauagauucacucuuugauucuguuccucuagagaacccugaauacagccaccacacccaacuuuuuguuuuaaaagagauagaauccugcucuguugucaggcuggccccaaacuccuggucucaagugaccaagugacucugcuaggacuagacucuggcccccauuuuuauuuuuuccccuaaguccacaacauuuguauuauuaaccuaaaggagcggaccagacagggugcugacauccaagaguugcggcuuugaguugaguugaauccugugcucuccaauaugacauuacacacauggcacaaagagagaaggaagaugaagacuaagcagaguagaggcugagcaggaguagcccugaggcuggaggaggaugugaugucuaagaauucaggcaaggcaaggcaccgggacuggagagaugucugugggacaugugucacaugaagaugcgugugugugugugcaugugcgugugcauguguguauguaugcacuagaggaggaggagagacuagagauaaugauggaaaggucucagauggagcaguuugggaagacauagagauggaguggcuggucucggaugggagcaggguucuuugugacagaaggaagguuagggaacgugauggauuugauagaguugacggaggggagaggagaggagguacuaacacgagagaccguuugcugugaauuaagggaaugaggauauuagaaagauaagggaagacugaaaggauuaagguguuuuaugauuuauguuacugugugacaacccauccuagugauuaguggcuuaaaacaagauuauuuuuagguuaugaguccagguugguugguugguagugugugccgugcgcaggauucucaucucuucuccacaaagccaucuugguuuacucauaggucuggcucagguggauguuuaagccucucuccaggguuuuaccaucauuagggcggccugaggaagcuucuucacauuuagucaaugaucucaaaggcauugagugaagcugugaagccucuuggggaucaggcucuggcacccaucuuguuaacuuuguugguuacgguggguuuuaagagcugcugagcaugaagggaaagcgaagaaacuuugacucuuuauuuuuagauagggucugacuagccugugcuaaugucagaauugcuauauuguucaggcuaucucaaauccguggcaguccuccugucuagucucuggaguguuagaauuacaaguguugaggguaugagccaguauuccuggcuuagacuucacaucuagaggcaagagcugucuguguuuaagcuuaucgccaucauuauaagagagggaaaccagcuuccuaacgagagauuaagaauccaggcuacauuaaacgauuacuuaauugagguuugugguuauuuagaaugaguaggggccgagcuagauuauucacagaagccuucucugaccagugcuuccccuaccagccuuccucacccaugacuaaagacaguuacugacguuuauuauggguuuacagugcugggcauauguugggcacuuuauauaaauuacauauuuugguuuguguuuggaguguguguguuuucuagauacaguuuuacuccaaaccuaggcuggccuguaacacaauguguaacucagacuggccuugaaaucaagcuaacucuccugcuucagccucuuugagugcuaagauuucacacuuggcuccagguuaucuugugagguauauacuuucauguucuaaaucauguauuagagggcacaaacacaaaauugaggacuugaagaaccuaggaauggcugacggcacaauccauguuuucucaagaagguagccauauucuaguacacuuaauaaaaggaagagaaguguucaaaggaaguguaaaagaaaugaccaagauggugaccuuccacuuuuggccugugaauggaagucacagcagauagcacugaguagugcugagcucugagugacuggccgucucagugcccacgcauagcaaaguccauacagcgcugggcuuggcgaugcuucuccucacgguggcugagaugguccuaaagucugagcuccuuggcuuaguuccugugcugcuguuugcgguucagcuuugccuacugccccacuuuccucccuggugcuuuuuagugucauguuguggcacuuuggguuuuaacuuuuauuuuauuauuuugaggcaggcugaccuugaacucacagagucaaucugacucugcuuccccaguguugggauuaaaggcgugugccacccccaagcccccaaaucacucuuuugacugguugaugauagcacacuucuuuaauuccagcauucagggggcacaggcagggcacaacucugaguuugaggacagccuggucuacagagugaguuccaggucagccagggcuacacagagaaacccugucucaaaaaaccaacagggcuggagagauggcacagagguuaagagcacuggcugcucuuccagagguccugaguucaauucccagcaaucacaugguggcucacaaccaucuguaaugggaacuggugcccucugcuggugugucugaagacagcuacaguauacucauauacauaaauaaauaaauuaauccuacaccaugccuagucuguaguaauuuuuuuguauuguuguuguuguuauuauuauuacuacuacuuauuugaaacaaagucucacuguggagccuuaguagccuggaacucacuguauaaaccaggcuggccuggaacucacagagaucuggcacccuuugucuccagagugcugggauuaaaggcauguucuaccaugccuggcuguuguuauuguuacuuuuaauuaaguguauauguuuguggcucugugugugugugugugugugugucugugccugagaguacaggugccuuuggaggcuggaggcaucaaguuccacuggagcuagaguuauaggcuauaagcugcacucugugggugcuaggaaccgaacucaaauccucugcaaaagcaguguuagucuuuuguuuguuuguuuguuuguuuuuuuuuugagacaggguuucucuguauagcccuggcuguccuggaacucacucuguagaccaggcuggcuucgaacucagaaauccaccugccuuuaccucccgagugcugggauugaaaaaguaggccaccacugcccugcaugcauuagcguuuugccugcauguauaucuuugugagggugucagaucuuugagcuguuauguggaugcugggaagugaacccagguccucuggaagaucgaucagucagagcuaucuccccagccccaguuauguguucuuaaccauugagcuaucucucuaacccugguaaugguuuuuuuuuuuuuuuccaaauuugucuuuagcuguuuuccccuaagagcagccacaguaugcccucuccugcuagccuuagccaaagguucccauucugguucugaacacugcuguacugagaacaagcagagagugacaacucugucccuagugaguagguuaguauaaugugucuguggcucuguuauugcuugggggugacugauggcauaacaucucuguguccuggaaccgugugcucuuuucuauucaccagucacauucaccagucauuuuucuaagacugcaaacuugaucagugacagaaacuggucuguaggcaggggguauucugcuauagucuggccuguuuacuaccaguucuauggcugguuggggucauuguuugauuucaugaugagccaagucucucaauaccagucgugagaaugugucuucauaaugucgagcagcucuguccuuaauuggaagaacugccaguuaagaguuaagguuuuacuuuuuaucgugccuucaucauaucuagcagauaagaugcuccugugaaaaccaggggacacugagagccuggcagagcccuugaugcuuuugggacuuaguguugaaguuaccuuucugagauuuugcugggauacagacuacucucucgagaguuagacgacccaggagcaugcaaccacaagcaaaccaagccuaggacagcacugagugcugccagcugcccggugcuuaguccucacucuggagcacaaggcagguacugugcucuaacccccagccuaaucauauuuggaggugagucuuuaagagaugauuaagcuaaaugaagacaugaggauaggacucucaaauuuggauuagcuaagauggcgccaucuguacuaggacuagaaccuaccagcuccuugauuuugacuucuacuagauucuuuuuuuuuuuguuuuuucgagacaggguuucucuguguagcccuggcuguccuggaacucacuuuguagaccaggcuggccucgaacucagaaauccgccugccucugccucccaagugcugggacuaaaggcgugcgccaccacgccuggcuuuuuuuuuuuuuuaauuagguauuuuccucguuuacauuuucaaugcuaucccaaaggucccccauacccaccccccaauucccuacccacccacucccccuuuuuuggcccuggcguuccccuguacuggggcauaaaaaguuugcaaguccaaugggccucucuuugcagugauggccgacuaggccaucuuuugauacauaugcagcuaaagacaagagcuccccgguacugguuaguucauauuguuguuucuacuagauucuuaaaauaugagaaauaacuacuguuuuaaugccccaaccuaaguguuuuaacaaguugagcuaagauaccagucaguggaggacuuaaagucuagugggcugagaucaaaggguaggcaggaaaacaugauggcagaaaaggguguuuuuguuuguuugcuuguuuucucuuuucuuuuuuuuuuuuuuuuucgagacaggauuuccucuguguagcccuggcuguccuggaacucacuuuguagaccaggcuggccuugaacucagaaauccgccugccucugccuccugagugcuggaauuaaaggcaugcgccaccaccacccggcuacuggcagaaaagucaugcauacugaccccacguccuguuggcuucagagugcauccugcaccguacuggccugggcagggcuaaaagugaaaaugguuacaccaauggagauguggagcuagauguggggcucauaccugugaucccagcagacugaaguagaaaauucuaguuuagauccagccuggguuacauugugaguucuuggccagucuaggauauaguaaaaacagacaacaucaacaaauagauuuggagauuaugcugggcaugguagugcccaccuuuaauccuggcacucuggaagcagaggcaggcagcucuccaugaguuucaggcuagccagggcuacacaguaaguaguuuguagccaaaccaaaaauaaacaaaaacuuuggagauuuaaaagauauaucagcuggguggcgaugguguaugccuuuaauuccagcacuauggagacagaggcaagcagaauucugugaguucaagcccagccuggucuauaaugugagcuucaggauagccaaggccacacaaggaaacccggucuugaaacaccuccuucaaaaaaaaccaaaccaaaccaaaucaaaccaaaccaaaccaacaacaaaacaagcuuuccccuguugauugucuucuacaugguguuucuguaggugagcaucuaucauguccagcagccucauccuaccugucuucuccauccagcuuccuuccuucugcuuacacuauguucuagagugacuguucuagaacccuguguagagcaaugagggagugaagaaaggauagauacuggagccagguagguugugugcaccaacuaccaauaugggggaguucagcauguuuauuuuguacagcacaguggggaagaguuaggcaggaaguaucuguaagagaugcagaugccugagacuucaggcuguaaacaucugggaaaagagaaguuccauugcuaggguuuuuuuguacuuacuggucaguuguuuguaaacagaggaacuuggaccaggagccagcuuugccucucuuagcugacccaggggaaggcuuuuccaacuucccaugaauccuaggccuuggucccugacauggcaggcucauaucaaacaaucccucagagcuguucagggucuccucuguucccuacacugccccaugccaaagggcuuuguguugcagugcuugcuuuaggaagugacaggaggaucaacaguuggguggcuggcacuuuuuuauugccucagugagaaagguuugcauuacagaggucuagaauuguaggaugcucacuuuugacugaagcugguauccccguuuucccuuucucuuuuucgugucuggaguuagucuacacugugcugugcuugcuccuggacagauacgcagacaaauuuguuccucaggcaguucuccauaugcuuuauaaggauuuuaaguuuucacuuaauuuauuuguggagaugggucuccacuuuguagaucuaugccucugccucccaaguguugggauuaaagcugagcaucacuauuccucacucgauuuuaauuuuauuuuuaauuaugucugcacaugaaugauaauguucuuggaggccagaaggaucaaauccucuggaauuggacuuacagguuguugcggucacucggugccacucaguguagaggcugucaaccaaucgugagucuugggcaagaccaguauuuccucuuaauaguugaggccucucccaccccaaacucugucugacacacucauagacauaggugcacacacacacacacacacacacacacacacacacacccuuaauguaauuuauuuuugagauaaagaccaugccugaccuaggcuuacuuguagauuaggcuggccuugaacacagagaucggccuaccucugccucccaugcacugggauuaaaaacuugaacugcuacuacaccugacuggcaggucuuuaaaaaacaaauuaaaaaaaauagcacaaggcuucuaauuuaaaauucugggcuagagagauggcucaaugguuaagagcacugauugcucuuccagagguccugaguucaauucccagcaaccacaugguggcucacaaccauuuaugaggguaucugaugccccuuucugacaugcagguguacaugcagcagagcugcauuagauagacagacagacagacagauagacauagaauauuggacugggcaugugccuuaaugucagcauuugggaagcagaugcaggaaguucucugugaguucaggacagucaguacuauauauagagaaagacccugucucaauaaacaaacauaaauaaacaaaauaaaaucucuuaaacauuuuuauuuaucguguaugugcauguaaaauauauguguugggcagguugugagggaguguuugcaggacauucauacauuuggacaacuuuuuggagcuguuggguuuuuuuuuuuaggauuuuauuuauuuaaugcauaugaguacacuguagcugucuucagauauaccagaaucuguuacagaugguugugagccaccaugugguugcugggauuugaacucaggaccucuggaagagcaggcagugcucuuacucacugagccaucucuccagcccccuggaguuguuauuuuuuuuccaucuacuuuuuuuuuucuuucuuuuuuucaagaugggcuuaccgugugucccuggauacauagcuuggaauuuguucuguagaucaggcuggccucaaauucacagcgaucccacccugcuccccaacuucugcuuccuaagugcuggacuaaagagccgcaucccccugcccagccucuguccaucugccuuuccguggcuucuggggacagaacucaguuugccagcuugacaguaaauaccuuuuacccacugagcuguuccggcccuacuacauucaaauucuauagcuacuuaacccuuaguuauuuuuguaaguaauagaauaaaagauaauggcguguauuugcguauuacuauucuaaaguguuuauauuauuauuauuacuauuauaauuuuuuuuugagacaggguagcccuggcuguccuggaacuugcugaaccugacugcccuugaacucacagauacccaccagccuuugccucacccugcccaacacccgaguuuagguuagugaugaauuagugauacuccuauugcagccuaccaaguagcugggcuaccaauuucaacuaauuuuuacuuagcuguaauaaaauauauguaauaugaaauccaccacuguagcagucuauacuauaugucaaccccagaacuaaaaaacaaaacaaaacaaaacaaacaaacaaaaaaaacgaaacauuuuuuuacagaacuuuuuuuuaccucuuuacucuuuugcccccugaaguagaauaagguaggaaaggccaguuaccacacauugguuugcuguuauauucagugauucacucagagcacugcucgaacugccuuuugccaagcaugacuucauuugcuacauggaacagcugacacaguggaucccgagaaccuggccagucuugcucacuugccccaccuuaugguuugagaauaugaaaugagaaggcaaacugagcccaguaccuuucaggagcuaucugggcuuucaggagcuaucuccuccuccuccuccuccuccuccuccuccuccuccuccuccucccccucccccucccccucccccucccccucccccucccccucccccucccccuccccuccccuucguccccuccccuuccuccccuccccuccccuccccucccccuccccuccccuccccuccccuccuucucucauugguguuggagugcuuauuccagagagauuccagagcaccugugaugcuggaacuugcacccaggaauuaccacaugccaggcaagcaccggucacagaauauacaagccagccccaugugcugaccuuucugucuuugacacuaagugcuuuaauuuccucaugugauuggaacugugugguauuuggguuuuaauuuaaagacaagguuucucuauguagcccggcuguccuggaacuugcuuuguagccaagguuggccuggaacucacagagauccaccugccuuuggauuuccuauugaauacugagcacuguuccaccguucguuuauacacauguucuuugguguugggguuguaugcaugcuguauccaugcuaagcauauacuuuuccacugagcuacacuccucagugccugugucuuauuuugucuauucuuucggcuguugaugcacacugcaguuguuucugcuuuuugucuuuugucuuuccgucagguuuuuuucuuuuuuugagacaggaucauuucacuuuuuaauuuuuuuuuuaaagauuuauuuauuuauuuauuuaaaguacacuguagcuguccucagacacuccagaagagggagucagaucucguuacggaugguugugagccaccaugugguugcugggauuugaacuccugaccuucggaagagcagucggugcucuuacccacugagccaucucaccagccccacuuuuuaauuuuuuaguugacacacaggacaauuguaccuuguuuauuauucauguuucauuacuuucccauguccuccuuccugcuggucuccuucuuccucccauauaguauccucuuuuacucucacaccuuuaugugugugcauauuugcauuaaauacauaaaugucuagauucuaugaggaaacaugcuaggaagaucaccugugaaaauaucuugcuuauaucguguauucaauucaagaaaaaaucgaaaaacauuguucuguuuuguuuuagucuuuuuucuucuuucucccucucucuguuucucucucucuguuucucucucuguuucucucucuuucuuucuuucuuucuuucuuucucucucucucucucucucucucucucucucucucucucucucucucucucucugucucugucugucucugucucugucucugucucucucucucucccgucuggccuugagccccugagagcugccugaugagugcugagauuacaggugugugccaguuugcccagcugcuuuuauuuuauuaauguacaugcaauucuacauauuuuuacugcaguccuuggaguuaguuaugucuuugaggaauguguauuguuugagguagcuaaagagcacaguuuauagugcuuuucuucuacaaguugagaggaauuaucaguuagcuugugcucagguguguccuguuguuuccagggaguaccauggccauggcaacucuuauaaaagagaacauuugacugggcuggcuuauagucucagagguuuaguccaucaucaccaugguggggagcaugguaccacucaagucaggcauggugcuagagaaguagcugagaacuuuacauucugaucugcaggcagcagagagacagggacacugggccuggcgugggauauugaaaccgcaaaguccaaagcuggauguaguguugcaggucuuuaaucccagcacuugggaggcagaaacaggcagaucucugucaguuugaggccagcuuugucuacucacugaguucuagaacagccagagcucuauagugagacccugucuugggaaaaaaacccaaaagccaaaaacaaagaacaaacaaacaaaugaaggaauaaaagaaagaaaagaaagaaaccucuaaugaaugcacagaugaaagacagaaagaaagaaaagaaaagaaaagaaaagaaccucaaaguccaccuccaguaacacaccuacuccaaaaagggugcccuccgaaugcucccaagaaguuuaccaacuggugguuacaugcaagucugugagccuacaggguccguucucauucaaaccaccacaccaggaaugugcauuuguuaauggauuuccagcacuguuaugaaacuggaaaguuccuugcagucuuucucaugcccucagguucuuuuuauuuuuuuaaauuguacaugauuaccaaaagccacuuuaaugcaagucuauuaauauucuuugagcacauucucucuauccucugcugcaauuuucuuuucuuuccucacuccccucugucccucuagacaaucuuguuucuauguaucuauaaacuucaggaccuacaagggaaagaaaacaugcaacauugucucucuuagacugacuuaguucauuuaauaccuguaucuccagaugcaaaagaaacaaaacaaugucuucuaguguugcccaggcuggccuuuaacucuuggccuccagagauccuuuuucucaguccccugaguacaugauacuguaaucacacucacagcacccauugucuguggauuguuuggggugacguucuagccacggacccaguuagucaaauagaauggauucauauuaauacuaaauuauuuuuguuuuucuuccagacagggucucacucuguagcccuggcuguccuggaagucuuucuguagaccagucuggccuugaacuuacagagaucuuccugucucugccuccugaguacucagaucaaagguguguaccagcaccgccaaggcaauacuaaauuuuugaagaauaaguagcaugaguuuuuuuaguuccauaauuaugaaauguucuggugauuuggauacuaacuaaagguaaugugucagguuuaugucagugugaccagauaaugacaccagauaaugugaccagcugagcaaaacaaaccaaggguagaaagaugauucugggcucacagucaguuucagaggcuuuaaucuaucaugucagguaugguggaacaaaaaguaguuacauugugcuggcaaggaaguguguguggggggggagaaaugccuauauaccuauacuagcuugcuucuuucuccgccucucccccccuuaccccguuuuuuuuuuccccagacauaauuucucuguguaguccugguuguccuggaacucacuccguagaccaggcuguccagagacgcagagauccaccugccucugccucccaagugcuggaauuaaaggugugugccaccacugccuggcuucauuuucuccuuuuauuccauuuguauuccuaguguaagaauuggugcugucuauuccaguguaggucuuaauacacuuaauuaacguucucuaaaaacacacucagacacaaccagaguguguuuaacuaauucugaccacuacaggucuaucccuugucaacuuguuauccaaacacaucuccuuaaacuguaauaauccauuuuugacucccaaaagucucauguugagaguauaaugcaaaucuaucuuuaagaggucugguaguuuuaauaguucuuuccaguguuauuuaaaauucuaaauccaaagcuuauucuaaaacucugaaaauucuaagcuguaaguucuguaaaguaaaaaaaagucacagccgggcgugguggcgcaugccuuuaaucccagcacucgggaggcagaggcaggcggauuucugaguucgaggccagccuggucuacaaagugagcuccaggacagccagggcuauacagagaaacccugucuccaaaaacaaaaacaaaaacaaaaagucacauacuuucaguauacaguagcguagauucuuaauaaugucaaguuuuucaaauauuuccaaaagaaaggaauuggagaauagugaggauguaucugacuagaguugggcaggccacaguuaaaucuuguagauguucucuugcuuggcuagauggcuuagugcauaaaggcacuugcugccaaaccugacaacugaguuugauuccagggacccauauacaaguggaaaggagagaacugacaaccacaaguugucuucaccucuccauguaugccauggcauguacacacacacacacacacacacacacacacauugauguguguacacaaacccuguagcuccaugcauugauguguguacacaaacccuguagcuccaugccuggcauuuggagcaggugugaggugugauguaaguucccaaggcuggguccugaacagcuuaucaccccuguagccuugcugguuauaaccaccggccuuuuuuucucuugggcuacucuguucacuugcuguaguuuucccagcacacauuccauguuugugacaacucugacuucuggaguuauuucuuuauuuuauuuuuaguuaugcacauaggaaggagguauacguauaugagugcaggccuucauaaaggccagagacaucagauagcccuggaguuacaggugguugugggcugacagauguaggugcugggaauugaacccuugucuucuauaaguguagugugugcucuuaacuguugagccaucucacuagccuuauuuauuuauuuauuuauuuauuuacuuacuuacuuauuacuuacuguguaauccaugcuggccucaaacucacuguaauccuccugccucagucuugccagugcugggaauaccuauaugagacagcacauuuggcuccuggagucuccauugaaucuuggccuuaccuuuacagaguuaagcaucacucucuccagggccuuucuuuggggauccagacccuacuacacauugccugaccuuccagacuuuucuuugaaaccagaauggaagccucaguaauuuuaugccuuagaguuucuauagcuaugauagaacacugugaccaaacgcaauauggggaggaaagguuuuauuuuguuuacacuucugccuuauaguucaucacugaacacagggcaagagccuggcgggcggcaggagcuggugauauagaggauauggaguggugcugcuucuggcuugcucggccugguuuuuguuuuuguuuuuauagcacucagacuaccagcccugagcaucauaugggcagugcccagucugccgccagcuuggucaguagcuggcaccccuuggaccaugggugcuuagacggcugaaugugcgggaaacacuuuccuaagugccugagcaugagucggaugccuagagcugucuuucaaaagacauaaaagcuuucugccucaacuaaagugauaguggccgguuccuauuguccugaugccaaguacuuggcuucuuucuaagcaccucugccuuuccaacagccacacuuccccaggcccccacuuuccauggggugcuuugcugagcaaguggaaagcuuucaggccuuucuucugccgugggucugcucauacccaugcugugagcuucucuagauagcgcagccacuuauauccaugcuucagccugaacgccagcaugcagugaguuuccugugcuagauaaucagcuaauucaucacuuuuuuaagaucaugguuuugucuucuucagguuccuuucugauccuacuuacucaacuuaaugguuuuguuuuuuucugucuauuuucaaagaaacaaacgaaacaaaaaaaacaaacaaauaaacaaacaaagucaagaaauacaauuccuccuacaaaacaaagauaaaaaaauaaacaagcaaaagaacaauaagacaaaaaaaauauucaaagcaaaaugaagcaauaaguccacagggaagagcuagggaggcugggaucugcaccaagagacagaguccucagugaguggagacggcaggaggggggagcucuugcagguaggcugcuacaggacuaagacuaacccacacacacacacaccacaccccugaaagaucagcagcggggauagacaggaaggagagugaaaauugccuuucguuguaccagcccagcaugccacugggaaucccugguaaaaagaguuuuugaggacugcuggcugacacaaaggaguggagaagccagaagggaaagcugaaucugaaccaagaggcagaggccucaggaaaugaguaggguggaggagccucugcugagaggcugugguaguauaaagaggaagucuggagagacaggaaugaaagggcuugggagacccugggccugcaccagaagcuaguuguucaccuuuaacuuagccuucaaggagcuagagggauugcucagugguuaggaauucugacuccuuauccagaggucccagauucaacuuacagcaccuaccugguggcucacagccauuuauaaauccaguuccagggcauccaauccccagacacacauucaggcaaaacacccauacauauuaaaaacaaacaaacaaauaaacccagccuccacacagucucuauucacugacagaauauagacgaauuuucccccugcaauguaauacaaguggccuguaauccaguuccuaauauagauguugcuucuauauagaauugcucuuucuuucccacaccccugucaguauucugaucuucugagaucccagcagaauuacauagaaaucucaucuuguagcauccuaaagucuuucuaaugucuuucuccaagcuguuccaaauaccuccaacaaucacaugagcucuggagucuuaagaaccucauuguggcugggugugguggcacacacuuuuaaucccagcauguggacggcaguuagaucucugagugugaggccagccuggucuacuuagugaaugucaggccagccaaggccucauugugauacccugucucaaaaccaaaacaaaauaacaauaaaaccuuacacugugaaucuggauaugguggggcaugccuuuaauucagcacagggaggcagugaaagaacuuucuguaaggccaccuuggucuacauagucacuuccaggccugccagggcuacauaaacugucuuuaaaaaaaaaaaaacucucaaaauacaaagaacccuauuguuuagucaugacagugccuacuccccccgaaucauuuuaauuuaaaugaguauuuugcuuauauguguaugucugcauguguucaugugugcauguugaaugacuguggugaccagaagagggcaucagguccccuagaacuggagaauuggaugugggaauuaaacccagauccucuagaagagaauccagugcuuauaacaguagaaacacagucccagcccggcugguguguugguuuuacauuucugugacagaauacccauauaaacaacuugagagaagaugauuuuguuucauaggcugagcagucuuacucuuucacaguggggagaccauggcagagcagaacagcucacgucaugggaaccaggaaggauagaaaagaaugaggggaaggagggaaggaaagaauaagacaaagaaaaagauagaaagcucuuagcuagccucuccuuuuuucugcuauucuuuuuucaggcccugagcguauuagaugguaucaacaauacauucaaggcagaucuuuccaccauaaucaaucaucucuuggaugccuucagacacacccggaagugcuuuauagcuuccuaggugcuucucagucccaucaagaugacaaucacaauaauggcucuugauuucuuuucuuuucuuuucuuuucuuuucuuuucuuuucuuuucuuuucuuuucuuuuuggucugacauuuucguuagugugauaacauugucagcuacuugacaggauuagaaucacuugggaaauggccaugucugcagacuauucugauugcagugacugaggugggaaggccugcccacugugggcggcgccauucugugcgcagaccuuagacugugugaggagacggugggcugaguacaggugguuuuugacugcuugcccccaguuccuucugaagggccuggaacggagagcuaaaccagcccuuccuuaaguuguucuugcauuuuaucacagaaucaggaaaagaaacuaagaugcaaaauuaacucuauaaaggaaaauuaaauacuuuuucuuuuauuuucagguaaaccagccaaaacuauucccugaaugaaaacaccuuuuuuuaaaguugcauauauacacaagaaaaaaccgaaaugcuuuuuauuuugccugaaugcaagauuuaaacaagguauugccauagaagguaagguaaucuuuucaauuaaauuacaguuuauaauguacagguuacucaaauauauuuuauagauggacauuuguaggucagaugauaggaucucacuauguagacaaaacugguugguuguuuuugguuuuaagacaggguuucacuguguugccuguuguggaacuagcacuuuagaccagacaggccuugaacacaccgagcuauaucugccucuugucucccaagugccccacccccacccccacccccacccccacccccagcugcuaaaguugcucuuaaacuuaggauucuccagccucuguguccugaaugcugagauuacagcugaacaucacacaccugguuaaugccauuucuugcuagcauuuuguuguauuagacauuaagauaauacccaaagggcgagagaggagagaggacacugagcauuaugacggcucuguucugcucuguagugaagaacaaagcaugcucugggcauugcuuccuuuucugucacugugauaaaaaaccaaagacccagguccacagauuuaaggagcauguuuuaucccaacugauaggaacugaaaaggaaaagggcuggcagcaugguuugauggguaauaguucuuacuccaggagccggaugaccucaguuggaucccuggaacccaaguuggagggagagaauugacccccaaacauugguuuuuggucucuagauaugugccauggcauauaugcgccuguacugacgcacauuacacacacacaauaaugauaaauaaagcuuauuuguuuauucuuuaaauugaggcaaacucugucuauguagcccuggcuguccuggaacucacuauagaccaugcuggccuugaauucacagugaccugccucugcaugggccaccaccacacuuguaauugauaaauuguaaaaaguuaaaauacaaaaaaguaagagcugauuuguggcugggucaaugaucaguugcaguuuagauucuaauucucucuuggcaacagucucuaccacagaguguucuguuggacccuuucauggaacuguagcaucauaugggcgacacuuguguuugaauccuauccucugucuuccgguucugucacccugggaaauaaagaagcaggacuugaggcuccuuucacucauucgcugcuggguaagcguguagcaggcuuggccguaucuuguuguucuuuacagucuggaaggaaucucaaggacaguagucaaagugggaagagcauccugcuguguggauguacuaaguccaaagcuggcuuauggacaaggaugcucucagugguaaccugccagucaucaguggauaguuaagcaucucuauggaagacaggauguagagaucaggcauaguguuugacaccuguaaucccaggauuugaaaagcugagguaagaugaucaccauaaaccgggcguggugccgcacgccuuuaaucccagcaccugggaggcagaggcaguaggauuucugaguucgaggccagccuggucuacaaagugaguuccaggacagccagggcuauacagagaaacccugucucaaaaacaccaaccaaaaaaaaaaaaaaaaaaaaaaaaaaaaagaaaaaagaugaucaccauaaguuuaagaccagcuuguauacuuagacucuacuucuauuaaaacaaaacaaaacaauaaaguuugaaaaagaaauauucaacaauuggaccuacaagauggcucaucagcuaaaggcacuggugaauuuaacagauuaaacauauuuaagacagaauuagugaauuuaauaaguauuugaaaaauuauucagaaguugaacugagagaugggaaauagaaguugagauuaaguaaaaauagagguuacaauaaaaggacgguaaguggauagugggaauuccacuguaaaaauugagaagauggagcauuauaaauuuuaaacuuuucaaaaacuuguaagacugaaguccauauagauuuaagaagugugcugcauccgcugggcggcgguggugguguucacagcucgugaggaggagagcggugcacaaaucccugugaagagagagcugccuuccucccccuugggcaguccggaacccagggacgagcugcccagucggucuucccacugaccugaagacgcucacucccucacagugugcugggccuugucuccuaggggauucuagauccucuuaguuaacaguauuaaucaccacaccguccucucacuucuaaguuuuaaaaaaguuuuauuuauuuucuguaugugaguguuuuaccuguauauaugucuguacuauucguauuccuggugccuucagaugucagaaaaagacaaggauagaagauaccccagagcuagaguuacagacuguugugagccaccaugugggugcuaggacucaaacccagguccucugcaagaacaauuagugcucucuuaaccccugcgcccucuccucagcuucugucucuagaacuguguccuuguugcuuguucuuugagguagggucuuucuaagcagcucuggcucuucuggaacuugcuauauagaccaggugaaccuugaacucucagagagccaccugccucugccuuccaaaugcugugauuaaaguuaugucgcuucuaaaauuuuaucaucuaaaauguuauacuggagcuaggcaugguaguguacucuuaaccuuucaagaggcugaagugggagaauuguuugagcccaagagguuuaagaucagucugggcaccauagugagacuauauuucaaacaaauaaaacaagcaaagcaaaacccaccaaguuguuaauuggaucauagagugcaaucuuuuggaaaugaucuauuuugcccaguaauaauuuucuagacacuuaaucaguuuuuuuucacucaccaguauuuccuuuguggaacugggacuauaacucaguuggcagagugcuugccugaugugaaugaaagcccuggacuugagcccccuucagcagcaggaggcagagguggaaagacuaggaggucaagguggcucuuagcuguggagcaggucugcggcuauucuggcaaacaggacacucuggcucaaaagcaaaguuuucccaaucauaaaacaccucauucacuuacaugaacuuaacacauagguucuuuuuuuuaaaaaaacauuuauuuauuuauuacauguaaguacacuguagcugucuucagacacuccagaagaggacgucagauuucauuauggaugguugugagccaccaugugguugcugggauuugaacucgggaccuucggaagagcagucggugcucuuaaccacugagccaucucgccagccccaacacauagguucuugacagcggugcuuggaauuguacauaaaauuuuucauaugacaugaaacaaguuauuuccuuguuaacuguuucuauagcauaugcauguuaggcaagaaaauaaggaaagauucaugaauuuuuauaucuuccuugcauggggccauguuagucuagcuuaguauguguauuaccaaagugggcauagauaggccuuuuuguuaccccauuuuccuuacuauguugguacuacguguugugcuauagccugcauuuugaaggcuguccagguagaucccagccuuccucacaccccuuuuugguuagcauacaaggacaugaacuucauuaugugagucuagcuuuguuguuuaguggguuuguuuuauuugauacagggucucacuauguagcccuggcuguccuagaacucacucuguagaccaggcuagcaucaagcucagagagcucuucuuggcucugucuccugaguccugagauuaacagugugcucugaugcuauucuagcuuuugacuguuacaaauuaaacugcuaucaacauuuaugugaaggauuuuaugugaauuuaaauuuuuguuucccuaggaucaauguccagggccaaggcaguuuuauuuguauggauuucuguuuacugcugcauuauagagguugcagaaucccuuaagguuuguauguuuaucaugcuuggaucuuuucuuucuuaccuguauaaaacagugccucuuauuguuuuguuuuuuugccguaaaguuauuuaucaaauauuaacagugaaucucagcuuuugguuuauauuugcccacuguguguuucaguugucguauuucugccucucucaguuuuuaaaguauauguuguuuguuuguuuguuuguuuguuugaaacaaggucucugugugucccugacuguuguggaacucacucugagguucaggcugcuugaacucacauagaucugccuuccucugccucccaagugcugggaccaaaagugugugucaugacaccuggcuaaaguauauuguuuauaguaaacauuguugaaauguuuauauccaguccaagagacuuuuacuuugguagguuuauccugugugugcugugcucacugauguuauuagugcugguuccugucauuuuaauguuuucuacuuacugauucuuuaguuuuguuuucauuucuuguuuccuaguuuuguugacaagauuaugggagguguuucauuuuggccuuuucuuuuguuuguuuuauugcucuucucuuaguuauguauuccuuuugucauggauauuaagagauuuaguaauagguguaaucccaguuacguggcuuuuaucuguucucuuuccacuguaacauagcuauaacuauauaacuauauaacauaacuauaacauagcuauaacuauguaacuauauaacauaacuauaacauagcuauaacuauguaacuauauaacauaacuauaacauagcuauaacuauauaacauaacuauaacauagcuauaacuauauaacuauauaacauaacuaacauagcuauaacuauauaacauaacuauaacauagcuauaacuauauaacuauauaacauaacuauaacauagcuauaacuauauaacuauauaacauaacuauaacauagcuauaacuauguaacuauauaacauaacuauaacauagcuauaacuauguaacuauauaacauaacuauaacauagcuauaacuauauaaaguaacuauaacauagcuauaacuauauaacauaacuaacauagcuauaacuauauaacauaacuauaacauagcuauaacuauauaacuauauaacauaacuauaacauagcuauaacuauauaacuauauaacauaacuauaacauagcuauaacuauauaacuauauaacauaacuauaacauagcuauaacuauauaacauaacuauaacauagccccuuuuccuugucauaucaacaggaagagaaaugccuauuuagucauucuggccacaugaauggcuauauccaaagaaugaaguuuaguugauagaguaauaaauugcuauuggaugugguaguauacaucugaaauccuagacuuuuguggaugcugaagcagaggaauuuugaguuugaggccaacuuuagcuauacuggauaaaccaaucuuaaaaaagagagagagagagagagagagaccaaaaccaaacaaaauacuugauuacuugaaaugaacuugacgggccagguguuacuguugugcuguuuuuacgucaugcagauuguguugucuuguuucuuucccuuaucucuaucucuuucugagacaagcucucuguauguagccuuguuugggcuagaacuggccaugaggauuaggcuagucucagacuaacagaaaccugccugccuguaguccuggcuguccuaaaacucacuguacagacgaggcugaccuugaacucagagaucugccuaccucugccucccaaguacugggauuaaaggcaugcagcaccauugccaagcucaggcccauaguuaguuuuaugucaccuaagcuagaggcauuugggaagagggagccucaauucagaaaaugcuuccaccagauuggccugugggccaaucauuuuuuugauugaugugggagggcccagcucauugugggcugguaguccugggugcuauaagaaaacagguugagcaagccaugaggagcaagacaccacuaaagaguguuccagcaaaggcuucaucuucauuccuguccuugaguucuugcccugccuuccuucagugauggaguaugauguggaaguauaauugagauaaacccuuuucacucugguuugcauaugaucaugguguuuugucacagcaauagaaauccuaagauggauugguacccggccaugggauauugcaaugacaguccugaccauguguuuuugggagauucaugauagcaauuaaacuuugggcuguguacuggaugguuuuguguaucaacuugaaacaaguuagagucaucagagagaaaggaaccucaacugagaaaaugccucuaugagauccaguuguagggcauuuucuuaacuagugaucaauagggaagggcccagcauauggugggugguguccugaguucuauaagaaagcaggcugagggcuggagagauggcucagcgguuaagagcgcugacugacaggacagccagggcgauacagaaacccugucucaaaaaaccaaaaagggggcuggugagauggcucaguggguaagagcacccgacugcucuuccgaagguccagaguucaaaucccagcaaccacaugguggcucacaaccauccauaacgagaucugacgcccucuucuucuggugugucugaagacagcuacaguguacuuacauauaauaaauaaauaaaucuaaaaaaaaaaaaagaaaaaaauaaauaaaaagaaagaaagaaagcaggcugagcaagccaugggaaacaggccaguaagcagcaucccucccccauggccucugcgcuagcucccuccucuaggcucucacuuccuccagugaggacugugaucuggucgcguaagacaaacccuuuccucuccaacucacugguguuucgucacagcaauggaaacccuaagacaggcuggaaaggccauugagugcucacugcuccgugggcuguucucuaggaacucaaaagguaaugcugagagcuccgcuggugacaaggccuggcuugugaaguuucagaaggaagcagagacucaaggccauuuuugugauauuuuggauuaagaaucugugguucuggucagcugggacugaagaauuggcugugauuaaggagagacuuuguuuuggaaugaaacguuguuuugauauaaaucgaugcugauuagcuggagcugagaaauuaguggugauuaagaagagaccagccaggcgugguggugcacgccuuuaauccuagcacuugagaggcagaggcagguguaucucugaguucaaggccagccuggucuacaaagugaguuccaggacagccagggcuacacagagaaacccugucucaaacaaccaaagagagaaaaagaaagaagaggccgguggcauugagaauuguaagaugcucuguacagagggagcugaggcugcggcugggcacauaagaaagcaaaccgaguaaaccaggguggagugagccagugagcaggguuucucuguggccucugcaucaguucccaccaugacuccuaguggacugugauguggaaguguaaucugaaaaagaccccuuccuuccagaguuacguagggucagggugcuuuaccacagcaguagaaacccuaagacucagguaaacugugaccucacucaagaccugacucuaauccuagccucuauguuaccccacauuccccccaucgcauguguuagucugugccauaucccuggcccugagcagccucuggucuccuugccucgggucuguuuuacacuuugugaauuccauaugaacggagcuaucggccuucuugcccugucacucccugugcugugcuuguucuacucagggaggaagggucuguuauaugggagguaacucaccuguugacagucauuugagcugcucccuguguguaacugcugugcaucaggcugccaaccuucucucagguuuguauaaacauaggauuuaauuuuucuuacauugacccugagaguaaaacugguugaucacaugguaagaguacaccuaacuuuauagcuuuuauaccuuuuuagcugucagauucuuuucaaagugugugugccacagugugcucccuuccuggaaguggaaaggagucaguuguugagcuccuccucagcuccugggcgccuuuuugaugguagcgguaguagguaugcaguggggcuucacugcagucacuauugacuacggugacccuagugucaugaacuuaccacuggcgugucauuuugagacaagaucuuacuguguugccaaggauggcuuuagaugcauggucauccugccuuaucaucccaaauuccuggauaaaaggugcaaauuggcaucuguaucuuucuaucuuuuaaaaugaagaaucuccauuuuguuuguuuuuggagacaggguaucucugaguaacagucuuggcuguccuggaacucgagcuguagaccaggcuggccuugaacucacagagcucucccugucucagacucccuagugcuugaaucaaaggcgugcuucacuacugcucggcuauaaauaauguuuaguauguuuaugaacugccaagcuuugcuuuuuuuuuaagcacuuugucauauuaucuuuuguuauugauuugagauagucucaccaugagggucugacuggucuggaacuccuuauguugaucaggcuggccuugaacucacagcaauccaccugccuuugccucccaagugcugggauuaaagacaugcacuacugagucuggagaauauuacauuuauuuauauuucucucucucucucucucucucucucucucucucucucucucucucucaaaugcaugcuuugauuugcauguggcuaucagaggacaacuuaugggaauggcccucuccuuuuaccauaugagguccagggauuaaacucacauugucuuguguggugacaagugccuuuagucacucagucauccugcucuggccuuuccuuuguagccucccuccugccucuguagugcugggaaacaaaccuaaagccccuuuauauggcuuuaccacugugcuguacuccaaacacuguccucuagaauuuaaccuuguagacuuuugauuaaaccugugauguauaucauguuaauuuggggucugacgugaaguaaguauugaacuucaggguuuuuuuuuauguauauuuuguuuucuggcauaauauguugaaaagacuuacauacuuuucuucauuuauuugauuuuguacauuuauugaagaucaacugaauauauauugguaucagaggcugcugugucagggcuucacugguagcucagauucacaaacaaauaaacaaacacauuuaagaacugcagccagucgagcuggagagauggcucagcgguuaagagcacugagacugcucuuccagagguccugaguucaacucccaguaaccguaugugugcaguggccacacaggucagaaaauggcauuauauggagucuggaguuacagacuguugugagugaugguuuggguacuagaaaccgauccucagauccuuugagucaagagccaggacucuuaacuacugagcuaucucuuuagccacagucuuuuagauuuuuuaaaguaaaaauacuaaguaagauaagccccucagguuuuaucauagguuuguaaauaacuuccuaugacauuaaaagaguggucauuuagaccagugacauggcuugcuggguuagggccgugggacccacaugauggaaaguaagaacugacucccccaaguuguccucugaccucuacacaugugugcuuuacugugugagugugugcauguauguacacauacacacaaauacauauaaaaauaauuuaaaagaucugucauuugaagauaagcuuucucuuuguugaagaugaagcuucauguuuucuuuuuguuaucagaacagugaaaccuguuagcuaacuugcugcggccugcacacugacagugagccucccugggacagacagcucaagcuggaaggaggguuggggaggcagaggaagggccgggcuaguggugaucuucccauugcuguggcaagacuucaugcacaguuuguaugcaugcgaaagagaugguugucuccuggguagcccucgacaguauucagcaagauugccacaguaaacugaggggcuagauggcagaugaccacagaaaaugacaggaucaagcaaugugcugucuuuuguuuggcuugcuacauguagccucugagacuauuccaggaacacauguccaguguucacucaggagggauuagacacugggaggauggguuccuauccuuuucagggcggggagacauuccuggugcugguacuugggagacagaugugugggccucacagagccaugagcaaagugagagccccuagggacucaagcacuguagugggggagaagguaggucagauaaggggcacagaggaaaggaccccaggguugcuuguguguguguuggggaugagccccuuggacuuuggguacaucauggcugagggugggacgagcgagcugcuuuuguccuuguuugcagcucugcgaccgccaucauguucuggaaauuugacuugaacaccacgucccacguugacaagcuccuggacaaggaacaugugacccugcaggagcugauggaugaagaugacaucuugcaggaguguaaggcccagaaccagaagcugcuggacuuccugugcaggcagcagugcauggaggagcuggugaaccucaucacacaggacccaccccaggacauggaagagaagguccgauucaaguauguacugaggcuguuagcgaggcugugguuagugucucaggacagcuggagccaggcuaucaccucaugagacaugaggaggcuauuguacaguugguugguugguugugcgcuguaagaguucugagucucuuguauaaauguuuucucauuccgaguuguaaaugaguuuauauuaaguuggccuguguuggggcaauugagagacacugcugaaaggccccaugaucaauagauaaauagguuccugagacugcagagcugugccacgucauuagaguuggcaggugcauuagagguuugaugucugacuucugagccccaggaaauguuuccuuuuaggcuguuuaguuaagaggaggauguuguuuucauuaguggcacuaaaccuuuagaaauuuuuccuagaauguuuuacuuccaguuugagcaggauguugggaggugacaaaagggaggggacagugucaucacagaauggagcuuugaggaaguacagucugaauugggagggcagcaagaagucaggccacaccuucaggccaagguuuggcuuccuaaauaggccgcaugguccauaguguuucugggaacaguuaaggacaucuaacacagcagacagaugugggugcguaugaggaaguccacuguacacagguaugguaggaaggucuuagaguaggaucaguaggucaugaugcaugguugucaguccuuccagccccccagccuaugacacaaagacucgcuguguucacauacuggucugacuuucacagccucccaugccuggcagcuucacauuuuuaaauguuuuaacaauuaagagagaggacuuuguuacacaugcucaggucuuuugggugucauuggcaugccgcacuaauccauauacagucagaguccagucacaaaagagacucacaaaaauaucuuuaauuugucccuucacaacaaaucuugccugacauuuguccuuuggaagaagggcaggccuggauuuugaggcagccuguggggggcugucaguacuuucuccaggguagucagucugucucugacaggggaaaucacgugauaggaagagcagaggccugcugucaaaugagccauggcuucauggagaggguaaccauagcuggaggcugucauggucucaguaucaacuauucacagccuaccugcaucuuacuuccaugugucucccaguuuagaugacacaucagaacaaagugacaggggaggggauauuuaaggggccaagagagagauucucagaacagcacuaaugacucgggagccuugcagagucagagucagaaauuaccaaugcaugagugcuaaggugaggcagagaaggccaugaggaagcgcauggcucucgggagccccauacauggucagcagguggacggcugugugcucaucguaacauacauauguauaugguguacgcaugccuggagcccucuggagcuguguaacuuaaacccuuaccuucaugcuccaugagcaccugagguugugcuuggucuacuacaguguguuucccucuucuuuccuucuuccuacccaugccugguauguggucaugugacuuacuucagggucuccugcaugccagacacuaggagggcacuguacuacaacggcuucugcagccagaugcucuucuuaccuuuaacucagcacacuugaauaggagcagaauaggaccaggcuagccuggucuacacaguaaguuccagacagccagggcuauguagagagauccuguucucuguguagacaagaugacuucccugggcucugaaaauguuucaaaaugcugucuguaguuugcuucauugccucaggaucaagcaaugugcugucuuuuguuuggcuugcuacauguagcaaggauuugagcuccugugcugccccaguggguugugucuugugggguccuuuggagcaucacuguggcccucacugcagcugaccuggcccucuuccugcucucacugggcucccuguccucaguggccauguguuaccccuacacuaaacgcuugugcaggguuacagcaaccccaugagguggggcccuggcugccccacuucacagacaaggccagagagguuagccagaaagaaguaaucccagaacugacuuaauccguaggucccgcccacacgcagccuguggggccugaacgcugaccauucuguuguccuguccaaaggccugcuguuuuguaguccugcugggccucugugacugacagacccuuuuuggcucugaaggcugcucccuucuugcaggcugagaaggagugucuacaucacauagccaguggagagcucuuugucucuggggcauugauugucuucuguccuauguagaccagcugcuaacaagaaagccuggaaucacacauacugggcuaaggguuacuuuguugucauuuuuaucaaaugaaaaguauacuuguacaaacuagcauuucuuaagaguaaauugcuugcuuggagucucacagcagaugcuguucauagcugcaggcauuuuucuugaguuuagaacagugugggccuuugcuuacugauuugaaggcacagagaggagagagaggagcaauuuuccaaggaugccugggacucagccucacugcaaguggggagauaagcauggccuacagagagaauccaggagaaagaggaguuuuguuuaggucuggucugguagguaguacacacuuaauuacagagcuugggagguaagagcaggaggaggaggaggccucagggucagccuugggacauaaugaauuuauggccaguccagacuacaggaaauugugcuuguuugcuuguuuguuuguuuguuuguuuguuuguuuguuuuuuaaaauaauguuauuuacagaagagaaguagagucagaaaaaaaauguagaauaucagaguauaggauauauggaacccauaaaagauggauuauaaacuuggaaguuccaauaguuagagauucaaguugucucgugccauguucacucuguucugaggucuguucaguaauuugcucuuuucacgugggucugcuuccucuugcuuugaaaaauguguuuauuuuggauuaugugugugcgugugucuaaaugagagugugccguucucauggaugccuggaaacaagaugugagagccccucgaggauguaggugguucagccacccgacauggacacugggaacugaacucagguccucaggaagagcaggacauacucuuaaccacggagauagagcuccagcccugacgugucugcuccuaagcaucaguuuacuuaaacaguuuccugagaguuggagaagucuaauuucacauccaguacuuggacugugcccuuuuagauacccaaacacagccugugagcuucugacuugugaugugccacagaucagcgacagacuaggcgaggacgagagucugcugaaccuucucuaugacuuccuggaccaggagccgccacucaacccucugcuugccaguuuuuucagcaagaccauuggcaaucuuauugcaaggaaaacugaacagguaaugaugugugaagacaaauguauuggacaaccacuauugauacugugcaacuauuaccaggcuccugggacagcacuuuguuaguuuaacagaacacagaugaacaguauggguggcugauaugugaacuguaguguaaguugcguggcuuuccacagauguuucugguaaccagcucuggaguaagcaacacuuguugcccucccugggugcuuugcaagccccagaccaggcaugaacaugagggccuaugacaugcccucacuguggagggauuugagacaucugcauuuuggggucuuugugaguagcauggcuguguguccagaacagugauugcuuuaaagcaaagauaauguuagaaucaggcuuuuguggguaaagaaacuccuauuucccauguaccacuguccuucccuggucuuguuuaaccuugugugaguguagcugugcguggggagugaaacggcaguccgugccuccugcagggaucaguguccgucucauccccucacuuaccaguccccaguggauaauuucagcacacagcuuagaugucuuguuuaauguucuacuauguguuuaaguuauaaggacuuuucucuuuuuaauacugguagguauuauuauauuccuaaaauacuggcaguaauuuuuuuggucucauacaacaaaacuauauuuugucuaugucuugaauccugggacuguggagggcuguuucaucucacauuguuuugaaacagcagagaugaagagugauagugcugugugugugcgcacgcgcgcaaguaugcauguauguguaugaguaucugugugucugugugcaugugucugugugucugucucuguguguaugugugugcauaucccguucucacuuguaugugcaguguuggggcauuacuggagggaaagcaagcaauugcccuaggagaagaaaggugcuguggggucuucauuuugaguuucagagacugggugugugaaucuccucauuuacuguacacugaucauauucuuuugccacuuuagauuuucuuuacaauuuuacuaucucauauaucccccuuucuuccuuuaucuggugcuuucugcauuagagcaauaggaaaugagcuccuuaacacauuucacugccaggugguggugggugcagcagcgcacaccuuuaggaggcagaggcaaguagaucugugaguuugaggccagccugcucuacagagugaguucuaguacagccauggcuacacagagaaacgaaaagaaaaaaaauauugugcagacaaacaugucacauuuauguggaauucaaguaagaaauaagcauauaggcucugcacucccucaguagcgagcagaugggugugaguucucagauaacaguaccauucugaguacuacaaguugcuuuucuaauauacacauaagucuugugugucuuuuguuauagaaauaccugcuucauuuugacaguuccuuguauggcucuaccaaaauugcucuggaaaauuuggucaucagucaccaggagauggccuauuccuaggguuagcugugguagacaggccagaagagggcgucagauaucauuacaggugguugugagccaccaugugguugcugggaauugaacucaggaccucuggaagaacagccaguguucuuaaccucugagccaucucucuacccugggaggacaacuuuuaagacagguucucucugugcaguccuagaacaauggcucucaucucccagcacuucuuucuaugccuuugccgggcaaaccuaagcuagcacaugcccaguggugauucugcaguaauucgcacuguuguccaguuagcagcagugcugcccugugcuugccugucuggggagggauguuuuucacauagccuuuccuuggucuuucugucauuucuucucgguauacuugaaauuuaaugauuuuucugaugugagggguuguuuuuguuuuuguuuuucuuugguuuuugagacaggguuucucuguguagcccuggcuguccuggaacucacuuuguagaccuggcuggccucaaacucagaaauccaccugccucugccucccgugugcugggauuaaaggcgugcaccacuacgcccggcuggugugagcuuuuaagggagugucccucccugucaggggccagcccuguuucuuucucaggaguguuugauugcaggugaucauguuccugaagaagaaggagaaauucaucagccagcuccugaagcacauaggcaccucagcucucauggaccugcugcugcgccuggucagcuguguggagccaguuggucuccggcaggagguccuacaugugagugccagggcgugagugucaaugugugggaggguguaccaggccaggcucccuggguuaggagcaccagauacccagccuugggcuuuucacccagucccucggcaccacuugcuuaugucuguauuuuuauucugcuuaggccacuuagaagcaaagguagagguuccuucuccccagcauacggccccuugcuagcuccagaaacaaaagugcucuuuccugccuuucccucacccaggccuuagagccaauucauacugagcugugugcuccaaaccuaggugcugccuggaggucaggaaggguccaucucucagucuggaguguggguagcugugcugcuaggaaggauguuguagcagucccugggaagaagaacaggacgcccagccuggagggugagguuuugcugcuaugcaaggcuuugcuuguuccccauuuggaaguaaaacaaaauaaaguuagaccuuuguccauuuucucccucugagaagcaagagucauuuaaauggcuguucucagugggcauggugauugaagucgguaaccccaacaaccgggaggcagagcuccaggccaccaagggcuacgaagugaaaccuugucucaaaagcaaauuaaagaugugauaaugguuuuuguuuuauuauaguuuauguuauaucuuguuaucucuuagaaaccuguucuuuucuaaugagagacccaaaggaaguggauccagugugaggggaagguggggaggagcugggggaaacagaagaaggggaaacuguaaucaggauauauuguauuaagaaagaaccuguuuuuggugaaaggggaaaaauaaauaaaagauaaaauaaagugguaguuguucuaacucuuaggcucauaacuuuccuuacggcauuauagagagaaucagaaugcaccuuagcuauuaauaagucuuggugaaagcuaacuuacuuacuuuucuauuguugguuuaaaacacuguauuagucagcgguuacuagaguaacagaacuuacagaauguguauauaugggauuuauuagagugauuuacaggcuguaguccagcuaauccagcaacggcugccuauggauggaagggccaggaguccaguagcagcucaguccacaaggcugggagucucagcuggucuucacuauacacugggguccugaagaaguaggcucuaauggcagggaaagggaguugacuugcuaguaaggagagagcaagcagacaaagcaaguaagcgucuuucuuccguauccuuuauggaagcuuccagcaggagguguggauugaaagacuaaagguggaucuucccaccuaaaagcucuguauuaaaggugucuucucaucgcaaagauccagauuagaaauagaucuucccacuucaaauuaaguuuaaaaaaaucucauaggugugauccauuuuuuuuuuuaggauuacauugacaaccaaaaauaaucauuacaaauaccaugaccaaggcaauuccuuuccucuccucuccucuccucuccucuccucuccucuccucuccucuccucuccucuccucuccucuccucuccucuccucuccucuccucuccucuccuuuccuuuccuuuccacgucucuucucuucuauuuguuuuuuuugagacaguguuucucuguguguaguccuggcuguccuagaacuugcucuguagaccagacagggauccaccuaucuuuaaauugccauugaccauggcaauuuaaaagaaauuuaaaauuuaaaauugggauuuuugguucuagaggguuagagucuaugguguuagaacaaaggcauggugguggggccagcugagagcacacaucuugaaccacaaguaggaguacacuggggauggcaagaguauuucaaaaccucgaacccacuuccaauaauacauccucuuugaaggccuccuaauccuuuacaaacaguuccgucaacugaggaccaaguauucaaacaucgaauccugugaaguccauucucauugaaaccuccauggaagaccacccagcuuuugccuuucaccucucacggcagcacucacacuguaaagcgucccugcagggccagcaucuugucuuugcaugaggacucugaggugcagagcacagggguagaaucagccugcaggggaugcuguggccugacaaucucacugagucuucauugcuuugacccugaaaagugucagcgucagccauuacaguauuccuacagguacaccagggacuuugcguuccuccagcuccuaggaaggcccugaugcuacagagcugaggguugucucauuuucauacccagcuggccccuggacugcauucuuuccuuuuuuuuuuuucucuuuuuuuuauuagguauuuuccucguuuacauuuccaaugcuaucccaaaagucccccauacccacccucccaauccccuacccacccacucccccuuuuugacccuggcguuccccuguacuggggcauauaaaguuugcguguccaaugggccucucuuuccagugauggccgacuaggccaucuucugauacauaugcagcuagagacaagagcuccgggguacugguuaguucauaauguuguuccaccuauaggguugcaguucccuuuagcuccuuggauacuuucucuagcuccuccauugggggcccugugauccauccaauagcugacuaugagcauccacuucuguguuugcuaggccccggcauagucucacaagagacagcuauaccaggauccuuucagcaaaaucuugcugguguaugcaauggugucagcauuuggaagcugauuaugggauggaucccuggauauggcaaucacuagauggugacugcauucuuuucauucuguacucuagguuucguaaacccuguguccugaaagcagagaaagugugcacuguuuaagacagguggaaaguaucucagccauucccaaaguuuacugugucauuuugguucuuucugggacaugcaugucagacaggcaugccagagucuauuccaggagaccugggcacaggaguuucugcuguaccaaaggacuuguuuccauucgcuuagaugagcagauacugaacuggacuuuccccccuuuuaguggcugaaugaagagaaaaucauccagagaauuguggcauugauccauccccaccaggaugaagaugugagugcgaugcucacagagcccaccuucuuacacggacacacccacccaggcucuuggaaaacaugcugcugugugaagggggcaagucacuccuuuccuuugaagaggaccauuagauacuuucuuuaaccaaaugcuaaugucuggguaauuuuguuuuuacugaaaacaaauguuggacaggcaugauggugcaugucuuuauucccaacccuuggguagcacagguaggcaguaagaccuugccuccaaaacaguuauuuauaaauaaaaaaaauaaguaaauaaguaaauacguaaauauauaaaauaaaucuaguauauaguaugcauacauauaucuacauacuuauauacauacaaauuauuucacauaagcauauaauuaaguaguuguaacaggguugcauggcugaaugaccgaucacccaguagcugaguugucaguaacaaguacccuuuaucuuuaucaguaucgguuucucuggucaggaaucuggccauggucuguuggcuucucugcucagggucucucguaagauuacagucauuccaggacucagccgaaagaagauccacuuucacugguggcucagcacauucaauuccgucgaggcuuuuaguccugguaaccccucaggcgggugcagugugggcuucugaguggacaacagggcucacaccaagcuagcuagcuuugagaagugagcuggacucacaccagacuucuauaaauucagcucagaaaugauggcccuccuucagccuucuuagugcugcgacccuuuaacacaguuuucauguuguggcgacccucaacuauaaaauuacuacugcuucagaaccugauuuugcugcuguuaugagucgugauaugcgggaucgugucaucucaacccacaggcugagaaccacugcucuaaugcauucuguccaagucuaggguucauucaaggacauggacuuacaagggcaugaauaccaggaaggguuaauuaggguucuucuggaaacuucccagaagcauguaagacagucacagaaagaaaaccuaacugccacucagugucucccacugagcucacuauacaagcccacuucugaugcaggugagcaguaaggcuucucacccucaggccaagcagucaguucucagagaacaccagccagacacccuggaguucaggucauuccugacacuugcuggguacuaggagacuacagauuggagggcuuaguccccaagaccaccccaacugugcugccuuacaucugugcuuuuggcugacacuggauccucuauacacucuucaagauuucugguuuaauauaaagaacauuauaaaugaugccuaugaauaugaagaggugcacaguauaauguauggaaggauggguguggagcgucccugucuuuuccacguguauuuuucugcaggaaucuucaugugguuugcuauucagaaacucccucaauccagucuuuaugagguaguuuguuuguuuguuuauuuauuuauagacuugauugcacaggauuauuacuaauagacuuuaggagaaaaacccaauaagaccugucuggucagaugugcagcauuacccauuccaggucauggggcaggagcccucugggaugaggaggauauuauaaucuacugucagaguggaccgugagcccagaacuguggacauaggccaaaaaauauaugucagcaugucauaggugacacaaguuuucagccaucuucauccuuccuauagaaaucacugcugaggguuugaguuuuauccuacgcauucuaaauauucacacacagauacacugccaucagugaacauuugacagguggauacugacaucaguacuugacacguguccgaaggccucagugcugccugaccauccuguuuuggccucuguccacccaaugagcacacuagacggcggggaaaggaauuguugaagacuagaggauuuccuauaguaguguuccaaaagguagagccugccaugaaaugaguguuauagagugacuagccugucucugguccugaaggcaauuauggccaaagagccaaccuggcuaccuucauuuucccugaaagccuugcgaguuuuuuuuuaaucuuaguuuuuuuuuuaauuuuuaaaaaauuuuacuguguuuaugugacauuacaaagaucaagcugucucucucgugauuacucuccucuccacccacucauguucucucgagcacacaucugagcuggggguggggcucagcacucgcguccuaggaauguugaguucuccagggucucuuguuucuuucagugacuuauccugcuuucccaagcccacaggacucacuguaaauaacaguaacugucuaauacugcauuuaacaugcagaauaagaugguuauguauucaguacauuuuagaauaugaaucaaagguauaaaauagacacaaaguauauaacauacuuggcuauuuugggucucauuuuuaauuccugggauguguuuaguaugucuuuuaaaaaaaucuagcaggauccauaucuugaugaugggcaaagcagacacacacuacuuucaaaugaaccauuucaggaaucuuuauagaaaaccggcucaggaaauucauuagcuggauugacguggcugauggguguguuuugcugaggggagccuguuucccuugucuuuucagaggcagucaaaugcuucucaggcacucugugacaucaucaggcugggcagagaccagggcagucagcugcaggagacuguggagccagacccccuccucauaacauuggagucgugagugauagugggucaugauaauggugggccucagucuggauuauggacaugucuuggagccuguuuugaauacaggagaugacacugccaucacuaauucagaacuggacuaacuccucagguucagagcccaggaagggcuaucaaucacuagaagcccuggugguccagggaguuggaacuagugggcuuguguguuaugcaagcuuggaguacuuggcuuugaaccugaacaaagccagaaugaaggccucaccuggcucagggugcugugguagccucuggggaagacaguguccuugaauuauguauguaugucugcucugccaggagugagugaccucugcaugugcccaacaggcaggacuguguggagcagcuucugaagaacauguuugauggggaucagacggagagcugccuggucagugggaugcaggugcugcuugccuugcuggagccaaggcguguugggugagccuuuucuuugaaaaagcaacauacacuguucuuaggccagaggacauggguaucuaggaagagccaggacaugcuguuuuuaauuuuugguuauacaaguuacaauguggcuagauacccugguugaaaggucuccuuuguagcuguaucgaggucugagguccucuucgacccucacuagcaggcauaguuucacccuagccugguggcacucagcugcugccaguuuguaacaugcuuauagaugaguauggaauacaugugguuuucucuagguacugcuuuggccaguaugcacaaugcaugagugugugugcauguguacccccuauagggagggcuucuacuccagcauguagcugcuugcucucuauauguuuaucucccaugcuagaaaaggaagcacgcuguguucaucuuugcuaaguguucaauaagacacuuuguuucugggauguccuucacuucuuugguuuuuguuguuauuuuuugagauaggguuuuucuguguagcccuagcuguccugaaacucuuuguagaccaggcuggccucaaaaggcacuggcuaagauguauuuauuucuguacaugaauguuugccugugugugaauguaugcacacuaugugggugcagugccugaggaggccagaagaggacaagagcuucccagaaccugaguuacaggugguuaugugcagccaugaggguguugucaaccaaaccuaguaagugcucuuaaccacugagccauuucuccaggcccucacuguccuucacugcuuuuucauccaucaguugcuauuugaauaccuagcauggaguccuaagagacaaagacaagcaaaauauggcccccuuacauccaguguuccugucuguuccaaaagaugguacagguucuacucaguguggaaagucugugugggccuggaagauagaguccuguggucagggagguuuucucugagaguccccauuuagucaaagauaauuccugacuagaagaagaucccaguaggagcaaaagcauagagccauccuauggguaaggggcugugaggcuuaaagaucuacacuguucucaggauugcuauuggaagccaguugaaucaggaaccauaaagggacaguucuaagacaggagagggcaggagacaggaguugguauagaaagcugaaucuguuugagaauucaaguggucuuaggauccaaguuuaaauucuggaaagugaagcuuucuuuggggcucaggcuggcccugggaucucagcagguuagauguggucacagccacuuaaacaaagacagccugugagccacagaugagagaacagauguggggagucagcagcagcagagcuucuuugccccggaccccauggaagggugaccgugccacacaggaggugauggguggggaucuugagauugcuaggcacugagcucccagccucccucucagugggccuugaagcuccaucaguagaugaagguucuccgcagccaguggaccguguugaaaaugauggaugcuccaauucuccuucaaggcacuugccuuaugaccacauguugagaagaacuucauuaucuccuggugcugaccuuguugugcuuuuaaacacaagguuauguuuaaagugacaagagauuggguaaaucauuuucuagaauaccucaguccaucaguauuagugcauugccuaaaaaugaguagcuauuuucucuacuuaagcaacuagaauuuuaauuucuuuaacaaauccaagccaccuaggccaccuuugaaagccaaacucagcacuaaaugugaaaauagugagagaauaguguaaaauuuagaaauccagaacuagaaccagguauggcgggccaugccuuuaauuguacuagugagggggggugggggggugggguuuaggcuggccaagggcuacuaagauccucuuucauuuuuuuuuuuuuuuuuuuuuuuuuuuuuuuuuuuuuuuuugguuuuuugagacaggguuucucuguauagcccuggcuguccuggaacucacuuuguagaccaggcuggccucgaacucaagagauccaccugccucuuccucccgagugcugggauuaaaggcgcgagccaccacgcccggccucuuucaauuuuuuaaagaaaaaggcaaaauagaaauaguccacuacuugucuuuaauuuuuuuauucucucauacaucacaccuacaucucauaaucaccccguccucuccucccagcuccucucccaccucuccucucucccaaauccucugcuuccauucaaaaaaauaguuuccuuuaaaaagagagagaaagagaggggagaccucccagggauaugaacaaaacauggcauaaaaaguuacaguuguuaaguaaaggauacucucuuuaauuuguaggauuuucugcauugauuuuguuuuauuuugauuaauuggaaauauauuuaaauauauaucaaaggaauuuuuuuaaaaggcaaaaaaacuauguggccagucugucuccuguuuuucacuugaggacuggggaccccuggugggauuaaggggacagcaaggcaucaaguccugugccccuuuguggucuuggauggcuaaggggccaagaguaugccagucagcaaguggugugaagaagucucgaguaauguuccuuuucagacaugguuuugggaagaugcuuaauagaacauugacaaaaugaaugggguaugcacgggacacagcacucugccacgccuuuauucacagaacagaaggcuugguggacuccuuuucucagggacuggaaaggucacacuccgucagcagcagcauccuucguggcaucgagccauggcugaagaauuuccaucagcuccuccucaacccaccaaagguaaacagagcaguuagaggugugggguggcaugguguagaggacaggacagaguauggaaaacagugugcuuugauguugcccuucgaggugcuagcuggaaaaccacugggcagauguuaaaauagacuauuagcuagaaauagccaaguugccuccacuaggagaggccugggcaugggcauggcagaacccccugaacuaagcaugaggucaccuggccucuuggucaggggcgugacucgccaaggguggcuccuggaggcugagcucccaggggaacuuucuguucagucgacagcucaggggaguucuuggguuaggccaaggacgguaaaauucacaaagguccucagcugccuccugcccuccagccucacauuacuguccuuccccacacacaguuccagccuuuuuccugguacacccauacuuacugacuuauuuauugucuuguccccccacuaauacguaaggauucauggaggcaagaacucuguuuugccaaacacagauggaucagaaaauaccugaauccaauagaaugaagcaaaccuggggccaugagauggcugagcaggcaaaaugcuuucugugcaggccucaugaccugaccuugcuuccugggaaucguauaaagaugaaaggagaagaucaaguccacagaguugccuucugaccuucacaccuguacugugguauacaugugcccaggagugugcagacacaugcccauaguacacucacaagcagauacauaauauauacacaugauaacuguuuuuaaaacuugggggcuucacuuagcaucucuuagcucagaauccuccuaagaauuccuugggcauacacagacaagcaccauguccagggcuccagcccuuaguuggaucagcuugcuucagauugguacugcuagcuccaucaugaacacuggacacauuucauaugccauaguacugcuccuuuggccuagugggccugaauaacaguccaggagccuuaucuacucccuuugguccugaggggacaaaguggguccuucaucuuuuggauucugucacuucucguaggaagcccugucuugaucauaccccauucucuuuaggccaggcauaucauaggugagugccccuguugguuacaagacuccagcugggugugucuucuauguuugcagaaaaaagcaauccugaccacuauugguguguuagaggagccccuggggaaugcucgucuucauggugcacgccucauggcugcacugcugcacacaaacacaccuggcaucaaccaggagcucugccggcucaacaccauggacuuacugcuggugagucagcgcuguggcgaguucugccuguuuguauguggccugcauagucugcaguugaacauggagaugaguccaucagggcaggcacuuuagcaucuggacaaaaagacaugccaaggggaggugccaguauggaggacuugaucauggaucucugguagagcaacacagagauguaccucagucuuaggcucauaguauccugccagaggcucuucccaauggcagaggauggguggucuugguuucucuuaagucacaguaucuugagaggugaauauccaugaguacuaggccagccuggucuacauagugaacaccaggauagccagagcaacauagugaaauccugccucaaacaaaacaauaaauaaauaagcgaaagauagauagauagauagauagauagauagauagauagauagauagauagauagauaaaaaacagaaggguccugagugagaaggguccugagagagaaggucuuuaucuucuaaaauagucauccuuauaguucuuguuaaaaccaguagaugaauggucagaagcuauccaguggcuguagauuacugaucuuaccguguucuuuaccgcccuggagcagcaggucugauaaaagauggaauggacuuuugaagacacaguuacaguuagguggcagcagccuugagggcuaggcaggauucuccagaagaugcuguaugcuuggagucagugucgguagccaggguucacgggucauggagucgaggguagaaaggaauacuucugcucacuaucacccacugggaacguuucucugaccuguucuggcuagaacuuuuggcuucagaguagggaaugcuucugccaggagccacaacaaauguuccauugagcuggaagcuuagauuugccccuggccacuuugagcuucggacacccuuaagucagcaggcuaagaacagaaaugacagugacaggagggugauugauccaggucaccaugggggaagcuggguugcuucccuacaacggagguaagaaggaucauggcuggagugccagagauccuuuagagcaucucuuaguacuaccguguccugugacuuaaaaucaaugggaaaugcaacaaccuaauccaggcaggauaagaaaagguaugaacccaucagaaaugaagguaugggccacuccuccaggaaaggagcuaagaccugcugaggugcuugcagagggugaaggacauacaggagggguaguagagaaagguuguagccggaccuuuggcuacucuguggauaguaguuaggacagacuaaaggacaggggccgugggugaaaucauucgacuacuuccugcugauuaggggcauagaauuccuuggggcaaguuugaucuucgacaccaggauaucuaguaucuucuuuuugucucuauguguacgacugcuauaugaaugacuacuugacuaacugcaaccagcagcauccaaccaccaacuagccagcuaaccccuucuaccaagacccuggcauuuuauucauucauucauucauucauucauucauucauucauucauucaauguauaugaguacacuguagcuguacagacgguuguuucaugugguuguugggaauugaauuuuuaggaccucugcuugcuccggccagcccugcuugcucuggucggccccacucucucagucccugcucacucuggcccaaagauuuauuuauuauuaugcacaaguacacuguagcugucuucagacaccccagaagagggcgucagaucucguuacgggugguugugagccaccaugugguugcugggcuuugaacucaggaaggaccuucagaggagcagucagugcucuuacugcugagccauuucgccagcccgagacucuggcauuuauauauguccaacaguccaaagcagccccacaccugggauuaaaaugaaacacauucuuaaaauauuucuauggguuuuuuuuuuaaaagaagccaaauuucucacuauagaagguaguuagaaauaucaacuaaggccacauggccaguuacagaaauaaggauuauaauugacauaauugcuucugccauauuuuauaagaauguguuuguauagauauuuguguuuucuuuccucuguuucuuuaucauacaguguaacaucaauuaagagaauaucagugguuuuuccauuuguuuaaauagaucuucuuugggacuaaggguauauagcuuagugacagaguucuuagauaauguacaaagcccuguucacacuagagauggcucagugguuuagagcauugguuauucuuccagaggaccugauagguggcuuacaaccaucuauaacucuaggcccagaaaaucugauacccacuucuggcuuccaaggacauauguguaaaacaaacaccuguagaaauuaaaaaaaaaaacaacaacaacaaaaaacaaagaaagcauaacccagcaaaacccugcaauuccuaaugucaaaaauaaauaauuacaugaaucuggucuucaguucugucagcguguuuuguagauuuguuuguuuguuuguuugauuggguuuuuuuuguuuuguuuuguuuuuuaagacaggguuucucuguguagcccuggcuguccuggaacucacucuguagaccaggcuggccucgaauucagaaauccaccugccucugccuuccuaguacugggauuaaaggccugcgcuaccaugcccggcucuguuuuguaguuuugaguacacuggauuuuuugguuuuuuguuuuguugguuuguuuguuugccucguuagcuuacucucaaggacuuuauucuuuugaauguuaccgugccuuacaucuaaggauuggcuuccuuuuccagcugguuauugcuccuguguagaaaugcaauuuuguguguguguguugacuuugcauccuacaauauuagugaauuauaaauaauuucuuaccucuaauaguuuaugugaaaucuuuagauuuuuuuucucuuugagaugggguaucacuauguagccuuagauggccuggaacuugcuauguagaucaugcuggccuagaacugcagagaccugccugccucugccucccaagggcuaggauuaacagugugcagcagugcacaaucagaaagggauugugggguuuuuuguuuguuuguuuuguuuuguuuugagauguauaucaaacagauaauuucuuagcuugauguaaccuuugguauaaagaaggggcccagacuuauaccccacuucucuaccuagcacacacccuuuuguguguagcugggucugggacugucuucugcccucuguuuacucaggacugcuguaaccacaccccucccucccuuccccguaugugggacacaacuguagugggaaggucaggagcugcggccucagggugccuucccugcucuccugcuuuggucuggaaaaggcuuugugguagacaggguaucuuuaauucuuuguauuccagaggagacccuggacugcuccuugccuagacuuugucagugauaauccagccauacugcagucucuuguuccuauggaggagacguauguggcucgcucagccuggguuuagcaugcucggguuacugcuuagagacaaaguaaugaaggaaaaugccagugccuagaguugaguaauaauuucaaaacuacuguguaguaagauauauaaaguguagaguauaaauuuuauaggaaaauaaagacaccauaaaagaaaaaaauacuccaaauuauuuaagcuucuaacuuaaagaacaaagaauaaauccacagaaaguagaaggcaguuacuuggaugagagggaggucauugagacacacagaguagcaagcaagagggcgucggucagccccagcacaccaguaacuugugaaauuagcggaugaaguuugagagugguuucuucuuuaccuugguacuucuaaagccugucuucuguccucuguuuacucaggacuuguucuuuaaguacaccuggaauaacuuuuugcaccuccaaguggaacuaugcauagccgcuauucuuucccacgcugcucgggaggagcaggcagaagccaguggauccgauggcaagguggagccucugcagggcaguggagaugggaaugggaagcuggagaccaccccauccaucaccagcccuccugagaacacaauggugacccauguaaguccaggccauguggggccgugccaccugcagccagcacuucccagacuccagcguguuagcuccuaacccucacauggguccgaggugcugccaucuuugacccacaagaacacaaaauuguaaagaaacauucaguuggagaaggcaagccauuguuugcaaagaugaucuugugguuguggguugugucuguguaggcauacuggauacugcagugacacccccucccccauggcuguacucacaaguggccccugcuuugcucaauccaucuuuauaacuaaacacaaaggaaaacacaagaguuaaguucucaugagaaagcuuucuggaaccuuagaccucgaagcccggugccccugcuuucuccgugacuucucuuauucuccagagaauggccauaguugucaccucaucccuuccccuguguaggucacccuaggguuagagucugcagcucaauuucuuuuugacaucggcacuuaacacugucccugggacagagcagcccuaaugaaugucugacagggaaaaaagggucaagcagcuugggccauaagcuguaccugcgccaagaccugcugugacugcuacccacuucuaaagugggaaagaacauucugggccaagugggcugacaggagggcagagguuugggagagggcugcugggucucugucccagugucucauagacagcagugcuugacuggguuuagaaggucucagugcuacuugcaugggguguguauccugggaaccugggagcaaaucuggcaggagcuaagacuggcuaagaugcauuuagucuggcccacaguuuauggcccaaccaugaggcuugcaauuauaauggcaagagcuaccuagggacagggaacguuauucagaggccaacagggaccauggauagugacauggaggugugaauaggggucuguaacaaacauccaagaaaauaguguaugugggggaaaagaaaauguugagggccccaagagcuggugggagagugcucagagguauaggugggggcccauaggaggaggggaggcagaagucgucuagcauaucagaggagcauagagugccuuuacuacagugcuggucuucauucucaggccauucaguaacaugagcaucagugaugucauugccacagggucuucagugcugauuugccaguucacuaccugcagcaccuaggaggcagugugaaccuugggcucccucucacacugcuugccgcucugcucucacagcuguuccagaagugcugccugguacagaggauccuggaagccugggaagccaaugaccacacacaguaaggacucugaggaacccccuuguccgacuccaggccccuugucaggcaucagcagugucuaauguagauaugugccugggacuguucuagaagggaucuugcuacuggguauacaucaggaagggggaggcagggaggccuggagaggaggguuauacugagugacagauggccaggccacugugagggucauauugagugacagauggucaggccacacaguggucgguaagugaccccuuccuacuugucuggcuuguucuuuauguucuuguggguuuuauuuuuuguuuguguuuuuuggugucugugugacagggucucauuauguagcccugacuauccuggaauucaccgcauagccaaacuuaaacucagacauccugaggagccugcuguugccucccaaaugaaugcugggauuaagggcauuugccacuagaaccagccaauaguuugguguuuugaaacagucuuacaagauagcccaggcuggccuaaaacuuuuuuuuaaauuauuuauuuauuauauauaaguacacuguagaugucuucagacacaccagaagagggcaucagaucucauuauagaugguugugagccaccaugugguugcugggauuugaacucaugaccuuuggaagagcagucagugcucuuaaccgcuggaccaucuuuccagcccuggccuaaaacuucuauuacugcugccucagcuucccaugugcuggcuacaaccauucuuuucuuuuuucuuuuaaauguauuauuuuaugugugaguguuuugccucauguauauuugugcacuaugaguauaugccugguacccucagaggccagaugauggcacuggauccccuagaacuggaguuacuggugguugugagcuaccaugugggugcuaggauucaaacccagggccucuggaagagcagccagugcuuuuaacugauaagccauuucuccagccccagcuguucuugcuuuuacuaaacuuggagcacacuuuguuggcgcauguacacagggauucauguuagcuuuucugcagcaucuguuggagccuucccuccacucaagaagcaaugcucuguguuucucagggauagguggccacccucauucauguguugugcucugagaacaggcuguuucuaggcaguuugagcagcacucaugggagcccaaggugugugaguacaguugugggacuaucacccaggaucugugagaggcacaaguagaggcuagagcagcucacuugguguggaggcccucccaagcuccagcagugacagugucccagaaacagugugcccagcacaagcugugccgccaucaguccugacucagcugcucugucacuacugccucugguggaacuugggccagcacugagcugucugcuuccaucuucauguccaucccugggcacggaguaagcaucaguguuucuaggugcgauaggggaggagugacugaacuuacgcauagcagaugcuccuuacccaccaggguccuagagcugaggcuguuggucaggcccagcucuugacugcuuagguuguuucccuagaauuuacccuggagugacaacugcaaaguaggcaaaggccuaggugacaggugaauggagaugaccuucaggaagccugccacuuggcccucccagcaagaaguugggcaaaaccuggacugaacgaccugcuuaauagaugguuucccuuccagggcagcaggugguaugagacgugggaauaugggccaccucacaaggaucgccaaugcaguuguacagaaccuggagcagggcccggugcaggcccacaucagugaagucauccgaggugugcccacuacgcucccuucccucugcccucuguccucaggagugacaacuacacugguauagucaaaccaugcagccuucuuugucaucuucucaggguaggcuggguguccuguucauggagcagagaucugaguauaggagacucagccugccaaggacaguucaugacucagugcugggccucgaaacugugagcuucucaccaagcucucuuguacucacgggcuuuccagagcugugccuguacuagagguccugacucaccuuccugucuuguuuccaucucacacuauuuagagggccuuccuaguuuucauaucaggaggccaugaguguaggugauauucuguccccuagaaguagguugugggcagcaaggccugaaacccugaacucuaugccccaagcaaaagagcagagcuucuccccucagacaugacgccuacugcccugagcaguucccuuaugcaauaccuccccaacaaguaugaguuaaggaagcuccacgugguccuccccaugacccaggaccagaggaauuguuuucuuugugguaucuuggaggccacuugccuguccaccuucuuccuagguauacugcaacaguggugaaguugagcuugcugguccaucaucacucaugaugagugggcagcagggcagaacagugaacaagcugagguggcucccuuguugcuagaagggaaaaagaaaugggcuuggagcccaguuuagggaggugaggggugagcagaagguucuuguuuccaguuaggcccagguucuaguuucccacacuccaggccuaggagugcaguaggaaggugcucacuuccucagacccuuaggguagacauauguaccagcagguaguuucagaccaggccugcuggcauaaacuauuaaucccaguacucuggaggcagagauaggcagaucuuuaggaguuugaggccugccuggucuacauacugaguuccaggacagccagaguuacaugguuucaccaugucucaaaaaacauaaaacaacagaacucucaugcccgauacggucucuguagaacaagcugaacauugcccugcucagaguuguuguagccuaaggcccuggaggacauuaacccucccccuuugcuguauaggcuuauuuccuaucagcagccccuguuugucuugaguggacugaucguagaagcauaacuugucccucucuggaccagcccuugccugcuagggcuccugagugcccuacccuugggacucauaagucccacacuuaugaggguacucacaggacuuaugaguagcacuuacuuugcagggcucccugcagauugccguggacgcugggagagcuuuguggaagagacauugauggagaccaaccgcaggaacacuguggaccuggugaggaagcuggggcuccuuccauggugaccauuggcagucccauauguaccacucugcagcacagggcgaggaggaaugcgcaagggcaggacuggacauuuaguucagccucuggccugcagucuguuacauacccuugcuaugucgcagcagagcuggcucccugaggaucucuuugcaaagcuagugcuuucuugaucuccacccuccagagcuauggcuuauuugugaaggacucugcuuaguucccagggcauuaccuggaccagggaggcugggcucucuuucaggaggcuuuggccucaguuggcauuuccuugcagugagcugcacaggccuacaggugucaggggauugguggugugggaggguaucggggagggggagacucaggcugggcugggcgggaccuggggcucuggcuggaauggacuggguggggucuggcuagcucacaugcccaccccaucuggccuguguuuuaggugagcacucaccaccuucacuccucaagugaggacgaggacauugaggggacuuucccuaacgagcugucccuucagcaggugagggcauggccggcacucugcacccugccgggcccuucuggagccuguguccuugguagugcuuaguugccgugacauugcauagaaaagagagaaguaacucaucuccgagcgcaucuggggagagggggcugggcgaguaccccaaagucacguuaccguggugagagagaccuggggacaguaagcuuggaggccgacugaggaggugcucucuguaugcaacugcucaaccacugugagcagucaaccucugcgaaaauccacugccugcuuccuaagaggcuccugagcaauggaguggguuccaaggagcagccaccaggcgacaacuuguuccauagcuguacccucuccucccaggccuucucugaguaccagauccagcagaugacagcaaacuuuguggaucaguuuggcuucaaugaugaggaguuugcagaccaggaugacaacaucaagugaguacagccaccaugaaggcuccggcucuaggcuagcacugcccuaagcaacagcaccauagaagcagcuccaagugaucuuggcaggaaugagguccacugucccugaggagauagcaagcccuacuacccgagggcccaggccugcuggagcagaggcgguacugagggaccuuguucuugcagcgccccauuugaccggauugcagagaucaacuucaacauugaagccgaugaggacagugugagugaugggggccgcugcagggcugcagggcauagcagcauuuuauuacacugcucagauaguucacaguguccacaacuugguccuugucacagguggauggaaccauggggcccuggccaguauauuugugugucaggacugggaggcuccccucuaugggaguugagagccgagcuucccuccuugccuccucccacacugucugucggccauguucugugagcuagccccucuggaguucuuugggaccagauucuccagaaaacagcucugcauucugucuuacagcccagugcagcucuguuugaagccuguugcagugaucggauccagcccuuugaugaugaugaagaggaggacauuugggaagaugacgagacucgaugcgcugcccgggugauggccagagccagguguggguucacucauccucccaaagcccccaccagcggggagcaggcaagauuaagcgcuggguauucagccacuguuaaaagugcucagacaccuagaggggcaguggcccuucuugcagaaaccagagcagaccugggagccaagcagugcuuauucuagacaccccguacucaacccuggucccaauuccugagccaucacagguucuccagcauugggcaucuaaccaaggcucaccaaacaucugcuaccuuuaugucugcccagguuuggagccccucaugucucagauaauuacucaaagaaugcuuuggaacauggaggccaggacaggaagacuggcucagcaguagcuaggaaugugccuggauuggccgcuccuucaucuccuacacagaaagaagguccucgcucagagagugauucagcagguaguaccugaagacuguacaagggacauggguacugaggacaggguguggugacuuggcugagggacccccuuugagccacuguuuuuccagcaguugauuuccuaguuccccaucuacacaugguuucaugaaauguuuugggaggucuggccaccacggguucugcugugcacugaaucgagccagguguucuuacucccuuccacuguagugccugccuguauacaugugcacuugcacagcugguguccauucuguuugcuagggaagggaaaccccauguaaccuguauguugcuauuugccaucucucagauguacuugggagcaucuacccauauacuuccucuuagagaccucucuuaccugcucugggguauuagauacucaggacacgggcaagaaaccagcugucuguuaggaguugccagcaccuuagcuggagcuggccagcugcaagggcaggaacacccacaguaggggccccccaugcugugugccugcuaugaccuggguugggacaggugagaugguaccuacuuuguaccaucagccuuacuggaggacagauggggcuuuacagguaucucaugaggcaccacaucagcaagaacugaugcccauacaugugcucuguggcaguggguagcuuaauaggacccuuuccaggucauucacaggucuuaugcccaagugucccaggguuugaagccauacuaccuuuugcaaagcacaagcagugcuggggagucccgccaucucugacacucgagacagugggggcucuucugggguuuccuaugggagcaucuugcauuccuggucagcucugaugaccccgcuauucaucuacgugagagaugcuucucccucgccuaucacauacuaggccugccuauucuugacugcugcgucuccuucuggcagguacuacauggacagcaguuuuugaugagccagugaacccgcugucugcaaccccaggagcugcgagggauguggguucuagugcaugggcggcugguccuucaguuguagaggagaaaggcugggccaaauucaccgacuuccagccuuucugcugguaacaaacaucagaauggaaucuugccuguuggguaucaggaccaguguuguccagugggcucagcaugucaucuucuuuucuagcucugagacagggccccggugcagcucuccuguggacauggaccacagcaaugccgaggguggccagaguccaggcccagagaaaaccugugaguagcaacagcucagacagcugccuugacuaguuggcaggccugaugcaaggcuagacccuauugagaaggugggaaguggccucggccccaggugugguuauguauuugugauguuggaauccuuacauacauaugggauuggaguuaucaugauuuguucacuguacaauacaugaggaacuuuaggguccuccagcuuuagggguagaaggcaggacaacauguaugagcauguaggguguccucagagccagguccaaucaggcuccauggcccaggccuguacuuuacaacauccuugagucacauuguuauguagaugagucccuguugggaugccacuaugggacuugacuuggccucucucuccuucccaggcaaguggacuggguaagaacgcuccugggcauuagguuuaaaguggcuucucugagcccauguuuccuccucugagaagagcacacacaucuccuaucuaguggaguaguggggcagcccacaugaaagguacauagcaguucaugugguuccugcgaacaugcagauacacgugcauaacacucaggaagccaacaugugccgucucugccacucaucucacacugacuuaugcaaaucugggaucccugaggccaugguaucuguguucucuggcuccucugcccucacaaauaucgcaggguuucuucuuuugcaguugguccuaccucgccuugugccuggaaugugugugucacuaggaaggccccccugguagccucugacagcagcuccucugggggaucugacagugaagaugacgagaaggcagcgggugcuguggaagcugugugcacaggccauacuggaaaggucuccccaccacccaggacagcggaggcugcuguuggcaggugugaagggacuggaaagcuuuccugggaggcccagugaacacugcauggcuucugagaacagggcucaguggccagucuucaguuccuugagaacaaguggagguuagacuggaauccuugcugcugcuccauggcuaaugauccuguaaagcugucucuagaaaaacagugccucuuucuaauggaaaggcugaaccagagggcuucuuagacaacaguguauauuuucuguuuuaaauguuucagaguagaagauagaaccuggaugucccaagagcuccccagaaacuuggaaugacagucuccacuacaggugccaguuacagagaauaccugguuuucaggcucugggacuggcuaaccuccuuggugucuacgguugucccagacaguggaggaaaggccuguugcccuuaacuuucuguagggcaagcuuaggacucuggccagcccucuccuguuaccccacuuugugcugugccauuuguuguagggcacuugugaauuacagucaggugcccugcacgcucgcacaguaggacaaaaugcaucucaggguuagggauuagguguagucugagcccugauugggaaguagaagcagcucgcagguggucaagccacaguuccccugcagugucugaaggccgucccuagggaaggaaucagguauguugucaucauccuugccaagaggccagccacuccagcaagugcuucuauuuugaguggucaagaugagaauauaggaccaaggugucaaggagcuacccagugagucagggguacuccacaaagcuagaucucuguguuccccagggagcucagccuccuggcauucagcggugggagagcagguggugaggcucaggagcauaaggaguugucuguggguacaggauacuggaaauggcuucccauacaaaggcccugaggcaggaucuccaccuaaguucaggguacaguagaggaagucucagggcuggacccuaccaggagacaagguacuaaucucacaaggcucuugaccuuaggcccauguggggguuuuguuuuggauucugcaucuacucuuaaaugaguaucaccuaugggguuucuggccuugucucugccuacacuuccaagucugggauguaccugacaccagcuuguucuugacacagugggcaccagacagacugccuagcacaaguucaccaucaugcauucaggcucuggguccuaccagcccugccuccuccuccuccucacacacaggguaggcccugcccacgugugugcuucuugaggguccucugugauauuggaacuuaagggguuucccucagcuaagcgggaagauuaagcagcuggaauccaugguugguauaacccagugguucccaaccuuccuagugugugacccuuuaauacagucucacaugcuguggugaucccagucauaaaucauuuuuguugcuacuucacaacuagaacuuugguacugugaugaacauaacuguaaagagccacagcccacaguugagaacugcuguuugcagcugggacucaaaguuucauacucuguacccauagcgucuggcugcucauguccaaagcucauugaggcccuggcucuuguguucuaggaacccuaggcaggauaucgccccuaaagcaaacaccacuauauaucuaaaagauuuguagaaaagcaaaaauguagagccaagacuuggagaaggguucacauggcuacugauucagaugugauaaaauuaacuaagaggaaaagccuagacuggaguuccuuggguugagaguacacaggcuuguuugugaguuuugcuguguuguggaggguggucucaacucacaacugucccaccuccaucucuuuagugaucagauuaccgaggaagaucaccacauccaacuaacagccuaccuuuagagaccuucauccucuuuuucuaaauccuuccuagagaaguacuuuaacccugcugcaaaaagacaaaguaaauccuuuacaaagcuauuuucaaaaccugcuagauaguugaaccacugccaaguuuauucagccucuacaacucccucccucccugcuuguccugcaucucaucugagaaccccucccugggacagagccagguaucuuuguucugcaggauccaucuguuacuugugguuagucuaggcuagcuuuggguaugaagacacucaguccuuauauaaucccuccuccucaccucacuuuuuuugcaaacacaggucucacuuuauagcccuggcuggccuggaacucucuauggaggucaggauggacucaaacucagugaccugccuaccuaugucuccuaaguacacgauaaaggcauggcccaccaugccuggucaucagggacccuuuagauagcguaagggugaaguuaaauuuaagcagcaacauuggggccaucaguaaaugaagcuccacagcugucaggauuugagugcugcuuauaggaaggauugaggucaugaucaucauguaguuugucccacugucugggacucagggcuacaaagccagcuguagucaugccacaaaagagauaagcagauaggagcugugcguaucacuuggaggcccuuugcugguuguuggguaucugaaauaggcagcagugaaguaggggcacccauaacuggagccuauuugccacacagggcugaguguccugacaguaccguguuagccccugccugccccgcaccuucagaagugaccaucaguccugccguggcuaccauagcaccaagcaaggcaggcucucccacggccaccauaguggucucuuccucaguggcugcugcagugcccccaggaccgaucguggcaguaaccacagcagccccagccauaguugccacccuggggacgaugacaaaggacaggugaguagauuggccaaagaggguagggugggacuggaugaaccccagaagcccacaugcugcaacucugccucuucccccauuuaugcaggaaggcagaugcccugccagaaggcgcugccuuaaaugguccuguguaacugcugccacccggccguggcccgcccuggucaggcugcuuccuuaaucaagaaaacuaccuggugaugcaauuuuuuuuuuuaauuuaacuuuaaaauaaaugcugcauuugguaaagcuggcaguggaaccaguuggaugacccagcuccugucucuccuaccugcccuugguccuuuuggaagacagauggaccuggccacucccuguccaggucuuggucuggcaaugaggccccugacuugcagcuucuaccugcaggacuuggugagggaacaagacccuacggugccagcaccgucagaugggcaggaagggggaggagcaccaggcucugguuucaucuguacuuuuuaaugcacggaggaaaagccuuuuuuuuuuuuuuuuuuuuuuuuuuuugcacuuuguacccagcuacaauacagggucucucuuggcucacggcagauguaaaggccugaguuggagagaccugauccccaauaauaauaauacaugggggucuggcacuaguuuggccauaugaggucaaaccccaguucuagcugcccugaggcuccugggagcuggcauugaaucaggcuacaaauuuugacugccuuaaaaacaaaagacccucuggaccugacggaguugucucugugcucagcaggcagacuuggcagacuuggguggguguuggcgcugcaucagacauguaagagugggcacagaagaccacugggaggcugagagacagggcgggcccauauuguccacgaagagucuaaaagucuauguugucuuuuuuuuuuuuuuuuuuuuaaauguucugaccuucugacagggcauccaacccccaauaaaaaguauucuuauugaaaaagugugucuuauuguuaggcugcaaaugcagagccccagccuguguggacaccuuugcuaucccuaggcucauucucaguaguugggacucauguugagacagaaaugaaaagcucuuccuuaacagucaaaccaaggacacccauuuuguaaagguuugcuucacucaaccccagggcccauccugggaagagagguguaucccucuggaagugagucagccccaaggcucauaucccucccucccagcagcuccucugcuuccuucauuggguccugugguucugcccuuggccucuaccagcauucaccuuauuucuuaggugcgucagccacuuccccagcucuuaacaccugaaauguggcgagcaggacccuccccagagucuauucugauggguuucuugaaucauaguugaggaaagaucuaugguuauuccagguccaguuguggggaccagaagucaugacaauagagcagcagagcugacagagguucacagccaccucccaccacacaaggucaacccucuggcaucuucacggcuccggcccuuuucuaccugcggcugcucaccccagauuuccaguagcuaggccucaacacugacagccacccugagccacccuuauacauaccucucugccccaacccugacuacaagaacacagccaaugaagucuaggccuagugagguucacaggcaaggaguaacaagcccaacaacaaaaaccacaacaaaccacaacacacugaguauccgggaaggaggagaagguguagacagccugagagccaugaccacuaagguuguugcccuucacagagccaccuuuccccaucccagcuuccuugaggaccuuuuguccuaagagcccaugcuccuuucuguccagggucugugaccuuugcccuuugccuucacaacaccuuccc

SEQ ID NO: 7937 - RNA, 27324 nt, Mus musculus
ggggcagaacugcgcaggcuccugaagcgcccgggcgggccggcuggcugggaagauggcggcggaagcccuggucagcggcgccgcagaggagcgggcccggggugucccaagugugcagcuuagggccagcgccgggccaugagcgcgccgccaucgaacccucgagccguggagcccgccugcgccccuugccauggcgcggcucgcggacuacuucgugcugguggcguucgggccgcacccgcgcggugagucucagcgccgagggggacgagcugggggggacugagggacugggacugaggacucgaagcuaagaagacccggccggaggcagggucaggaguuggggccgagcucucggggcucucgaaaagaggccuccguaguuauuggccacgguggcgucggggcaacccgcgaggaccccggacgacauggccuguguaagaaacaucccuccuacaccugggcaccugcgucgcuguuccgaggugggcaggggcgugucgcucgggcgugggaggcuggaggacccugcugcaguucggucuccccgauuccaaguugggugggaugggcucaccccgccuuggccgccugccgguggcugggucugggaauuucagagaggggggcggaacguuuucgucuuccagcuucucugacccagugcuaggucugaagccucaagcaccgcuugauggggugcaguggagggggagggguucgucggugguauggagccggacuucagacgaaagugucacacuuggaggagagcauuccugguguucaagccucuaagccaggccccucagcgggggaucaguguggugaucuaggaggcccugaucuggagucagcaccugugucugagagcccuucaguccuggggguaggagaaaacggagccugacagugacaucaaccacagccauggagacaacaguguugggggguguuggcuggaguccucagugugccaggcccugcacaacccuuuguguguaugaucucauuucucccaauagcccacugagauugccuugcuguugcccuaucuucagcauagaaucuggcauagagaaguugagugugugggucuggaauggaggcugggacuuguacucuggcugucagaguccaccugcagaggggcgguaucuuagggacaacuguggccagaugagguagccccuuaaucccuagauguaaugcuuccuaccguguuccaguuaucuauuccacacaguuauucugcugcuucucagaccagcugucacugucaccauucaggacccaaacuuucuucuuugccuuucuucuugcuaagucuccacuaggacuguuccuuuguuuaauguccacaugauggacccuguaugcacuggaaaacaccaccaccaccaccaccaccaccaccaccaccucugucuucagaucuguucaguacccucgcuucuuucugcucucauguauucaagucuauaucuuuuggcacucagucccgagcaucugucuuucccuccaaagagggaguucucaaaggcagagaccacauuguguucaucccccuguccuccuugagcaggaggcuugccaccaguguuguacuggcacacacagggagaaccugugcuccaaggcauaagugaaggccagugaggugccuccucuggaacggaggaggaguacugcuggagagugaggaaaccaagcuggcugagggcuggcuggggucucgggcugggcgcugggccagggcuggaggaauggaauggacuuggaugguggugagaagguuaugaagaagguccugugaaacagaauguagguaaaggccagguuggggaggucugcugggaguggaguaaaauugagggugauguguggguagcuccaugggaaguugcuguggcacgugggggcuuacugauacagcuguacaagagguguggaccucugaccucuguacaggacgggauagaaggcugaggccagagguggcuacuuuuccugaaucaccggugugauggaguaauucucagauuacccaucacuguggcgacugcaggccagugagcucucuaagcacugccuucuagggucagaguugacugguuguuggcugaccacucggcuucaaggcauuccuuugaggaaccagccuggaaucggguuucugggugugggcugaaggcagaucuauaaggcaagggaugugaguaccaagaacaaaagaccccaaacugaggagcacacugaagauuaguuguccuuccuuugucacucuucaccguuggcuugcgccaguuaccgugcacucucgccucaguuuccccgucuuuauauggaaugggccacauggagcugcucugaggcugucaggaacacuuaugcguaaagauauagcacaggacuggcccaaggagauaauuuacaucucagaucugaguagccgauguaagaacgcuagguagguguuucugaagaaggugaagggcccucugugugcugacugaccuaggaugcaggguccuuuagauuaagggaauacgcgugagaggauaucucaguuuuguucugaaucagaacuuuuucucugcagcugcuaggagucaaaccuugguaaugaaugccuuuuuagagagguagcauucugguugcuaaugguuacaguuggugacuugugggcaaggcuacagacaauaaaugccugagcuguguguaacccuuucccuuaagacucuauaaaguagaggguguagauggcacagcauagaccccgcaccuggugaguagggcugugugcuuuguccugucacugaacuggacaccuuuuuuagaaugaggaaccagacagcauaguuugagaccccugcccagaucccagacauggucacuuaauugcuuguagcuuggggaguccucaaaugggaacaccaauuaucagacccuuuacaugacuuaaaccugacagguacccuucuacuacuuccugugaggaaaagcuacaucuccaucaaccaagaaaacuauuuguauuucaugaccuggccucuuucagccuugaugguaaugagguggccacauucuugggcccaucuacuguccccacccaugggccugcccucucucuggaucagguuggggcuguuugggguggcugcaguucccucccagcuccccccacacccugagaguuuaaggguccaagaucuuggauuaaaguuucugugguccguuuauagauuggggguaggucaaagagaacaucugaaagagcuguaggcuccugcugcacauggagucagcuguaguuugccuggagcauugugucuucguguucaggucugauagguagaagcaggaaggcaguauucuuuugcuuccucucccuuuuccuauagcuaggcucuugagugagaggcagcagcuauccggugcuguccagcauguauggugagguaugugguagggcagucaggggaacugcuauucugucugggccuuuccacagugcacacuguccacagcugguccugcaggcaucagagccuggcacuagugaugaggugccagcagaugacagaauacauaaucuguauucugccacccagucugcgugagccuggcugcuggaggugcuuugaguuuaggaaucccaguguaucuuccuagggugggccuacccagccuguggguucaagagugguucaggaacuuuccuuuuuuggggggggggggaugagacaggguuucucuguguagcccuggcuguccuggaacucacuuuguagaccaggcugaccgcgaacucagaaauccgccugccucugucucccaugugcugagauuaaaggcgugcgccaccaccgccuggcuggucagggacuuuccaugucugcuuuaguggaccucaguguccauccuccauaagcugcccaaagagcacugccuuguaauauauggcugugcuaucgggauuccuucuaacaggguuggguagggagggaggaugugccugcucuugucuacccagaguugacaguacaucgauggguuaaguacagucauugcagguuacuccuguugccaaaagucuucagugggugacagacacagaggaacauggcaaaauccuucauacaaaugcaagcuagcaguuuggggucucagaggagccagagagaguuaacaaggcuuccucauggaagggccuacugugccguagggcuccggaaguuguucugcacuucugacugaagaaccuguuuguuugugaggugugaguugggcaggguguggggaagauggucauauagcugacuacaugcauucaacaagcccuaauuaggcuguagucuguaccaugcacaggaacguguuucuguucaggcuacuacaggugccuggagaggggcuuauauguguugugggaagggccucaggguccugcuauaggacccagauuuagguagagaguagauagcaagcuucuuagaggaggcacuggacugaaaccugaaauucaaauccugggcugucacaggacaggaagggccucaggagagaugcccacugggcuucugccuuuaugaggcaguugggagucucaggaaaggagcucuuuagaguguagaauccucagaaggcuuucaagcuaguaggaaaugggaauuaacauugcacaggaugagggguacuggcaguggaaggugaccauccuuucugugccaacuccccuggguagagaggcugcuaaaaacaacccucagaaggcuacuagcccuccuggccuugugggaaggcugcagagcagaggcugcagucccugucuguguacccaccccccuuuccuuccuccgcaugcugccucguggcaagaacugggugagcccugggugccagccagggcugggcccagauggugguuuagggccgagcacaaggaggcucuugccggaguggguggugggaggagccacaacugagggggggguuagugugugugugugugugugugugugugugugugugugugugugugugucuguguaucucuguguguuuucauaguacaugcacuguccaggccuguugagggugggaccugaggaaccccauagggguuuuaucuuggugggacagguguguggguguguguagguaggcaugacaccagcagacaccugucccuuccuugucuguugccugucgccugcaggguguuggugguaggaggaggggagcaggaagcugagguuuuugugagucauaauaggccccugcaccccaccaccuccugcuuagcagcaaccuuccuaguguugacagucguggugcuugcuucaugguucuggagggaugcauggucucccaugguugcagcugaguuccuuugcuuuuaggggaccugggaauuguguauuguuguguugagcuuagugguucaguaugacuguguucaaguagaccaggcuggguggaugugaggccguagcucagcaagcaggcccauugcacacggaaguuuucuggaacuuaggcugagcagggggauccaugacaagaccuuuuauguaggguaccaucccuucaccgucugcuucugcuucuuccacuggugggagcaucuguauugaggcugguccaugggaaggaugggagagugcugugcccugaggaucuugaagcuguaugugugagaugcagaagugaggaggccuguuuuccuuugcauaccacagugguucucagccugugggcugggaucucuuuggggucagauauccuguauauuagauaaucacauugcaguucauaacaguagcaaaauuacagcuaugaaguagcaacaaaacaauuguaugguuggaggucaccacagcauggggaacaugaggaauauuaagaucgcaacauuaggaagguugagaagccuaccagacuccaucucauguguguaugugaggccaaggaagccaucacacauccucgccgcugcccucacuuugccuccugauuuaaugguguagaugagcccaggccaggaccuucacuccaccuacauagacuguacuuagaaguacuucccuugcugguacauacugagggagucugggagcuucagggcucagaggggcagcauauacuugcuaaacucuuuguuuuuggagauuuguguucugggaggaacugucucugagguacuguggauagguagcaauuuggauccaugguugguguuuccacccccaucauaagaggcgcuaaggcuugaguuccacacaugggcccagggcagacaggugacagggaucaccaacauagccaaaugugcccuguauguuuagacacacccacaauuugcauggcgcucacuguagcagggguugaggcuaacgcugcagguuggcagucaaggaagauauugaguucucuaaaacucuuccuccucccugaaaggucccuguacagugaaaggucagcuugggcugguaggugagaggaaggaucuggaggcgucucuaucuuccuuaugguggccuuggggucuguaccuauccaauggcuuaucuacccagaagucuauuuagagaaauaguagaucugggagcuuagguuggucuggugccagaugagaagagguuguuuccauccugcaccaauccuggcagugugaggguugggguguguggggaauggugcucugaccaccugcucuuguucucagggaguggggaaggccagggccagauccugcagcgcuucccggagaaggacugggaggacaacccuuucccccagggcauugagcuggugaguguggagguguagcauuaagggggaagucagguccaccguugaugguaacuggccugacaggcagggugucuugcucaugucacugugucccucaugggcuucacccuggaugguaaggccagagcuauauuacucccccccccccccccagagagcugaggcuaggaggcuaagguguugccuagguaacuaacaggugcuucauauacccugcaacucuagcccuggcaguacagaugcuugaggauacuggcagggguaaagggggaauuuuuguuauaggugugggugcaggcacuaacugcugaucccucugcaguuuugccagcccaguggguggcagcuaugucccgagaggaauccaccaacuuucuuuguggcuguccuuacugacaucaacucugagaggcacuacugcgccugcuugaccuucugggagccaguggaguccacacaggucagcguaagcucuggugugcaacaugugaggcugagcccugggccauggccagccugcucuaccucuggggguauguuccuguugggaaggcugggucucaguuaccucugucuuccacucggucucaugggaugacucugauuagagccaggagaaugguuuucuguuugcaggaaguagugugcacugacaaugccacggagaaggaggaagaggcagauggaggaggccaagcgcggcugucauccacagccccagcccagccuggccagcuuuuugcgccaaagacucugguucuggugucucgacuggaccaugccgaaguguucagggugaggagggccgccauagcagcaagccagggcacagggcguucaugucagcuguaccacuguucccuaucugguuguugcagaauagccuuggucucaucuaugcuauccacguggaaggccugaaugugagccucgagaaugugaucgggaaccugcucacauguaccgucccauuggcuggcgggucucaggugggucuuggagagucauaggaggcagggguggggugggggaguaccuauggguuacugauaguccaaagccucagauacucccuucugcuuuuggugccacccuuugccaucuguucuuagcccugucuacuuacuuggcuucauaccuguaccuuugggccuucauuuucugucucucuauccucuugaucauuggguguguuccugucacuggaugcuguuguccguguaucugucugcuuccuacuuugugccuugucuaauggugucucucugucugucuguccugugcagcuggacucuguugaggaaggagcgguauggauucuuuguuucuucugcccacucaggcccugcccccacccagaucagaggcauuccccccuuaccuugaguuuucucugcagcgcugcucagccaacagaggcagagugugaccuuucccuccagucaucuaagccagccccaucucaagauuugucagcuuaccuggguucaagugcucagauuugauccaacuauacugcuaaacucugaucauuuucuuucuacagagaaccaucucuuugggggcuggugaccggcaggucauucagacuccacugguagacucacugccugucagccgcuguaguguagcccugcucuuccgccagcugggugagacugccugucauacccuaccccuaaauuccugaccugggcugguggucagagguguggugcucccuggguuauggaguagggacaugggcccucaccaggccuucuuucuucagguaucaccaaugugcugucuuuguucugugcugcccuuacugagcacaaaguccucuucuuguccaggagcuaccaacgucuagcagaugcuugcaggggucucuuggcauugcuguucccucucagauacaggugcuuuucugccuguccccuccuccugucuccuccaggucccucugccuaccccuaugcccucugucugaggcuuacagugucuucuggccuguuacagcuucacuuaugugcccaucuugccggcacagcugcuggaaguccuuagcacaccuacgccuuucaucauuggggucaaugcagccuuccaggcagagacucaggagcugguaagggcugugccuugugucugcaucacugccuaguuugcuggucucucacuguuuguuccuuuuggugcacagcuggaugugauuguugcugaucuugacggagggacagugacugucccugagugugugcacauuccaccccugccagagccacuacaaagccagacccacaauguucugagcauggugaggguuggggucaggguggggcuggaaccuggggcuugugggagccaucaucugacagccagggaacccuaaggucaccaugcaguuguccucugcuuccacagguccuggauccagaacuggaguuggcugaccuugccuucccacccccuacaacaucugcuuccucccugaaaaugcaggugggggucacugcugcucugggauagagauugcauugccucucauggcuaagcugauggugucacagcccuaccuccaagcugaccucaggcuucucuagccugggagcaaaggagcuauacaaacaguuagguguggugacgguaccagucaguacagugaaccgaucaaggggcucugaacaggagcugucuguucaacacuuguagaacucacugggcuaagaagcacuguugggagaggcaaagggggguggcagaggugccugggaaaccugugucgggcugugaguguuuucugggaccugauacucacugcaccgaccugcucucccaggacaaggagcuccgugcugucuuucugcggcucuuugcucagcuccugcaaggcuaccgcuggugccugcacaucgugcgcauccacccagagcccgucauccgcuuccauaagguaggcuguggggcuggggcuagagcugucucgugaggcugugaggagcuaacuuccugguguucucccaggcagcauucuuaggccagcguggacugguggaggaugauuuccugaugaaaguauuggagggcauggccuucgcgggcuuuguaucugagcgugggguucccuaccgugccacagaccuguuugaugagguacagccugccuuugccuaccuaccugucccucccccagcccacuuaacugaccucaucacccugccuccuuuccccuuagcugguggcucaugagguagcacggaugcgagcagaugagagccauccccaccguguccugcgucauguccaggaacuggcagagcaacuuuauaagaauguauggugggugacauggagggcaugcuaccacuuugguccuggcccacuagccaaugucugcccauguucccucaggaaaacccguacccagcuguggcgaugcacaaagugcagaggccaggagaggccagucaccugcggcggacccaccggccauucccccggcuagaugagggcacaauucaguggauuguggaccaggcugcggccaagaugcagggcgcaccuccagcugucaaggcugagcggaggagcacugugccuucagggccccccaugaguauguaacuugaaggggaaggcaggcugguuuaagauggguauggggccaggaguuaaggugaacauguccuuucucuuuagcggccauacuggagcgcuguagugggccucauaucaacagugcacgucgcuuggagguaguacggaauugcaucuccuauguguuugaagggaaaaugcuugaggcaaagaaggugaggccugucagauagaacuucuaaucugggcuuugggcagcaggugucaggaggcucaguucuuucuucucguguuguaauucggagcuugugcggugccuggguggauggaggguguucuuucacccgagugacagcaguaggguguguacacuauacacagugucagcaguuuuuggaguguguguuuguuuguuugauugauuuuuggugggggagggggucugagggaagaguuuucaagacaggaucuuuauagcccaggcuggccugcaacucacuauauaagcaaagcugacuuugcucuuagcugccucagccucuugaauacugggauuacagguauaagccaccaggccuggcuuaauguugcuuuaauaauaaucuugcaugcuauugcccuucauugcucaugaacacauuugaggucuuaauaacauuugugugguguuccuguggagccucucuccagaucccauguccacacuugcuugggagccugcaccaugcacauuucucugucauuuguggaacugcugggucuguuggaagauuucaucuguauuggucaaugaaacccagcgccugagcuucccugaguuacacuggcuuuggguuuuucucugcuuagagcuugugcuuagcuaccuccacgcugacucagggugagguucucccugcacugcugucuguccuucaucuucucuugccucugcuuucaguugcuuccggcuguacucagggcccugaaggggcgagcugcccgucgcugccuugcccaugagcuucaccugcacguacagcagaaccgggcaguucuggaucaucagcaguuugacuuugucguccgcaugaugaauugcugccugcaggugaaacuggccucaccuuagcagugauagcacaugaggaagagggggugcgggagucucucccaugggauaggcugggggaggugcugaggcugaggaggguggggagcugaagagcgagcauucuuguuggaaaugacuuugaaaccugaggcuacaguuccagcaggcagugaugggagaugcuguucuguaauggccagagaggugggauugggcauggauguugucuaguagggcuucccaucacuccuggcucugcucacaggauugcacuucccuggaugagcauggcauugcaucugcacugcugccuuuggucacagccuucugcaggguaaguguugcgagugagguggggcuggguuuccucuuuaugagauaggucuacugucugugagcucaugaccuuucuaacuucauuccuauagaagcugagcccaggggugacacaguuugcauacagcuguguucaggagcacguaguguggagcacaccucaguucugggaggccauguucuauggggaugugcagacccauauccgagcccucuaccuggagcccucugauggcgugagccccacccagguaugcaggacuuuuuggaccuggacugucugggguaggcaccuuggccucgccuuacuuuugugucgugacaggagacuggggaggcacagucucaggaugaugaacgaucugcccuggauguggcuucagagcagaggcgccuguggccaacccugagccgugagaagcagcaggagcugguacagaaggaggaaagcacuguguucagccaggccauccacuaugccaaccgcaugagcuaccuucugcugccucuggacagcagcaagagccggcugcugcgggagcgggcaggguugggagaccuggagagugccagcaacagccuggucaccaacaggugggcuggggccaguggugaggccugggccagggagaaggcuuaugggguugcagggguacuaaugcccacacuuccccccucccgcccccgacccagcauggcaggcaguguggcugagagcuaugacacagagaguggcuuugaagaugcagagacgugcgauguggcuggggcuguaguccgcuucaucaaccgcuuuguggacaaagucugcacagagaguggggucaccagcgaccaccucaaaggacugcaugucauggugccagguauggcgauacugguuugggagcaugccuuaggugaguggcuguacgggcccaggguaugagaccugcucuccccuagacauuguccagaugcacauugagacccuggaggccguacaccgugagagcaagaggcugcccccgauacagaagguaagcagccgcugaucagcugugcauacaaagucugggcuguguucuaaguuucugcucuguuuccuggguagcccaagcugcugaggccacgccuguugccuggugaggaguguguccucgauggccuucgaguguaucugcugccagacgggcgugaggaggguguaggaggcaguggagggggcccugcucuacucccagcugagggugcugucuuccuuaccacauaccgcgucaucuucacggggaugccuacugacccccuggguaagccuuuggaccuuucuugugccucugccagcucuuugcaggagauaagacuucccuuucccuucccuuuucucaaagaaucaaagccuaaugggagaugggcucaugugugggccuuuccuaccaccccagacuucuguauuugguacccugagauaguaugcuuuucuucucccuucccgucaugacucugcuuggccuguuuaagugggggagcaggugguaguccgcuccuuccccguggcugccuugaccaaggagaagcgcauuagugugcagaccccuguggaccagcuucugcaggaugggcugcagcuucguuccugcacauuccaggugcguaaacucuuguccacugcagcuagguugagcccuauaagugguuuccugccauggggcuguugacuugggagugucacauuggcucucuauaaugggacuuucuuggacccaccggcaguguaguugaaacaugaacacuuuuaauauaguuuaaagcuuagaccuuuugcuugggcagucucccagcuacuuuaaacuuaacccaacuaacuagccuaccaccugccacguggcuagcucuaaacuuuuucuccuccguggcaguccgugucuguuccuucugugcccccaacgacugcuuucuucuacuucauuuucucucucuagaaguuucccuucaccuccugcccagcuuuuggcugucagcucuuuauuacaaccaaucaacagcaagauaaucucugauacaauccuagauugccucuaggcauacagagcugucugaccuucaaguaucugagcagguguggaaaaauaaguauuuaaaauauaaggccaaugaggggccauagaaaugacagugccagaguccugccagcauuuagcucucugcuaacagaauugaaaauuggaaauacagagagacaccuucacaaauguaaagaaaagguuacccaacaguucccagccugcuaucuugggaaauaguagcccaugucuuuguuauuauccuuggggcauugaccuuugaguccaaguuaugaguguauugucugcagagaccucaucaguuaacacugaaguguacagcauugggcuuucuucuaaguuuaccugccucuggugugcauggcauaagaagggagccugugaacugaauacuaugguuggggaggagccagggggccacuuagaguccugaggguuuauuguuuucugacccagcugcugaaaauggccuuugaugaggaggugggaucugacagugcugagcucuuccgaaagcagcuacacaagcuucgguacccaccagacaucagggccaccuuugcauucacacuuggcucagcucacacaccuggcaggccgccacggguuaccaaggacaaggguccuucauucagguauggaacugggucccagagccggggcagccaggugcuugcugugccccuugcagagucuuccuggacuuccuguccucucaucucuguuggacuuuuacaccccagaacccuaucccggaaccugaugaagaaugcuaaaaagaccauugggcggcaguauguuacucguaagaaguauaaccccccuggcugggagcaucggggccagccacccccugaggaccaggaggacgagaucucaggugggagcagggucagggagaucacugugcucgcuaucagaguugaccccauggaggcuggggccugggugaugacccccaacuguaccguuugcacagugucagaggagcuggagccuagcacacugaccccguccucagcccugaagcccucugaccgcaugaccaugagcagccugguggaacgggcauguugccgugacuaccagcgccuuggacuagguacccugagcagcagccugagccgggccaagucugagcccuuucgcaucucuccuguuaaucgcauguaugccauaugucgcaggugagggcuggcuagaacaugccaggaagauuuugcugggacugacuagggugguaggcagugcucggacaccuucccugcuugccauggauccuggagaaacaaggagcauggacaggagguggauagagaguuggguugcagguuugguggaggcucccagauaagcauaaaguaccuuuggccuuuagaguugggagccaugaauuugcuccuuggugcucauccuguuagcucuuccugccuccuguguguaaggcugcggguaggcacgggcaaggccucagagcuguccucaugaaaccuccaacuccuacagcuauccaggauugcugauuguuccccagagcauccaggacaacgcccugcagcguguaucccgcugcuaccgccagaaccgcuucccuguggucugcuggcgcagugggcgcuccaaggcugucuugcuacgcucugggggccugcauggcaaagguguuguuggucucuucaaggcccagaauacaccuucuccagguacuccuccucuguucuuccugugucugccuacccugccuguccagucucugccuccuucagccccagcuuuuccuuccucaggccaggcccaggccgacuccagcagccuggagcaagagaaguaccugcaggcuguggucagcuccaugccacguuaugcugacucaucaggacgaaacacacugaguagcuucuccucagcccacauggguggccauggugagaggggcuccugaguaaugguggccacagagcaaagaguacuuuguggggcuguggcagaauuuaugcugggcugaccagcaggggcagaaguggcuugacugugguguuggguaugggacaaagagagggacuccucucccgaguucugggacagggcaggaacacugcucagaccaggugaguguccugaggcccucacuccuuugaccauaaaccugaccauuuccucgccuuccguaaaccagcacaucugccagaggccucucaguccagcagauggaugcucuguccaucccucuaguccagcagaugggugcucuguccaucccucuagcccaacagaugggugcucuguccaucccucuaguccagcagaugggugcucuguccaucccucuagcccaacagaugggugcucuguccaucccucuaguccagcagaugggugcucuguccaucccucucgguccagcagaugggugcucuguccaucccucuaguccagcagaugggugcucuguccaucccucuaguccagcagaugggugcucuguccaucccucuagcccaacagaugggugcucuguccaucccucuaguccagcagaugggugcucuguccaucccucuagcccaacagaugggugcucuguccaucccucuagcccaacagaugggugcucuguccaucccucucgguccagcagaugggugcucuguuuaucccucuaguccagcagaugggugcucuguccaucccucuaguccagcagaugggugcucuguccaucccucuagcccaacagaugggugcucuguccaucccucuaguccagcagaugggugcucuguccaucccucucgguccagcagaugggugcucuguccaucccucuaguccaacagaugggugcucuguccaucccuugcuguguuugcugauggaacauccuuaaacucauuuucucaucuuuucucuagccugucuacuuccagcugccacucugcccauuagugggccuucauacucuucuguccuggcuuuggguuugucugcacuguucuugcugcccuugucauucccugugcauaccuccauugcaccugaaaucacuaagaggcgccaggccaaccuucccaugcugacuucugccugugaggugugcgcggacacaguucucugccugagaacugcuauuaucauaauugugugcagugucuucuguccuuaugcauugggucuguugucugaggaggcccagagaugagguaucugccucuggcugugaguuuagcccuucuuuugcugccuggcauuugcuuccccaaucuagccgugggcuggacuguuaauaguuggucuagaugacagugcuaaaagaggggcauccuggguacgcucuggacacucucugugaaggcaaauagccugguuagcaaaugaagugugaguuaugggcacugcucuggccuccuucucccggcuugacugcuagaugcugggaucucuggcugauucuuuggcuuacaacucuagccacugacuugcauaccaagcccugugcuuggaaaucugucucagcauuugguguggcaucugccauagacugcagagcccauuuuuaccaagcuggugucacacugucacuugggaguaaguugccccaguccaucuugugugcucaaaaccucugguucccccauuccccucuugaaguuguagggcuacauuuucucuucuggucuuggauccugaaaguauaauggcacugguggcuuuuaggcuggugguaguucccacgagagcagccaucuuguaggccaggguucuuaagucugucugucuuguuccuaugguugauuguucuuucuuauaguuuuuucaagauacgguuucucccuguagcccuggcuguucuguaaauugcuuuauagaucaggcuggccucaaacucauagagguucaucugccucugccuccugagugcugugauuaaaggcauacgccaccacaccaagccagauauguucuuuuuuguuuguuuguuuguuuuuuguuugguuuguuuguuuguuuacaggguuucucuguauagucuuggcuguccuggaacuuacucuguaggccaggcuggccuugaacucagaaaucugccugccucugccucccaagugcugggauuaaaggcguguaccaccacugcccagugccagaucuguucuugcuaguagcuuucugcccuuccuuuuuucuguaccuacuuacucuaccccaggcuucuucacucccuguugaacuuguaguucucauuuguauuuaccagugcuuaucagugaucuucaucucuuguuaacacuugcuggccacuggugcugaggacaggcagcaagucugcucucaugaucaccaagugauacuagucugauggauaggccaggcugaccaauugccauuuuucccugagaguaccugcuuuuugugugauuaaauguauuuuauagucugauuuuucugccagaaauucugaguggcacccucaggcagcagccuccccuccgagugugugugcuuucaccuucccuaaugucuucuggacagaucuguaaaccuucuccagugcaaauguugcuaccucugguguuauaaauucaggguguagggccacccucccugacuguccagugaugaucuggagucuggcuuccuucagcucuacuuggauuuccagcugcagccuaaauaggcggauacugucugcacuccaaguuggcuaacugccaucuguaaugugggguugucagagaagucaggguguggaagacuggccuugagcuuggccauagcuggguggggugauguuuugcaccaugccuuuuucuguguccuguaugagggaggccucugcacagucagguaaacuugaggugugugugacucaggcuucucccagauacauugucccagcccauaacucugccuggugcaguccuaggacucagaucugcucauguccucgauugaacugucaccccacuccucccuccagcucuucuuucucccucuuccaguugccucuaggucuccuccaagacugaggcucucagguaccugugcuuuguuguggacaaggcuacuacaugguuguguguugaauauucuuggaauuguccagcagucagacccuagcuuacuauaaaggaggucuaagagaaacuugaagacaagauuucucugagauguuugaagaagagccccacuauuccaaagucugaccuuucccaguaucauagaaccucuauaccuaguuaccccugguggagaggacccauaccuggaccagacaagggcccauccuguuucugaccccugggaguggggcuuggugggaaccuuugacaauccaggccuggaaccaaaucugagccuucucucugcugugcccucagugcccagcccccgagccagggucaccacgcuguccaacccuuuggcggccucggccuccagauggacugcgucccgagguacuguacuggggcuuuccccuuaacuggaacugauggcccccuaguaugagucaagccaucuuuggcacuaauaucucuuuucacacccagcacuaacugccccuaugugacagacuagcacaacugacuccuccuagcccuaguuacuuaucugcccagcaccuggucccgaucuagacacuaacacaggccaccccccacccccaugugccucagcauuuguguguuccagcccuccucccucuuguggccugccgaccacucugcccugccuggaaacucaguuccccucccuggaggccaggcccagccagccccagguaagugaugcucugaccucaaucuagcacuuacugggugucuccuuugcagggaaauggagcaguguccgagccaguggucgaagcaguggucuugguucugaugugggcucucggcuagcuggcagagaucuccucaguacuccccacaccaacggagcuccaccugauucugguuuucuacggccacagcgugcagcccucuacaucauuggugacaaagcucagcucaagguaauugggguagagguguagggcuaggagggggagcacagggcuaggcauggcucacaguuugucauugguuuucuuccagggugugcgcccagaucccuugcaacagugggagcugguaccuauugaaguauuugaggcaaggcaggugaaagccagcuucaagaaacuauugaaagccugugugccugguugcccugccacugagcccagcccagccucuuuucugcgcucacuggaggacucagaauggcugauccaggucucugcacugccucugccuccgcccaccugggugcuaggucucucuaggucugggcuugcuugcuugacaccuugggcaugaggagggggaggggggugauaggcgcuugcuauguagugucauguuguuggggagacagcugguggcccgggccagucugcugugugcagggaguuagguguccaguguggaaucacacuggcuuguagagcagggcccucugcugcuuugcccuuuuugcagaauggacauagguugugucaucggugcccagugaaaacuagagugcugaggggugggacugcugccaccugaaaggcaacacuuagcucucuuuuugagacacggucucacaguguagcacucgcugaccuagaacuuguggcaagucuagguacugagauuacaggcaaccaccaccacacccagcaaaggacagggacuucugaaucugcuuuccuugucauggguggccugggaugugaugggugggcaggcuggagggacagugcaagcaggaccagagcagaguggguccauccagggcuguagacacuacuggccuucccaggauucuguggaugugugagccucugaguccugauuggcugugguguccaugcagauccacaagcugcugcagauaucggugcugguaguggagcugcucgacucuggcuccucuguccuggugagccuggaggacggcugggacaucaccacucaggugugugcaggugcggggaagcggggagggcaggguccuccaauguccuccugacaucugcugguguuggcaggugguauccuuggugcagcugcucucagaccccuucuaccgcacucuggaaggcuuccgacugcuaguggaaaaagaguggcuguccuuuggccaucguuucagccaccgcggggcccacacccuagcugggcagagcaguggcuucacacccgucuuccugcaguuccuggacuguguacaccagguagguagauuuccauguagauaggcuugaccugugcuccccuaccugaccucugaccccuacgucuuacagguccauuugcaguuccccauggaguuugaguucagucaguucuaccucaaguuccuugguuaccaccacacaucccgccguuuccggaccuucuugcuggacucugauuaugagcguauugagcuggguauguagggaagacggggaucugggguaacugucugggccagcggggccuaagcucagggcuguucuuguguagggcugcuguaugaggagaagggugaacgcaggggucagcuggccugcaagucagugugggaguauguagaccggcuaagcaagaggacccccauguucuacaacuacacauaugcacccgaggacacagaggugaguggggccugacuggggcagcggcuccugcauggcccagcuucugaacauaggcuuacuugcucccaggugcugcgacccuacagcaauguguccaaucugaaggugugggauuucuacacugaggagacgcuggcugaggggcccccuuaugacugggagcuggcccagggacccccugagccuccagaagaggaacguccugauggaggugcuccccagagcaggcgccgugugguauggccaugcuaugacagccguccucgaguccagccugaugccaucucacgucugcuggaggugagugcugucccacacaacacgggaguacaacacgggagugccugugcgugugcaugugcgugugugugugugugugugugugugugugugcaugugucaguaguuacucuugagaacugggguggcucugacuucgcccaccaugugaacugcuuacauacuugggauagcugugguucuuaggucccugucucaugcuaauagauauuuacagauaaugauaagaaagcauuugucaaaaacucucaagaccugggaccugguuuuugcucuuggcauauguguaucccuuuaccucauauuuuaaucagcuuucaucacugaggaaauacuagagauagguuuguugacaggguacagaaauugauuuagcuugcaguucuggaggcucacgggagugugcucaguucuaggaagugucugggcugggucacaucauggcagucuuccaagaaguguucucacccuucccaagacgcccucccuauuacccaaggaccuuccaccagagcccaccucuuaaagauccaucacuuccuaccuagaucugcuacuuggggacacaucuauacuucagugccugggugucagugcaggcaggguuuucccaggagcuacuaacucuugccucugcucaguugucugucaggcaugucuuaaagugaguaguagcucuucuggguuccagcccuggaguuuagagucauguucaccuccaacuugccaucucuucuggccauaucugcucaguaaucagacuuaaacaaggacagagaucccuugaaagaaaaaauggucaaaugaguugugguaguuggugugugggaacugaggcaguauacagggugacagaucugucugguguggccucccugaguggcucaucaaaggggcugagcagucagaaaggucugggccucagggccuaaguaagaagagcuuugcacuccucuguguuggcuguguucccuucaagauucugugagcauugccugguguccucaugugcaaaguaggauguugauuugugcugcccaagcaaggugguaagcgugaaauauguuuugaugauccaguauagggccuagcccaaaggguuuauuacucgagugcgggcgugcuugcgugagugugugaguguguguguguguguguguguguguguguguguguguguauggcgccuguggguggguaguuugguacagggaaugguaguauggaaaucagaagcacuggcuugaucugauguaacuggagccucuuaguuucccuguggcauaaauaugcauaguauuuuauuuuuguuuuacuuuuuuaaaagaaguuaaaaaaugagagaaggcuuucuauuucugcuucgcuuugcuuuuccaguacugagaauugaacucagagccuuauuuaugcuaggcagguguuccaccacugagcuauagcugaaacuugauuauuucuuuauuauuauuauuuugagacaagaucuaaguuguccuagcuggcuacaauuugagauccuccugccucagccuccccaguaguugggaguacauacucuaggucuggccucuaguuccuuuuuucuuuguauaucuagucuaauaccaguuccuuucagucugaaagacuuaguauuucuuguacuacagaucugcuagucacaccuugccucaggcuucugugguguuaugugugagaaugccccaccccuuggugacggugcuaucaaugagugggccaguccaggaccuugugugcacagggaggugcucuccaccaagcuaugaccucugcccgccugccugcugcauccuuaagggguuuuauguuugguuuuuuuuuuggggggggggguggguggacaggguuuacucuagcccaaguuaaccuggaacuaacauuuuuuucucgggcuagcuucaaacucaguaaucuuuguguuucgaccuuguaguuaaaggcgccugccacccggcgcuguggcgcacgccuuuaguuccagcacucgggaggcagaggcaggcggauuucugaguucgaggccagcccggucuacagagugaguuccaggacagccaggacuacacagugaaacccugucucgaaaaacaaaaacaaaaaacaaacaaacaaaaaaaggcgcuugccgucgugcccagcuauugacagucuuugagacauggcuuguguggcuaaaggcagccuggggcuccuuccugauacuuuggcucuccccuuccuuccaaguuuuaggauuacuaaacgcuuguaaacuaccaugcccagcucucagucuuaagagauaggguguugcuguauuucccuaggcuggccuagaacugccagucucaagugauccuucuauuuuagccugccaggaagguaaaacuacaugggaaacacagugccuggcuuugccugccugccucuccaucuuucuuucuuuuuacaugcuuagcagugcuggauauuaaacccagcuuugugcaugggaaaugagugcucucucuuacacugcgcugugcuacacuuacccguguggcacugcuuuuaaaggauauuuucuuugaauauaggaauucagauauggcaaguuuugaacccccacugauagaauacuaauuaaacccacacacuacauucaguuuuaagauauuacauuguuuucuggcuugcaguauguucaccaaaaucaguguucauucauauccuuaugaacuauaacaugucaucuucuguuuuuaacuucugauauaauauagcccuuguuggcuuguaacucauaaagacuggccugcaucugccuccugagugcuggaauuaaagaaguguaccaccccuggucuggauauauuuuuaaaauguuuuaaauuacauuuacuuauuucgugugucugcacguauguggguuuaaauuacauuuaccuauuucgugugucugcacguauguggguuuaaauuacauuuacuuauuucgugugucugcacguauguggguggaagcucggggaugaacuuuuaggaaucaguucucucucuuuccaucauguaggucuaaagaucguacuucauucaguuggcaggcuugcugacaagccucuacugacuaaaccagcauguucacucagccuggaguuuuguuuuguuguuguuguuuuuguuuuaaauuaaaaaaaaucuucacguguauguacgcuuugccugcauguauguauauaucuggauacaugccugggaccuacaaagucagaaaagguguuggguccccaggaacuacagguagaugugagcaccauguggaugcugggcaucaaacccagcuccucugcaagaacaagugcuguagcugcugagcugucuuuccagccucugcaugaucuucugcucaccaauucuccucaggagcugcagcgcuuggagacagaguuaggucggccuucugaacgcuggaaagacaccugggaccgggugaaggcugcucagcgccuugaaagccggcaagauggacgugugagugggugggaggguuggcugggcagaggaauaucuaguauggguguugccaggagauggaggcugaucaccuuugauaguaauuccauucugcucuuugcaggguacccccagcucacuucuggugucggcugugccccaccaccgccgcucgcuaggcgucuaucuacaggaggggccugugggcucuacucuuagccucagccuggacagugaccagagcaguggcucaaccacaucuagcucucggcaggccgcccggcggagcaccagcacccuguacagccaguuccagacagcugagagugagaacaggugugagcggcacagccugcugcugccucugcacugggaauugggacccaugcaugacucucaaaugggguuuuagguucuuugaggaguucaguauuuuauguagguaaaaggaauuguagaagcuauaacaaucgccuaagcauagguaagcaucaaaagagguuuggguuguagaccuggugacuguagcaggucugaaauggagcuaagagguaucguaggacagucacucgaugaaacugaggccagacaggauccauccucccugggccuugaggggccauuuuacucugguucccuccacagauuugacugcuaaguuccucuuccucuuuagggugucuaugucacaugggacuaccuccuagauacaguguuugggacccagugucagucucaugaugacuauagagggacucacccuucaucuaauuucuagaggugguccuccaccuaauagcuaaccuggcccugauucugguacaaaugcagguccuaugagggcauccuauacaagaagggggccuucaugaagcccuggaaagcccguugguuuguccuagacaagaccaagcaccaggugaguggugguacagggacaagggaaacagaagacaggccugucuugacucugcacaucuucucauccucaccccagcugcgauacuaugaccaccgaauggacacagaaugcaagggugucauugaccuggcagagguggaagcuguggcaccuggcacacccacuauaggugccccuaagacuguggaugagaaggccuucuuugaugugagccucugucaagggguggggaacaccuggggccagggacuuggaguuauaggggcacgaagccaguaacucgcucuucccaggugaagacaacacgucgcguuuacaacuucugugcccaggaugugcccucagcccagcaguggguggaccggauccagagcugccugucggaugccugaccccucccggcccugcccgggcugcucugcuuccagucguuacagaccacuaggggugggcagggccgccccggccauguuuacagccccggcccucgacaguauuugaggcccugagcccccccagcacuuguguguacagcccccgccccgccccaccuggccagcucuaacuuauuguggugucauggcugagccguuuagggacgcggccaugguacagcccugcccugggcuuguaaauaguccacccuacccggcccaucagugugcuggcccuggccggcuggcugugcuaaguuguuucuagaaccagagucuauauaaagagagaacuaacgacacaauuguacgccugcaucagcacugcaucagacugugggucugcccagaggggcuccuuugucucaaccuuggggucuccugagaggguagcagguugcuaucuucuccuguaugccuuuucuggagccugagcccaucuuccuccgagaucccuggccaugaguggcuuugcacaggaaggggacuuccugcagcaaaggaaggacuuguuaacccgacuuccccaggccuccacaccagagaaagcccaaucucucuacccagauagcucuggauaaucaguucaaguccag

SEQ ID NO: 7938 - RNA, 2023 nt, Mus musculus
uggccacagcuuucgcccacagucagacuuuaauucccagugggguugggguugggguugggggugggguggggucacaggggucacuccagccuucuuccugcuuauucauagguagagaugcauuuaagauucuagcuuuugcccauuucuuuagguacacgccuccucgaguucuugguggccuaugauauuggcagcacuucuuccaagcaccuguacccugaguguacacaguucugagaugcgcaggccccugucggugcagauucuacagccuagauccacauauccucauagguuuaggguauccaaagccacgaggaauggcuacaagcaggagcuccagagaaucgggccaagguauggagcucagcugcagcucugggaucagagcacagcacuccagauggaguaccuaggacccaccucagccauaacugugggggcugcugggauccacaggagcugagucccgccggccagcuggccggacaagcugccacaggcgauggcuaagauucuggacuuggcauguacccaguacacagccaacccgcaggagcugggcauggggucuucgggaucccgugggacgcuggggaccagggugucgugagccaccacccugaggcagaugaaccauagcaagggcccuguugccccuucccuguggcuggggggcaugacgacgagacuuccagacuacaggcugaagggaaggguguccaggcugcagguuacuggaaggaaucuuagcugggggcucucugcagaaggggagagaaagauguaguaaacucaguggccuaguggagccuuccaaaagccuuuuaaaaccaccuacuucucuucuucacaguccgagggcacuggcaggggaagcccgcagcuucccuaaaagccuggcccaggaccaggggaagcccaaaaguuuggucuccaaccugaaggcugggaaggggagcccaccauccuucugggcuuacuggcagcuuggccaucucaguagcccaagucacauguaccauuaacaacaccauucugggcaaagguccccaagaaagacccccauucccccaccccggguucuucccuuauguggucagaagccagcagguuugagaaucucugagcucccuuccuucagcagaccucaaugucaauuguauccgugggggugggggaauaaguaccccaaguagaaagaggcaaaggaagaaaaaaguucuccugccuuguucaggcaacacuaaagguggaggguggccccugagcugggagaugaacucuagaaaaguuagguucccccugaggaguucgguccaacccuguacucaccugggucuggagugccucagucccuugcccaggcugccagacaacgugccggggagcagguagaggaggcugaugcaaccgaggguuaccgugaccaucagcaacugggccauggcgggcugggcuguggagcaagaaugcagugaagcuagcaaaugggguggaggaggugggccacucuggccuggagccaacccucuuugcccaccaguuggggagcccuucucugcccccgggcgcucggaaugugggaagauugguugguaccugcgucuguugucugucggggcacaggucucaggaucuggagacagcuggcaaagcugggaucugcuagcaguucccagagcacgcaacggaacuugugggucaggucguggucuccuaggaaagagagccuucugggguccagcggaaaaccaguuugggaagcacuuccagcacuaaguagucuuuggagcuaaaggcguggcccagacgcugauggggcggagcguccuccacccgggugggcugcgguagccacgcucuccugguggcuacuccugcccagcagaaagcaguagagccacaggaggucacuucaaggggcccauccuugcugggaaaugcucaacagcugaccagaaaccccguggggcuacugcccucacuccugguaccuucuggugcgcgacaaagu

SEQ ID NO: 7939 - RNA, 2959 nt, Mus musculus
uccuaaauucaauucccaacaaugcacaaccaucuaucuguacauaaauaaaauaaauaaaucuuaaagauaugugcaaaaaacuaccacugcacauaaaauaaauacaaauaauugggaaaaaaaagugcucccccacccccuuuuuucuguugaaggaagcugaaucuagaaaacuuaaugaccguuucuaguaugggcaggugugugugugugugugucugugugugugugugugugugacacuaacaaggaaccagaagaauacacagcacauuugcaguaccucauacucugcuaccacaacacgacgucuggcccccagugaugagucagcuucguucgucaucucuuucauucuuuauugauacccagcaaacgugaccucaauugugauggguggggacugugaacccugagccaggcuggagugaggggcuauuauagcuccugaaguuguccagccuagguguacuggcucaguggugggaggguauuggaaaccauucaccagcucagggugcccgggcaguacuugucaaucagcccuugauaguagggccgcaggcucuccacauccgguaggucagggcacuucguguagagaucaaacuugcugcagacaaggagagcaacagugagcaucaggaaagcuccgccuucaaaccccaaguccccccuucacugcccgcaccccuggaggaacuacggacuugaacucuugcacccagggcagcauauccagguccugcuggcugcacagcugccgguagucaccgccggugugccacggauagaaggaguggaaucggaucauguagaaggccuggggaagccacacguagcaugcucagcucugucagacgagcuggacuggacguggcuccugauugggucccucccuccaccuaccucugaaggcagggagaacuuguugaacuucaucaucugguauagguacucuacaguagagggaggucguuauaagccgggugcccagacgggcagcccccgccaccaucccugcaccguccccucgcccgucucuagcuguccucaccaucauggccccaggacauaaggacguucucuaguccacagugaggcugguacaugccgaguucugugcugcaaugaucaagagcugagccugggaggaacuggaggauguagggaaaaagaccagcugggguccuuuauugagguaaacugaggcgcuauuucaguguaccuguaucgaggauccuggaggucaggauuguccuggaaaguagagucacagaacaccacagaggccuggggacggcagcccacggggaacgugucuccaacaacagcccacuaggaaaggacaggcagcugugagugagggcuaaagaggucuccucugcucauagugccccaagcccagggcugaagcugccccacuccccaccgcuggccuuuaccugagguuccccccacagagccauaauuuuccccagaucgugcaaaaguccgaccagguggaaccagucugugggaaagggacauaugaccuagaaccugaagggauaaagguaggcggagcaggcucugcgcugaaagcgaggagcccaggggucugcuucccucaagguggggccugcgggagaggaccaggccccucuggacuccuucuggggcggaugggagcaccucccccaccacagcuguaggggcacacccuuguccgggugggcuuuccggaugcccuccgcggucuggaacgcguggaaggaguuggggaaaucuacgucugggucagauucguccaccagaucauccagcaugcccacagccuccaugauggucaucuucuuguaagagaagcuuccauacuggaugcgcuggagagaagggagaagugagccguucucccacagagagggagggcuacagggcaggggcauucugugggucaaaggcaaggaggcgccuccccaucagaguuggcaucgggagcagggaacguuuaccuuccugcugacgaaguccacagucuggugagugugcaugagcuuguaugugguaaagacacgauccagcagcgggccugacugaaaaccagauagucagugcaggcuaggugccugacuacugccccagcacacuggagaccauggccuccccugcugcaggccauauaucccacaggaauggggcuuccaaaaaaacaaaaaaauccccuuuagagcuucgggaagaagaggaaggucugcucuccacagagcuggaccagagacuugcuugaaaaggcagagaaggcccagggugucacucacaguauaguuucggaagcuguccuugcuuuuggccaucucuggguccacaucgggucgauagaccagggaagggucugggcccugguuaaauaggaauuugacccauuucaccaccagccagguccacaggaagugaggaaaugacauccccaggguauaaauacuaaauaaaccaucucaucccuugcgcaugucgaaggucggcuuaaccagcugauggcuacuuaaggucggcuuaaccagcugauggcuacuuccagcgugaggagacuaauuaagaggcagugaucuccaccugcugaucuccuugcauuuagaagauaauuuuaggcgguugccugauucaacaagaaguugggggaggaggggggcuucuaagcccuacggggacuggaccacaacagggaggaguuagcucuguggccuugagggcagggcuagcaggugaaagggguggcacugccacugccucuucuguugagcccauggcaagggguugguggagccaucccuguucagaucauaagguacuuaccacaucgaccuucauccugagggagcagucacccgacggcagagcuugcaggaaagcgaaaucguaggcccaggagcucuuuauaugcgcacagguuauguaacugaccagacaaaaccua

SEQ ID NO: 7940 - RNA, 2166 nt, Mus musculus
ugacugcugagcgcagggccgucuaggugcacgcggagccagggugucccugcgcgagcgacagaggcgguuaccuaggucacagcgggcgaccggaaggguuguuuauggauuccagacagcgcuuaccucgggacaaacacuggcccacgucgaccaguaccucggcacccacucccggucugaucggcugccccgcucggcugcguccggcuccgaggucgugcagcacacgggccagcggcagcgcucggacgcacucaacaaugccuaagggagaggguggacacugagaaccuacuggaggcacgugccaggaccaggaaagaucgggagaggaagugggugggaucuggugccguugauauccggucucaccgucugccggugcgagcagcuccucuugcucucgggcgugaggcagcagcugccggcguugcguggggcucccggagcacaaugcuuuagcuaggccgggguccacgcccugcgccgaaagcaucagcuggaagcggcgccgcgcggagccgucauccaacgccgcggccacucgggcggcgccuuggucuuguguuuccgccuguccgcuaauccaaagaauggcgccuccugcuggcgggcgggguggagcucagaagcugcagggauugagagcuccuggcauacaaacugguggucuuaacuccagcccucucaccuagccuaaugaccaggucccgcagauccggcggccccgcaccauccaggcaaagcaacgcuucuuccaccuccaggguauggcccacgcugcggcccagaggguuauccauggcggucagggcugcggcgaccuucagccccaggcucacucccacucuaaccuggggaggcauuauucaguauccggcauuaucaaaucccauaccugcugucccuggguuaaggugucaguaaaggcuuagguuagagaucagaaaccaacacugccaggccucagaggggauggggguguucugguugguugcccuaaguggcggggguucuguggaggauuuccccagguccgcagucaggacagcuuugauuggauaggguaggagggcuggaaagaggaauugccguuuuauucuuccaggacuguugagugggcagaggcagggauaggacggaaugugaggcucaugucccuucauagaaagggcacuguggccuagcacggcucaccaacaucuuugccaguucucgggccuucuccuggucugggaagacugcagcucccccaaacuuaacaucuaccaccagaguggacagucccuccacggccuucuuacugaggauugaagcugcgaagaccagaaacaucaucccaggguauacuugggcacaggaagaguugccucucugagaaaagcggcagugccuagcggacugucugucagucaggguaccccguuucaggucaccuguaaugagugggacacuguccacaguggcugucacaucucgugcagcauacaggaucccaucagcaggaaccagcuuugcacucuggccgacaaugcagcagccgacuuccucaaggaugugcagcaucugcucagacaccuucauuaacuucuagggacggacccacccacuggcccugaccacugacccaacagaaguucaaaacauggccagcgagagucaguaugguucugauggcuaaccuaccaaggaucccgauuaguuaugacagacacauuaaugcguaccagcuaaucaguggcuucucccuguucccaaguaacgaucccgaucaaaguucucucgaugacuccaggccuauuuacaaccaaugaccuuuugaauagucaauguucucucucauuagugacccagauaaauaaccuguccauugaucauccugugauucgggccagugacucccucaacccagaucauugaucaguuaguggcccaccuguaccugcucugggcucugggugacaccgaacccaggaaucgauuccagcuuauccagugugcccccugugugucccagacugcggccgcugaucauuggcaccugguggagagggaugcugacugcccccacgcaggcccuuaaccucauuuuaccuauccucuacuaagaaccuauccuauccucauaugaaauuacuuuuaaaaaagcaguuauauuuu

SEQ ID NO: 7941 - RNA, 3687 nt, Mus musculus
gugagcaucggaagagcagguugcugaggccuccgcugcagauccacacaggucaggcucagcaagggucguccccccgauuggugggacccacucuagacacccuucccgagaggaccucccaagucccgaagggggaccccgccccccagcacagcaggcugcagaccugcccccaccccccacccccccgcguagcacugacggcgaccgaacugggaguguccccaggguccccagggcugaccccugaccucacgggacaaacgcucagcuccuccggccgcgcucggcgccaggccccgcccagguacucccggcaccacugauaggcucggcgcugcgcgucacgggacagcgaggaagcgcgccgccgauuggggauuggcucugggcacuuagcauccugcaaaccguccuugggcaggccgccgccgacagccccuccuccgacuaccccugucccgucugccgccaugacgugggcuccguuagguuuaacgccugccggugcucagcgagccucaggugagguuggcuccuuccggguaggcucgguuccgcuucccggaagccgcagagucucugggcguccucggcucuucgcgacugccuucggcuuucuugguggcuccaguccugggaccguuuccaagccagaugcgauucucagggcugcggcgcucaaaggcaaagagggacggcagcuuucccugaguggggcgcgcucgggccacgcccgauccgccuaucagucucugcaaaaacaaguuacugcguggacuguguccggaaccaaggaagugacguaggccaaucccgagcgccgugggcgguuggacaguagcuccgcaaagcuuacgagccaggcucuggccaaugaauggacgaugguaguuugcggcuccuuuauaacagcugcugugugagacacucuacuagggaguagauuagccgagccuguggugacaguugggguaagugaauggaagaaugaaaacguagguucuaacgauuccccuuuccacaaggcagcagguguauaugugaugcuggaaggcguaauaagaaucaguccggcguguccagcgcugcauagaccgcaugagcgccauuaaugugacccaacacaauaacuuaaaguauuuuucuuucucgagagagugugucucucuccuguuaaauaucgggaagagggagacguuaauggucagcuuagaaaggaagcuuacacaauccauaauucaucugaaggaugagguuuauuagaaugaaagggccucaaagcuacgaguuucgguguaggggagggagaauugaacaugagaccuuagaguuaagaaaagacuuuccuuuaaagucuagggauggggcugaagagguggcuaagcgguuaagagcacugaucccucuuccagagguccugaguucaauucccgccaaccaugugguggcucacaacagucuguauguaaugggauccgaugcccucuucuggugugucugaaaauagccacaguguacucauacacauaaaaaauaaauaauucuuuuuuagaaagccuagggagugggggcuggcgagauggcucagugguuaagagcacugacuguucuuccgaagguccugaguucaaaucccagcaaccacaugauggcucacaaccacccguaaugagaucugacgcccucuucuggugcgucugaagacagcuacaguguacuuacauauaauaaauaaaucuuaaaaaaaaaaaaagggaagagaguucauugugcgggugcgggguguguguguguguguguguguguguguguguguauaagaacgcgggggaagcauucaggaaacugaaaucggugguuaauuaccugugaaucugaggacagucuagucuauauacuggguuccaggccagccaggcuacauagugagagaagaaaggugguaagagaauuaaugggguggcagcagaggagccaaucagagagcagccuuaagagcaaucugugaagcagacagcugagguguuuccagaccgaucuccuaaaaaaaaaagagagagagaaaauugacuucaaaacaaaauuuuuuagaauugucaaaaccaugagcaguuuuccuacauggcccacugagagcuggagagaggcauccccugcuccaggcugugggagcuggcuuaaagauguaggcuaucuccccuuuaaucccagcacuggagaagcagaggaguacagggucaggacacagacagauaaacgugcagguggguauuuuaacuuccuuaauacuuuggaccgugaacuuuguggagaaugaacuuuguaggugguaacauuguuuuauguugcaauguuaaaacucuggaccagccuggaaauguuaggugguguuuuuauuuuuuauuuuggcuagcuuuugagccugggaaagaguucuaagcucuguuuucugggccgagguucuaggugaaaguggccuugauucugcuaucugacugaccagaccauaucuuuccagccuuuuuuuuuuuuuuuuaacauaacuacuccuaucaggaagucaggccuggguuggcauagcuuguccuuugugacuuacuagaggucagcuucuuagccugugggacaugcaugaccccgugagguuggcugaauguagggauuggugaaagauuuggcgacaguaaagguuucugaacaaauaauaaccagaaauuaauguaaaauaaaucaagacaaaggaauucaagauguuucugaccacuagauaacugaauuguagccuugguuuugagcacacagcaugcguacuucauguggccacaccaacuuggcuaguauuugagacugugguguacuguugaaacaguuggugacccggugacguaggucuccugucucuggccagguucuuggccauccuuccuccaggaauggacugggaagacagcaaaggaaagcaugagcaacuuuaucugccucguggacauaaagaguuccaagggucucgaugaauggcuccaaacauauuucugcuauuuuguacuucauauuuaaagccaaacucucagcacugaaaaucauaaaguaagaauaucaaauuugaaaaacuguuacuguucuguaccccaggguauccaacauucagccagaauuuaauguuuugggguuuuuguucgguuuuugguuuuuggagacaggguuucucugugucgccauggcuauccuggaagucauuguacagaguggucaggguggucuugaacucagaggucugagaugccucuauuuccugaguucuaugguuaagagguaugagccaccaaugucuggccagaauuuaauguuuuauuuaaacauaagcaugugccucauucggaagcaguuuuucccaccuuaacaaaugguaaacacacacacacacauauuaggccuaagaauauauauauauauauuuucauauuccuaagaauuguuuuuaaguauuuuaugaguuaucaccaaauguuuauuuguauguuuauuuguauuacauauacaccuggggcucaguauaaauuucucagguuaacaaacugagcagugggaaaaguugacaaaucucugugucaggaguaggcacuccuacuguuggcuucucucuuacaguguacuuuuaaucaguuugucuuaaaggauaga

SEQ ID NO: 7942 - RNA, 8634 nt, Mus musculus
ucauuuuguguggguguuuuaccugcauuaauggguggcgugugcauucauugccugcagaggcuaggagagggaauuagauauucucggauuguaguuauagaugcuugugagcuaccauguaggugcuagagauuaaaccugaguucuccagaaaagcaacacacgcucuuaaccaauaaguuaucucuucagcuccccagauuauucguuuuucuuuccuggaaaucaacuucuuuuuccucaucuuuucaguacuuauuugaugugggcaucuuuuuuuuccaacuucuggucacauucugacaucuuggcuccuaugcauccuuaaaaccccagauuuuaagauccugguguggugaauguuccagauuucauacgaguuuacucuguugauuucgauuuccucuucgcuuggugucuuuuaagcuggaauacacacauaaaagaauaauuauuaaaauucuaauugccauuuucagguguuuuacaauaggagggcuguagauuauauuguugaaauugaccuuuuuuuuuaauuuaucaacuauauucaguacauauaacugcuaggugauuuuuuuccucagagagacaaucaaucaaucaauagaugaacaggcccggccgugguggcgcacgcuuuuaaucccagcacgugggaggcagagacaggcagauuucugaguucgaggccagccuggucuacagagugaauuccaggacagccagggcuuaaguaaguaaguaaguaaguaaguaaguaaauaaauaaauaaauagaaauucugucuuguuuguuuguuauuguuacaguagcggggauugaauugaggacuuuuguguacugggcaauuaugcuaccauuaagcuauuuuccuaacccacauucuguauuuuacaacauucauuucacacaauccaaguuacgaaacacaguaguaguaaucaaacucagguggccauuucaugcaccaagaauuuggacaucugucuagcauguuaccugcuuauccugaauuauuguugucuugcagugcugaagauuaaacauagggcuuuacaaauacuaccagaggauuauacccaacucucacacacaagaucugaugcuauccacauccccucaaaugaucccuuaugccauaguuucucacugccucucugucuuaacaacuguaaaauccaggguucagguagguuauagacccauguauggccaguuugaauaaggagugccucucucagggcacugaagaucagugaagacucaagacccacaagcauugcaccgcuagcuguaccaacaagccaagcucuguugcagucauucuguggaguccuauuuauacaucacauguccuccacgugccuccaaacauuguguccuccaugugccuugccucagcacgugaauccagucagccccaguccucagaguccugacaaaugcaucucaaccacgcaauguaaaguggaccaaugucuguguguuguuagcagagaauccuucgucauuguguccuuucguguguuugcuuuagcagaacauccucucuccugugucugcuucagugaaacguuccuuccugagucugccuuagucuuucaucugugucugcuucaggaaaacacuccuucaugugucugcuccagcaaaacaucauccaauauaauugacucuccaaaaaucccuuaaguuuccacuucacuugugaguuagauguaagcucucagcuacugccccagcaucaugacugccugccuggggccaugcucccugccguggugaccagggacucacccucaggaacugcaaagcccuauaaacucuuaacuucuauaaguuaucaugguguccuuacugcaauagaaaaguaacuagggaagauugaaagacaaguauuuguuugagucaauccccuaagaguuacucuuugccagucagcacacugaagagucagaaaguggcacuugagcugccagguucuggguggacuauucuguucagccaaagacuuuucucuuagcuucuucugcauuuaagaagaucuuggguuugauuuagguaguacugaugugcauagcuccuaagccuaaccuacaagcacagccugacucacagccacacugugcucaguccugaauguugucucuuuauccuccugcuaauugguuaugggacucugcagugacacuuuuacaauuguuuugguuucuuucuuucuuuuuuuuuuuaagccacagaaauauaaaaaugugcuuucauuuuaaucccaagugcagggauguggggcugcuucagacuguccacagcagcugacuaugauuugccucaugcucuagcagaggugugcuuuugccagcugcagauaggacccucaggggugggauagguuguuugguguggguuguugguugcuguugguggcaguuuguuaaguagucccacaaagaggaaacaacaagaagaaauuaaauaucuggaugacaaagaucaaacuugccccaagaaacuugaugccccuagucagcaggaaguagucccaugauaccuuugcccucuuucagaccccugacuuuauucagggaucucuuuccuuccuccuucucuauccuuuuuucucucuucacuagugcuaggagguugaaaugguagaaguaaggggguggagaaagguggaauaaagaaccuacaaaguaucaaaggccagcuacaggacaugccuuuaaauccacaugucaaaaaauggucucagggcuggagagauagcucuguaguuaagagcauuggcuagccuugcagcggaccaggguucaauacccaggacccucaugucuauuuaaaacaguaacucuagacucaggggaacugaugcccucuuccagacuucucagccaugcacacacacaugguacaaagacauauaggcuggcaaaagacccauacacacaacaaaauaaaauaaauuguuuaaaagauuuauuuauuauaugcaaguacacuguagcugucuucagauaccccagaagagagcaucagaucucauuauggaugguugugagccaccaugugguugcuggaaucugaacuuuggaagagcagucagugcucuuaaccacugagccaucucuccagcccccuaaaauaaauuuuaaaaaauauuuuuaaugauauaguuccuuuaucuagguuccuaaaugacuacauggagcaaaaaaaaaaaaaauccacaguccucaccuauguugugauaucggcuuaauguaagcaauaaauaaaugccaaugguaagcuacugagguuuaguguuggcucacuugauacugagaagcacggggaucgcuccaggggaugagaaugguguggccaccugguguaaaagcugaguagagcugcucucuggaauguuuacuuagcauuuguaagguucuggguuuaaucuucacugguauaaaauaacaaaaaauaacaaaaagagagcuggaaagcucuuugucugacucaggagagugagaacuggcaaauuaacacaggauguucacauauuuaauauauccuuuuuaagucccagccuggcauggugaaucaagccauaguggcaaacauucaagccauaguugcaaagacagauagauagauagauagauagauagauagauagagcgcuagggaagccaaaguagaaggaucacuugagucuguggguaccauggcgagacagaaacaacauacgauguauccacugaccuucaaaacauccccgucuggccagugaacucaagggcaccaguguuugcuaagggccgucaaacuccuagccaaugccaaucaccccugaguccauggacuuucuucuuccccuaaggccuuuucugccuaaagccuguacuucccuugggaggggguggggguggccuugaacgucucugccgggauuggcauucaguagaggccuccagauccaagaaugagucauauccaggaauugcuccauuguguugcagccaaauccaggacauauuccuaaaacccagaucuuuuccgccuuccccuaguguggcuuucuguucuguccuaggcuagggugacuuuauggcuagugagucaaagguguuccagacuacugagcacugcuugcuugccaaggugaccucacgggccugccuaaucacguggccucuggcccgccagcaucucuucgcuucuuggcugaguuucuacugcauuccugcccaacuaucagcgucuccagagcuguccaaggguguugcuguuugcacucgagcgugcguguguguaagugaguguaugugugugugugugaguguaugugugcacgcgugugugugugugaguguaugugugugugugaguguaugugugugcgcgugcacgcgugugcacaugugcgugugugugcgcgugcacacgugugcguguguguguguguguguguguguguguguguguguguguguguaauauguacagcauguguguauaaacacauagaggacagaggucacuagaauguggcucccuuuaccgacuuccucuuuauuuuucuuuguuugucuggagacagagucucuguguagcccuugcagaccuggaacucacucuguagaccaggcuagccuugaacacauagagauccgccugccucucucacugaaccuauaacuuacuguuuuaucuagacuggcuggcagcaagaccccagaccccaucugucucugucccuccccuagcgcugcaguuauagaaagcucuagccucccagguuuuauccaugugcugggaccucaugcucacaugcuaugugcuuuucccacggaguugcguuccccacaacacacaaucagaguauacuucuuaaggucuugaagggcauccuccaggccccgucaggagacaaccaggaggcaauugagccaaugaugcucaauacacacuccauaggacugugguaucauuuucucugcuaaaccaaggaacuucuaauguuacacuaucaucccacagauuucuugaacccuggcuuuaauugccaaauagaaacaguccuuccaaccauuccaaucaccaaaaucuaugaccacugaaugaucacugucugauucuggaccaacuauuuccagugucuauccuuugagacuuuguucaauacgacuuguaaaaugguagaguuauucugauguuuaagucuucuuuccccagacucacuuuaaguggcuccuucccuauucagaaagaaagaccugguuauugauccguuccugcuucagcucacagccucugcauuucucgggaucuugaauuuguaauggcaugcaacaguagcuguaucucaacucgcccucauuacagcuacacugauucuccgcggugguccgcggcugccauuacuaccaggucuaauguucaucgaaguuacuguggagccuggcggagggaacagaaugccuuuuuuaguucuuuuuaagauuuauuuauuauuauaccuaaguacacuguagcugucuucagacacaccagaagagggcgucagaucucauuacgggugguuugugagccaccaugugguugcugggauuugaacucaggaccuucggaagagugcucuuaucggcugagccaccuugccagcccuuuaguucuuugaaagcacugggaaagaacuuuguuguagaagaaccagcacuccuaauaaaaugcuuacaauuauuuucauuuuucuuuuuuuaaagacauuauuauuauuauuauuauuauuauuacuauuauaaguaaguacacuguaacugucuucagacacaucagaaaagggcaucagauuucauuauggacaguugugagacaccacgugguugcugggauuugaacucaggaccucuggaagagcagucagugcuguuaaccacugagccaucucucuagcccuauuuucauuuuccuauaaugcuauaaacuacaaucauaguaggucuugcauguggaaacucguuaucugcccagcaagaugucauucacaggucagcugaugaccagagguuauuguugugucaucugaccguaacucuucuuccucugagcauaugugugaaggggugucucaggguuccccuuccuuuagagauuaugacaaagccuggccccugaucauaacucaacugaaaacuugccuucagcagacccccaaaccccacauggucaaccagguaggacuccaucaggucuguuuuugccuaagauauuugcucuucuguuagaacuacccuguugguccugaucagcacuguacaucucaacgccuauacauaaccaugaugagaggcaguaggguagggaagguggaggccugauacguccuagguccccacauaaacugaugcaagaacagccacaguacucuacucaggccacuguugcaacucaaucaccccaucuuacccccaugcagaggccucuccuaucccuuugcaagcaagguacagaaauaagagaccugccucccaaggcaaggcuccuuucucaacuguggguguuuguccaaaauuagcaaggccccaggcaucaucugaagccacuuccugaaccaacccuagcaggcuacuuccaauuggggcucugugggaaaaaaaagggggggugggggugggagagaguucacaucucuaaagacagguuggccuucagugcucagcuuugaacagagcuggcggcaggcagauaccucuuuccaaguuuuccacagcucuaggucagagcugagcccaagcaaccuucacguguacacacaccugagucccccaagaacccaggggaaacguaccucgauuugcauaacaucgcaaccccacucgggcucuccagagaauaaugcgcagguccugggguaguuccccagcuagcaacggaaagaaagugcuucugguugauuccuuucaaauuacaauucacaguggccaccagcugggagagauccaaauacaguuucaaagauuucugggccacagaagagcuuucuguccugacucuaaauagaaggacuaccggcaacccccacccgugcacaaguccagaaaccgugcuggaaugugacacuaagagagccacuaacugaagauugcucccccccccccgcccccagccaccccccacuucacaugaggugugcaguagccucagucagacccagcuccuuccugugccaucucuggggucucugcaguuucgaacuuuccuccugcaguuucuugcagauuucaucgggagaauuccagaugcccagagagccaggcuucagugaaaaaaaaaaaaaucaauaaaucaaugaccaguuuacucgucauucugaaccacccucauucugcuugccagagggcaccuucaacucagugucacguguugucugcuccugaccugagccuguguuagaccacugggugauccugagucugauccgcuacuguagucgggaggcccuuccagaacccuguuuaucuccccccuggcuccagcgucuuccuuccugggugcgcaggucgugaccaucuugacgccagaggucuuagagugccacucugucuuggagaggaaucaaagccaagaaucuggacaaaugacuucccuaggaacagccaccugcaaggaaauacccuggaagagacuugcuccggaaaagugacucaggucaggggcuuuugggggcggggagaucugggaaguccaguuaccacagggaccuuuagauguuaaaguacacuaagaacccacccuuccacccucugagggauauaucuguuagucucccuuaacaguuaaaacugauaagaaaaaaagguuauauucaauaauguauaaaugaagaguuagaaacaagucauguugucuucccauuaguucaauacuaaugugcccuaagcuauaccacacaggaacccagcaacccuucucaaacaccagacucacagacacacaucccagcucuaacaccacagauacacacacacacacacacacacacacacacacacacacacucaaccuuaaacaccaguuacgcguguagaagggaaaggauuuuuuuaaauaauuugauacauuguguuucacaaaauucaccaaaggugguugugagcaaaaagccagcagccaaucagauuugucuuccugguuuguugcagucagacuccaugguuuuugccucuuugcucagucagaagggggaugcugauguuuuuucaacaaggaucccucaaguaucucaucagaggaaaugagacaaacagcccaccauucgccagaggaacuccagacacgcauuuaagagcgacacagcaggagagccagauagcuguagugcugcacugcuaggcaguccugagccuagcgcgcaggagcaaagaacguaagguuaccaagcccagcacgggacaccccaaccggcgcagauaaggaucgggagcacgcgagcaaucuccagccucacccuaucccgccccggucccagguccgcagcagccccacccggaagguucccauaggcacacaaacccgcuuggcucggcuccccagcuccgccucgcccggucccagcuccaccuagccccgacucuguaccgccc

SEQ ID NO: 7943 - RNA, 919 nt, Mus musculus
ugaaccaacugccaccauccuuaggaaggaugaaggggagcuauggggaugcacagcucagagagaaaagcccugaaacgagccacugaauuuuaaaagggcugccaggagaagccauguagcuuugugcuuggacagaaagcuaagagugucaugacaugaauuugagaaaagagugacgucugaagauauaaauggccugauacaaugcccauucugaacaauagguucacaguuuuguucacugaugugcccacccagagucccaucuguguuucgagacugucucuguuugucucuaauccuuaaguguguuguuuuauugaaacagggagcauaccgucauuccaacucccaggaaagauaaggcuggaaaaccuuucaaaagaacaccgugaguaucuuuggaaaagagcgcagugcuugaaaaugucaaacagggcuugagcuagauaaauauuaccgggaaaccagacaggauugcaggcagauggaaaaguucccucgggaaauagcuagaucuaagcuuccucuuuaaguuauugcuaagcuaggaguagcaaagggaaccccguuucaguacacuuugaguacaacuucucugagaaagaagucgaaaguuagcagcaggcaacagaaacgaaacagaucagagagguucaggagacacauccauuuaaaaggacagcucccaaggcagagacaccugucccaguggcugcaucaggcugugaauuuuacugacaaccgugguuuuuuccucuugacauuuuaucgucauaaugaagggucaauuaaaacuugagccaccugcauaauagacuuuuuuuuucuccucaaagaacugaagagaacaccuggacuuuucaucuauauugacauugguguguuuaagaaaaggaaauaaaaaacccuugac

SEQ ID NO: 7944 - RNA, 629 nt, Mus musculus
caugcuuagaagaaucaaggccauuuguaaaagcaaacggcagagguacccuucuccucggcucccaaaccaucugaaauuuagagcagaaaguguauaugaaaaugcuggucaaacaaugcagucaaaccuggcugagaaaaucaccgggaugcggcuggaaaucgacaacucugagcugcugcacaugcuggaguccccuagucccucugcuccaagguggaugaagcuguggcaguccugcaggcucaccaugccaagaaaaagcugcccagaaggugggcacuguugcugcugcuaccucuuagacaagaagaaaagagucgaaaaccaaauaaccccucauggcauccagcuaaggucugaagacguccuacuuugucuguggaccuccacaccaagaaccaaguugcaaauucaauaggucauuuuguaucagaaggucaauuaugaaacaccuauaauuuuucaauuauaagaauauauucucuggguucuguugugacccagacgauaacuuuuuuuuuuuucauuguggauucugguuuuuuuuccccucaucccagaaauugguuuugauguacccaagacuuaaguuucucaaauaaaggaaauaaaaucuccauaaa

SEQ ID NO: 7945 - RNA, 542 nt, Mus musculus
cuugccauaguuccaauuuuuuuuuuuuuuuuuuuuuuuuuuggcaguucugcaacuuuauuugacacgagcagguuaguucucauccacguugaccgucuguagauuuuugaaugugguaacaggcacguaaguuaccagcguguagagcuuguuuggggaauccucauccucauuacguuuucuggacaagcguacucggaugcgauauggaacguuccuuauucccuuggcccagacggcuuuauugagccuggugucaaugcgcacaucugguguccccauuuccuucauggcaaacuuccgaauuucuuugagugcccgaggagcacgcuucuugaagcccacuccauggaugcgcuugugaauguugaugguguauucucgggucaccaccucguugauggcagaacggcccuucuucuucucgccacccuucuuugcgggagccauucugccgggcccaaguaggaaaggaagggcgcgaggguuugugggagggaaagucgcguagccguacaacuuccgggucacggggaggc

SEQ ID NO: 7946 - RNA, 7094 nt, Mus musculus
uggagggagaaaagccaaccaguuacacgugagaucucagacagagcugucauaggcuguuucuacaggugggagguugggguguugaacugggacugaaggcugcugaaaaaacuaaagcuagggcagguugagaggugaugagcuaagaguacugggaaaggcacacuagcagcgggagaacugugguguccagcaauugaacuaaguaagaaggcagguugaaaaugaacaaugugugugguguggugugugugugugugugugugugugugugugucugugucugugucugugugucugugugugugugugucuguguuucauccucgguuccuggagcuuaggcaggguagcaaaagcuacaagugacagguguguagggauuaaagagguagcuauuguaguguucaggagcccaaacucaccaccagaagcaaagucauugcaaguauaucuuugauagaguaguuaguacaaaugauguccacuacguuucaacccuugagaauguuuuguuaaucgaucuaugugacaaauugaaaagcagccaugcuauggcuaguuagagaauuaugguuugcuaaagagaagcauuuuguaaauguaucacuuucauaaaacacugucuacgcagugguucucacuuuccuagugcugagaugcuuuacaguuccuccuguuguggugacccgccccgaccacacaauuauuuucauugcuacuucauaacugucaccuugcuacuguuaugaauuauaauguaaauaucugaugugcacggugucugauaugugaccccugugaaagggguugugaccagagauuuagagccacucucuuaaaggauagugggcuuucauguagcucuacaguagagcacuuguugagcauacuccauacccuggguuugagccccagcauggguaucgauauucagaccauaaaaaauggacaaagugauuuuauuucaaggaaaacaauggaaauuuugcugccagugauaagguucaaguuuucaagggagaggaaaaaaguguguuugccagcaugggcauaauguuuuuuaacaucuaaacacacuuaugaaauuauauacuguaauguaucaacauucaggagaucaguaaaucucaguggaaauuauuauuucuagugagcaaugaugcuacuaaaucaccuacucauaugagagaaaauuuaauggauucucauguaauagcaaaagauuacuaaugugaauuuacacccacacuguaacuauucuuuaagaagaaugucaccguuccaauuuugguauacaaaaaggaaaaaaaauuaucugaggguauagaaauauauucccuuuuaaaaucaaguaucagaagauaauagcauuucuuucaaauacaucaaccaaaauaaugaccgacucaaggcagcaguuaaaaaauaguuauugcuuucauguguacacuauuauggccgccuuuaauugucaguuaaacacaagcuagaaucuccugggaagagagucuccaugagggauugccuauaucaggguauccuuugaguuugucugggaugggauuaucuugaugaaguuaauugaugugagaagauuuggacugauugugucccagucucugaguuugggucccagaauauauaacacagaagaaaaucaccugagcacaaucaugcaugccuuugcuaauuuucucucugcucugcauauagaauaauauuuugaggaccuggcuggugaugccugcagggguguaucccuaccuagaaaggccaauccagaaggccaagcuuuaccuaaggggaaagaugaauuuccucccggaauacuauuucaagggugcauggucaguguagucaauacagaagcaaugaaccugcacucaaaagucaauggguaaggcuggguuagaugucauaauuggaccacuuugugauccgacugugguauuaacauagucuccauggcuuauuaaaaauccaaacagauuuguuuuugagaguagaugacaaacaaauuguccuuccugaacauaaaacuagauuuugcucaugguaucuauaaccuggauuuuauugauuaggaauaacaguggauccaaauaagaagucuacuauuaaagucacauuagcaaacaaaauaucuggauuggccuuucuuuuuguaaaaauauaacucugauucaaauauaaagguugugucuucaaaaauaccaaaauuuacaucaucucuuuucuuuuggucauagauauacuuccaaggaccucucgggcaauuuuggcugaauaucuuuaacccaucccuguaagcaucuaauggugccaacagcuguuuauaucugaaagcacaauguagcaacaguggagaaccauuuucagcugagcccacaauagaggcgggugguugaugauagguagcauugugaggcauuuggcuguggggugacagcucauccuuagcacuccuggguuaguuuguucuuccuauuguucccaagugggcgugaggauugcagagugagagguguaccuuccucuguagcgacggugaugucauccuuuugaaggaugcuuugagaugauccgcauaauugaaacuauacugcuuuauuauaauauuuuaaucucauuucaugucccaaggggcuaucuguccacugguuucuucuuguaccgaugcggcacaaguuugcaacggcuugaauaccgaggggggccagauuacaaagagaucaaacauuuaaugggaucacugcucccugcugaugagauaagucuguuucaaagaaugcaaacaucuauccauugcuucuugcacaauguucccugugcugguagcccaucacagucuaugucuauauauucugauaggucacagaaaucuugguuuugugcuuucucuccagauacuuuuagcauugagggcacaugguuuccuuuaugcuuuuguuuugaccaaugguuaccugagcauccuggaaucagucccugagugcuucccaggagccugugauucuccagcauuacccaguaaguucuauacacuucagucuuaucccugucuagggagccacgaauuacgaaacaccaguggucgguacaaggaucugaacuuccgaguucuagauucaggcacucuaggcacugcugcuccauggugagcgcuugcuggcauucugugaagcuuuuaucccaccagagcucaggguucaaagcagggacagaagaacauacagaguuucucaucaguaucaccagaugugcucaggauauagaaggucucauggccaaauucguguugucugcauaauacuggaguucacuaagcgguuuggucaggauggcccuuggcaauccuugggcugguagaggcauuccuaacagggaagcaaacagaguucuaugggaacuggaugcacacagcaggauauuguuagaaaguuuauuacaugcaggcuacgcugcauauugcacaucgccagccaaugugaaggauauggggagaaauagagagagguggcauccuuaugcaggagccaauugaagauaaaagugaaggcccacaucucgaccucuuguuucccacagaagucguagcaacagaguucgaggagauuuaaaugaacuuuggggcauuauuugaaacgcuucaaaauacuugaguccugcuccgaaagacuccuacgcagggcagagaaauuuccuagcaccaguggggaugcucacguuugugguuccuagcacuccuccuggcagugacuugauggacaucugcucugaaucauuuuccuucugcaaacuucagcuuuacccacaggagacgcacgcacccuuggacugguuccagcaccauuccuugcaaagauuuugaaaaauaaacaaaagcuauuaaauugccaggaagccuaaaaggcuuuuuaacaaaucagcggaaaggagaugucuggcauuuagccugcaaaaauacugagaaauccauguaccaagggaugggagcuuaugagcaaggaccugcuaagauucuuuaaaacacagaaguggaugcucacagucagcuaauggauggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauucacuggaaagagaggcccauuggacacgcaaacuuuauaugccccaguacaggggaacgccagggccaaaaaggggaaguggauggguagggaaguggggguggguggguaugggggacuuuugguauagcauuggaaauguaaaugagcuaaauaccuaauuaaaaaugggaaaaaaaaacccuauacaaaaagaaggggagagaaaaagagaaaaaaaaaacauuucuacugguacgauccauggaauuggaggcuaauaguuauaacaaaugaaaagcagcgguaacagcaauagaaccgaccagagaaaaagauacacucucuuuuauuuuaacauaaccuuucuauugaauuucacaucuugcacccugaucacacccacuuuccagugcuuccauguucacuuccccacccuugugagcuccgcccuaaaaaaaaaaaguauaaauaaaaauaaguccgauuugucuuaucuauauacucgcugagccguggucaaacucucaguggucugccccuuaaauagaauugaguccuuccccucccacaccccgccagaagccaucaauuguggagugcuaacuucagccuccauaucacuuuuaagaguuuguuuguuuguuuuuguuugguugguuuuuuugcagcuggaaggucugggugucauuuauugacagcggcuuacacuguguuuucuccccuugauugcuuccuucggagcgcuaacccacagcccucgggaaggaaaggcaaucucugagagagagggagcaggaaggcaggcgcacauguccuuguugggugugcucagucccggcaggaugcaauccuucaagcuggaaucccauuggguauuugagaaggcggaugugggggguggagaggaagucuuccacgggacucacaucucaguccaggccucuugucccguccaaguccauccagguuuuaggacuguggugggggcagcgacaagaguucuuuucgauguguucuuguuuaggcuguuugcuacuuuugggggguugccacagaagguuuccaugucccucuuucucaacugugcaucucaacugcacaaucgcuaucacagugaaagcagccuccucgcuccucauagucagccgggagcauugacugguguugaauaugcugagcaugagaucagagauaggacugggcuaaagacacagagaagaggcaguuuaggguaagaagagaaguucauguaauguacuguucuacaccacuagggaacuaagucucaaagccugguauuacucuguuggaggcauacuuuccaaagaacucagaacaacaggauuuguuacuguggcuggaaaaacaguaaguagagggauuuccaaaagaguuuguagacagacacgugggcccaugaaagugagugguagauguucaucuauuuauuuaauuauuuaugggugugauuuggaaguguauggcauacuuccuaggugccagacuuccgacaugaugaguuucauggacuuuaugccaguuaaacuuauauuuuucuuaaagaugugcuuuauagugcaugcuuaugucuaaaaauaaaauucuuaggaacaaaguuaacaauauaauauaugacccuggcaaagaaaaauuuaaaacacauugaaaaacagcucuaaauaaaucuaaugauacuauauauauauauauauauauauauauauauauauauauauauauucauauuccccauggcuccaaguauuucaugucacaaauucaaaagcauugggguuucuagaagagaaugauaaggugauuauaaauguguaaaggaccuauggauuaaaaacacugaccauauuucauuaaaguguugauaagaacuuuagacaggacagagacaaacaacuacuacuauccugcuagagaaacagccauaaguugucuccuaaugauauuuugcuauacuuacaggucuugcucagccaucaucagagaagcuuccuccagcagcagaugggaauaaauacagagacucacagucagacaauaugcagagagugagagaccuuggaacacucagccauaaaagggaugucuccaucaaguccugcuccucugagcucagggaacucuguggaagaagcagcagaaagaguguaagaggcagaggggauggcggacaccgaaguaucaagaccuagagauaccauggcuggcacacauaugagcucacagagacugaccagcaugcacagggcuuccauuaguaugcauuagguuacaccccauagccagaaggagaagacauaugccccuguccuuaaccaagaagcuaucuccaaucgauagccacucccaaaugaaaaguuaauuuucuccaagagagucucacuguaguuacaaacuacuuuuaagggucagaccccauguccaguagcagauggccaacacaaaauaaauucaguggcaucuuuggaggguuuucuugucucauaauguuaagcucagacauuauuuuuuucuaccauuuaaguccuuuguguauacguuaugguuucuggcuuuuacaggauucuuguguaugcaaaugugugugucacugcuccuacauguauuuuuugcacuuuucauuuggcucuuuuucuugucuguuuuuuucauauucuuauauuuuuuuuuacuuguuucuuuuucuuuuaacuuauucuuuagaugccuguuuuauuuuuuccuaagagagacagaaagggugugagucuggcugggagucggggugaggagaaacuugaaggauuaggggaaggauacaauagucagauuacaguguauaauguguuauauuuucaauaaaauaacaaaa

SEQ ID NO: 7947 - RNA, 816 nt, Mus musculus
ccuccaugccagugcuucuucacauuaagacuccaagaaugaccguuucccgcgggaaagagagcagccgaacgccaaacaucagcacaaacagaagguguuggagagacuccuuaggauccggagacgguaagauaacacaacaugucaggaaacacuggcacuucaagaaacgacuggguguugaaagaaacgcccuagaaacggaaccgguuagagcaaaaagcuggggggugggggugggggggagggcuguuucggaaacacugugcaaucuguaauucuaaagcucccgagggagggguuaguaagguuaaucccaucguuuuuuuaucucccucccccacagggcggugaaauaucuaagagggccucugagguagcugguuaaaaugcagccgcugcacagccaaagccggaacugucagggaacugaagcccccuggcccugaaccaaaucccggcacaggaaagccaggcuguuucuuacaggaaaccccauccagcgaaugcccacugcugccagugccugugcgcaccccggagacgcaucagacaaccagcaaaaccaggcccauuggacuucacagaucucuccuggugcagccgguucggaaccuuguggaguuggcugccugcccggugcggauggaucacuugggucugggucuggggucuggggucuggggucugggucugucugggucuggguugguugguugccuccacacuuggacauuucuggugcaggaguucaugagcucacagguacagucccugaaaacuacauugccaaggguuauaacagaucagaaa

SEQ ID NO: 7948 - RNA, 816 nt, Mus musculus
uuucugaucuguuauaacccuuggcaauguaguuuucagggacuguaccugugagcucaugaacuccugcaccagaaauguccaaguguggaggcaaccaaccaacccagacccagacagacccagaccccagaccccagaccccagacccagacccaagugauccauccgcaccgggcaggcagccaacuccacaagguuccgaaccggcugcaccaggagagaucugugaaguccaaugggccugguuuugcugguugucugaugcgucuccggggugcgcacaggcacuggcagcagugggcauucgcuggaugggguuuccuguaagaaacagccuggcuuuccugugccgggauuugguucagggccagggggcuucaguucccugacaguuccggcuuuggcugugcagcggcugcauuuuaaccagcuaccucagaggcccucuuagauauuucaccgcccugugggggagggagauaaaaaaacgaugggauuaaccuuacuaaccccucccucgggagcuuuagaauuacagauugcacaguguuuccgaaacagcccucccccccacccccaccccccagcuuuuugcucuaaccgguuccguuucuagggcguuucuuucaacacccagucguuucuugaagugccaguguuuccugacauguuguguuaucuuaccgucuccggauccuaaggagucucuccaacaccuucuguuugugcugauguuuggcguucggcugcucucuuucccgcgggaaacggucauucuuggagucuuaaugugaagaagcacuggcauggagg

SEQ ID NO: 7949 - RNA, 12240 nt, Mus musculus
auuccacaacugcauuugguacaguaagauuuuauuugaauauuuacaaaauaaauauuuuaaucacuaaguucuucuucaucacugaaguaugcacuuuucuuuauccuuggucgucuggaaucaucugaggucgagggacccccuggguugggucuccauuugcuuugcucuucuucaaucuuggccugcuggaauaugauucagaagcagaauaaaaccaguuauuuauggcauaucauguuaauucaaaagaauuacguuaccauggaaaauuaccagaacacaaauaauucccacccuccuggccacacugacaaauuuggucccccaucgcagcccuacucaaaauuaucguaggguuuuucuucuucccugagagagaaguauugaacucccuauguaggaugaccuugggcugcguuccuaccccaggccuaugcagugcuagagaauaaaaccagggcuuugugcaugcuaccaacuaaacugaacuccuaccucagcccccuuuucuguccuguccuguucuguucugacagaguucuacuacguagcuuaugcuggccuggcacuuauugggcaucccaggcuaggccugagcucaugaccuccugcgucagccuucucagguaagaagacaagugugcgaggugaucggcuccagucuacgcaaggaucuuucuagguuaugcuaaagaaucuuaaacuuuuaauuuaaacauuaauuucauuucugagaucauauuguucagccuggccuugaacugauuucuaccucaaaugugcugggauuacagacacgugauaacauauccaguuaaaucaauaccucugcccaauuuuguaaugaagacagauuaauaacacacuaaaaguacgugggaccuuacaguccagaaagacaaauuacaauguuucauucacagaucuuaguauaaugugcugccucaaaggcacgaggugagagggaacagaaucccacugcagacgaucagugauaaaacccgugcacuacaggccagccuggucuacagagugaguagaccacaaagaacaugaaguacaucacggugccccguguuacaauuuauucaaucucugagacaggguuucuguaguccaggcuaggcuaaccugucaucuucucgagucaagugcucaguuuacagguauggaccaguguacucacuauauccccuccuuuuucugagacacaguaucccugggcuggucuugauuuacucagcuccagugguuccccacuucagccuccuggguagguaguuuaaaggcuguagcugugcucacuuaaaacaaaccaagagaaagacuaagcugcacaccguggcacaccauuuccuuucuuccugcccucuguccucugcuuuucuagugcugcagacccagccugccaggcauguggucauugcugagcaguguccccagaccccaguccuccagagccaguaugucaguaccuggaacgcuauggccugacucagacuguccagagccggguccucuccuuccucuucacucacuucuacuuccucacuagaucagcaaagagagaaaauccagauuuggucagcuggcaggaaaaaggcacacagcacagcaccucggggagugagacagacauacguacauuucuucuuccgguucagggaguuuccuuuucuucuucuucucuuucuucuuuggaggcucacgcucgccaagcauguuuuuaggacaggcauaacuuaaguguccacuuuccuuuuguuuugcauuaaaaaacaaacaaacaaaacaaugaaccacuauaguugcuguuacugauagaaacgugcccugacccugugcaucgaaggcuagaauccaggaaacaaaacucucgcugugggaacagaggagggaacaccugcuccuuucguacagaggaggcagagcaccugcuacucuaagugcuaacaugcuacaguaauaacuagggagcaaaguagaauucucuccucaaacauuuuaaaccucaacuuuuacccuacaaaagaacuaacucucggggcgugguggcgcacgccuuuaaucccagcacuugggaggcagaggcagguggauuucugaguucgaggccagccuggucuacagagugaguuccaggacagccaggacuacacagagaaacccugucuugaaaaaccaaaacaaacaaacaaacaaaaaagaacuaacucuaaguguuucaucaacacggacauaaauucuagauuagccugauaaauagggauaagauuauuucuacccaccuguaagaugcugcugaauauucagcucugaaaauaaguggauguuggggagacagcucagugacagagucccugcccugcaggaccggggcccgggcuugagcucugucuagcccuauacaacauuucucuuucuuucuguacaucaacucacuaaacuacaugcaauaguauuauguuaacucauguaggagagacuaagccaagacuucaacagaagaaaaaaaaauaugucccaaugccuuacauaaccuguacuuguacuuggcauaugacagaauccaagagguaccauuuacuguuaauuuacuauggagagaauucuauuguguuuugaaauaauaguaacaaaagauguuaacaccaucacuaaaggaaaagguuaguaguaaaauuauuuugggagaaaaucuggauauauaaauguaagcagauuuuuuuuuuuuuuuuuuuuuaggggcaaaguaggcguguaaagguagcucagcugcuguagugcugccuggagcacgggaucugacuccccuacaacauguaaucccagcacucuggugugggagaggagagguuuaaagccauguucugcuacguaacaaguuuaagacuggucuaugcuagcggcauugucuuuaagaaaaaaaaaaaaguauuggcccugcugugguggcacacgccuuugauaccagaacucggaagacacaggcuggcauauuuuucugaauuugaggccagucuagucuaccaguggguuucaggucagcuaagguuacauacuaagauaaaguaaauaaacaaaaacccccaaauaauuaacaacaaaauauguaaagcaugacaauaacaucugucugaauugauaaaccaagagaauaacucucagacgaucuguacucacuguaaacauggagaguagguaaggucuuaaauaaacagaucuaauggagauagagucucccuguuguacucacuauaaacauggagaguagcuaaggucuuaaauaaacagaucuaauggagauagagucucccuguuguacucacuauaaacauggacagaguagguaaggucuuaaauaaacagaucuaauggagauagagucucccuguggccucagcuagccuagaacucaguacguagcucagagccuccugacagcuggacuccaugcuaagggccuccuggcaccagacucugugccugugcuacuuugcacagccaccacuucuuucacaaacauaacuuaggacuuuacaauaguuucaaaguaauuuucaacaggauucagacaguaugaacugaccacauuaguaugugcacaaaacacauuugcuuccuuucuaguccucauacccaucuacaauguaucuugucuuggggaacagagauaaaaggcggcagcuggagaaaggagauugucaugugaaggagaaugcuuccauaggcucauguacuugcauacuugguccggaauugguguaacugauugggaaggacccgaaaauguggcuuauuggaggaggggugucacugggaguggguuucagguuuccaaaggcuggcaccaaccuccgugugcccccuugcuguuuccaguuucugguccuuuugugagcucucggcugcugcuccagugccaugcgugccaugccugcuugccugccugcuaccaugcucccaucaggaagguggugagcuccuagacuucuagaaaugaaagccccaaaucaacucuuccuuuguaagcugccuuggccaugguguuuaucacagaaauagagaaguaaaugaugucaucucuacccugcuacuuuguagcuaugacaaggucugucuggcagaaauagccucucugucucuccacuuauacuuuuggaccugguguucaaguuuuaugcagacauuuuaaggaacuaacagcuaugagacuuagagugaacuuuucuugguauuaaaaacaagaacagguguggcugcuuagaaggucaagaagggagaaucacuccaggcuauggguucaauaccagccuuggaagcauucugcaauccugucccaacaauaacuacgagaagcucagucuguuaucuuauggagggugggccauacgaucacauugauggugaaccccgaugacuaaacccuugcagagacaacaacaaaacucaugcaaugucugcuaacagaaauuuaugcuuuacuuaaaaccuuccaagacauuaagaugaauaauuagccuuaugguuuuagaaaacaguuuugagggcuuauacacuauggaacuuagugugcaucaccuaccuaugcuuugugauacugaggaugaacccguaucuucaggcacucucccuggcacucagcuacgcccauaaucccacuccaaguuucuuuagauacuauucuuucucuuuauuauuguuguguguagacaugcauguaccacacauucgugcguaagguuguugcaguuugcaugucaucagcuuagcccgagguucagacagagccuccuguuaaaaagguguaagugacagaacaggcagaccaucuggaguccuguguccugugccuguccgaguguuccccacauaccccacuggugggcaucaaagaugaguaacaccaagaaaaccuuauacuguagcagaguucuggguuuacucaccccacauucauaacacuuagauuuaucaaaguaguuucgucuccggaugaacucagcugcucuuccauugucaauagcgaugcucgccuuuaucacucuaccaaauaacugagucagagaaagauguaaaugcacagacagggucauagucaccaaguccuagucaucagauacuguuuccucauuucuuguuguaguaacaagaauucuaugcugcaauuuucucuuaagguucuuccagcauuuugauaauccaguacaaugcugauaucuuuucuccaaaaggccugaauuacuccugaauuacagaaauuaaucaaacuuggugaucucccgcagccccagcuuuugugugaugaacacagagacuucuggguaaaccuugauuaaaugaauggcuuaccuguuuauuauuuauugcucuggugcaguuuaaggcagagucuuuauccaaaaacaaaauaaaugcaacaccuuuacucuuccuaguaucuuugucuuucauuauaguaacccuuaaagcacaaacaaagaaccaguuacaaauaagauaaaacaacuaacuacucaggaaacucaacauguuuuuguaagguuaaauaaugaggccuuugacaugagaaauaaaaaagaugccuagugguggcugcuugugaccccagcacucagcagggggagauggaagggacuguagaccacggucauccucggcuagagagcuugagaccagccuaggcuaugaaauccugcugaagagagagacugauuuaaaccaccuaguucuucaaaguccuggggaucaaggagaaaugagaaagcaacgaugacagagcagaggagcacagccagaacugggagcuaaccaaccagagcuucaaaggguccaagcaagagacagagugaugcagcugacagcaagugcauauuaaagcacaccuccucuucccuacuaacgccugcccugcaaacccaaagcauaaacugagguauucucauguauacaaaaaacaaaaugauuuuguuuuuucaaguuuuagauccaagugugucugucuaagaaucucuaguagugguccuuagcccugucugagugcucuugugucacacagcuaucgccaagaacgucauuuaguguaauuuagaagaacaaagcuugacccuggugugguggcacaugcuuaccaugccgaggcagaaucauuguaccaagcugaagguuagcuucaagcaaguagugagacucuaucucauuugagauuucuauuuuaugugcuugaauauuuugccugcauguauaucuguacauauaugaaguuccugaguacuaggugcccugggaacuagaauuacagccaauuguuagcugacaaugggugcuuggaauugaaccuggguacuauggaaaagcagucaguguucucaauggcugagcuguaugcccagccugagaucacaucuuaaaaaauaaagcagcugggugugguggcgcaugccuuuaaucccagcacucgggaggcagaggcaggcagauuucugaguucgaggacagccuggguuauacagagaaacccugucucgaaaaacuaaaccaaaccaaaccaaaaaacaaaacaaaacaaaacaacacaacaacaacaaaaaccaaaguaaacuaaugucuugcugaucucuuugggggaaaaaaagguuaauucugugucuggagcagggugaaggugauaagaccuugaacuuaauguuacaugaaagaaauuaaacaaaacaugaacuuaacauacagaagcccacaagucaguacccaccagccaacuacaagacaauuagaacacacagauaagauaguaccaaguuaugaaauauggagaaagcacuugcaagucuacaucagccauaaaaacaagaagggagccaagagaugacuggauacagagcaaauguggagugagugagaaaaccaccaucuuaacaagcacggcaaagacugggucaggaaagagccagcagcgugcgguaaaugaaaaccagguuccuguggagcagagcaccuguauugccccaaacaugguuuauaauugcuaaaggagaauaaagaacaaagugaagaauccagucauccaaacucucaguaguggaugaaggugucucagggaugggacucugaacaggccauaccauuguccucugguaagucuaugaaccaggaagacauggucagcaucuaagcaaggcaaaauacuaguuaaagagaacagguggccuagaguggaccauguacccgaggggaaaagguuaucuagaacugauuccaguaccucaacugacagaacaggcuagaggacuggcucaauaaaagcuuccaaaauaaaucaugcaguuguuaacuuacuguauuauauaaaauguaccguuuuaaacacauuucaguguguaaauauaaaggagaaugaaguuugaaacucauaaaaacgguguguacacaaaaugcauauauucacacagucaggacagugcaagcuacagagcaaguggaaggggaacgugggugaagaaaucuuucuguaggaacggggcaacagggcuuugcugucagagcaugaggacuugaguuugaucuccagcaccccuccccccaaaaucugggcaugguuguacuugccuguccccucauucuggacaggcagaaacugggggaucccgggagcuccguggcaggccuaacaagagacggugagcuucagugagaagccccaucuugagggaguaaggugccgagaaguagcucaggauaccugaugcgcacucccccacccccaucuucucuacaugcauaugccaggggugugcacacaaaaccaaaaaugggcggggguaguuaauggcagugcugcucaaccucccuaacacugugccccuuuaauuuauaguuccuuauguuguggugaccccaaccauacauuuuuuugguugcugauacuucauagcuguaauuuugacauugucaugaauuguaaauuuuuuggacauagagguuugcuaaaggggcugugaccuauagguugagaaucucugcauuagauacuuuguuuuuauuacuaagguaaaaaaaaaaacucuaaaccuagcuacauguguucuuguuaacuuuaaaaccacuaccucuggacuccagcauugaguacugugaauguuacagaaagaagacagaagcauaagcacccgcagggaaagcucagucugcugauggacacucuguaaaccaguuacacgggucuguccuuagagagcucuucucugggggaaaaaucacagcaagaacuuaaagaagggcuggagagauggcucagugguuaagagcacuggucgcucuuccagagguccugaguucaauucccagcaaccacaugguggcucacaaccaucuguaaugggauccaaugcacucuucuaguguugugucugaagacagugacaguguacucacauacauaaaauaaauaaauaaaucuuaaaaaaaaaaaagaccuuaaagaaaacaaacccaugacacccuccauucuacuggcaugcaaaaagacagaguggcacuguguucagaugcagggcgugaagggcucacuuaugcuacuccucugaguagacacuaucccaagaaccguagaccauccugacacagacuuccugugcauccaguccuuauguauaccuagcaaaauccacuuggcucccaaauggucucucaaggaucaaaagccuuucuaucugacuguccuguucuaaguuucuucccuggugcaguuacagauuucagucuagccacgucaauuugcucucaucucaauuggccgagaauaacaugaaauugguacacagcauagggaguuaucuggagcuaaugaagacuguagcacagucugacagauucgauuaguccugaagaugcgccccaaggauuuuuaacacggugcuguagcuacugcuuuaaaaccacaaaugggcuugaaaucacagagcuucuuagucaggaguuacgacuggguucacugucagucucuccguaguuugggggauagcucauuauacacaugucaacggagguuaagaacaguucaagggcuaacauaccagguggcaaacagguggcaugucuacagccagaucagagguuuggcuacagauauucuuugacacggcuuggcagcacuaugagcaccaagauaaugucccucagguaagacugucccccuagacauuucccaguaagcuugacaccacacaagaacuagcucugaaaaccuucaggggcuuaauagguaguuuagagauuaagaguauggcuaguaugucucaggcucugagacuguuucucagcacuguaaaagcaauacuauuaaacuaguaaauccuuauaguacacggucacuuaugauuugaaaacugucaaauguuuauguacaugggaaaauaacugaacuauauguaaaaauguuaacaauagaaucuuuauucaaccaaguauuuuguaaugugaauacuuacuuuacaacuuugccauacuuggaaaauaucugaaauaaaagaucacagaauaauuauaauuuaaaaugucaccaaauuaaauacucagauuguauuuacugaccagauucuuuguuauauuuuaugaaacacuccagccauuagcagccuauacaaccgacuuucuaacaaauaucgcuauaccugggggacugaggaggaggaccacgacacagggcaacacagcaagacacugauucaccaagccaaagaaacauuuucuaagugacuagaauaauacaguuacuggaguuacaagcuucaguuccuaacucccuccagggaguagaugggggugggggaccacucagcaugucuagauccauggccuauacacuaggcagcagcuggacuucugauccaauggaucuguggggccaacaaacccaccauagcuccagcugguccuguccuuuuauuaucaguguugucaaauaaaaccauaccagugaguuacacaaucugccaucugaggacagacagaacucucacugcagauaauacuuuccuauaaugaaaaaaaaagcuuccuguaaugaaaaacccaucugcagccagcagugauggucuauggcugcaauccugguuuucagaagagcaaagcaagaagguuugagacgagcccaggcuacaaaacaagacuugaugccaaagaucaaaaacaaagcaaagauccuucuacuucuaucggugggugcagaacucuuccauccuuacuuaguauucuggccucgucuuccuuuuacuucuacauauaguugcccauauauugcccagaucuauauucuauagauauauacauaucuauaugcuuauaauucugacuaauuauuuaauacacagaaauaacacccucccccaaaggcuuuuagaagaucccaucauaugcagucuaauauugaaauugugggccagacauuuagcaacauuggauuccgagguccagcaguuuccuaugggauuauagcuuucuaacggguucuccauugauuccuuaguucaugugguacuagggaaucaacacaggguuuugugcacgcaagacaagcauccuaccaacuauacuucaccuccagcccccagguauguuuuaaauaagguuauuucuuaucauucagucuaaaaucucaccuccaagccuaauucaguaucucuuuucucuuucgugagauggggucuaaauuguccaagcugaucuuccuaccucagcuuccccugugcugggguuacaggugugugauaacuacucuaggcaaguguuccaccacucaaguacaggcggcagaggaaggcagaucucugaguucuaugauagccuguucuacagagugaguucuaggccagucaggcacagagaaacccugccucgaaaaaacacacaaacaacaaauucucuuugggaaauuaaaacaaaauugaaaaauuucccacuaaaauuugcagaagauaucaacuaaaaauuuucccagggagcaguauuuuugcuuaagcuucagauugucucuaaagaaagaauccauuaguuagauguacauacaacuuacccgguauaaaucauuguuuguuagggagaaaggcaaguuggauacauaaacugugcuuuuacuuggcgccaagccaccgcucauuucuaaaacggaaaaaaaggagacauugggaaucuuacuccaaguagaaccaaacaaggaccaucacugacuuaauuaggguagaauuccucaggcuccauucauuuaaagagauuagaguaccaguguggguagggugugaauuaccauauuccuuuucuagcagcggguguuaagccuuuuagggcugcggugcgauugaagagggguuuuagagagauggagaagccacaaggcuauuuuuaacgccuucuuaggguaaaagcggaaaagauguuucccaaggauucgcccaccuccgaaagggacaccugucuaccccgccucuuuuguucuuguuuuuaaaaaaacuccuguaucuacgucuguauauauggauuacugauauagguaggccaugacgacagagacucgguuuuguuaagcuugggguaguuucacauuuugauaaaguucuuuagauuuuuaaauuucgugcacaaccaaaucaugaaaugacacucuauuacauggauuaccuacuuugaaugggacauuaaccuguauauuuaucaaugugcuuaguaaucaacgucacuguuaaaacucugcaaauuacaggugaaacgaucgcgucggucggcagcaaguguuaagaaccccuaugaaugacaauggacccggcaccccggagggcgccccgcuggcccaguaggaggauuauucaaaaagccuuagcuagccaaaaccugcuugucgcguuuccaguuucucacucugagaaaugcuaaccccggcuggacguuccuggggccggagcuggggucagggucgaggccgaggccgaggccgaggccgaggccgaggcggaggccgaggcggaggcccgggccgcggccgucuccugggcccggcgccgugggagcuuaccuucggcgcagaggcgaagcggagaggaugcgagcccgcggcggcuucaccuccggcugccuuccgcggcgcgcaaaagcgcgggcguccgcgaacgcagcgcggugcagcgcuccuuccgacucccccaaaccccgacggccccgggccggaggcuggcgcgccgggcgacg

SEQ ID NO: 7950 - RNA, 93567 nt, Mus musculus
cggaagugccuuuagggcgagcggacgucuggcuucgcggguuucaccggcggcugaggcggcggcgacagaggcggcggcgacagaggcggaggcucagcagugggacguaggugagcgaguggcucuccgcagaggcgcgaggggcgcaugcggccggcgggcgggcgggcggacguuuccugcggcgauggagaugugcuuuauucuggacuccuaguggaaccuggagagggacucaguggaugcgggaggaaagcgaaguguggaggagagugagacccagguuccgcuucucggcaggaguuuaguaagcaaaaggggaguucucagccaggcaacuucagugacgccaggucagucaggaagucuggguuuuuaucuuauuuuuuauuuuuuggaccuaaccgacucuguaauaggcacuuugagagacggacaaaagagugccaaaauaauccacuugcuguugagaaugucaguguggccggggagacaaagcccacguggggacaguuggagucacacagugacccauucuugaguacuggcacggacagauguucagcuccaucgucccguuguuuauuacuauuuuuuccuuucugaaaauauggaauggguacgcacugauuauuuuuuuguuuuccgagacaggguuucucuguguagcccuggcuguccuggaacucgcucuguagaccaggcuggccucgaacucagagaucccgcccgccucgccuccagagugcagggauuaaaggcgugcaccaucaccgcccggcuacacugauuauucuuuaagagcucgucguuucuacagagaaauccgaaugcuuauuuugcccgguaguuuaaacuuaacuucuacccaccagcacguacagaccaggccuguaacuacucccugggaaccugcgugucagcagcccggagcccagagccugucguggagccugcacaaucaauccugacugaagcggagggacgaagugcaauccacccagggcgccgcugaguuuugagaggcauuaauuccuuggcguccaccaagggaccacugggacuaauucucauggcaaacuuguggccagcccaaacucccaggcuucacaucccgguugugcuugguuaucgcccacgauguaagccccuuuggucuucuaauuguuugagccuuaacucuccgcgcuguuucgugcuuccucucgauuuggggguaccacugcuucuccuuccuuaguucacccugagcgcaucgucugugcuccuggaaucuuauuuugucugcuuagcaaacacuuauuagccuuguuuugaaacugucuugcguuuucugacucuuuaacaaagcuguggcuuuugccuuuaaauugaacuuuuuuuuuuuccccugacaucuggguuuuaagauuugguguugcuccaucuguaucgaauugauugcauuuccuugauuuuuuuuuucuuucaguuuuuguucucauuuuuccuuuugguccuaugauuucccugccuucuaccucuuucuauuaauauaauccccauccccuaccccccauccccccaagcagggccuagaacuggugauucucuuguuuugccucagcccuccuacguucugauuacuggccuuccucgggcuuagcccagcucuuauuuuugaguagucuuucccuaaguucccaaaguuagguucuucuaagcccccuccagcaggagccaauugcuuccugauugugucuuucaucuugaauuuaaauuaaacgcugagggugggaguguuuguuuugcuuauccuuggaaugcugcugcuguuugccguuuuuagagguuuuagguagugagugaguggguggcaggauccggucaggucaucagcuacuuaggaacaacaaauggcacauggguaguuuguguggagugauuucaauguugcuaggucaugcagucuauucaagaaauaguucaaauacagccccccccccccccccguaaauugucucaaauuaaacagagaucugccugcuucugucucucaagugauugaagguguguccuauacccacucaaauacuacuaacccccccccccccccaucucagccuuuugucuguguagcaucuggcuguccuagaacucauuuuguagaccaggcuggccuggccuuaaacucagagauccaacugccucugccucccagguguugagacuaaagguuuauauuaugccaaacacaagguuuauauuucagauuuuuaaguguuuuuucagauaaaagucacacguugccuauuaauuacuacuuuuagaucuuuuagguguugggacagucuggugauguguuuuuagagaguaacagcuuugugaacugagccauggguauggauggaaauugaaagagaauaggaagacuuuggagagauccaggcuagccaguguggggcuugagacacagguaaugcuuuuugccuggaauagguuaggugagacaauuaccagagacuguggaggguagagaagucugaacuuaggauuucuacgauucuugauuaaggaagucacucaucacgaauauacacuggcaacugcuugauucuuuguauucugugagauggagggugaggcagggaaagcaugcucaucagauaagauuuuaaguucuaccgaugugaagguuuggauucauaaauauuaaaacacagguaagugucuggcauugucugcucauauaauuuuaucacaugcaauggacagucaaacuuccucaguauguaguacaauacauuggggaucauaaaagaaacaauuuaagcauguuguugacaugaaaauaccucauuguggauuaguguuuauucuggagccaagugguaguuaguguggucuggaaacacagauuccagguacugcaaauaauuccauguccuaauacggcaacaguuucaugaagguuuuguuuguuguuugcuuguuguuggguuucucuguguagcccuggcuggccuggaacucacucuguagaccaggcuggccucgaacucagaaauucgccugccucugccucccaagugcugggauuaaaggcaugcaccaccaugcccggcucgugaaguuuuuauaguaacagcaaagaaagucauaauuggaggcauuuuaaacuaaguuguuagaaacaucagguagccaggcucauugcagccaagcuggagagcucagcuauugucuuuagcuugauugguaucugacagcacucugagccguuugguugguggaagccaguggucugucaaacguauacuuuugaaaugguuccuguuagucacaaggcuguuggaucaaacacagauaggaaaggaaugucuuauuggagggcuaagauagccuguaguaaguuguaauugggccucagggcuuugacauucccaacucuacucuaauagauuaaucagcauuucuggaggugcagugugacuagaauucuuucauuccuguugccacguguuacauuugugagugugaaggccacauauugcuuauuaaguauuaguaauggcuccggucauuccuuuguaggaugugacguagguggggcugaguaguaugcaggagagcagacuugaggggaaauagcucugacagccaugaaggaaugaacucucugauugguuggucuucagacucugcuagcuguuaggaucccagccuggcucuuccuuuaccguuccucucacugugauggaacaugacaucacaguuaugauggaguaauaugcccaagguuauaaucaagaacaguucacauaauguagguggagggugagggggaauguaguuuaaaccagcugaaauuacauuguuuaaaaacuagauuaacuuugucuuguuguauuuacaaugaaugcauuguaugucagauccuacaaaugcaccaugaauuaguuucauuuuuccuuuggaguauguaaucaaauuauuuucuuaauucuggugcuuugguuuauuuaauucuuuauaacuuuguguggaaugguuagagcuaauucuuuguaaaguuggucuuugguaucuagacuauuauaacuuacuguucuuuaagucuggcaugcugcaaaaguauuggcacuauuuuuuuuuuuuuaaagaucuguuuacuuuauucauauaaguacccuguagcuguuuucagacacaccagaagaaggcgucagauccuaucacagaugguggugagccaccaugugguugcuagggaauuguauucuagggccucucuaagggcaguccaucuggaagggcgcucuuaaccacugagccuucucucuacccgaaguucucacucuuaguuguagaaaguaacuugcuuugcuuuaucgucuagguaguaagcagguuuuaguuuggggaaauaaaguuguauuacagaauaaaucacauaaaacaguauuguauucuuuuagaccagaugcuuucaggguaauauuuuuuaaaguuuuuuguaguauuuuaaguuuuaacaaaauugaccauauggugggacacaccuuuaauccuagcacucuggaagcagaagcacacagaucugagugugaggcuagacugauauuuuuaucuuacuagucagaaagggaaauuggaaucauucugauauucuuuauauuuuaacuuuccaucggguaauuuuaaaaaguugcuucucucugcuguggcuuuggagauggaacucggcucacuaguuugguagcaaguaccuuuacuuaaugagcuagcucaccucugaacuucauggguaaaauaugaauuaaauuguauuuuaaaaauaaauauuuguuuuggguggugguguugcacaacuuuaaucccagcacucaggaggcagaagcagguggauuucugaguucgaggccagccuggucuacaagagugaaguuccaggacagccagggcuacacagagaaacccugucucaaaaaacaaaaaccaaccaaacaaaaguaacaaauaucuuuaauccuggguaguuguauuauaggacacuuaaaguauaaauaccauguaauuucacucaacauacuguaucccaaccuccauuauuacugaugcucuaaucaaugagccuuucagaggcccagucacuauuuaaagcauuuguuuauuaaagauuuuauuauuuuguuuuugguuuuuuuuuuguuuuuuuuuuuuuuuggguuuuuugagacagaguuucucuauauagccuuggcuguccuggaacucacucuguagaccaggcuggcuucgaacucagagauucgccugccucugccucccgagugcugggauuaaaggcaugcgccaccacgcauggcuagauuuuauuauauguguauggguauuuugcauauacuuacacauauacauguucauguacauguacauaaacauacaccugaugcucacagaagucagaaggcaucaaucggcucuugggacugggacaauagaauguuaacuaccauguggguucuagggaaccaaaccuggguccuuuacaagagcaaaaacaaugcuuuuacuggaagcuggcuuuaaacaaguaucuccugccucugcuucuagaguucuuggauuacagacacgcacuaccacaccuggccuaaccuguaugcauaaagugacucacaauaguaagagugaaguacuuuaaaggcgcuacguugcgggaguucagggaugugcauaaugagacccaagccaaccagggcuacuuagugaaacacucaaacugcugccccuuuauuccuaaccuauguaauuuguuaugaaagccauccaugcucuucuugcuccugccuucucuagcuuuauaaaaggaccuucuuucccuuuuguucccaguguuaaaaaccuugucuagauguccuggagccuguucucugcuugcuugcuugcuugcuugcuugcuugcuucuuaugugauaguuggaaaggguugagaugggacuccaggucaacuuuggaauuucagguuuugaaagcuucaggguuuuuauguaggaguaggagauuauaucucuaucauuaggauagugugaauaaaggguuuaaaugucuugaaaauguguuacccaaauuauuucauuuaggggagagcaaaugaaaguuugcuagcuaccugccuaggguggguuuauuuacuguugcuuuguggucuccuuugucaggccuuucagaaucacuccuaaugcuuugcccuuugccuggagucauccaucacucaggauucuaguuaaucaacgagguuuuuugguuuugauuuuugcuuuagcuuucuuaaaaguuuucucacauagcauacucuuuuuuuuuacacuacuuuggaguccuaguuggacucauucacagagcugagauucaaggggaccucacccacgcccacacccaccccacccacacacagcauacucuugagugccaaguaagccacaguucuaguugagauuuuggugcuuugacuguuuaauugagaucaaugcaguuuuuuucaaagacuuaaaguuuauucuagaaaaugauuugugguuuacuuguuugacauuggaaacauuuucugcuagaagcagcaugacaguuuuuagcuucagguuagcccuuaacaucucuuagagcuucaguguugauuucaggaguagacuugcuucacuuuaaucuguugaucuuggccugagauggccuuaagaugagcaagcaguuaacuccucccaagggcauuuuggagacugcaaagguaggaccuggauaguguuguuucuuacaauucuuggauagugcuggugucugacaauugaaauucacuugguuuugcuggauuuaaagguuucuuuuguguuauuuuguguuaaaagugaaguggaauugauggcuuuaaaaagcguggcuagaaucauaacugucucacaagaaguuuucugaacaauucaaggugccaaccacuuguuacuuguugauaaaaaauacuuuuccuccgcuaagacagaggagcaguguagguauuuagucauugugcuuucccccggaggauguggaggaagaaggaaggagagccggcaggacucgagacugucuacuaguucuguagaguguucuagagggcacagaggaugacuagcuuccuuccuugggaaaauacuaggguggcauuugggcugaguccugaacauaagcugauggugcagagauucuugugcuuuguugaagaguagauguuaaggcaugaucagugaugcguuuuaguaguuaaguuucugaucugacucuuuggguaucugccucaugggcuucacugaucaaaacggagaagacaggagcgagaugagucucugugaggcgugguuguaacuggggaaauuuggguggauuacugaucacauucuuugugcagauuguugaccuuaaugaacaucguagugguucugcuuccuguuucuagcauagugacguggugucuuucuuauugcagugagccaggcaugguggugcaugccuuuaaucccagcacuugggaggcagaggcagguggauuucugaguucgaggccagccuggucuacagagugagcuccaggacagccagggcuacacagagaaacccugucucaaauccccccauccccaaaacaaacaaacaaacuugcaaaugaccaaagcauuggggguggggguuaauuuaacuugcucuuccacaucacuauuuaucacugaaggaaaucaggaccggagcucaagcagggaggggccuggaaacaggagcugaugcagagaccauggaggagugcugcuuccuggcuugcuaccuaggauuuauucaccuugcauuuauucauuuauuuauuuauuuauuuauuuauuuagguuuuucgagacaggauuucucuguauagcccuggcuguccuggaacucacucuguagaccaggcuggccuugaacucagaaaucugccugccucugccucccaagugcugggauuaaaggugugcaccaccaguccagcaucagccugcuuucuuaucgggcccaggaccacuagcccagggauggccccacccacaaccugcuaggcuuuccuugauuuucuaauuuaagauacugcccagcaggcuugcuuacagccugaucuuauggagacaucagcaguaguaacccuaaguaagacgguaaugugcauugcauguaagucaccacacuugaugauuagcacugugaagaaaccacgccugcaggagauguuugagugacauuaaaauccucaggugagagcggagggaguuaccaagaugucuggagaguauccaagggagcugccaaugcaggugccuacugcucauccagagugugagcuuaagugggacuuggaucuucauugccucuaguuggccgacagauuaucuaggugagaguaaaccaugaaaggacuaugcagggagaggugagaaaguuugaaggggacuggaaacugucuagaucauaaugcaaguuacucgauuuccuaaacugugggacaagcaauuuggauaacauggaaaggguuguaucauuuugauuuuacauugaaaguccuugugucugguuggacacaaggucauuaacugaguuuguuuuaucagauuccuauaacuuucauuaacaaugccaguucucagucacagcucucagugacuauauugcuuauauccuggauugauuauugcauaagaguuagguuauuacauuuuggaaucaauuauuggcacacuucuaaaagaaguuuucacuuuucacauugaauucuaauucucucuguugugauacagagaauuauucuagaguacuuuuaaaaauucaaauuuuuucuuuuuguguguguguguauauguguguuauauguauaugcuugugcaugcaaaggcuagaggaauguguucuucucuuacccuucagccugucccuuucacacaggucuccuacugaacauggaggucauucaaugauccucaugucuguccccucagauacuggugcuacagguugagucacagugggcuguugucuuuuuuuuuuuuuuuuuuuuuuuuagagauuacuuauuuuuauguauaugaguacacuguugcugucuucagacacaccagaagagggcaucagauccuauuacagaugguuguuagccaccaugugguuucugggauuugaacucaggaccuaugguagagcaagucagugcucuuaacugcugagccaucucuccagccaccccccacuuuuuuuuuuuuaacuauuuuauuggguuuuuauaucucuaccuuucuuccagcccuuauuccacaccuaaucccuuccaaccccccaacacuagauaggaaagaaaguggguagaggggaaaggagccauagaacucuuuaggcuccuuacugcugauaauggauaucggguuccuuggcuaagucuaaucuugauaguuaggcuucucgauucuuuacucaugaccacuugauaaacuguaacaacagcaaccaaccgggagcauggagggggagcaguaacugcugccuucuucggagcacccuggcucucuuggggcccugacauuuauaccugcuccacaguucccagaauuaaacuauuugcagcuggcaaaaaccaggccccuccuagagcacuagaaaaucauaguuaagagccguggacaauccacaccugggacuaaagcacaaacauucauauaacauaacugggguuucaaagaacccaaaacucucaccacagugcacauccaugugggugguaggauugagugaagugagcuuucagccacugagccaucccuucuuaggcccuggaguacuuugagacuccaguaaugggagggaauagcuuaguuacaagucagcgucauugauugguugugggauagauugauuccuuaaacccaaacaaugucauaagcaacacaugcuaugaaucaaaagauuauugugcuuaagaaugcuucuaagugacuuugagaauugcagggcaccauuugaauugaaagcaauuuuagcauauuuucuauagugcuguaaucaucuuccuuuagugucugcuucuuuuugugauaauuuaauucaagauccaucuugaacaaggaauauagcugaguugcauguaugaaauggcagugucaacuugaacuuaaagaaaaaggcaaccuaaggccaggcgccagcuugguuagagaucccuauuuuauaguucacggugcuuugacuggucuuacagugauucuaauauuugagguaacuuauccuccagacuggaucaggaacaaccuggaaauauggucuccauucugcaggcugguagugucacuuccuggaaggucugugcugcaccuaagagcacagucuuuguagagagcacucuguuagccuuuggguuucaugugaagugcuaagacuuccaguacuugcacacccauucccacacccugcuuagcuaugguuacuguugcugugaugaaacaucaugaccaaaagcaaguuggggaggaaaggguuuauuuggcuuacacuuucacauuguaguccaucacuguaguccaucaaugaagaaaguugggaaccuggaggcaggagcugcugcagaggccguggaugggugcugcuuacgggcuugcuucccauggauagcucagccugcuucccuauagaacccaggaccaacaaacagcccagggauguccccacccacaauggucuggggccucccacauugaucacuaggaaauggauucuaugggggcauuuucucaauugaaguucucugcuuucagauaauucuggcuugugucaacuugacauaaagcuagccaaccuguacucuuccccuuuugagaucuuuuugagauagcgucucgcuaauguugaccagauuguccuugaacuuuugaggucaagcaguccucccaugaagacaagacaagccuguaacacagggcccacuuuagguuuuuuauccuugucagauucaauccuuuuucauuacaggcccccuucuuccuccuccuccucccccuccuccuccucuucuuccucuucauuuuacauuaucaugcuugauuauucacuuagggucucauauagucuaagcuggccuggaaacuuuuucccucuuccuccuucgcccucccccucaccucucuuccuguuucaagacaggguuucucuguguagcucuggcuguccuagaacucauccuguagaccaggcuggccucagacucaagagaucuuccugccucugccuccugagugcugagauuuaaggcaugucacaccaccaaccagcucaucugauuuuuuuuuuucuggccccguuccauucauuuuuauuucauauauguggguacacugucacugucuucacacauaccagaagacaccauuggaugcccauuacagauggcugugagccaccaugugguugcugggaauugaacucaggaccuccagaagagcaguuggugcucuuaaccacugagccaucucuccagccccucaucagauuuuuaaauaugcuauauucagaacaucuuuugaauauuguauacugcuauaauucacucaggaggguuaguuguuuaagaccagaaaaaccaaaccaaaaccagagggcuugagauggccuggucagcaaagccacuucaccaagacugaugcccugaauuugaacacugguacuccaugacagaacaauuuccugcacuguccucugacuuugacacacaugcugaaauauggaugugcaugcaagccugccuacacaugauguacacauaugcaaauacauuaauacagaauuuaaacaauaaauacagaauuuaaacaauaauacagaauuuaaacaaggucaaacugcaguauugcaugcugggauauaccuguaauccuaguaccccugaaggcugagacaagacugcauuuccaggccagcuuuggcuguuucccagauuucgguccaccuugauuggagcaggcguguuggcccgcucuucaaacuguuccucaaagccuaucuuuccuaauuuaaaauggguugacaaugaggaaacugugcuuuauaggauguugggugagaaaguuuuacugaacuuuucaguaccauuugaacuagaaggaagguaggaccucaugagugcagguauacguauuuauaaguguaguugagggacacauugccuuccucccuccuugcucaccuuccugggugucuuggcaggcauuugcuucuuuauugucucuuccuugcugacaaagagaacccagaauuguuuguuucuuuuuaguggcuuccacaagagaugaaauguggucugagggacgcuaugacuacgaccgacuuccgagagaacgcgugccuccccggagccaucccaguguaagucucggcugcguggagaaaagcucagagcuugcugucacugugacuuccccagcuucuuccgguaucaguuuaccagccuaacuggaaauacaggucaaauucagcuuuuagaagccagaaaauacacagaaauuuauuuaaguaaaacacgaaaucuguauuuuauacuuguuucuaugaaaaagaauuugaacugaauuuaguugguggaggaaaauuuuuuguuaauauucuaacaugcaauagcaaagaacuguugaacaccugcuucuccuuguggcugccauuacuuugucaccuuaauguuuauaaauugagccuggcaugguggcacuugggaggcaggggcaggugggucucugaauucaaggcaagccuggucugcauagcaaguucuaguccagccuacaacaacaaaaguuaaauuaaaaauuaaaaguuaugaauuaauaugacagucauuuugccggagucuuucuggggcagaagcauguggagguccuaguuagcacuucuuguuugccugugccugaccaggcaggcagccuccaggugagaagaaugccgacagcucaagggacaauaauucggagaguuggggcuucugagccagacucuaaaugcucuugguaacuuuauuuacuagcccuggagcuguaucuaguccuguauguagcagaggcucagcguuuauuaaggggcuggagcuauucucccuggagguguacauggagaacuacguaugggggguuuggaggucaagcucaucuugaacauuggguggaauguuauguggaugucuucucuaccacaaaaggcauaaauauuuguuuaucugucaagaauuuuuuauaguguuaaggauuugaguguguggugguauuagugaggguugaauccagggcuuuucccacgcugggcaaguacuugaccacugauccaccucccaccucccuuuuguuucauuucuuauuuugagacaaagacuuacuaaauuaaauuaccuacuuuuaucuuaaacucacucugagaccuacuuguccuugugauucuucugccucagccuuucacguagcuuauaggacugugaccaggccuagcuggcaguauauuacuugauccuaucccucacuugggugagcagggucaucuucaagguuggcauucaguggccugaauuauagcucauguugagauugauagaaaaugauuuaagguagaaaggaaaaaacaaacaaacaaaugaagaaacccauuaaauuaggaagggucuacucaguacuuaucauagguccuugcuuuccugguuguuugagagucuuucuaauuauuuauuucuuuaacuugauaaauuauuuuaugacuugcauaggauuaggauuaaaaaauaaugcauguuaagugucauauagcuguggaauacuuuccaaacauuuuuuaaaaaaagauuuauuuauuuuuucaaacuuuacuuuuuuauuuuauguaugaguauacugugcuaucuucagacacaccagaagagggcaucagaucccacuacagaugguugugagccaccaugugguugcugggaauugaacucaggaccuuuggaagagcagucaguguucuuaaccgcugagccaucucuccagccccccaaaauguuucccaccaagaauauaucucuugaauagaaauuuuauuuuaccagcugggcauugaucugaaagauguguguguguguguguguguguguguguguguguuuuaacugaguagcuuaauuuauggaugugaacagcagaucuuauugacuuaagauugcgaggugcaugacuggcccaggcugauauugaagagucugacucaggaucauugagguagagugaaaugaccucauccagaagagaacugagagaacucuacauagccagaggucaaacuucagaugcuucugcuaccuccaguccagagcugcugguaaaaccugccugcucaucaguuacccgaccaaugcauuuccuggacaguacauccccaccgucuuugacaacuagucugccaauguuaugguagauggaaaaccagugaaucugggccuaugggacacagcuggacaagaagaucaugacagauugcauccccucuccuaccugcaaacagacguguucuuaauuugcuuuucccuugugaguccugcaucauuugaaaaugucuguguaaaguggucuccugaagugcgacaccacugucccaauacuccuaucauccuaguggggacgaagcuugaucuuagggaugauaaggacaccauugagaagcugaaggagaagaagcugacucccaucaccuacccgcagggguagccauggccaaagagaucggugcuguuaaauaccuggagugcucagcucucacacagcaaguacucaagacaguguuugacgaagcuauccgagcaguucucugucccccuccugucaagaagaggagagaaugccugcuguuguaaaugucggagccugucguucucgguccugucuggaaccuuuguacgcuuugcucaaaaaucagcggagccuucgcuugcaguugaugcugaguuuuuguuacagauuaauuuuuccauaaaaccauuuugaaccaaugaaccagccaauaaguuuaagguucuguuuuaaauguaagaauuccaacuuacagucuauuaaaauucagcccuaaaaugacaaagccuucuucaagccuuauuuuuaaaaucccccauucuugcucagauuaagaauugccaaaauaggucgggcgugguggcacacgcuuuuuaucccagcacucgggaggcagaggcaggcagauuucugaguucgaggccagccuggucuacagagugaguuccaggacagucaggguuacacagagaaacccugucucgaaaaaccaaaaaaaaaaaaaaaaaaaaaaaaagaauugccaaaauaaccuucugaacuaaguugcguugugcugagaacaccuaagcacuaaacucucuugagagacuucugcugcuaagaaggacugcagcuucuggagccaggucaggggugcaggcccuuccagaguccccagaccgugugacacagcacagccuccuuaaugacacguugccacguaacgcaccuguaacuuaucagcccauguucauuacguaacuuuguacuguacgucacagugaugagugugacagcucagcucuucgauuucauagugaguuuucuaaaagaccagccgacuagcuuuugcagacuuugaacagaucucugguuccuguguugccucuaaugaaguauucuguuccuaguugugggugugcuggguggagugugaaacacgacaugaucaaaggagacagacacaguauuuugacuaauaugaaguagagauuacacuacauuguacauggaguaauucaacugaauaaaagugucacgggucaaaaagaagagaaaacugagagggggagugguauaacagauggaggggggacaagggauaacagcuugaggacuaaggccguccuucugguagaaggagaggcaguugguguuuuggagcacagcggugugcuuagaauggccacauaguugauguuagguguguugagaagucacaguguuagucugagaauuagaauugaagggcagaggauguaacguaguuagugcuugccuaacauuccuggucuccugaacugauuccaaacaccucaaaaaaagggcagguggugggucagguacuaggcaguauguguuuuaucgcagccuauaauaaggucuagugcuuuaaucggagacucuuaacuguguaacugcaagcuuuuccauccaggcccaaguuccggaauagugacucagucuuguuaugaauaaaaaacuaggccauaagcuaaguuuguucgccaacuaaacuagcuuguaauuuuuccuaguuuauacuagucuaugucugccgugugguuugucaccucucccaagcccgacugccacugaacucgagugugggaucuucccacgcuugacuucccauaguuccccucucucucugcuggagagcccccuuccuagucuacccuuguuacaggccauaggcuuuuuauugauugacauguggugcuuccacacggugcacaagagaugacccccugcaggaggcaagcuagagcaguagguagcuaaauaucaagagcucgggaaagggguuugugaugaguacagugacccagcuguguggacagauggccauggcuuuuccacacagguuugguuucucuggaaaaaacaaacaaacaaacaaacaaaaaaacaaccuaccauggccaaggcaguuuacacaaggaaggguuuguuucggcuuauaguaccagaucaaaaaugacagagaaguuggcaaacaugguggcuggaauagcaagcugagagcuaaaucuuuuuuuuuuuuuuuuuaauuuuauuuuuuagagcuuuauuguagaaacacagggagaaaggagagaagguagaaaaagagagggagaagcuggccauggccauguggagagaagggggaagagagaaaggaaaggaaggcuagagaguaagagagauagaagcuuagagagagagaggagagccaaaucuuuaauuguaaggacagagcagagagaaaaaaugguccuaaaauggcagucuuuuaaacucucaacacuuacuucuagccucuuccaauaaggucacaccuuuuaagccuucccaaaaagugccaccagcuagaggcuaagcguucaaaugccugcagcugagaacacuguauucaaacugccacaccugauuugacuauacuggugauuucaguuaaugacaaagucacaggugccucuuccuguuguguugauuucuguucaggaaaaagaaaugucuuccuucuucagccucuggagaguugaacagugcuuacagucaucugcccugugaaaguaauuuuauacucaugccugauuuuaauggacacauugaaauuugcagaaaaguguuuagcagaagaaauugcaaaugcaacuguuguuucuaacauuggacuuaguuaaaaaccuacccuguauauauacaguucuaaggggcuagagagcuggcucugugauaagagcagguauugcucuuccagaggacucaauacaggugacuggaggacucaggucaggcagcucacagccaccuguauguaacuccagcuccaggagagccgauggccucugaccucuggcacuggcacuuagugaggcacacacauacacauagaaguaaaguucuaaaacccuugcuuaugaaacagaggucuucuuuuuuuaauaauuuuuauuagauauuuucuucauuuacauuucaaaugcuaucccaaaaguccccuauacccuccccucccacuuccacuucuuggcccugguguuccccuguacuggggcauauaaaguuugcaagaccaaggggccucucuucccaaugauggccgacuaggccaucaucgaaacagaggucuucuaacauuaauuuaaaaccauauugcauguuuguuuauaaacagcauugguaaggcgucaagcugucagcagccugaaugucuaacaggagaaugugugaacuguugauauaaugcacucguggacuaagaggccugccuacugccagacccagcaacuuggcugaacuuggcaaacaaaucccugaaggccagaagcuggguucaguagugugucuccaagaguuccuuuacauaaacacuucagucaagccaaaggagccagcaccguuguuauuaagaagaaacacugggagggaccccaaggacgcccagugacuugaucugggggauaacuccuuuguccaccuggggaaagcuuaucgagaagugcuuuuguaaccuacgcucugcugucuuaccagccccugucuuaguuagggagucauugcugggaagagaccccaggacugaggcaacucuucuaaaaggcaaauauuuaaauggggcuggcuuacaguuucuaccuggucuaugccuguaauccaaagguuuguuuuuuuauugcugucccacauuuucuguguccuuuuuauguuuuuaauaucuuuuucauuguuucugcuuauuugaucuagguucucuauuuuaucuuugagaccugauauucuguucugaugauuaagauuguaaggcccuuucaguuuucuaguugauuuuuuuuuuucaguucuaucuucauuuuagcuugaguccucuucaguguuucuaucucuuuauuauuccauuuuccugcccuggauugucuuugccauuucuaucagccuugucuugggcaacacucagguguuuauucuucuuaagcucuuucuccuugaucucacugagcuguuugugucuucuugaaauucuuuguguucuuccagguggcuuaugacuguucuucuaauuucaguguacugggugggguccauagguaaacguuucuacagaacuggucaguucuggagggaagauguugucuugaucuuucauauuguuaguauuuucugagaucugggcauauaggcuuuccuugucuccauauagaguguuaggucuauuauugaaggagcagggcuauggagaaggggaugcuaugguggcaugggucuggagauugagugucgcuugguuagaauguagacaggugggcagaggggacuggaguggucuauaggauguuuccuuuuccacguaggaguguggagguugauaggucugggugggaagguuagaugugauguggaaguguguaguuguuuggggguuggcuaggaggaugcuggccuacguaucuuugcagugauggcagggaaggcuagucuaugaugguaaauuacccaagaaguguacuccccaggcuggauccuaggggacggaggacgugggacgucugggaaugagugacauaaaguaggugucacaaaggagagugcauauagcaugcuuaaauuucuugacucccucuuugucuuuucuugacuccaaauuucuugauucccucugaaucacuguguuuuguguguguguguauauauacacacacacuauagcauauuuuauaauauauaucauaaauuaaggaacuagaggcaugucuaaccaugcuuaccuuguuuuggcucuuuauaaauuaaaaaaaaaaaucaaauauuuaaaaguaggcaagauaacgacucccaaaguaugugccaagaaagcagcaauugucugcuuugguuaguuguauuuuauucuucuauuucccucucuuccagguuguucuaacucauuuuaaagcuuucauguguauuaguguuuugucugcauuuguguuugugaccaugugugcauaccuggugcuuaagaucagaagaggguguuggagccccugggacaggaguacauagagacuguugagaaccacuguguguaggugcuaggaacaggacgcaggcccuuuagaauaaauagcagccuguguucuugaucacuggcucccuuuuggaggguauuuugaaguaaauccacuauucauguuucaaauauaaauaaauauuuguugugucucaaacgauaaagaugucuaaggaaggacauuacauaauauuuuaacuuuaaacagaacauuuucuauaggauggcauaguggcucaguggguaaaaguacuugcuaccaaaccugacuaccugggauccaucucuaggaaccacaugguggauuugaagaacugacuugaaaauucuccucugaccucuacaaacaaauuauggcaagcauguagaccucuuccaccauauaauaaaaauauuaaaaauaaaagccaucauguuuuugugcauucacauauauuuaaugauccauuaggaaauugguggguuuuguuuuauggauuaauguagggccuaaccccugcucuaugacuguaugcuacccuaaucucaagaaauacuaugaaauaaauguccuaagugauuucauuuggauccaguuaauuaugagauuuaauauuuguguggaaaguauaauacagaauuguguaucaaauuauucaaccauuugguugaugcuuuuacuuucuaaaaugaaaauauguuucauaguagaguuuuaaaaauuggaauauauggaaaaugaagauaauggcuuauuuuuaaaauugauuuauuuauuguaugcaugcuaaggcaccuguaguucuggcacucaggaggcuaagacagggcuuguugcuguuccagggcacucuuggcacugugguggaggccauccuggaggcaugcauagugagaacaugucucacaacaaaagucugucugugguguuccuuaggaagauuaggucagauucuggcccgcucuguacaucuuacccuaggaguucuaucucauauuagcuguuaacauaagacagacuuuguuuuccuuccgaccccucaaaucccacaaaaucccucucagugacugaaacaucaucugauuuuuauguguaugauggguauuuugcaugcauguaauaaaauugugcagcauaugcaugcagugcccaagggaggcaugagagcuucagugccccuggagcuagaguucucgacugcugugagugaccaugugcugaaacugacuggacccugugaaagagcacucagugccuuuuaccacugggcuaucccugcaaccccuaacaaguuacugaauauuucaaaucaucuagacuguauaguguuagaaacuaguucuaauuuuacaaauuagaauguaaaaagcuaaagauaucucucucgagcuucuggaaaagagcagaaugcuuccuuuugcucuucuaguuggguaucugcccaucccuguuugcagguuuaugggcacaagcccugucuguguguacuaaauagaauacucaaaguagaccgaacuguccucauugucauuagggacagcacuguuguaaccuguugugugcagccguaguuguuaaaaugacuuguuuuacuuaugugacaugauuuggauuuguuuuaauuuuauguguacaaguguuuugcuugcauguauaugcacuauguggauacaguacccauccauaggggccagaagaggaugucauauucccugggcuugauuuuacagacagcugugagccacugucuggguacugggaacaaaauguagauucuuugagaaaaccgcaagugcuccagccccccuucuuaggaucuccaucuuguauuguuguguguuauuaugcuuguuugaauguuucucauugaaauauuuuauuuccauuaaucuauaugaagauguugcuauuagcuauagccacauuuuucauucguguguuuuuguugguuugcauuuacucuguugaauuaugguuaagaacuccugugcuuauaagaaaguuuuccaaaaccaaauagagaaauuagugaugucucuauauuucuuuuugucuguuuuaggauggcuaccauagaguaguuaauguugugccaaagagaccaccucugcuagacaagagaccaccucugcuagacaagagaccaccucugcuagccagaccugaugaaggaggcuacaguagauauuacagucauguugauugccgaguaugugacgagggccgcaguuuuucucaugaucgaagaaguggcccaucucacaguggaguauguaaauuucccccguguacuaauuguucuuucuuucaaguuuaaaauccauguaacuaaagucuaugugcaggucucugaaguggagucauggugcuuguguuagggugaaaggagagccugaugcuuguguucugccucccucccccaccccaacucccuuuuuacacuagggucucacuguauaggucccgccugccuggugcuugcuguccuccugucucagccuccugggugcuggagugcuagguuuucagagcuuggcuacccuuccuguucgaugcuguuggcugccggccacagcuccagagggcgcuaguagucaagggucuucugggcagugaagaagaaucccagauagcucgaggugacauuaacacuuccagugugauuggcuuugugccgugcuggguagccaggccguggccuuccuugcacuggguaagcacucuacugagcuagcugucuaccuagccuaugcuucauucacuuuuuaacuuaaacuugcagggauuugcagacucacaccugauagucagugaugagccggugucaacacuugucacguugugcuuauaauuucuguauucuagcaugaaaaccacuguggggagaugggcuuaagcugacagucucaccuuucguucacauucuuaaggucuguuugcuuuuaagagcuuuacuauuugagaauagggcaguaaagccagguuucaaauaaaaaacacuuaaaauguuaguuacuuagauuuaaugugguuuugauaaucuagaagguauuuaaaguuuucauaguuuguuuuauugacagguuggaggcaauuauguccuagcuugcaaauuacaauauucuuguacacaguucaucuuuuucuucuuuucuccaucucucucugaccugguaaccaguagcaugguuauucacuguguguuugaccucaguugaagagggggaggugaguccugagguauguauggaccuccaggccucguggucguucacgguugugacgcugacggcucuaaaguggagauaggccuugguagugguuucuggugaccguggaggaaguuugcagugcuacagcauccuuccuuaccauagugccugccauugugcuuauuuauagugccaugcuguuccuuuaggaagggaaggucuagaugcugggaaggaagcauuucuguacaagggauacagguguuacugagacccauccugcagguagucuccgggagaaaggauuuaguugcagcacgagcaucucuugcuguuucaugagaacucuugcguccauuugaggaguuugguuuucucuggcugaugucugacaugagcaugagcguugucugaaagccgacaguguggguucaggagcggcacgggugcuccggucauccucccaaguuguccgagcuggcuccguucaguggugagaguucuagcucugcacaucaggaagccugcgguucaauccucaauaccacaaaacaaagccauguuagcacaaaaucuuguuuguucuuaaacuuuaaguaacuuuuuuucucuucacauaaccaacuggcacaccuaugguccuuaguucuuuuagaacacgaauguauucuuacuggauccaguguuuuauuauuauagcuauggaauuuuuuauuuucuccugauuauauuuaaaauugaaaaaaaauauggacacauuuuauuuauaaaaguguuggguuuauaauguugaauaggaaaaugaaaaauaauauuagcaauaucagucucuuacuguaaauaauuugcauguuguguuauuuauuuuuuuauuucuuaguuuucuuuuucuuuuuauuauuauuauuauuauuauuuuuuuuuuuuuuuuuuuuuuugguuuuuugagacaggguuucucuguguagcucuggcuguccuggaacucacuuuguagaccaggcuggccuugaacucagaaauccuccugccucugccuccucagugcugggauuaaaggagugcgccaccaugcccggcucuuuuuaguuuucuugagacaguaucucuauagcccuugcuguccuggaacuugcuauguauaccaggcuggucuugaacucacagaaaucuaccucugcuucugccucuggagugcugagauuaacaguaugugucaccaugucaagcuuauauauuaucauaugcauguuuuucuugcaugugccucuacauuguguauguucaguucccauagaggccagaaggugguguccgaucuccuggaccccaguuagcagcugggugugggccaccucuggguguugagaaucaaaccuaggcucugcaagaguagcaaguggucuuuaucauggagccaucucuccagcuccauaugguuggguuuuuuucuucuuaauauuuacuuauuuuuuucacauauaugugugcuuuaucuucacauacacacaucagaucccauuacaguugguucugagccaccaugugaagccagggaccugaacucuggaccucgggaagaacagucaauauucuuaacugcugagccaucucuuuagacccuguaguuuguuuuuaaugucucuuugugcaggagucuuuuuuuauuuuuuuauuuuuuuuuaauuuuuauuuauuuauuuauuuauuuauuuauuuauuuauuauaaguaaaguacacuguagcugucuucagacacuccagaagagggugucagaucucguuacagaugguugugagccaccaugugguugcugggauuugaacucuggaccuucggaagagcagucggguacucuuaccaacugagccaucucaccaacccccaggagucuuuuuuuaaaaagauauuuuuuuaauguaugugaguacacuguugcucuuuucagacacaccagaggagaugguugugacccaccaugugguugcugggaauugaacucuggaccucuggaauagcagucagugcucuuaacugccaagccaucuuuccauccaccugugucuuaaaggacaaaaugugccucacuugauuaauuuaaaauuuuuuaacacauauaauauuaauauuccuuaucagagauaauucuugcuggauugcuucuaauuaugccuuuauugagugguaaaugagaaaagaaaacaaguaaaguggagcgagcacuaaguucuuccuugaacuugagccugaacauuggugagagagcucgggaaggaaaaagguugagcagggugcacucagacaccaggaucugcugucacgucuguuugugugucuguggcacuaagucuggagucuccugggggaguaaugcaguuuuuacagcacagguaaguggugccucagguuccuggucaucuuuaguagauggaauggcugacuugugucuucauuuccucucuuuuggaaguucaggcaucccgagagacgugaucuuacucucacuguaaguuuaccucagaggcuauucagaagacgcuggcugaccaaagccccauuauuacuuuguguuuuucaggaugaaucuggcuacagauggcuaagagaugaucauuccacaagccggcagccugacuacagguaaguagauacacauaaguccuuugauucucgacucugucaccugcugugcaaaucaaagugcagcugaacugcuucauuaugguuugaacuugaaagcagcaagcauugugucuuuuuugacugugauguagcuaguaacugauguuccucggugguugacauuuuauuuauuuuuauuuuuuauuuuuuuaccucccaucuuuaaagauuuauuuauuauauguaaguacacuguagcugucuucacacuccagaagagggagucagaucuccuuacugaugguugugagccaccaugugguugcuaggauuugaacuuaggaccuuaggaagagcagcugggugcucuuaucugcugagccaucucaccagcccugguugacauuuuauaauugauaauauauuucaaaauaaguuugaauuacaagauguaguuuuacauaacuguaaaguaaauuuuuuauuucuccagaaguagccuuugaaaguacucagccugacaaagugucuucuauuauaaggcauuuucucugguugucuauuuauuuauguauucuguuuucuucuuccugugcaacuagugcccaaguaagguuguuaaucccacuauugaguuuuccuguguucaacuguuacagcacucaggcugcugcuauaggucagaagucccaguugcucguuaagccgguagcugaccuugcuauuauucacauauuugguuuuuuagacagguaaagacuuucaggaagucuccagagacuuccacugagauuucagaagacacccuaggaggucaggcacuguauggcuagguuggagugcuggugccugccugcccccagaggguaacguuugaagccauugagugaagaagcccaagaugcugcugauaccuaaggaauuuggagacauuaggaauguggaacauuuguucaagaaagcuguaggcaacccacaagauaggcuugcauugguuugguucuuugcuauucuguuuuuuccuuuuggaauggguauuuuacuguuuaccaccguauugcuuagcuauuuccucugacuuaaaacuucuuucucugggagaagggagucuuauaaacuucagaaaacuacugauacaagaacaaagaaacucagaugguggcaagguucacaaagccacuccccuuaauauauauacagugaacaguggcuggccaaggccaaacugucccagcagaauugauugugaguccugcagggagcuccaguccucccugcuaaagugggcguugggguaacacagcugccuuguacggaacccgaguuugcuguaagcccugauuuugguuugcguuggucaucagugucuucuuugggaaaaggaagggaaagucacacagcacauuguauauuggaaguaggugacuugguuucaggauuuuucaggggcucacgaguuugcuuugggacucagaagagauuuuccucuuagacauuuguauaaugauagaacuguucuaacuauauauagcgguagauuccuuuaauccaggaggcaggggauggcuagucucuuaguuugaggccagccuuauccucauacugaguucuuugccagcccgggcuagacagugaaacccugucuccaaaacaaauaaaaaacacuuagaaaugaauugaauacauuucauauucugggauggaugugagcuuuuuggggacuaggaugcuauggaguaccccucauaacuuaauauguugaauauaugguuccuaguugcuggugcuauuuaggaaaaugcuagaaacuauaaaauggggcuucgcuggaugaagugaguuacuagguguguguguccccaacuuaaugccugaaauugugagccggaguagaugaugccuuccuuaaguuacuuucucuuauauauuuaucacaguaagagaggcugacuaucucuuaugaauuguaaagggaaaagaaccccagucuccuagaauauuguucuuagggccgggggucauaggugagagggccuggucacuccaugggauggacaagggauuguauguccuagaaagaagacuggaaagcagcagacaggagggagacaauagacagacagcagggaaguagugaggguacagaagaggagccuauacuggagaaggagcugacaggagauaccacgaugcaucagccgcagaugaggggugcacaaacaacagagagcuauuuacacacacagcucccaauagggacccuggaaguagaaauuaugggguuaggcucuaagucagaccuuucacaggcuccaggguccuccucuuuccagguucccucaccuucauccucauuggucccauuagccauagcaacuuguaaugguuagagucguggggggggggggagggagaaggagacagucgaaauuuucuugaccuuccauuaccauggcaaggacuuaaccugccacaauccuauagauuccagaauuagacacuaaaauccauuugaucuaagcaagucagucgcuauucucagucggcugagggaucagugugggagggccaguuauccgcuccaaauccuggagugugauauaauagacagagaugacagcuuggcugcacuuugguuaaggaacccauuaucaagagccaccuuuuccuuuuccuuuuccuuuuccuuuuccuuuuccuuuuccuuuuccuuuuccuuuuucuuuucuuuucuuuuuuguuuuuuguuuuuuguuuuuguuuugugagacaggguuucucuguguagcccuggcuauccuggaacucacuuuguagaccaggcuggccucgaaauucagaaauucaccugccccugccucccgagugcugggaauaaaggcgugagccaccacgcccagcuucucuuucuuuuucuugaaugaguagcuaauugagaguggugcugugaucacucugaccuagaugaucaucucuggaacugcucagcagcagugggugucugaaucuuacaguuuggcaaacacagcugcaagaacgcucagauuuuuaguagauucuucagauuuauaguagauucuguccccaaagaagcaauagaaauaauagauccugagcaguggaugaguuuguagacauuccgcauuagugacuguauacaauggauagccaacugcauaugcagaaggccacugacuugaacuuguauuugcuguucugaguggugguaguagguuugucuacacuggauuccugcuugcccugcuugugcuagcacuuaccucagcuccuauagcaagagugauaaaggguaggauuaugaaaaacaagaacagcagcaaacuauuuaaagaugcuauuggcugggcgguaguggcgcaugcuuuuaaucccagcacucgggaggcagaggcaggcagauuucugaguucgaggccagccuagucuacaaagugaguuccaggacagccagagcuauacagagaaacgcugucucgaaaaaccaaaaaaaaaaaaaaaaaaaaaaaaaaaaaaagcaaaaagcuauugauaaauuuuaccagaagucuaggaaauucuacgggccauuggaauucuagaaaauuagcaaauaauaaaucaacugucagaaccauaaacaaguaaaauuuaaaauacuccagcacaaggaagguauugcccgauaaaggaaauguccuggcugacaguggaguguuacauggcauucuuggcugaggagcacgcccauuccauaaagaugucaguucugccaacaucaggucguacacuuauuauuucuauaaaaaaaaucaguucuuuguuuauuuuaacuaauggaaguugguaaacugguucuaaagauaacaugaaagaauaaagaguuaaguggggugggggggguugauagccuugaaaaagugugaauaguauacaaauaccauaugugggggacagcagcacagacagcaguagugcaguggccgagugaagcaggggaggaggaggccuaguugggggaaguuugaguuguagcaauggugcauucugugccuacaaagcagaaagaagaaacuugaguaaacacugcugggacaaggauuuagaaggaaggaauauugagcucaguaugucccagcagugucucugauuaagaccuagagaguaaagaagacauaaaauucgcuuuuguguuagguuggcuugugguuuauuauagggauuuauaaacaguucuuagauuuuauuguuuucuuuuucuuuuuuccagacugucuguguaguccugguuguccugggauucuguggacagaccugccucacugccucucuccuucucucccucucugccucucccucugccucugccucugugccugucugccucugccucugcgccucugccucccacaugcugaaggugugugccaccaacacccagcucuguucauuuuuauuaacaguuccuguuuuaauuuuuacuguccuuucuauccuuguguguguacggacuuucacauaaugaaauaaaaucagguaugaguugaaugugagccuguaaucccagagcguaggaggugcaacaaggauggagaauucaaggcugucuucaccuuagacccuauccuuuucaaaaaugacuuuuaauuuuaauuguuuuugugugugugugucugucugucugucuguguauguauuuauuuguucauaccuguacacugcucauagaggcuagaagaggauaucggauccuccugaaguuugaguugcagaacguugugaacugcuucccagccuccugacaugggugcucagaacugaacuuggguuuuacuuagcauacaguuaaccacagaacccucucuccagcgaauccccuguuuugaaagaacaaugagauggauaagcgaauggggaaauggcagaagugaucggcagucagagcacauucugcuuuugcagaggccaggguggacuuacgcaccaccauggcaacuaggcugucuuuccucacagucccaggagcuagccuugggcuuggcuucggaggcuucaggcaccacacagugcacguauagggauacaaacacucauauaaaauucaagaguauuuuuaaaaagaauuuauaagucacacaugaauuucuaaucccuauagccacaucaacauauugauguacauucuguauuuuuuguccacauuccuaaauacuuagaauuuuaaauuugugugguagauucauguuauguuauauauauauauauauauauauauauauauauauauauauauauauauaccaugaccuacauuuucgaaaaauaguuguuugugaaagagccuucaagauuuuuauguuucauugaguuuguuugguaaugcucaaauaauagcccacagugugccuacaaugccacauuauucagacacgaguuuuauagcgucacagcaguugcagcagaucucaguauguaguauccuuuugaaacauuacuuugguuuccccaguaaguugucaaaugaguuuauggacuaaagggaagaagucuuuuaaauuucacagguguuaguauuaaagagcugaaggguauuuucuuuuuuuaaaaaaagauuuauuuauuucauuuauaugaguacacuguagcugucuucagacacaccagaagagggcaucagagcucauuacaggugguugugagccaccaugugguugcugggauuugaacucaggaccucuggaagagcagucagugcucuuaaccgcugagccaucucuccagcccugaagaguauuuucauuuaaaaaacaaaacaaaacaaaacaaaacaauuaacucuuaacuuagaugauguucuuuuucuuuuccuccuccuuaauguaaauauguuugcaauuuccuuuauguaacuguuauaaccauaucccauaauuuggugccuuuuagucugguccuaucuucauauauucugauuauuuucugauuaugcaccaccauugcuucuaauacuauucuauuuuaaaauucauuuaucaucaaucgucauuaguaaguuuucuuaacuaguccaugagcauucaaacaagauaaauucucuguuuuuauguuauggcguuuauuauauaugcugucuucauucauuuauuauauuucuuuuaugccagauauucuucuuagccucucagaguacgaaggugcugcauucauguagccuacauuuucauaauacauagaaaacaaauuaugaguaguaagcaagcauuaauuauucauaguuagcaaauaacaaaguagcuucguucagaaaaagaaagcagguugaagcagaucauucccgucuuccugucuggguuuaaguuuuacucacagagacagcuuucacugccugucaucuggcuguuggcuguggucuuagcagacagauacauggacucuuuccuacauguaagauuguagccguagaacguagcuguugcuuuagaacaaccuugacugcauuauacaccaagcaagagauauugcuaguuauauguauuuguaguguucugagcauguaaagaaagccuugucagugguaaguuucugcccuuccaguggaguaggcacagugauuauuugaacugugggaagaaacuguaagagcauucaaaguuuuaaauuuauagacgaguucuuagaacaguucagaggacuccuguauccaucuacuagaggucacauugagucuccauccaugcccuagugcuacagaaagauuggaguggguucacaguuaccuuuaccgugaccucuuuacuuuguaacgacuuagucuuucuuuaggucuccuguuuuuggcaagauguacagugcacagaaauucuaagaguauuauuuacugagccuagggcuuuaaauaugccaagcaagcaugcuaccacugagcuguauccccagccuuagauuauguggccuguccuugucuguuauacacuuugcugggacaaucccuaaagagauguguucuuugaauugcauauuggacgauugauugaugauuguacauguugauugguucgcuguuuuauuguauugauuuuugucacuuguugaagcuaaauuugcggacacuaguaaugugaguuaauuuucccuugggaaucagcaguggcuuuugaggcuaugcuuugcaacugccagucuuuucucaggcuuuccuaaaccuucaugacaucaguuuuucuugcccgaaugaccugcugaaaugguuacagacauuuuuuuccuucccucauauucauguuuugaagcuuauguuacuuuaauuucauuuuuuguuuguauugcuuugcuuuugaauuaguccauguagcucaggacggucuucagcuuacucuauaauggaggguggcuuuuaauuucugguuuauuuuuauuauuugcugccuguauuucucuagugcaggcauuauagguauguacaccuaauuuaugcuguccucgggauagaauccagaauagugugcuagacaagugcccuaccggcugagguacaucccaagcccuacgggaugaagcugugaucccuagcaugaugcucuuaaguccugcuuuugggagguaggugcuuuucaugcauagugcuugaauucuuguaaaugcaguugggaucuauauuaagaauuaguggaacuuaauucucucuucuccauaugaggauauaacaaggaaacaacuaacuacaaaccaaggugaagggcuuugcuauacaugagcucugcugguuccuugaucuuagacucuguagucuccagagcucugagggcuagacauaugcuagguaugcauauauacaaaggugcccgcucuuuuacaacuccauuuguuuuauauuauauuuacuuauauugaggaccauaaauuuguggcacuauaauuucugucagugagggcccugacuuugaguugucagcagagauuauccccuuuaagucuuuuguuuuuagacggcuuacuaagguacucaggagccugagcacugacacauuauuuggguaguucuuaggguaguauuugcagagucccucugggacugauguucaugugacauacauuuagaauggacaccagugggaacugauguugccgugcuaauacucucacugauugcugcugaaaccaaguccuugaguuugauccagaaaucccgugucuucuacaaguaucuguggaguauuauaucauuuaugagcugauuggggcacaacuccaucucagaccuagcaugaguaucaguaucugcuuuguuuguucacauucuucaugcaguucaucuugacccugcaaaucuuacuuucuagauggaagcagagagagacuggguugguugugggcuuuccucaccaccccaagagacuccuccaacaaggccacaccucucaguccuuccuaaauaguucaccagcaggggaccaagcauucaaauccucgagccuauggggucauucucauuuaauccaucaguuacauguucuccaacuucuuaggcacauagaccauguucccuggcccuucucugcagauaggugugugaucucaugaccgguucaccucuaguggaaugugagucggaguucugccccuguguguggaguuucuucucuuccuccuccucccccauugcucccuuuaucccuucccucucuguuucuacacccccacucccagcacucuuuguguagcccagguuagcauagaucccagcacucuuuguguagcccagguuagcauagaucccagcacucuuuguguagcccagguuagcauagaauuccacuuccuucuguuccagaaugcuggauuauguucuaccguugcccagcuuuuggcauuaaacacauagccuucaucugugaucuucauggauccuugagcaccuuggugggucuuuaaccuucuggcacauuuguccaaugucuuacagaucuaaauaaccuugugucgauucuguuguuuuucacuuaccuuucccaaugaagagaagacccugguuaguauuugagagggucagcuuacugcuuuuuagauaauauuuugauauuuuaauuacaacuguuugggcauacccuucucuuucucauucucccucuuucuccucccucccccucccccgcuacuaauacaguuucucuguguagcccuaacugucuuagaacuuaacuuuagagaccaccuugcuucaacucaacagagauccuccccccucccccggagugcugggauucaaagugugcgccacuacacucuuaaugucuuuuaagaguaggcagaaucgcuucucggccuuuuggcuaagaucaagugugucagagcaggcagauacuccccaccccacuccugaacacugaauaauaggucagauggacgcucccucuguccacacugcaucacauuaaagaucggagacacuugagguuugcaguugauuuauucuuaaaaacuuuuaccaaacugcuuuccuaaaaugauucaugaagccuuaauuucauuuuuaaguugccaugggcuagaaaagcagccaguauauuguguggaguauuuuuauagaauucacugagagggagaggagguccugagauagugcguacggcgcauuugcucucuccuuuuccuucccugacagcucuuucccuaccucauugaaaauucuccccagcuaauaaacuuaaaugccuguagcaaaaugggucucuggccaaugaaacaacucagugaguauaaacaucugccaccaagcuugaugaccuaugucauccuugacacccacaucgucugaggagaacugacuccugcaaacugaccccugaccucugugcugugcuguguacaucuuuaacugucaggcuggaagggcucaucugccauggccuauuugguuugaccuguggcauugacagcugcaaauagucguucagggaagaaucugagcucuugagggguggugacgugcucaguggcugcgcucuugccuagcguguacgaaggccucgguucaacacccagggcugugaaaggaggaaaugagccucugaagcagcaucagguucacugugggaguuaaugggugugcgggaggccgggggcgggauccgguccaggaguucuugcuggcucuucuuccccugcuucauucuccagccuggguuuccccugucuucacugccuugggccuucaguguuuguuaugcagcuagaugcuguccucaauccagcaaugcacuuugucauagcacaaagcagcaauucauucaaaaaauguguaaccugagacuucauuguaaacauguugguuguauuauaauuuuuuauguguauguauguaugcaguguguguguguguguguguguguguguguacaagugcagauguuugauuguuuugaaacaggaucucacuguguagcccuggcugcucuccuggaacuauagacaaggcuggccucaggcucacagaaauccaccugcuucugccuccugagugcuaggaugggauuauaggcgugagcuagcauguccaccuuauuuauauauuuucagaacccuuuagccccuugaguauacugcuugcuagucacucuguagaugucaugaguacucaggaagcuagugcagaggaucuuugugucuaaccaccuuuucuuuccuuugcuguguauggaagacagacugcugugaguagcucuauaguaagguaaaccuagagccccuugccccucacuguguucucccacuaacaucugauguccucacagaguagucagucacguuugaaacuaaauugggucuuuucauugccuugcuuaaacucuguagcagugaacugcuaagagacccaggcccucccuuaccagguucacuggucuuaaacacacaauacauaguauuuuuuuuuuuagauuuauuuauuuauuauauguaaguacacuguagcuguccucagauacuccagaagagggcaucagauuucguuacagaugguugugagccaccaugugguugcugggauuugaacuuggaaccuucggaagagcagucagcgcucuuaaccacugagccaucucgccagcccccuuuuuauuuuuaaauaccuuuauaaaacgauuuuuuaauauugaauugugcuugugcacgugaguacagauaccugugaagaccagaggcuuuggaucuucuuggagcuugaguuauaggcacugagcuuccugguagggaaguucacucagccugcugggugacccugccugccuuugcuuguccacaacccagaacagaguggcugcauucucuuuuucacuuuccacaccugguucguaacugcguggaggcccuuuuuucucagcuugugcuuccuaagugauuugugagauguauucugggaauaguucuuauuccucagugccuacuccaagccaacgcuguccuugaacuugcccagguagauacccacccccaaacauguuucuagaacuugaccccucuuccuugauaauuagaauaucuagcucacucuuuccugcucacucugacuaccugcccaucucugaaaauauggaacaguuauuuuuuuugcguguuucagccauugucuuccagcagagcauggucagaccugagaaucuuugggaauucuuagacugcucuccugagcuuugaguuucugacuucuagcuaguagacaauugcgauacauaugcacucuuacacauuaguaagguccucuguuucaguccuucucagagacguuuuguaaacagaggagucccggggggggggggggcggguuguuaaaguucagaauuuagaauacaguuagaaggccuggagguucugcuguggcuacagaaggaguguccauugaguuggauuuuuguuggcguucauaggugauguguaaauuaccgggguguggggccgauuccaucagcucuuccucaagccauuucuccacgcucucucucggccccucuguagucacuugcugggugaggccuucugauggacgggguucccuaccacucgcuuugcuuccuuccgccugucucccuuuguggucuucucuucuguucaucuccucucugcuccuguugggcugagcguuggguugucaguucccgaucugcaguaaggaggccucuuuguccaccuuccacagcaaauaggcgcccccaucaaaacaagaucaguuccagguccagcacaaguuucugucucgaccauaaaucacuaggcugacagguguuugauuucuaauaaucuguuuuccaauagucgugacugacccggucacaugacauggagauuguaaguguaggugucuucccgugucugcagugucucaggagcuucuccuaagucuccuaugcuuucugccuuugcuuuguaguuucucuccugauaacuuuuccacauaauacccuuucaccucgucuguguguuguaaagcugacauggcuucuuugcaccugaaucuggccuuccaggauugaaaucucggguggcguuguuaaaacacuugaaauuugccuuauuuaaauagaaguaaguauuccauaacugaaaaauguauaaccuugaguuuuuaagaugagaacacaguauaaaauacuucaguagauuuucaaguccugauuauguguugauaagacugacauaguggguuaagaauugauaaaauuaauucacuuaucuguuuauuuuuguuuuauagacagggucucacugugugacccugaggagcuucauuuagauacgguuguugcauaugugacucacucacuucauaccacagacuugacccgacucuuaguugugcugaucaguguguuuggguuuauuauuguucacacacacacacacacacacacacacacacacacacacacacagucaggaugguuucaaacucacuaaguagcuaaggaugauguugaacuuuuuuaaaaaaaaguuuacauuuagccgggcagugguggcgcacaccuuuaaucccagaacucaggaggcagaggcaggugaaucuuggaguuugaagccagccuggucuaaggagugaguuucccaacaacccggacuucacaaagaaacucacagagagacuucgugucaaggggaaagaauuuaauucauuuuguguguguauaaauguggaugugcuccugcuccagugcgcaugauguggucagaggacaaauuguaggaggcgauucucuccccauggucccggggauugaauuccaacugucaggcagauagaugccuuuacccaucagcucucuugucuuucugauccuccugccuccaccuucagagcgcugcaguuauaucugugugcugugugcagucagaccugugugcugugugcagucagaccuguggugugcugugugcucagcuugauauggugcucccuaccaacagcuucacaucagcuuacaaaacaaaacuaaaacaaauaaacaaaaaucuuaccagugagauccuggaacucucagucccaagugggaugucucccuucccucuguucucaggaagcuauguggaagaggauacagguucuuaagagccaguggggauggaagacagcaaggaaaccaggccuccuacacacaacaggacugaugcacuagaaacucacagagacgguggcaacaugcaccagaguccacacaggucuaagccagauggguuccuagugcugagaagaaaauaggcccacguccccaccucuaacccugaguagcuccagucaauaacugcuuccagaugaagcauccguuuucuccaagagaucucaccugggaaacggaccacacuuaagggcaggccccacacccagcaggagauggccaacucaaagugaacucaugguauuuuggagguucuuugucucauguugcuuuggacguuuuauuuuucuuuucuuuuuuagucuuccguaucuuuugguuauaugguucccuaguuuguuuuuaugggauguuugugugcaugugugugucucagcaucugugugauuucucuguggcucuucuuguccuguuuguuuuguccuauucugguuuguuuguuuucuuucuuuuguuuguuuguuuauuuggagacaggguuucucuguguagcccuggcuguccuggaacucacucuguagaccaggcuggccucgaacucagaaauaauucugccuuugccuccugagugcugggauuaaaggcgugcgccaccacacucagcuuuuguuuucuuuuuauuuuaucuucuuauuuuuuagaugcuuguuuguauucuacugagagggaaguagauuuggugggugggaagguggagaggaucugagaggaauugggagagagaaaaccauaaccagaauauacugcaugaaaauaauuuauuuccaguaugaaaagaaaaaaacauaagaggcucaagaagccacaaggaugaagccagugaacagcacuccuucauggucagcuucaguccuugccuugauuucucucaaugauggacugugaucaugauagauaagcgcaacaaguuccccugucccuccccacuagucauagaaucuagcaacaauauuaaauuauaggaccagcucccucagacauuuacugcuaauccccugucacggauccuuaguacaugcugaacuucccuagagccacugugauacccucacggcugacagaguagaggcgcuuugccuaaacagguccuuggggaguuguugugacaccuuugcccaagauguuaggcagcagggaggcagggaugaaguggcugaguacugaucaccacauuuugcgcugugcuuugacugcccucugguguugcgguuaggaaacuaacucagugguucaucuuuucaaaggaagagguagguggugauuuuagcucugauuuugauccugcugcuucucuuuucacugagcaaucaauaaugauccuuuaagcucuguagacagucuuuguucuccauggaauaagcuuuacuuuucugccuguuuucauucuuuaaucgcacgucuuucugcaugguaguuucuagcccuguuugcuaagccuucuguuucuuuuaucuuuuauuuucauccucacaugcuuaaauccuguucuuuguacccagucguaaagagagagcuaguaaucucuucuaaacuaacauggcugucuaugcuuguuuaccuagauagugcaugcacacuucacauguaacccgcucccacacauguauggaccgucccuguuucucagauuggccaaucucauuucacugauauugugcuggaauucugagaauccgcauccuguaucuuuuaugcucuggcagacagucaucauuccaucuaagcuaccacuguuucuucccugggauauguaaauuccccuucuucucucuucucccuuucuuaucuucccgacugcauccacaucuguuguguguauugguuuagugucggguuuucuuccuguccucagaguccagagcuagcagagaccuuguaucgcccacuguggcauccucuucuccauugagucuguaauacaguucuuaagaccugcugaguauguaucuagccacugacugauuagugacgucggagugaaccgcacuuaauuacaucaggauuccugaaugccuuccauauugaugcuucuuuaugugaguuacucuaaaugaauuuuaggugauuuuuacuuuuuccuagggaaacauaauuguuucugaagggcaguguauuuaggggguuauugauuagcuagugcucaacugaacuaagacaacgagcuacauguguaacgcggacugauaaucaauuuaaaauuauuuucagaaaaggcuuuggguuuggucuucagcauaaggaaaagaaggaaaaauaaaaaaauaaagauaaaaguaugggcuggagagauggcucagcaguuaagagcacugacugcucuuucaaagguccugaguucaaaucccagcaaccacaugguggcucaggaccaucuguaaugagaucugaugccuucuucagguaugcaggcagaacacuauacauaauaaauuuaaaaaaaaagacaaaagaaaaaauggauaacuuaaauuuaacaugggaaauaugcuuaauuaaaacuucuuugagccuucucuuuauagagguucuuuuuaauuuucuuucuuuuuucuuuuuuaaagauuuauuuauuuauuacauguaaguagacuguaguugucuucagacacaccagaagagggcgucagaugucauuacagaugguugugagccaccaugugguugcugggauuuuaacccaggaccuuuggaagagcagucaguacucuuaaccacugagccaucgcuccaggccuucuuuuccuauuagagagguuuauaucugaauuuacuuaguaaguuugaauuaguuggauguuucuccuguauaagguuuuccuucucuuccucccuaccucuuguguuucucuuuucagugcuagcaucagacccaguguugagcauguaaagugaucccaacgacugagcuguauccucagcccugacuaaauuuuaagauuuauuuauuuaugcuuacuuaccgcuuugaauugauacugcuuaauacgguuguugaauuuacagaaaaagaccacaaugauuuuauaaaggugguaggaucgguaagucugugcccugagggcaccaggcugagcccaggauguaguagcuagagacagcaucaauaaugucuggguuugauggaucucuuuaguuugaccuuggugucuugggucuuucaggauuuuaagguauccgugcuauucucuuaucagugcccugccuccccaugaaaacaaacugauuaacuucuaacuuuggagauaaauguauguacagguggggugucucuucugggugccuggugaggaauuuucagaucauguuuugaaacauuuacauaaacuuuaugggugaacaucucgggugugaacucugaaguguggcccagcagggagccucgugagcgccaugcuguuggagagcgccaugcucuuggagagcgccaugcugcuggagacaggcuuccgacucugcagccuuuggaugaaggaugcccaucacuaacauguuuagaagggagaaaccucuauuuaugagcugcuuuccuuggaaaguuuugcaauuccuagggguuucugagagcagaagagacugguuuguuguuguuguuuguuuuucuucacauuuuggaauacaguagccgcacacuuaaucuccuggucaaaccccagcugagaaaagugguaugugcuuaaucauagguugguaaaaguuucccguuaacuaggggaaacuugccauuuuguguacauuucuggauagagaaugcaauuaacuaaucuuucuuuuauccuucaaagggacaugagagacggcuucagaagaaagaguuucuacucuucacauuauucgagagaucggucuccccauaaaagggacgcucccuucuucagagaauccccugucggccggaaggacuccccacacagcagauccggcuccagugucagcagcagaagcuauucuccagagcgaagcaggacucacuccuuccaucagucucagcauagaaguaugucugcuuuucuuguuuccucucuaaagugcaucuccagggagauguuccuacaaggcaugcuuuucuucugucauugcgaacacucagagacuugacagaauaguauaguaaguggugcacauagcauuccucaauucucugugugacaacucauguucaauucuugcgguguguaaaagagagucuugucaucaagucuaagucaguccacccccguccuuucuagcaguccaaacaagaacuuaucguucuuguuggauucuuguguucagggaauaucgauauaagucuucuguuauuggcaaagcaguagagcuucacagaacacaucuguuuugcauauagaugugugaauggugacagaagagguagcacugaagggcuaaaaggaaggcuccguggauaagagcaauuugcgcacuaaguuugauccuuagaaccuauagaaaagggagacacagggguucuauuccucguucuccuagacagaugggaagcuugccgaucaucuagccuacuguacacaguggugagcauugagagacaucucacacaaggcagaaagucagggccaacauucaagguugucuucugaauuccacgugugugccaugauccuuuugugucuguguuccuacaugugaauaugcacacacccacaagguuguuuguuuguuuuaacguauuuaauguguauggauguguugucugcuccucugugcaccagcuguacuacuuguaugucugugacugcccgguucccuagaaggccagaagggggcacuggaucccuuagaauuagaguuauaaaugcugugagccacaauguguuggugggaauugaauuggaguccucuagaagagcaacaagugcucuuaaccacugaaauucugucuagaccccgaaaaaaagaauuuuuuaaaaaguauguuguggugguuugaauauccuuggcucagggaguggcacuauuaggaggugugaccuuguuggaguagguguggccuuauuggaggaaguguuugccuuuggaacaagauguagaaaucucagcuccuucagaguguguuaaaauguaccuuauaauugaaauccugauaugauuuuaaauaguucuauaaauacaaauauuaagugaagauaacaauuuuauuauuccuuauacccuuauucuuuuaauucuucaaucccaauccuauuccagcuaggggcggaacaagaauuucgaugaauacaguagcuuuguuacugggcuaagucuagcccuuaugugcgugugugggugcauguauguaugugugugugugcgcgugcaugcgugggugcaugcaugugcgaauguacacauguguggcaagaggacuucuugggugucaucuucaggaaugcuuucugccuucuuugagauuaggucucuuguuugcuggaacuuucuacuuaagaguagagcagugaucagggucuggggcucugccugucucugccuccucaacauuaagauuucaagcauguguaaccaugucugauuuuucuguucaacugaaaaaguucaucuauuuauuuaauuuuucuguggggguggggguauacacacauuuggcauauguguagaggucagaaaacuccuuucaucaaguagauuccugccuucacucgcugagccgucucccugacugcaugccuggauuuuccacuuggaggcugggggucauucaggcucucgugcuucugagguaagcacuucaccgcaggugccaucuuuccccagacaucaguucuuuccuuauugcuagugugucuuuucccugcccuuguguggguggaugucaccaaguggauuuuuccccaagaguacggcuuggggaaaauccgugugagccccguguaauugaacucagacugucacaauuggcaagguuuguaauuaacaagccaucgaaugauuuuuuugcucuuguuucguuuguuuacuuugggaggguuuucagguagcccaaguuggcuucagacuuugcugaacuggcugggagcucugcucucugcuagcucugcucucugcuagcucugcucucugcuagcucugcuuucugcuagcucugcucuccgagcucugagccugcuagcucugcucuccgagcucugagccugcuagcucugcucucugagcucuuagcugcaggugugccgccccacacccacacccacgccccgaguccucagcuugaccucagcaccuggaaguuuucucucugcucccucaugggagcugugagcacaugggcuuuaguugcccauacuuacccuaaccauguaggguuacuuuauuuccuuauacuuuaaucauuuauaauuugcuuagcauuaaaagugacaucagaaccacuaaguucacacuccacacucauucuucagaguccuuguauuuuuuaaauuaguguauauuaacuguacaaaauauuuuuauuaauuuauauaauguacuuugaucaucugucuucugucccacugucucccaucuugugauccccuuguucuccccuaucuauacuauaucuauacuauacuauaucuauacuauacuauacuauaucuauacuauaucuauaucuauacuaucccucugcauuuaaacacugcagucacaggucacagaugggagaaaauaugcaguguuucuucuucugagucuccuuaucucagucauuacaaucuuguaauuauuucacaaaauuccuagucaucucugugguccccuugcuugcaucuuaauuuuaaaccuuccauuguuaagagaaacucaguauaggaucuguguuguggaguuuguuucuagaauuaaaauauaucugucauguccaugccuguuaaguacugcauucaguacaguagucuguauuauauaaccaauaacuucauuaucuauaauuaugcuuucugguuuggguuuucuacaguaucccuuguucuugugugauuugaagaaaagcaguuguuaaaguggaugucucuggguacaucuuacacgcguucucacgaccggccaggaagaacacaacaaaccagaaucuucugcggcaaaacuuuauugcuuacaucuucaggaguaagaaugcaagccccaagcccccugcuuacaucuuuaggagccagagcgccagagcgccagagcgcagagcaagagcucuauuguuuacaucuuuaggagcaagagagcaagccccaagccccaagcccaaagcgaaagcgaaaccccgucccucuuaaggggaguuauccuuccuaggacguaucacucccugauuggcugcagcccauggccgaguuguagucacggggaaggcagaguacaugggguggagaacuaccuuuggcacaugcgcagauuauuuguuuaccacuuagaacacagcugucagcgccaucuuguaacggcgaaugugggggcggcuucccacagguacauuuauccuucucuuagcagguaauccuaucucaaaaagaaaguauuguuuggaguauuagauauauccuuagcuauuacuuguaagaagucacuaaagacaaacucuuggaggacuuaauauuuguuugaagcauuuaaguuaugucuauaacuuugcuucacuucagugccaagcacuuuaucgcuaguauauggacccaguggaagugcuuccaauggcaccaguuucaguuagaaguugaauaugucuuuaagaugguaaugaacuuaauaauacaccuuccccccccccccccaagcuucauaauuagaaacagcaccuuacgguuugggcugcugguugucaugauccgaauggcuuacuguuccugauagcauccaguguuucauguagcaugugacacuacuuaguuucauuucuaugauaaaguaucuugauaacaaguagcuuaggggaaaggucuuauuucagcucacagcugggguuuuaguccaucucucagggaagucaaggugccggccgggguuggaagugaccagucggguuauguccauaucaagagguagccaugagcugugaaccucgugcacagcucucuuccuccaguguugcacaauacaggguccugccuaggaacuguacaaaccuuaguugccgauauuuuccauaucaauaaagauauuuaaucaguuauggcuucuuccacagacuagacaagacauaccugaucuagaggaccccucauugaaacucuguuaucaggugauuuguagacuauguaaaguagaugauuaaaauuaaccccucagcccuagaaaagaucaaauauugaagaauaggcuucuuuugaaggcauauggguaaucuaccaucauuacauaggaauauguaaguugaacaguuaaaaaucaaugaagauuugaaauuuauuuuuucuuccucauuugugcuuuuuauugguacuaauguuuuuuucuuaguaguuuuuuuuacuacuggaaaauugcauguauguauguauguauacaguguuuugauaaucuauaccaaacucucuauccuccauccucuauaucccuucccuacuccucauuccuaacaacuucaugguccuuuuuuucuuuuauuuuuaaccugaguucacagauuguggccagugugugcauggguauagggacagccacuucacuuucagcacacucucaggggcuguaugcauuucuuucccaguagccaucaauugccaguagcuccucugucagggacaggacuuugugagacuguccccauccauucugggauuuuggcuggcuugucuugugcaggucuugugaugcagucacagcacuguugaguucuuguguguaaggaccaugucguaucuggaaaacugcauuucacagcaaucuucuucuagaaccuuuggcucucaacaguccuucugccccucuuccacaggggagaucuuuaggcucgggaggaaggggucugaugcccuugucaacaccuaacaggcuuauucugugcacuuugaccagcugugugugagcuacuauauacuaauacuacuauauauuaauagcuacuucagauggaaacuuccuaggaggggugagagcugccugaaucuguagguauugaaagggaaauuguggaacuugaugugauuaugcuaccuagaucuggcugaacuguggcccaaccuggcuuugaacuuaaaauccuuaugcuucagccucuugaguguuagugauuauaggcaugugucaccaugcuggguauaucacuccuuaaaucauaaauauaaauaacuuucaacucuuccauugcuuucauaauuucccuucugauuucuuuccugaauccuaauauaaagaucaguuuguuuauuuuuaagcaaguaucacuaaaaagcaggauuguuuguggcuugcauuuuuaccuguucuaaaggagaggaugauuccugccucuguagcugauaacagugagugucugagauggauugaagacguuuguguucaguugguaccaagggagaaaagggaugagauuagagacugcuuagacuugguuagccaacaaagaggcgagaaagauguggccaggaagagagacacaaaggcaguauggcccaaaauguaccgagagucccaccuggggaaggaaggcaugguccucaguccagaucugggaagugguggggccuguauuccuagcacaguguccucuuccugacaucccaucugaguuaagucuaggccucuccuaucaccuguaucugccaugauugucauaggaccagagauugcaauagcugggcccaguuauugcagagugagaacucauaaaguuugagcccaaauaagcuuuguuccuuauauuuuguuuaucuuggcuuuguuccuuauauuuuguuuaucucugguauuuuuucucacagugguaaaagccgaacagcacagauaaaaaucuaaugucaaaauacuaagauuuuguuuaugagucauuaaaauguauugauggaggaugagugagcccuuugguuucuaagaaacauaguuucuuauuuauguguguggguauuuugccugcauguauguacagucauuauaagccuguaguagggcuggugagauggcucaguggguaagagcacccgacugcucuuccgaagguccagaguucaaaucccagcaaccacaugcuggcucacaaccauccguaacaagaucugacucccccuucuggugugucugaagacagcuacaguguacuuacauauaauaauaaauaaaucuuuaaaaaaaaaagccuguaguacuauagacuugaagacaucauuaguaaaaaacagaaagucucagaaacuagacauugagagagcccuaguaauggcaacaaacaaacaagaaagcccaagugugaaccucuguauuuaaagagauauugagccuguucauguuagcuguuuugagagaaauaaguuaugaauuguccuguuucucuguaccagagaaacguuuggaguaaauacgugacagagaguagaauccaguugggacggggcuguccggccaauggagaggaagagaggaggaggggcagggguugucaaguggagagaucugggaggaugugaccuuagcugagagguuaggcagcggcuagagaggcuuuugugaggcgcaugugccguccuucugcaggugaaggguccugcgaccugccaugaaaacuuagauauaaugaaucucaaucuuuuccuaaauuaugcuuuaugcaaaguaggucuaauuacaggcugcacuuagcuuaaugugguauuagaaggccaguguuguagcccacaggcuuuuuggacucccuggagguuaccccuaaggccaauuagaaaaaacaaaaaccaaaaccaaagacaaagaaagaagcauuuuucagugugagagccaccguuugcaaauacaucccaguagagcacacuaggcccugugagggauuuacagacgggggaucuuacuuacuaugugucaggagugacucccagucucacuguagcaacacgaagguguguucccuucuggacauccuccaaagaggacauggccucccagccuguggagaagaagccaucuuggucaggccaccuuugagaugaaguacauuuuuuacaaacugucaagaguguggagaggcuuauuauccugagcacagacaagacacgauugcuuuuaagcuucuuggauuguaaagucuguccuggaaaaaaauggcaggcacaaaccugucaaucauacauucuggcuccccugcucuggacagccagugaugggcugggagacagagugaguggagaaauggggcggggcucaccaguguauguguggguucagccuggacacgcugucccuggccucagccaaagggugaaagugaggacaguccuagagaaggaaaacauggcuccuugugcuuggaggccuuagcaggcugaccagaauuugucuguugcaaaugagaaguaaggcuuuccacaggggacugucaguuuacacuuuuauuagugaagauuguggguaggcacaguccagaaggcuuggaauuuucuuacuggcucgagugccacuuccuccugccaccacagacacccaaucaagagaccuuacgagaagcacaggauguguuuccuggcgagaacgccugaggauuuugcaggggugcacagugcccaagcaaaagggcauuuuaccaguccagagccgcuagaaucacaguggcugugcuagagaggacguauggaagaaacaugccuagaaacacuaguguuucuauguaguggucaagaaaagcugcuuggccuggccuucugggacagcucgggucuuccaugaguagagaaguuggcaagugcaagaucauguuguuauggaagggucucucgaauaccuuuccuuuuugagaagggcuauuuggggugaagcucaggaguuauuaggaaucucauagugguuuacugggcuaggcaucaggcagggaggcccugauuguuagagagugagggagucuaccuuuuauuuggggcccuuuauuuuuggucuuuuugucccuacaagaagcuaacaaaauguuuugagauucuaaauacaguguaauaaaggguucagccaggaugguagccauaaauuugccugaggaaaauccauauaugggaaacuuuguacagaaaaaucaguaaguuuuagauauuguacuauuagaguacuguaaacauguuaauaagaacaagucagacaacuuuccuguuacuguguuauauuuccuuuuuuccccuuuauuuauauuucaaauguuuuccccuuuccaggucuccccuucagaaacccccuaucccauuucuucuccugccucuaugagggugcucacccaccgcaccuacuccugucuucccgccuuggcauucuccuacauuggggcaucgaacacccucaggcccaaguacugcucuucccacugauguccacauaugcagccagagccaggggucccuccauguauacucuuugguugguaguccaguccccgggagcuugggagccgggaggucugaccaguuugucacuguugcucccccaugggacugcaaacccacucagcugcuucagucuccucuccaacuccuccauuggggaccccucacuuaguccaaugguuggcugcaagcauccaccucuauuugucagaagacagccaugucaggcuucuaucagcaagcagcucuuggcauccacaauagugucuggguuuggugacuguauaugggaugaauccccagguggggcagucucuggauggccuuuccuucaguuccuguuccacacuuugucuccauauuuccuccugugaguauuuuguuuccccuucuaagaagcacugaagcauccacacuuuggucuuccuucuuggguuucauauggucuaugaauugaaucuuggauauucggagcuuuuaggcuaauauccacuuaucaagugaacaaauaccguguguguucuuuugugacugaguuaccucacuaaggaugauauuuucaaguucuauccauuugcccgugaauuucauaaauucauuguuuuuaauagcugaguaguacuccauuguguaaauguaccacauuuucuguaucuuuuccucuguugaggggcaucuggguucuuuccagcuucugacuauuauaaauaaggcugcuauguacauaguggagcauguguccuuauuacaugucggagcaucuucuggguauaugcccagggguaguugggucacuguaauauuucuuuuuuuuuuuuuuuuaagauuuauuuauuacuauaucuaaauacacuauagcugucuucagaugcaccagaagagagcaucagaucucauuacggaugguugugagccaccaugugguuguuggucuuugaacucaggaccuucagaagagcaguuggugcugagccaucucuccagcccccacuguaacauuucuaauggugacuuagcuuccaguagacugacugccucccucuccacuugauaugugauccugugucacaucuuuaaaugugaaccuuaugguuauuguaugaacacauguugguacuuauccacuuaacgguuuuauguccucuaaugcuauccuuagcugcucucuuccccacacuucuuccacuuggcugaaauucauagaagaauuaaacuuuuucuuauucucugauaguuuauaauugcgaaacaaauugacaggagacaaguuagcagaggaaaagacuuccaauuuauuguguguguacacauggggauaucccaucaaaggccagauaauugaacuuuauagaauuuuugaaugcagauuacugguuucugguggggagauguuaagcuguggguguuugaaugguuggacacacggaaaagaaagcuuuucuuaauacacaugcagucucagauaggcucugaggagcucucugaauaggugacagccuaugagugucuggcugggcuccuaaucuccagucuguuucuugugagaaaaucauuacuagauacuuuaaaggcagguuaagggggcucauacaaagucucuuggauucugcucuuuauuaaucuagauaaguauacauuucuuuguuaaaaagaugguuuugggaaccacuaggugucuguguguccucugaggagccagugcaguauguucuguccgguucucccuuggcuucucuucaguuagggcugcucuggcauuucugccucaggcgggcucggaggaguugaguaucaccagcaagagcucagaggcccuuucuccuugcuccuucuucuggggucuucccuugcuccccugcgcacagagccgcugguguuaaccccucccugccaccuuucccuagaguccucgcgugucggugcuuccuacaaacgacagaaugaagcaauucguggaagaggugaguuuggaaguagguucugaucuggaaucuugaagggugggagguuugacuugagaaguuacugaaauggggaaaguaucuuuugcucucaaguccacugucggcaagguuggauagcaauacagcuguccagguaguugguugucugggccagugguuccuggccaggaauagcugccaggggugcauagagcuguagaaugaggccuuggcagugggagauagagaugucugcucacucugcgguuuuugcugucaucuguguuuaugucuuugucucuugcuuuuugcuucuccacucauuuauguaaccgauauaaaugagugugugugagauucgcccugagcaauccuuugcuucugcauaccaagauugguugacgucugcuucuguuagccauuaugcaucugaaauuaggaaccguucuugggcuacacuugaucauaccuggcugagcuacaguaguaaugcccuguuucuggaaggcgaagucugagauugacaguuguuugccaucuuuucugcguguguuguugcuggguuuuuguuuguuuguuuguuuguuuuuccuguguucuagcugaugcacgcuaaaauugaauauguaacuggcaccaugauuaugcucuggccuucccugggcuccuuauccuugugaccuugaaaacagaugagccacacagaagacaguguguaguauauuagaugacaguuggguugauuauaaaggauuacaaaacuggaagagcacacuugcaggguaagaauggccauggacgaugggaccauugcccauuuaccuguaaacagucuuucuaggacuccuaaggucucugggacagauaguuugcucagaaagguuuuuuuuuccugcacaggugauuggcaagcccauuuggauuaacucuuaaggacauauguagcuccagugauuuuagaccucuggauagucagaaugcugaucuccauuagggcuagguauauaacucauauaccaauuuuugacccaucaguuuuuacaguaugcuguauuugggggagaggucaucucucaagaggucaucuucaagccuacucauauacaacuagcuaccuaacaugauuauaucuuuguagccuauuuugugcugauugguucagcaccucaucuucuuucaaaggacuguugcagaauagagaagacaacgaccuuguaacccaaguguagggaauaaguuaccucucucccuguguuugguccucuagggcagaguucucagccugaacccuuguugacccuuugaugcauuuccucaugcacugaugagcccagccacaaaaucaguuuguugcuacuucaugacucuaauuuggcuauuguuagggauuguaguguaaauaucuaaucugugaccccaaagggguugugaccuacagguugcaaacuguuguucaaggugcuuuuugacaguaagauagacuuuacaauguaguaaagaauuugccacaugaguugggaaugacugaauuaagcucuugacuguuggaagaugucaugguuguaccaguccuuuuuuucccucucucuuucuuucucucuccucucucucucucauccucccucccucuuucuuucuuucucuuucuuucuuucuuucuuucuuucuuucuuucuuucuuucuuucuuucuuucuuucuuccuuccuuccuuccuuccuuccuuccuuccuuccuuccuuccuuucucuuccuuccuuccuuccuuccuuccuuccuuccuuccuuccuuucauucauuguaauuuauuuuuaggucccgcuauucagccuuggcugucuugaaaccgaugguaccaggauugugguaccacaagaaucuagauucaaaaaccuguuugaacuucagaauuggaauccuagagcagggugcucucgccauuagacucagcauuaguaaagccggaugauuaguaaagccuggccccacagcagacucucaucacuucggccugcaguuguuuuaagucagcacuacucucuaacggacacaaucagaauaucuuuacacacugcccggggccaggcagggaagagcuguguccuguggcugagagccacuguguggaguggcuuucugucuuuaggaccuugggaagagcuguuguuuuaaaaccgccccaggucucuagagcuugcuuagcuguagccuggaaguuuaaagaggcgccauuuggagcuggcuuugcugugcucugcaggcggcuugguugucugcuucgcccuugccugcucuccuggcucuccuccccuuuuccaggcuuuagcagcauuuguguggccacuuucuaaaacaacuuuguguuaauaauauuuuagguuuucagaauuuaagauuauaggguugaauguaaguuaaaaguuaaacaaauuagcuuaacuaaauuagcuaacuaaaaacuaaauuaaauaaguuuuugguuguugagccuacuacaguaauuuuguuaauauauuuucuggcuuacauuucuauuaaagaugguuccaugagacgucaugugaguaucugaaauaacuaacaauggugacuuuaucucauaaacaaaaacauuuguuaacaucauucaugccaggcucuggaucaguguucggaauuaauggguuucuaaauucuuuuaaaugguguggauauuuuaggaguaucugcuaaauguccuguguauagcuccuuaacugaaugcccugugauagcugcauacuaacuguaauaacauuccauauguuuauacuaugauauguuaaagauuaucaguaacagggaaccucaugguuugcauacugcccaagacugaggugguaagaagagaauggucccugcugagagcagcugggguagaggcuuccuguccucaggaccuugggaagaggugguaauacugcaccccagguuguuagaagcccaaguauguagagauugcuuagcugugacaaggaagugugaggagacacacuaauggaaaugucuucugccuuucucagccuuucuguggucaucagcugacagugcuguggccuaugguguuauuucauucuacaugacuuuaauguuuugugauguuacuaagagagguagaguuugauguuaaacacaguaauaugauaaggaauuuccaugaugaagaacacaucuagcucuccccauuaauucagcuacagaauuaggaacacacgaagcagaaaccccgucuuacuuuguuucuuuccuuauauucucucuuggcauugucacauagguaaagagagauccauccagucagugaaaaccucgagagaugcgucacccucaaguuccucagcaguugcuucauccaagguuugugacuucagaaguuagcuagacauagcaugugaagaugaauugcagcuguuacuguggauacccgcggugcuaaauggacccauuugaaaccucgaguuuuaaguuaucccagcuggaaaaauaagugaucuuuuucucauugaucuuuuccuguaaguuucuauguagccuuugcuccucuccaauaaccaaaugggaauagguauuuaauggccuguguacucacaggguuuacuuugauuuggggaacugagaauguaggcaagaaagaagugcaacaugaauuuaaaacagcucaauuuuaauauucagcauuucuucucuuauuaacucauagaaaaguucuauaauuaguuuaaauuucaguucuauuggaaagucaagauucacaagccugauaauuuccuuaaagugcuagcugcuccuuuugugccuuauguguugggaagguggaaggcauguucuuuaccuaguuaccucugucagccccauacccuucucuugcccagaacuucuuuagauacucucuacuuuuugguuuuucuuuuaauguuuuugaccauuagaaaaaauaguuaucaccuggcaaucugguguuggucuacagggggcagcaguuucucacccugagaggaaaaaauaaccuuuggugacaaagcuucaccaggguccucagaaaucucaggcuucugggaugucacauuguuuucuguuuugcuuuguggcaggaggaggguuguaaauccuugcccuggccaaucuuugacagaggacauccucaggcuuacaaagccagcucuuugaaaaaucuguauuuauguguguuuuugaaauuggaacuuacuaagagguagcucaggcugguccugauaacaucccaucagccuccugagcgcuuagauuaccuucucagccaauggcuuuuuguugccaacacacuauggcuuucagaguaucuuuucagagugauagccuuuuagguacauccagugacggaggagcagauagaaaagguacugugguagauuuugcucuaccuuuuacaagaacuuagcaaucauuagcuugguuuuucuuuauaacucuuuugaaaacauaaaccucucuuuaaaauuaacgacauuguuuucuuggauaugccuuuguuuucuuuuaaaaaaauuaaaauauuuuuauuaauauauuuucuuuugauacuauuuuaaccuucugagcuggguaggugccuuauaccuauauucuaugugccaguagucccaguacuugaaggcugagacaggaggaugagcagacagcagagaucuauggaagauaaaucuaacaguguguauugugagcaugggagccauaacacccaagcaucacauacacaaggcaucagccccagcugacucuguaucuugcagggcacaggggccuagaugcuuaggacugucucugguugguugucuuguuuuguuuuugcuuuuuuucuuucuuuucuuuuuguuuuuuuuuuuuguuuuuguuuuuuugagacaggguuucccuguguaguccuggcuguccuggaacucacucuguagaccaggcuguagaccaggcugacgucgaacacagaaauccaccugccucugccucccaagugcugggaucaaaggugugcgccaccaugccaggcaucuuguuuuugcuuuuuaaaaaaugauuauuacuuuaaaauuauguauuuuugcgcuagugccagauaucaucagcuucugagccccuggaacugcaguuacagaugguugugaaccaacaaugugggugcuaggaaccaaauuaugcagaccaauuuuccuaaguagacucugaagaccacuguggcagccucuccaggccaagcauuugcucuguaauacacuuucguagacagacacggguauccuagaauaaaaggccucuuuuggguuuucuuacuucgcuuauguagaucucuuguuacaaagugacaguuuuuuuuggugccauuccuaaguuuucagaaaccugcaguuuuuuugagucaaaauagucaaguauguucuguguguguguguguguguauacauacauacaaacacauacaucaugaucaugcuaaauauuucccauggucagucuguaguuugcugagcuaaaucagguguggaugaagcuuguguguccccuucuaucaucguuacuaucaaacccuuuucucuuuucuaaugugaaguaaugaggccugccuaagucccuuccgugaaggaguuguauuuaucagaguggguuuuuguauguuuguuuguuuguuuugcuuuuuuuuuuucaagacauaguuucucuguauagcccuggcuguccuggaacucacucuauagaccaggcuggccucgaacucagaaaucugucugccucugccucccaagugcugggauuaaaggugugcggcaccaccgcucggauaucuugggaggacggcagcccuuucuuuggaccuuuucacgucuggcugccuguuggcugccuguuggaaggccccaugagcacaagccuucccccacucagucaguccuucuggaagcugccuaauagacauuauuucuuaggugaugucgaauuccuucaagcugaaaaucaagauuaaucaucuuggggggaggguuguauuuguagucagggacacacucuaagagaagagaggcaggaucagauuagaggugaaggcuuguaguugguaaauagguaaauggguauauaggaaauaggaugaagucagcagcaggccauaaggaacgguacauaaagagcagcuagcaguuugaggaagucauccagguugugaaucuugacuuuccuaagguaaggauuucuuucuaaucugaguucugcugcugcucuuacuaucuacagcgcaggcccccacuggcacugagugggcuggaaagguguuuugauguuuauauuuucuccaugaacucacucaucuuuuuucaaaagcgucuuuaguauaauaaauuugucagugaauauagaaaggagaaaguaccaaacauuaaauuuuuguuuaaguccuuuauuguuauucucacaacugcuuuguaaaggaaauaaguccgcucuaacaagggacugagcaacacugccuacuguaaucugccaguccuuccaaagcccacgcucugacugcaugguauuugauacagaaacaaggacauucaagucuuuaaccucuugugcaagaaguaugcuuuacauaacucaucacaaauuauaaauauaacauaguuaggccuuucuuauacauuaaauuuaccuuagggauggaaaaacgcucuuccagaggccccgggcaugacuccuuguuccggccugauugugugcagagggaguguggggugggaggcaacaagcucacacguggagcacagauauacaugcagauaaauaacacugguacauaauacaaaaaaaugcauauuuuaaaaaagauuuaccuuagugaaugucaaacaaaauuaaagauaaaaaguaauaaucaguguaauguuugcuguauccuaauacaguucucauuguauuauuuauuccuauuuaucaugguuuuuacacuggcccuuguuggguucuugaaguucuauguaaaugaaauuguuagugacgggugugcccuucaugugugaauugcuacuuacaggaauucuggguugggucuuauguuucuguuguuauuguuuuauuuauuuauuuauuuauuuauuuauuuauuuauuuauuauauguaaauacacuguagcugucuucagacacuccagaagagggaaucagaucucauuacagaugguugugagccaccaugugguugcugggauuugaacuccggaccuuuggaagagcagucgggugcucuuacccacugagccaucucaccagccccuguuguuauuguuauuuugaaacguucucuccugguguagcucuguuccucuggcuuuugcaguucuccgggcucagccuuagguuaaagggccuggcacuuucucaguuguuucugcaggagugaaaggggguaugguugcucucaaugcacagugcuuccugcuguuagaggccuuuaagaacacuaacgaagacaucucuucauuucccauaggcguuagacaaacccagcaggcuaacugagaaggaacuugcugaggcugaaagcaagugggcuaaugaaacacuagagaagucagacgaaaguaacuuggcugaaaugaaugaguuugagguaugcuuuaauuuccccucuguguuucacaccugaauguuuugucuggguuuuaaacugauggaagucguacgugguaccacacaccugugaucccaugcuguaggagaugcagugcaggcagaggucaucaucagauggucaggguccucaucagagcgucuuugaggccagccugcuguucauggguuucuaucuuuaaaacgaaaaaaaaaaaaaagggcaaaaaguaccucggcgugugcuuggggaauagcuuuguuguuauugaauuuaccacacacaggaggagugugggaacaguguuuuaaugaauggcuuuuuuuucuugcuuugcuugccuaguggugguggcacacaccuuuaguuccugcacuugggaacaaagguagagagaucucugaguuugaggucuacagagugaauucuaggacggaauauacagagaaaccaguuuuagggaaaacaaaacaaaaagagaaacuugguuuugcuucucccuccucuuaggcggcccuggggugagcccagggccuguccccagggccugucaguuacauccccacccuacguagaaaguguuugaugaguccuguguauaaaaauacugucuuaaccaugucuucacgcaugauaaaagggucagucuccaaaugcuuacuggguaauguacaccaggcagugguagcuaugguauccagaaggacuuguuugugaaugucugaguugucucccuuuuguuuguuuguuauuuuguugugugcaaagugcugguuugucguuuagauaguaauauucucuuaaacaggucaaaguuuucuuguuaucuuaggugugauuacagguauuuuugaauauucuuaaauaaauauauaaauuauaucaaguuguucuuagcacuuaguaaaacuuaaagcauagauaaggaaacuauuggauuauuuacuuauuaauauugauuauuuuaauaauuuagaauaaugaacucgggucaccagacuugagcuacaaauaccuuuauacacuaguccauccaccugucuuuuuuuuuuuuuuuuuuucuuaaagauuuauuuauuuauuuauuuauuuauuuauuuauuuauuauauguagguacacuguagcugucuucagacacaccagaagagggcgucagaucuuguuauggaugguugugagccaccaugugguugcugggaauugaacucaggaccuuuggaagagcagucagugcucuuaacugcugagucaucucaccagcccuuuuuuuccuuuuaaaauuguguguguguguguguguguguguguguacaggcgcgcacacacgcgcacgugugcgcaugcacaugcggcggucagagaaugacguuuuggggugcuucucuccuuccgaggcgucccacgaucugacucgagcaucaggcuuguggauggagcacuuucauuugcuccguuugccggcuccguucuuuuuccucacugucuuugcucucacagaaucucuuguugccugugauuguucauucuguucccauacugccgucuuuggaguacaggacaauguguggcucgccugugcccaggguaccugaggcugagaagcuuacgcaguccacaauucagggaggccggcgucacggugcuguuagcuguggagucuaaaacgggcuugaguucuaaugugaucccuugaaugcccugugcuuugaagggaggauuucuguuccucgagugacagaagagcacagagcucauccccagcccccugagugcaucucuuaaauuuuauuuuaauugauugaaaauuuuauacauauguacauauauguugaucauguguguucagucucucccuucaguccagcugcauacagcugagcuuccccuaacauaucuccgaacuuuccccuccagcuuuauuuucucccaguuuugucuuagguucuuccuguccaucuuagagguucccuggccagggugggaggcuaguguuuucagugucucuggccucccugacuaacagcuuguggggugauaguuggugcgccuggcacugagguuuucagguaauagcccugucuucuggaaguagcauugucucuucauacuccuuuaacuuucgcuguugcuuuuagucagcgcacaaacugguggccucugcauucuuauuuuugguuaaccuaacucacugcuccauccccuugccuucuccuagcuuaacucuuuagcuaccaguacccccaucccucacuuuucauaucacauguguuuugcugucuugucuuaaauguucucuuuaguugggcugcuauaucauuggaccucaucuugaucuauccuucauuuugguuaacccucccauaccuuugucuuucugcccuucucacuccacugcuugcuugacccucccucccugucucccuccacagucucucucuugcgcucucucucuauauauauaucccucucucccuuuccccuguaucaucuuguucuguaucccuaaauauacccaauugccuguuucuuagcucccuggcuuccacuguagguuaaguacgcaaaacaacauuugaagcuaggacccacauaagagaauguauguaguguuuaucuuuuggugccuggguggccucaguauaauuuuuucaaguuccauuagcaguauauuucaugauuucacuuuccuuuacaguugagugauguucaguuguguucuugguaacacauuuauauuauuuauucaucaggagauggccaucgucgugguugauucuauuucuuaguuguugugaacagagugacagugaacaugaguguaacucucuguaaaaagauaugaaguccuuucaguucauucccaggagaggucaaagggaguuguuuguuuaagcugcagaucagcuugugaagcugccaguauauucucaccagcagugccuagggauccacaccuacaccauugguagccacuuguaugugcuaccaucuugauggugauggucauucugacuguugugaggucaaaucauagaguagauuucauuuguauguccacuauagcuaagaauacugaaaagacuuugugugcacuaaccguuugauuuuuuuuuuuuucuguucaguuccuuagccuguuuuaaaauuuuuucuuuauguuuaaguuuuuuagucucuguguauugcagccacuaguccucugauauaugugugguuggcaaagauuucucccccauugugucaacuucuucuucacucacuuggcgguguccuuugcugcacaagugguuucccuguuggcucugcacugccagguccuguucccaacucuuuaccaugcacccccuacuucuuccuccagcacaggguuucucaaccugucaguagagaccucuccagggauccaacaauccuuucacagaccacccaaagccaguuauuuaggauucauaagaguauuaaaauuagaguuauguauuagcaaugaaauaauuuuaugguugguggucacuacaacaugagcaacuguaugacagggucucagaauuauaaacauuuagaaccacuggucuagguauuuucaaagauuaagauacuuuaaaaccgucuuaauuugcugaaaguauuuguccagauaagaauuugguagugcagguagagagagagcgcugucguaaaacguauucacccagguuggguucuuagccuccacagggucguucacagccacuuaacuccaauugacguccuuucuggccuccuugaguaucaugaacacagugcucguauagacaagcagacacccagacauauauguccuguagaacauuuuauugauuaauugaugugcuagggcccaccuuacuagguggcaguguaaccccaaagcagguaguccugaggugugagaaagcaugcugagcaagccggugagcaguauccuccauggcuucugcuuuaguuucugccuuggauuccuucagugcuggacugugagcaggauguuuaaguuaaauacaccuuuuuuguucucccacaaagguaaugguauuuaucacagcaauaggacgcaaccuaggauagucuuuaggguuucauguacagaguuauaugguguacacguuuccuuugcuugcauuacugcucuagcugagacuucaggcucuacacgaaagaguagcagauucagugagcaaccuugccuuguuacugaccuuaacuuuccucaguuaacaacauggcgacugacuggguuuguuuacacaggcucuuucuguuaggagagacgcuagaugcuuccucuguaaaguugcugugacuuuuaucaagaaaggaugcauuuaaggagauggucauauguauuuucuguuaaguauauuugcuuaauggacaguguauuaauuuauauauuugaaccauccucacaucucuugaauaaagucagcuuagucaugaugugaucuugauaugaucuuaaguucaguugaggacuuugcgucugagcucaucagggagauucuucuguaaguguuuuuucaugugugugugucugccugucugucuagauuuaguaucagaauaauaccauaucggcuucauaaaaauaauuuggaauacuuuuguuuauuuguuuccaguuauggaauaauuuaaguauuauuggcauucugauagaauuuuggggugaguacaucugguugugggccucuguuaguucagagacuugauuaccgcuccaguuuuauugcuggcaauggaucucuuucaguuguuuauuuuauguguaugaguuuuugucggaauguaugugccugggcccagaguuacagacagugacugccaugugagugguuggaacuauccuuaaccucgggaguacuugguauucuuagcugcugagccaucucuccaaccacuaauguaguagggcuuuaaaaccuauaucuuuaugguuuucugaauuucauaggcaucuguuuugcuuccuuuucauuuuuaauuuuacuaauuuggguuuuccuuccuuucucuuguuuaaucuggcaaagcauuugucacuuuuuaauuuuuuuucauagaaccagcucuuuauucuuuuaguuugugucucacaacaaauugagaaaaguagcagucauguccucuggccuuccucauacacgcucauuauguaucauggcaguauacauuuucuuaaaauugauuaaauagcauuuccuuuuaauauaaucuucucuuagugaccguauacacagucccaaaugcucuauguccuucaagaaaauaaccgaggacuuccucuguuuucaaggcgggauccacggcacccuuauuuauugaccagacagaagaacccgagucaaacacaguagaugguacagaacuguaugaagacagccagcucagcaaccgcucuaaagccauugccucgaaaaccaaagagauugagcaggugagaaugucguccuccacaggcacggccgcucuguucugugacgugaauguuugcacugaauaaauagagugauugucuuuuccacuugaaacuccagaauuccacugaauguguguagaggccagaggacagccucagguguuccgcgugucucuucuuuucugagacaggguucuguuuaguucagaaccaaugaaguggcuacccaggaagacccagaguacacuggucucugucucugggucuuucgguuccuuuguguuuccuguuggggucucauauuguagccuuggcuaauauggaacuaaagccaccuucagacucacugcagucuugcugccucaguuuccccaaugcuagguuuuucguuugagccaccgugucagcauuuuuuuuucccuguaaauucacuucaugugguggccuccuuguguuucuuuacuguaagagagacuucccaagggcaggacuugugcugccuagugguuugucucuaccaccuccaacagccauucaguguggccgacucaugagaggauucaccggguggaugaugggcaaguccuaacccuaacagugaccuuugggugguuccugggucacuuaaacuuacaggcugucguguguuucugccugcccugcuuagguggcacccucaccaaugcuggcuuacaagaugcuguugggauaagugaauucauguucugcccuuugcuuccuaugcucuauucgcuuuuaagauuuaugaguuuuuauguuacgugcuuuguguaggagugucugggcacuacuugugugccuggugccuucagaggguggaagaggguguugauccccuggaacuggaguuacagacagcuacaagcugcuauguggguacugggaauugaaaucagguucucuggaagagcagccagugcucuuaaacacgugucuagccuccugaguuguagauuuuugaagacaaguucucuuaagaguauaacuagaagaaaaacucagugggaauaccagggaguauuuuguguugucuuuuaugaauauccucacuguuucuuuguacucuuauuuacaauugguuacguugauugugagaaauuuaucauaccuugaugguguacuauuauuuagcaugaggucaauuuuuauagaucucugugaaaaacuacacauguuggaguguaaagacguuuauauauagcugcuauucaaaugcaugaaauagcuguugcuaaagcugagacucacuggaugccuagugacccaaagaaauggagagccagcucucuauuauggggguggugguacacuuauuuacgaugcuggggcagaggccagaggaucucuugaguuccaggccacccagagacuuaucagagaaggaaugacaaacaagggguaggggauaaauaaagaaaauggaauuacuacauuuuaguauuacuagaggauuaaaaugguuacugaauuauaaaacaguugagcaaggugacaggugccuguuuaugaaaaauggaggcaagaaaaaauuauuuguuacguaugguguauaucaugaggcacuaccuugagaaagagaugaucucuggggcgcucuucuguuagagacuucggauuccucacaugagcaagaaguaaggccagaauuuccccuucccccccaaauucaggaagcuagcacaugauaauaaauguaugguuagaaauauugcuaauuuuuaaauagagcaaauaauuuucaagauaacguuuuccaauuuaaggauuaaauaucaauggauagaaagucaugagggucuaaaaacaaggucguagcuacauuggguuuugguaauuucgccuuacauuuuuuaaauaaauaguaguaauuacauuauguguaugaguuugugacuuccuguauaucuguaugccuggugccaccagacacuaaaagaggacaucagauucccagaacuggaauuccagacaguugugagccgccaugcgggugcugggauugaagcuaguuccucuggagagcgagcagcaugugcucuuaacugcugagccaucucuucaacucuccuuggguuuuaaagcccaaggucuuuuaacugaggcaauauuauaguuuaaauaaaauucuacuugaaaguuucaucgugagcacacuacagcaguucuugacguuuaaaggcggcacauggguagacuguggugggauugauuaccucauugaggagacauaggguagacuguggugccauuaucucaguguggggacauucuuuuaauguauuuuuacuuuuucaucccuggacagaauuuuguuaauuagccuuaacaaagagugguccauuuuucauguuaaauuuuuugguuccaguugguagccuuuccuggcuucugaguuuauggcacaaauuuuagaauuucucaugaccuuuuauuaauuccaaagagaucuaaugcucaaggcuaugagcgagucacucacuugaauguuugcagcaaugccuuggcugauucagaguccguucugcuuugauaaaguggugcucagaauaaucuauaugugagauccucugguuucuuggaauccugacauccaauguuacuuucacaaagcuuccucuuucuucaaagacaaauacaauguaaccagguaccggaugcuuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguaccgggugcuuguacagguccgugcagaugagaugcaguguuaagacaaauacaauguaaccagguacagggugauuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguaccgggugcuuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguacagggugcuuguacagguccgugcagaugagaugcaguguuaagacaaauacaauguaaccagguaccgggugcuuguacagguccgugcagaugagaugcaguguuaagacaaauacaauguaaccagguacagggugcuuguacagguccgugcagaugagaugcaguguuaagacaaauacaauguaaccagguaccgggugcuuguacagguccgugcagaugagaugcaguguuaagacaaauacaauguaaccagguaccgggugcuuguacagguccgugcagaugagaugcaguguuaagacaaauacaauguaaccagguacagggugcuuguacagguccgugcagaugagaugcaguguuaagacaaauacaauguaaccagguaccgggugcuuguacagguccgugcagaugagaugcaguguuaagacaaauacaauguaaccagguaccgggugcuuguacagguccgugcagaugagaugcaguguuaaguggcagaagcuguucccagggguggcuguuagauagcuguggggugacuagccuucagugacaaauagaacuaguuuuaggaagaaagcagagccuucagggucuucaucuucaaagccacggugcauauuauguaguucucaauugcuuuuguuguaagacaagauccucagcagaggaagguagcacacacaccugacgaccugaauucaauuuucaaacccaugucaaagugagagaaccaacuccaaagaguugccacuuguccuccacacggguguaagacacacaugcccaaauauaucacgcugaggcgcacaguaaugauacauuuuauuuuauucuuaaagaaagguagaacuuuuugaauguagaauaacuauucuguuagguaucagagcuccucaagagcauuugcugauuacuugaguauuucauuaaaagucaucuucucacucaguagcucugagugggccguuaagcuuuagauuuucucgcauauuucuaguuaaugcugauucgacauccuguguuuagaauaaaauaauuaggagagaacuuuuugcugacaucuguuacuuauaagugaaaggcuguaaacaguuaccaccuugauauggguuagaaagguuacauaucuauaauuuaaauugagaugugguuagugaacaaauaaaauauaugaccgaaugaguuuugacagccguaugucuacagaacugcauuuacggugacagcagacagaaguguggcauuuagaagccauggugugauuccgugugauguuuuguucuacuuuaacuaccaguguuccuugauauauagauauguggauagaaaagugagcugauaaauacauaguccugauauagaaacaaguucagagauuuucagacauuuuaugauuuagaauuauccacaauaagaaaguaucucuagggucagcaagauggcucagugauuaaaacacuugcagccaaggcugaugaccaaaccauuugaucccagagacucuacaugauggaacgagaaacccagguaucugaccccuacaugacauguaucugcgcgcgcguguguguacauacaaauaaaagucuauguggauggacaaauagucuacaaagaaagaacauaucccauaucccugccuuuuaauaaacauuuucuguauugaggcauucucuacaugcucugcacaagaucaaggcacgcuuuccuaaaaguauguaaugccuucuucccugucuuuuucaggccauuccuguuaaguugcauuuaacaggaugugaacccuaaggcuuuuuuuuuuuuuuuugaucaggagacauuauuuauuaaagacaugcuuccagaacuguguagauuaucagauagcaauuucccauuauaauaccaaguaaaauacacaaaaaggcauuaaauaaucacuauaagacuugguuaaaaaauuccaugaucugggggcuggugagauggcucaguggguaagaguaccggacugcucuuccaaaggugcaguguucaagucccagcaaccacaugcuggcucacaaccaucaggaucugaagcccucuucuggugugucugaagacagcuacaguguacuuacauauaauaauuaaaaaaaaauuccaugaucagugauuaagcauguauacugaauauaggugauauaaaacgauagugaacaacaacaacaaaaaaccuauauaggcccuuaaaucaauauuuaaaaugacuaaaaaaugaaccauaugagggcuccuuaguuccugggauuuggguuuucuguaacuaacuauaaugucaugccgguauccuagcaccugaucugcuaagauucuggcacuggaguggauuugaagacacaggucaacaucagcacauuuuacaugugucgcagcaagaaucuuguguuaaguaaaucaaucacagcccaacauugaagcugcauuucuuuccgucuguggccugagaaugcugcuguucagugcuaugacuuuggaggcuuuuuaggacucuccacaucuuugagccucggucccauucugcccagggccuugggugcuguucuguggugcuugcgaugucuucacugucacacucaagugcaguugaugcuagaaagacggccuacugcacagugacccgaccaguggcuagccaggcccgucgugaaaaggccaucugagggccacacagguugcguuacggugucccacuauugucuuaauuccguguguaaguuccucucaaauuauuuagccuuccauuguuucacugugugucaauuuuauauuuuugaaugugauuuccaagaaccgguuggcucacuugaagccaugucaauuucguuaaaacauauucaaucuauaagguuuugaaauugaauauagaaguaaugcguagaaaugucagucacuugaguguguuccgcuugcagccaucuguguuuugaaugagaaaauguaagaaaugagaaauggucuaaccagccacugcgguuuaacccugcagcacugaacuuagucauccagcucagagcuccugcagagcgcuccacugcuucagcucagcgagccugcgcucaucgugucugcgcucagcugaaucauacuucucaaggcuuuuggguggaaaaauaacgaauuugggcacuuaacugcaugugugcuacugcccauuugaaacaauuucgugauugagaauaccuucacuaagacggaugcuugcucuuugaagauggcugaaggcggggccaccagacuagcacacagugagcugcucugggagagcccaccugcaguuagcaagaaaggaagcauuuggagugagcucuuuuagggauugacuuuaaugcuguggcugucacacaccuagaauuaggcauuauaaaggaccaaggauuggucuguuugugaguuagugaguuuaauuaggguuacuuacgggaacauggauaggguguuauuuguaagagugcaggcaauucaacaaugacuacaucaguuacaaaaggaaaugccucucccuccugcaguagcaaccucuguguguaaagccuuguggggaguggggccucaucagcuccucccuccagggugcaguauugagggaaccaguuuggugcaggguuaucacacuugcuaagaguuaaagagugcacaggccauugcaaaccuauaaaacaucucauaacacucugcccauucucucuuccuuaauguucccaauccuaggaguuggugauacagauguccuauuuagagccaagcaugccacaucaucacuuacuuuagacacuuagaccauguuuuagccucuacagucacaacuaacuggagaacgaagcuuccaugaccagacugggcagcagcucugcucugugaccacaaacaguuguuuacauggcaagaaacaagcaugccauggacauguaagcaaaauaugguggcaccuucccuaccaugggcuuuugaucauguguacagucccagauauucccuccuguggaucagggcucagauccaaccagaaaaagcugcugcuucacgauggacccauccccauuaccucgguggguaaugcugccugccugcugggucugcucuccguucaagcagccuacagagcaccaguagggaagagcugaguggguuagacugcccaggagaggggucaccagggugagugccugggaagcagauccccguuucacagauucuuaaugugcuuuaucaaagccaccgccugaggaaggccaaagaagagcuacaggacauggguuuguacaggaugcuuaauuuccugcuuguacaggaaaauuugugaaucuuugaaguuaggaaauauaauuguaggaauguggcugaaaauaaucuuuuuuuguuguuguguucuugcugucuugcagaggcuaaccuacauuucuugucuuaagcaauggcuuggcugacaggcauguccucuguccucuguccucuguccucugccuaaaggugccuaaaggacaccccugucaugguguuccuaaagucuauagaguuaguccuuuuguuuguuuuauaauaguaaaagaagguacucugaguucauucccacaccucugucucugucauaguacauccuaaaauacugcugcuuaaugagacuuuacuugaccacugaauuuuuuuuuuuuuuuuuuuuuuuuuuuuuuuuuuuuuuuuuuuuuuuuuuggauaauuccuaguugacuauggugagggugggaacauuauuugguugguuguuuuuuuguuugguuugguagcuuuuguuuuuguuuugguuugaguuucucuguguagcccugauauugucuuggaacuuacucuguagauuagacuggcuucaaaggacucagacaucugccugccccugacuccugaguucugggaugccaggauuaaaggcaugugccaccaccaccacccaucuugaggguagcaacaucuuaagggaaauguucuugaacauaaaaaguagagugaaaccuauagcauugguaaaggggauucuggcuuuuuuuuaaccuuggagaagacucaggugaugucuaucuacccgcacaguacacaugcacauguucagguacacacacuagauucgcaggccugucagucaucgcccugggauguguuguaucacaauagggcauugcuauccaguagcuccaccuaagaaacaucaagucaauuuagaagucauuuuguucucugccuagucauaagcugauaguaaauauuauucugcuccagugaugugugucaauuuuuaguuuccuuuaaauuucacauuuuaauuauuuuuguaacuuuuuaaaauuagcuuuuaugcaaagguuagauuauauaaucuuugacuuuuaauauuuaaauauuauuucauguucaaaacucaauauucuuuucauaucuuagccugguguguuuuauuguuuuccuggggauugaauccaggccuucccagugcugagcaagugugcugcugcugagcugucuguccagccuuuugcacucugucuuccauguuauuucagauuuaauaauagaauuuuacguacuuugaauuuuuaaccaccuucuuaguagcugcuggauaugcguagugagucauuagugcucgcccagcuagaguggugccuguauucuguagugggagagcaguuaucuguggcacagcucucuccuuacaguaucugcucacagcuucucucagcagccuggugccagcacucuccccagcuccuguuccuucuccuccuuucaagaaguccauaaauaaagaugaagcagaugaacauucauccuggacaugguaguaagagugugggcacagagaagagucagcuuucaguuugugauagguuaaaauaaaaugguuuucaaguagaggaaguucuagcuauugucauaugugaagcauuuagcccaccucacauaauagacacauucuuuguuuuuccuuguuaucagacaagcuacaaauguucuuaaaaguacagcucuuacuggguauuaucuugucuagacaucaagucuacccaauuguaugucacaauccauuaccagccacuucuucagacuuuguauauauagauuuaguaaaacacaacuuacaagauuugccucugaaacaaauuguauuucuacaguaauuuaaaaaaaucauuuaguuugccaaauuuuaaaguuuuugaaauguaugguuuacuaguuaaauauuacuugugguaugacuacaggaacuuucugcucuaguguuaggguaaagucuucauuuugagguagguagguggggcuggggaucugaccgcguugguaguuauccagcaugcauaaggcagcggguuugauuuccccagcacaucagaaacauggugugcugcagcaugcuggcaggccagcacucaggagacggagacggaggcaggaggcugaggagugcaaggccauccuugacugugcggcaagguugaagggaaggagauaacuuaguaucagauaaucuaucacuuuggaaguaucaaaauuaaggcucuaccuuuuuuuuuuuuuuuuuaauuagucauuuuaggcccuaauaagcugaaugacauuuugguaaaaaauauagacagugucacuuacaaaauuuauaagaaccauucuguaaaagguacaaacuaugaggaguccaugcuagaccuuucuuggggaugcugcccccagggaugcaggcagcuguuagguaaauguuuggguaaggcaagaucaagcgcaggcgcaggccacucacgccacuauucagcauugugugacagacuuucucugguaguaaauuacugucccugcuacucaauccucuuuacuuuaaacucaguaguuuuauuuguccuacagaaagcacuaaggacguuuguaaagcacaguguaguugaaacugcuuucaguuggugcuuuaugggcucagagccucuuugcacauuuguuaaauguaauuaagaacugguucuguagcaggauuuacaccuugucugaaaaccaucccuguaucggaaaucccaaguacuuaugccaagguuaaguaguacucgugcguuucuuagcagcucugagggagugacuacuuuuggauccuugaguguuuuauagaacugcuuugccggggcuuggacuccgggcuuccugugucuucugcucccucccuuugcgguguagcccauacguagagcaggauugacaugagguagaccuaaccuucuaccauuccuggcuugcucuuuuauuucuuacuuguuuucucuccuuccuuccccgccucucagucacauuuucucaagauguaaacaaacauuuacuguggaaugccuauggagugccucucuuauuccggguaccucugaccuccugcgcguugggguuaaagguguguagcagcaugcccagcagggaggacauuuuacaacuuacuagcuuuaauauaacucacaggcauaaauuaucuuaaauauagcccauuuuucaaaagauccauguccugacacauuauaagaaacuauguauaaaaaggaaauauauuuugaaauuaaaaaaaaaucuuauuccuuccuguugucaagaucaguuagaccacauaauuucuuauauuaaucuucucauuauguuuccaccauaucauaaguucaugacagcacaggagagauuuaggucagcuucaaaagcaacucuguggagauugccuguaguguugauguccacuggccucaguuaacuagcagcagaaccacacugcacagggcaggguccugcagauacugcuucagugcuguuaaaagggacucugucagcugacuaaagcaaagguacuugccuaaggaaaguugauuucuaccuaguagagggaggcagcacucuggaggauacauacugcgucuguauaacuggcagauagucacuaauuacuagcugcacaaaucauaaagcacaaucaauaaacaucuuuucucuggguaaaaaauuuaaagccaagcacucuguaacaagcaagauucccuuugugccuggccaguuucaaugaagucaauuaacuuccuguuucuuuacugcuuuuuggccuugcauuaaaaaaaaaugguggcauggaaaacauuuuuuuaaccagccacuuuuauguaagaguaaaggcucguguuugggcuugccuguguuuaagaagcauuuuauaauucauaccgaguaacuacagagucugagguccuggggcuuuagcucagcugccguucuuuacacucuacucaguuuagaaaguucccugagggcuugggauguggcauuucuaguuuauauuuauaaauucgaguuuacauggaauuccaggggaaaugacaucucccuacuagaauaacucagaacccaagaagacuguacggcuccauuucugguagugagggaccagcagaauggaaggauucuguuucauccugacuuauucaaauuauuauagaccccacaguugaugauggucagaugggaaaaugaagagcgagaagcagggcuaguguaaguauauuuacugaaacuuguagaaaacaauuaguacaucucccaccaugguuauauaagcaugcuuggguuggaguuugauuuaagaacaaugugugaugcacagaauagcuuauggaugaauuuggagcacaggcacauugugauccguugguauuggacagauuaguuuagcuauggagauauuugccuccuuuuuccuuagagagccccgauuacaccuggguggggugggggagaguggagcuguuuuuguuguaaggguaggagggaaacugaagauaaacggaguaauuacuaaaggaagaguagcuaacuuugaaaauucagagcaaccccuuccugaauagaacagagugggcugagguguuuuguuuuuguuuuuuguuuuuugguagaacgaacauaaguuagaaagaagcaauuuuacuaagagcauagcgaaacaagauaggaaagaggggaguccuauugaccgcuggaguuccugcauuggguguggaaagggcuuagaauacucaauguguuaugugcugauagagaagucuaccagagaguagggaguucacaguggauugaauaauugcaguuuuggacuucuuccaacgauuccuagcauccugacaguaaggauacacaggcuaagccaagcugcuucauuaaccaaguugucaaccuugcugguugaccaagggaaaauauucugcauggugccaaguaaccaaagaugcucacuaauuuagcaaagguaaugauuucauuaaaaaagagagcuggaacucuuuuuaaccuuuaauucuugaucagcuucaugagcuacuagauguugcacaguuuagaauuaaagaaggaagcaagagauaaaaauaaacgugugccuguaacucagcuucagacauugaucauagugcauucagaggaugguggaaacaaagugucucuguggagcccuggcuguccuggaacucacucuguagaccaggcuggccucgaacucagagauccuccugccucugccucccaagugcugggauuaaaggagugcgccaccacugcccggugaaaguauuauuuucauauuuaacguuuucagcaagaaguguccaugacaguacauaauuuucacacaaaggaaacugcuccuaaauauuuggggcuuaguuuuacugucuggucauguggaguguuggaggagggugugcuagucuguggcauguaggcuggaacuauaguaguuucuuugaacccucacagacuagaauugccaguaccgaacacauccaguccucacuucugccucccucugugcguggauuuuggcaagguggcugacuuaucaaguaaaggugcuuuacuugagucccaagaaccccuguggagauggaaauagaguucuugggcugcgucucuugauaugauugauuaugucuggguguuccuguggcucccuuuuacuuucaucagguaaggauggcacugucuguacuuuuaggaaugaauuaucagucagugucucgugccauugacagauagguggcacugugcuguucauauggcccaaggugcagagugagucuucagccucagacuaguccaugggggcaaagcaugaggaaaaccacugugggaagagaguggaauacaaccgugcacaauacagcauaauuuauaccaggggaaagcugggauuucaugguauuuuucuagucccuugggaaaguccaaggagcuaaggcacuguaguaguccuuaaaauaagaauuaggaaagaggcucccagcacccaagccuagagguuuuguggccauagacuucaucauagcucuguuguauuucaauuacaguuuauuaaacucucagugcuguaauccacuucuuagaguagccauaucuauggaaguuuuaaaagugaggcuuuuuuuucccuucaguuuugaagaugaacuauuuaaguuacauuuuuauuguuaguauagauacacaaguacucguagaucuuccuucuuuuuuuuuuuugagaggaaaaugauacucacccccaucucuggcaguucuuguauuuuuuuucccuuuguggcgugcacacagauaugaaggcuguauuuuccaagguuuuaacaguuggugcuugauauacaaaguauuggauuugaauccucaucuuuaauucugucugugggaaaucauuugaaggcuaacagacuguuuaaccugguucucauuuggccuguugacagcgugcugugcacgugaguagaauggcugcuacuguuuaguacauuaucauccaaaucuggcuuaacgcuguauguaauuguuccaguuuaauguggccugcuuugucucugaagcugaaauggccauuguuuagggagaguagacuacugaacacugagggaacacggcucagcuguuuggcauaaaaacugcugaacucacuggagaugacucaauauuugagagagaauuccagagccuuucuauauagcugcacaguggagacaaaagcagaaacuagaaacaucucucuuuaacuauugcuuuaucuugguaacauguaauccuuuucacuuuacaugguaccacccugaaugcuacuauuucuaaacuugguuuuguuuugggucuuuacaaaagcuguauuaucccucuuuaaucuuguuuucuuacaacguuucucauuguaucuauuggugguggugagaacuccaagugcacaguauuggauugcguaggcccuguccaccuauagccacagaugcagagccagagucauuaaggcugcauagcagaaacuggcuucaccacugcgguugguaccucggaacacauguaaauauucccuuuuaaaauaauagucuaauuuaccaguuaaguuacagaugauugguguuuacucaagagguaaauccugacuauaaauaauaauuucugggcuuuaaguuucacaguguauauauacacuacaccccugguugguggagucacaguguuaaaguugguguuuuacugucaugugacccuggaaauggguuuggagaugagaguggcuuagugcguuuuuccaggauguguuucuaugaaaacccucucaucucuccuaucugcacaagcacagggcaaugcagugaggggaaaauuagagaggaaacaaccauuugcaguucuuuuggcucacaugacgaggugagagaccuuucacccuuauuuuauuugaaccaauugaauauuuggugacaguuauccaaacaaaagguuuuauuucugauuuucccuguuuuucuuacuccaaauuuauuuauuauuuuaauucuggugauuuugcuaaacaaaaaaagcagggcuggagagauggcucagcgguuaagagcauugacuacucuucugaagguccugaguucaaaucccagcaaccacaugguggcuuacaaccaucuguaaugagaucugacgcccucuucuggagugucugaagacagcuacaguguacuuacauauaauaaauaaaugaaucuuuuuuuuuuuuuaaagcaguuuuugugcaccaguagcucaacuuugaaaaauauccauucaauagaauguacuguggagugaaaauacauguggcaaagaugauuagcccugcagacuuccuguagaauuucaauuuagcuguaguauugucaucugcccucaauuuguuacaaccagaaauauugaaugauauucagcaauucuuauucacacaaauauaggcauauaacuaauacgugaguuuucauucccuaagcucuaccuggauccuugauauagguaaugugugacuugauagacuuuuggaccagugagauagcucagcagcuuccacagcauugagcugccccagccugauagccagagucaucucuuagaccauguaaagagccucacgcaguguugcacgucgguaaucccaucacucgcccagugacguggaagugggaguauaugcuagacagucugucuacugagcuauccccagcccggggaaguuauuuuguuguucuuuuacuuuguuuggguuuuuaauguaaacuuugccuuuccuguguuucaaauccauuuugauuccagugccacguccagacuuaagauccuaagaggcaguagucuuagauacacugcgcugucgcagugggucgaugcuuuugcuuuaacccugcuugcuaccaacaagaucccugccccuuucugccucccgccugcauaacauucauauauguuaucacaucucuagauuacuugaaauccggaguucaauguagaauacuguuuaaggaguaaugaugaagugugcacgugggacauguagcuauggauguauagaccccgaugagauauucccucuagugaaaagaagugugcacaugggugcauagcuacgcauguguagacccugaugagacaacugccucuagucuuucaguagcucauccuaguuuucauguaugccuaagugcuuugcaacagauuaagcuacaugaguauauauauaugccaguguguaggguuaaauauuugugacuguguucuauguuuaaaauaugaaaacaucacagauaaaccucauuuugaaauuauuuaauuuuguuuuguuuuuuguuuaugcuguggugcaggacauggacaucagggcgguugcacaugcuagaccaccagcagcuacacacuguugcacaugcuagaccaucagcagcuauacaccagccuuuagaacuuguguguguguauagcaugcaugcaugcauauacacaugcauguauguguaaauaguaggcuauauaugagaauuugugauuauaauuuauacacaaugaauguuaguugagauauauaaguucuuagcuugcuuauaaaaagcaguggggcugcagcuuugagacacaugcuaaaauagauauuuuuuuauuaacaagaauacuagaaacaacauaggcuauaaaguuuucaugcauuuugcaucucuguacacacacauuagauguuuaaacuggucugcaucuuaaccggugcugucaauuuuugcuguuaaccuguuagauacuuggaaugucuaugccccaguuggacuuucuuucuuaacauacauuuuuauauuuccaucuuuuuuauuaauuaauuagccccacuuuguagagcaguuugaccucaggcuuagaucaucugcgucugccuccugagugcugaaugaaagcaugugucaccaugccuggcuuauuuucagguuugaaacaaaguuugcagcagacuucugagcacugauuauauuuuacagcacuccuuuaacagugauaagaguuuuuauuuccaccauucaucuucucuacucggcucuugcuuuuucuccucuagaauuccugcaggacuggagguacuugacacacauguuggcugauguaacgggcacuagaauuugaaacugacaaguguuggcuuuaauguuauuucauuaauaccaguauaaguguacagcuauagauggccucuguaugguacugagcaguauggucuuauaacugcacccccaauaacauucucauguuuugcccuguauuuccugaccucagucucugugcuuugacuguuucuguaauuuuuggaggcguuugacugacagucuugguguauaaacuccccagcauuggugcugguacuuuuucuugcuauugcuuuucuuauugugucuucugugacgaauaauugaugagcuuauuuggcccguauguuaccuguucuucuaaagcuugcuuuugcuguccauucaacauucguugacuuuuguuuuacaggaauggaaaaggaaugauuuuucuucguuguugccaaugauuaugguguccgugccucucucccugcccuuaccugagguccaggcucacccccagcuucugacugguauacccaguacugacuuuaucccuggaaaugacuaagcauggaaaacccaguccccaccacucuucacauucuguguuguuucugagacagggucucacuauggagucagagaugucuagcuugccuaggagagaauuuccucaguugguuguugaggugaaaggcucaccccaauucuagaguaaauaaaggaaaaaugagcccagcaguaacuaaaauuccuccccucugcuuccugagaauccaguguggccagcagccucaaauccaaaacagaaaggcucccucuccuaucacugugucugauagagaauacacacucuucuaggggucuuucucuugugaaugcucuguauugucucauuuaauccuugaaucggugauuggacacagacacugaaaacuacacacagaaauuaagaaaaaaaugaauuuauacugauucuuuuaauucguauacuaaucuuuaaauaguuuuuauuugcagaaacuuuugagaauaaccuuuguccuuggaguugcuccucucccaaguauuuggaauugauguggcuggcaaaccaguguugauugcgcuguuaacugagucccagagucugcaucccagagcugguagauucaaauaggagauuuuugugacuuagggaggacuucugccuguuuucuuggagacucuguucuauuccccucaaguggagcaucugggugugcugucugcucugugaaugaguguugugagggggguguaggcuuguucagauagcaacugucucuucuaggaguucuagcaaauuaugucuuucagggaaauggcccguuucaucuaauuaguaaaaagaguuuauaguaucccuuuauuugcuaaugaauauccuugaagucaaguaacuucugucuucucuccuuuccagaguugguuaguuuaauuauagaguuugcaguuuugcuuucuuuucaaagauccagguuuuggggauguaguuuccuuguaagagugccugccuaggaugcuuacagccuggguuccaugcucagcacgauacaaacagggcaugguggucauuacaugucauuacaugccugugcacuccagggcuggaggcggcagcagcauuucaaggccagucucuacugcacaguaguagcucagagauuagccugugcuaaaugagacccugucucaauauuagagaagccuaaaccguuugcuuauacacugauucuccuccuuauuuauuuuaugcguguacauaaauaaggaagccagagcacgggguggggugucuuccucagucacucuucauuucauaaacaaaucauuuguacgaagaacagaaagcucagugccagcugcugugagcugucuagccgggguuugaaaccuggguaugagcucagaguagggagcacuccucaucacugagccaucucuccagccucugcuuaaguuuuugagugaggguuaggcuugugugccaggcuuagagauccucacugcugggagugcacugagcuguuuggaaucgaauucaaacccucaugcuuacacagcaaggccuuacuuucugagccaucuucccuaccccuuauuuccuguuuuguuuuguuuuuuaagauuuauuuauuuuauguauaugaguacacuguagcugucuucagacauaccagaagaggguaucagaucccauuacagaugguugugagccaccaugugguugcugggauuugaacucaggaccuuuggaagaacagccaguggucuuaaccacugaaccaucucuccagcccuuauuuccuguuuuuaaguuuuuuuuuuuuucuguaauauuuucuuuuccaucuaguuauuugaauuuuaucuuuuauuucuagugucauaaacuacuaauuuugugucuucuaauaauacucaauuguuucauuuuucuauaaauauaguuuuugucacccauugcgaauuuggauauuuuauuuguauuuaauucauaauguuuuagaauuucccuugagacgucuuuggccuguguauuauuuguaacuauacuaggcuagagguuauuagaguguuuaucuaacacaggugagacccuggguucaauucuuagauuuauaagaaagcaaacagacaaaaaacccuuaaucuuugacagauuguugguacuuccuaaggguaugaaucauuuccgcuuaccucugucaugaggcuaggacccuccugaagcaggacaugaagcauguuaagcaaauguguuugguuaaaggaaaucacaugagaugaugaggaagcaacagcagaggaaagagucuuguuggauagugaaggagcacugcaggcaguuuacugcagagaggaccacccccacccucaucccccuguccccacccccccgacccccaccugucuuccauucuuggaaugcaugugcuaaucaaagcuuaucuugccuuaauuuugugcuucuccugccccaggaacacagaauaaaaguucuuuuuagaagaguuucacauccccacagacgacuuuguucaauuacuugcuacagugcugucaauuuugcaagcguggcaggagcuccaccagcucagcugccugugcagccccagcaaagccgcuuuaauagagcagguuugcuguugaguuugcuuugccaaggugucuuuuauauuuaccugaaaaaccuuauauaugaucugaaaguauaauuaguaacuaaaauuuuaucuaguuuaauauacucuuuuauuccuagaaguccuauguaaaauuugguuaacacuggccucgauaauaaagggcugugaaaccacgaugggugauguuuucauucugcggacaaauguagcugucugugcaguaugugugaccuccacccgcacacugaccugccuccuauuuugaucagguccaaacacaacaaaaucagcaauagagucuuccuguguggccuguagcuaucagaucugcggguuauugaugcauuuccaacuagggaccguaagcaaacaugcuccgccccagagagcugcgcccuuccugucauggauuggauuuacuguggaacagauuucggaaauagguuucugacaguuucauguuguguuuauaaaauguuacagggugaggucuuccuuuaacuaaaacuauuuccuaucugaugugcaacugggcauuaaaguuuuguuuuguuuuguuuuguuuuuuaaacuucccuuaaauagagacuuagguugcuuucaauaguuuugguuauuucuguagaaaaauguacaaacauuuuuguauuccaguaaauaauuuuaaaaagacucuuaaaaccuauuuuuaaauuaauuaauuuauucuauguguaugcauauuuugcuugcauguauaucugcauacucucagauggcaucagacacuugugagcugccauuagguccugggacuugaacucaggaacuucagaagagcagugagugcucuuaaccucugagacauuucuccagaauccccccaaagaagacuuuuaauaaaaacauauacuaagcaaaaauugcuuguggccugugaugauuucaguauuaggaguucagcaugcuuuuuucauauguagauaugcagcccaacuguguucugugaugggguuuaaauuggcauuuaagacuuuguagguucauucaguguaacaugaucuuuaucucgugcaucuguuauauauuuuuuuaaagccaguaaaauguaggccacccacaaaggaguccucugagaccugugguuggugugagaugagagcgcuguuauuagguaacaguguguuugcugggguuuaccuccaggaugcccaagcauccugagacgacucuuccguaggacugugguggcuugacuuggggagcacaugcuguaagaccaguuguaauguggcuguugucuuaguacuccagguagugaacgugacuaauagacugugucugcuugguuugcaagauacugauacuggguccauguccuggaagccucaggauaaacuggaauaaaugguugaguugaacuugauagcuuuuaaauagaugugaucauuauaaaaguguguguguguguguguguguguguguguguguguauuuuauugcuaacaagccaauuucauaacugugugugugugugagugugauauguauguauccaugcauacaugcuuguguggaauccagagcaguuguuucucuccuaccauaugagcucaaacucaggcccucaggcuuggcaggcagcuccuuaccggaucacagauauggguuuuauauauuguacuuugugucauaucauuuuguaaaauguuuuaauuuucuuggaacuggucagucagccucccucccuuccucccuccccucccucccucccucccucccucccucccucccucccugugugcucugggucucaggcuggauuugaaccuguucuauaguucagguuggccuaaaacugaggcaugguucuccugcaucagguuuuguaacucacaccaucacaccucccuuuguuaauuaauuucaagaucaugauaaugaguuuaguaaaauuuagcaacauaaauuuauugaguccuuaaaucgcuguuuuuuuuuuuuuaagauuuauuuauuauguguaaguacacuguagcugucuucagacacuccagaagagggcgccagauccuguuacagaugguugugagccaccaugugguugcugggaauugaacucaggaccuuuggaagagcagucagugcucuuaacugcugagccaucucuccagccccuaaaucacuguuuuuaagcagucaaauccuauuacacauuugacauccugaauucaguucugugagcccauguaaggcggaagaagagaaccaguuccacagagcuguccucugacugccauccucuguguguucagauccaucaacacccaguguguauagacacacacacacacacacauuuaguguagaggaaauacacaauuagugggcaguaaguaucuaauugcuagugauaaaguuugcauauuuugaaauaaaaguauauuuauuaaagaacacacaacgcauguacauguguguuuauauauacauggauguagcguacacaucugugcgugcgugauuuuuuuguuuggcggcuuuguuuaaauauuuguaggcaaagugcuucccucagacagaugcgcggcguccuuacagauguuuguuggaugaguugacugguugugacucagagucucugaaguucagaagcucucucccccuccucagagacagugucuuacgauuguaguaguucuggcugagagagaauuugcuauguagaccaaacuggccuccaacucagagauccuucugccccuccugggauuaaauguguggcuggcacgcugaugacaaagccuuucuucucuuaacaaaugagugaggauuuuuuugccuuucuuuuguccuuaccuucuuuaccuaacccaaguguaaagcccugugcuuuucucagugaugggugcgucugucugucugucugccugccugcuuauucaguugugagcugauacccaaggcauguggcugugcugauacaggggagguucagccaucuuacagguuuagcucccuuacagguuucagcagcugaguucuaccggcucagccagccaugggcuuaauucacucaucuaauccaaauguguuuugccauccuagguuuaccgacaagacugcgagacuuucgggaugguggugaaaaugcugauugaaaaagaucccucauuagaaaagucuguccaguuugcacugaggcagaacuuacacgagauaggugagcgcugcguggaagagcucaagcguuucauuacugaguaugacaacucugcucaggacuuuggagaccccuuuuagaagaagaaguacccaggucaaaagguuuucuuagauuguuuuuuucuccuuggauuguguaaauccuuacuauuuugugaugaagagaaauacuuuaugauagcuaagcacauuucuaguacuaaauaaacaucuacaauagcuuaaaguaucuuaauuagaauguuuccccuauguguagaauauucuacucuaucuucauacauuuccucccuccaaaaauaauauucaguuacuuuaauguucaaaagaaaaaagcagcucuggagagcagcucccuguauuuaacccauguuucauagucuuccaugacgucuauggucaucuuuuugcauaccguguaaagguugucuuuuuuauuuuguuuuguguuuuuugucuuuuuguucuuuuuuuucgagacaggguuucucuguguaucccuggcuguccuggaacccacucuguagaccaggcuggccucuaacucagaaauccgccugccucugccucccaagugcugggauuaaaggcgugcgccaccacugcuguauucagauguugauuuccagcugaauacucuuugguauuguuauuugaauugcuaagcaccuucauuguaguuuguaaacucuccucuccaccaccuucugauugguaaacacugagggccuguaggucaggaaaggaaaggcagggcagggcagggcaucacaaaaggaagucugacuuucagggacugaaagauaacgggccauguggcaaacauggaccaaaauaaauggauuaguuaagccauaggagcuaguugggaagaagccuaagauauaaggccuuggcauucauaaauaauaaaaagucucuguguuauuguugggagucaggggucgaaacagucuaacaguagugaucauuuggucucaggaguuuaauuuguaguuaagaucauuccagauugcauacaauuagugguaccguuagcauuuugaguuggugaugucaaaauaugcugucuuaaugaguuagaacuuugcuaucauucaauauuugcuuugagaauaauucuuauucaauauacaaaaaaaugcacuugaaaaucuguaaggaucuguuagaacaaaaucuucucccaagucaguaaacuugguucaucucuucuaugaagugcucuuaaggcuucuaccugcucucucuagacaauauuauggacuaacaggagagguaaucugagaugcaagaugaauauuaaguugagauggucucagaaacccaucucauggguauaauaaaaaaauuagaauauacagagcacuuaaguuauguuuuaggcccacauuauaucaaaaacgggaccugacauggcacucaugcuugggauuaagcuauagauuacucuguccaucuccgugaucucaguucugugggcguagaggggcucacugcucacaaguguccucagaacacacugaggccagcacagcugccagcagguccugagugagccacugaaucagugaagagacacuuaggaucucuugcucacuuccuggucccugguucacugaggcaaaauacuaaauuugugacauuaggcaccuuaaaaaaaaucacugcccaaucaaauuaucuaccuuuuuuugggggggggcgaggggggucagggucuuacaguauaguccuagcuagccugaaaaucucuguguagacuaggauagccuuaaacucacagacaucuccccaccccuaccucuuacaugcuggcguuaagcccacgggccacccugcucagcauccuuuuguuuguuuucauuuucauuuuuuuucuguccuuauuacuuuuugauucgagacaggguuuugcuguguguccuaggcuggcuucaaacuuaacugcucuggccuuuagcuuucgggauuccugccucagcuuuccugagccccaaugcuugccgugaccauugaguggccucuaugauccugucugcggauaucccuaaaccacauacagauuauacuuaaguagaaauagaagaaugguuaauuuuaaugagcccuaaaauagaugugugaagauuuguauuaugccauuuugaaaauuuaaaacuaauugacgacauguuuuuuguuuuguuuguuuucuuaaauuccccaagugagaacacuuguacguuuuggcauugagucuuuccaucccuuuucugcgcacacuccccuucugagcgugugcugcgcaaugccggucacuucaguaauaccacaagcgauuuuccuucuucccuuccacuaauucucagcucuuuaaaucaaguuauuaacaagcauacguauaaaauuugaggagcuuccaaggcaaaaaaaaaaaauguucacuugguagaaacauucauuuaaaaagagaaucuuacugauaaauuauuuaagugaaggcccagccagucauccucuuccuuccacucacacugggccuucgaagcuguguccagcuugccguccgcgcuguucugccaggcuccacaguguuaaauguuuccuucaucuuuguuuuuuuuuaaaugccuuuugacaucuaaaauucauguguacuagaguauguuuuauaaaauguuuuugauucuacggagacauguuuguaaguuauccauuguuuuucaauagaccugauucauaugauaaguucucauugccucaccauaaggccuugaugaucaauauggggaaagcagauacuguaaaugcaaaauaaagcauccgauacuaaguaauaaauu

SEQ ID NO: 7951 - RNA, 11952 nt, Mus musculus
auacacaacucaaagagaaaaauuuuauugauauaaaaugcacuuauaaaauguccacagaagacauguaauuuuucacugcuauauaaauuuauuggggauguuauucacaucuauugucaccuaaaacauaguguaaacaaugaguuauacccuaaaacaaaugcauacgugauucucagcaaucauugguuuaaucguuaguaggguuacaggaucacaucuauauucuggaaugugcauugacuucgauguaguguacuaggcuucagagcaucguugcacgugaugccucagaacagucccccacuggcucuggauccaggacacguagugcucccucugcuugaaguggcagcuguggugauggucuagacagggcuccaggacucucagugcagcacucuauggcacgugugacaacuguacacacguacaacuaaaaaguuuaccucucguaaacaagugugacgucacugucgacuguccugcauauguaaguaguaaagucuacguauuuguaaacaaacaaaacacacaauaaucaaaucuauuuuaaaaaauuuccaucagccuguaauuccucuuauggucuaugugaauacacgcugaauuucugaaaggcguguguauuagauaauaaggcucugcaaugggugcuucauauuucauaccaugaaauguacauuacugacauuaucuugugcagcaugaaguucaggucgaggacuuccagguccuggacacgaugguccacuucagaacuucucaguuauggcucugcagcagguuuagcagaugaaaucaccaaguguucuaacucccucuauuucaaguaacaaagaacucuugaggcucuaaacucucuagguuguaacugaaaacacaaagcuucagacaacccguguucugagacauuauucacugaaacaagaucccugggcuaaguauuaucugugucagccuacuaaguaguagaaaucaauaauuuuagaucugaacacuugcucccaagcaacaggacaauuugcuuuaagauacaugguuucaaagagaaaaacaaaaacaaaaacaaaacacaaaaccaaaaaaaaaaaaaaaaaaaccccuugaaacuuccaacauuuuucuuuaguuuuguuuuuuuuugagcgauccuuggcuuucgaacaugaacgucuggcgucagcccucuggacucacuuuggaaauagauagcucgaaaguucugcaaagaccuuacuggacgcgagucuuccagugcaggggggcgggggaugggaugggaagccugcacugucugguaccuuucgagcuucagugugaacuucguuucugagaucugaugcuacuacaauggagaggagggacaggaagcccugcugcaguuugccuuucuccaccgcggcagacagcccuuccugagcaugcucaaagcaaucagcugcccgccuccucccaggcuccuuaacacacucgacaggugugaguaucucaggguuguucgucguucgcuucccuucauagggaacguuagaccucacuacagaguucuacagagcaagaccuuaugcuugguggaacuggcccaccuaugggaaauauugaagauuaugugaaaguguggaaucaacacguuaugaaaacagugugacaaaaccaaacaucacuauguugaaaccuugucuaguuuuaacuaaaaaauaaaaaucaugagucuucuauagcauuaauuuaaaaaauacauagaagugaaaagugcuauuuuucaaaaaguacaauuuuccucccaacucuaucaacauggaaugauuucaguucuccuuguacuaaaagcuggaaacuuuacaaaacuauauugcaacauuuaauacgacaguucuagucaguaguggcuucugcuuccgcugggccccuaaucaaucuucggaucccccucuuucccgcaggaccuuucgguuuagcaaaacucugcuuaugugcaugcugcuugggguggacuucaucguacaggaaauccgcagucagcucauccccauugucuaucucaaucugcaagagaggaaggcaccaccgggguuaaacaacgucagggaaccuucacaacugccgcacuguacgccggcgcccagcugcggaugccuccaugaguguacccacaccuuccacaugagaacaagcaagggcugcggcuguaacgccugcugccuuccaucccuucugggagacacuagugcagccucucagcgcggcucuaaagguaacauuucccggcagcagcgagcacugcggccuccagcugcccugccuuaugaauucaaaccccucacuugcuccuucauccccugggcuaccuagagucucucuacaacagggcuaggccagcgauggcccacagaccaaaucuccagcccaacuuuagggcaauucacacuuuaaggggcuucaaaaacaaggggaagacacccaggucugcuggcaaagccuaagagguuugcugucuggucuugugcagcgucagcugacccuuugugaaaggugcuagcauacacugagugauggacgggaucuagaacugccccaggcucagcacccaacaccagcgguugauaaggaagaaucuuugccuauauccuagcggccuuuaagaagauauauggagaucugguagcaacaccccacuuuguaaacugcagaaauguucuauauguugcaauccuaaugcuacagauggccagugagcacuagugauaaucaguguuaaggaagggaaucuuacauuuuauucuguuuacacuuagccagccacaguggcuuauagcuaccacgcacuuagcgcauaucuaaccaugggcuaagacagggcacucugcaggcuccaaggacugaggauggaaacccuaagacuaaguacucuccugugugagccacgacaccacacuggacagcaugggaaugaagggcagacuggagcaacauccguaugcugaaacggcacggcccaccuuucugaucacauccaucuguagcugucgcucuacaaucucgagcagagggcucuugcagcuggaauacagcauccgcucucuuaugcugcacguguauccaggcaucgaauaaauaaaaacuguaaguucaaauaacaacaaguagaaaugucaacaaaagcaagucuauaaccuuccucaaauugcaucuaagcuccuggcaagaagcucagaagcauacagugcugagacagaagguaccacacggaagacaaggcaggcgucacauaccuacggacucuaaguagucuccuucgugggaaugcuuguacagaaagaaaugguaacgcgcugaauccuugggaauccucuuuggcaaaucucucaguucuguauuuucuguguuggccaaaauuauuguuucauuuuuuauaucuauuuccuaucaaaaagaaacagcacuugugaaacagguaaaacauaaauuaacuuagaugagagucaaagaugauguacagagguguagacugucaggagccaucgaagagaugcuaaggccuucccagaggaggcccaccuucuugcaugaacuaaaaugggcgagcucugagaggcaaggucccagaaagacuucaucucaagacuguuucuuguagcugaaaugucuuuccuguuauuauuaaauuaauauaauaauccgugggcauuagccuacccuauugaguagauuuucugcagaucaacauaaagauaaacauucaugaauuaaugcuuuuuagauaaauuaaugacuuuacaaacuucccugauuugaaucaaauaagguuaggaauaaaguuuuaagauaugguuguuuugcuagaaagacguaauaaaguuaguauuaagaauagaaugugcccauucgucguaauaguaaguaaaggcuucauaauaagaaauacaacugaguuuucauaauuacaacaaaaagagaaauaggcuugggacaaauuugugauccagcaaaacauucagguccaaggaugaggccacaggugugcagcaagccaaggccauguaaagaguguaacuagcuuugaacuuauaaugaguuuacagauggaaacacugcuuugaccuuauuagugauauccuguuacucccugcaugcgaccuuuuaccuagcaggcaauucuuccucacacagaggacgcuuuguguuaggauauaaaaggcugaaagcaauaacaaaaggcacugcagccauuucccgcuuuauugggugugcacgucugugugagugacaucuuuccuucccucuuuggguguguaugucugugagugacaucuuuccuuugcuuuuucucucugguuaaaaguuaaugagcucccuggccagcgaaaggcuucuggcugacucagcagaaaaaggaacacuagcaauaaauccucuacugaacucccggcugcucuacagcaggaugauugccagggaauuacauauuaaguguauagaguaaauagggguuaaguuucccagcgcuuacugaagcacagagcagagagcucccaggccagaggucaucagucuuuugcccuggaugcugugccccuuuagcucuugccagcuggcaggcccuggcaguggacuaucugacuuuuucacauaaaguacucugugauuuaaaaaaguaaauaaagagugagacccugccugaaaagaaaaaacauuaauaaaaggacaggaagaacaaaaccauaaggcuaguuaaaagucagaguuauccaagccauaagccagcaugcagaggagccccugucgagggaggcaccgucucuuaccaacugcacauaguugagcugcuucuuacucagcuucuccaaagccuggaaggcaucucgagaaauaggaaaggcuacgccuuggagugucuggugcuuuguguccacacucacaucaguuuggaccugaguacgacagauauaauugacuggugacgcuucaguauucaacaguguccacuggcaaaaauauaguacuuuaaaaaauacagcauaucucauuuacccuuucccagucuaugguucaaauccuuaaaacauuuuaaacgcaggaggcaaaucauuucucacacuggcuuacugccuugcuagcauacuguggacaugcagagugcaugacacacggcugugaacgacugggagggaugcuuggacagcaguguuagggcugagguguguccuuagcucaggcuggcucagguucaagcagcuacagaugcucuuccagagugccaucagcuuuaccucuuuaagcacaaacuuuucuugcuaggauuucugaagggaaaaauguguccagugugcacaggccucuacucuguucuacuggacgugagaugcagcacagacaccaugcacugacgggaggaggacgcgggacacagacagaacacauggcucaacaagcuccagcugugcacauuccagauguggggcuuucuguacuaaacaaugcuccguagacgagaggagggcgcuuccaggaagcgucucggugcacacgaauuuuccacuugagaaaugacagcuaugagagggccucaucugcaacauugcagcaagaagcagaaugcaaacuuuacuuaagagaugaaugaacucuacagcgugauucugaucaugagaacguuacagaacagaugcaagcgcauaccccagugugauccucuggguucugauugcaagaaacaaaacaaacuaucaaaccuguaaggucacauaaaaagcccuacucaacuuuaguuuaaaauauaugcuagauccuugcuauggacagauuauuaaagucacugagccaucgccaggcuggcccagccuaugaugaggaagaguggacagagguuuggggcacuaugcucuucucuguaguuucaguggaaagagagccauuauaaaagccaacuaagauggcugaggaaaagcauuaaacccuggcuccaaugugcuucacaaauucucagcuucccacacacgucuccauccaaggucacagaaaugaaagccugccuagaaaugugagcagccccuggcaucuuaaguuuacucucuucaguagacaccagucccugaaguaccauggucuuuagagauguucuuucugcagcuguggaaagcucuuugcagucgcuggguaacacacuuuccucuguucucuguccucacagggcagagcuucccgcaggaagucuguauuaacucugugaucucagggacagcccucuaggaacugcuguuacuuuaauaugaauguuuuacuugcuucugaaaacacguaaagcacacagaucaguuuuuaaccuaaacagaauaaaccuaagggacccaacuugugggucccccaggucuaugcacuaaacacgcuguccugacgcuggacacccugaagcagguuuagguugucugugaccuaccucguugauuuuaaucugccguaauucuuccucagcggcggucagcggggcaggggaagacugggacagcaaauacuuuuuauauccauguaaugauacguccuccuguacgcaaagacauaaacuauuauuccccgguaauacaacauggugagguuacacuagaaaacaacgcaauagagaaaaagacgcucccagccggaggcuucucucucgcccagcuucugcccugugccgagggcuucagaacaacugcauccuccucugguccucaaggcaggaagcauacaucuucugucucagucuggucaagcuucgagccgcgggccccccccccccccagagucagcaugccccaugggaauucaaacuguucggagucauucacucagucuaaauccuauauuaaagucacuuauaugguaucugcacaaguauucaucacacaagaagcaagucaaagaggcauacucaugagcaugcugcccucggaaggccacaagugagaaagcugagaggccagcacaccuccuggcucacagggagggaaaucacccccucuacuggcuaaagcaugucaucuucugacgcauuugccagcugguuuaaguagucuaaccaucuuaauucauaaauaaaucauaaauguaucaaugcagcacacaaacuaaaggauaagugcaucgcaauaguguuuauucucaacaccaaauagagacaagcaaaguuaauagcacaaacuugcaaaucuugagcuagaacaaugcccaucucacgcuuauagaccgggacacugaaaccccuaucuaucuucuuucaccuuuccccuuuuguuauucugagauagggucucucugugcagcacuggcuguccuggaacucagucuguagaccaggcugcucccacccucagaguguguugccucccucccucccucccacaugcugugauuacaacagguuuggcucaccacgccaggcuucaccagcuuugguuuauuuuuguuuugaaacauaaaaaaacacauauaaauguaagguuuuuaaaauaaauauaaguuuugcaccuuuacuguuccaaacacuucaucuuuaauguggccaccuccaaauucuuucuucagagucgcucuuguugccgcauacagcauuuucugacguaccuaugcaauugugaagguuuuagauguuaacaguauuaauuuuauaaaauauaccauuauaaaagcacggauguauuaaaaucuucaguacuuaaacagaucaggcugacacugacagcuguaaaaugggugucuaaaccauuaauaaccguuacgguaggucuuaaauuauguaggaugcuuguuuaaaauacaaaauaagcuccuggcuuuacaaaguacaaaacuggcuguuagaauaaagaauagccuaaaguacuguuugaaacuacgagggggaucaauacaaagcagccuuugccgugcuauuugacucaaagcuacuggguaagcaucacguguuccugggcucgggauggcggaugcugcugggggagcaacacugggauggacaugugcucgauuagugaggagccggagaagcucucaggggucacgauuaauuagcacaaacgauuucauaauuccaaacagggaaaucugcuauuucuuccagacagaaugaaaaucagguaaucuuuucagaauaucuagaugguauuaaaaagucagcuucuuaucauaaaccccagauucuuuaaaauaccgagcaacauucacauccaauuccaccuuuugcuguauuuccgucuacuaucagauguuuguguguuuggggggaaagauuaucccucuaugggaaaagacugccgcuucuaacccuuccuuuagccugaaaauacuucauuaaaaaaaaauucuuccuagcauuuaacgccaaacaaacaaacaaacaaacaaacaagcaaaccaaaacuacaaaaaaauuacucacaugagaaugaucuggagaccaugcaaugaauauccauucauaucccugggcauucugagagucuaaccugaauaauacauagcacggcugcuuguccuccagcaggggcaagacaaaggagucguaguccuguucccaggagucugaagguggacuacaggagccaaccaccaguugcucuaugaaaggagaauuugaaacagaugaaugcagugucguaucggacgcuaaacuaaugaagacaagaagagugacguaggucucaacuccuauaguaacagugcaguuaaauguucaaguagaggucaagcagaguucuauuuguuaaaauguugaaaaugaucacauauagagauauaaaauuuuauaccauauauacaacuucauuuaugacucaaaacuguaauucuugaaauuaauuauuaaauuauaaagaacuacaaagcaagcuucagcuccuacuaacaacacuacucgguuuaacuguugccugaacacaaacuacaacugcgagucgccacacgcuucaagugcugucuuguagaacuauguaagauuaugaaggguguuuucccaggcagcugucuguccccacagacagacaugcacuucagcacgacacagcaacagggcaaacccacgacagcuuccaccuuccccguaagagaacacgccgugguacagucacauaaaaauacuguuuguguuuuaaagucaucauaugcuagcaacacaaauccaccagaaaucccagaaauaaagaucaagaauauaacaauaugcacuuuauaugaacuuaaaaacagcauuaugugcuaaagaugauggauuuuauauaugugugugugugugucucuaucuaucuuuccaacuguagaugcuccacgaaaagaaaaguacagcugucaaagcuguccuucauuagagagacaguaacaguuaacaaggucuggaacaaacuauaaaguacuaggucauuaaguuaagagguggguauuuauguuuccauucucugaaacuuacuaguuuaacaauuuucucaagauuaaaaaaacaauuggaaaauauuuaagaaauagaaauuuucuuccuaaaguaugaauuagauacauuuuaucuuuccauuuugcuuacugaccgucacaauuuuagcugcuuugaaguauauacauuuguuccuacagacuuuaagauuuccuaaacuaguuucacaguuaaauauauaagcagaaaauggaaaacaaacuuaguuuauuuccaguuuaugaaaaaaaacaaguuauuuuuccaaaacaaaaugucuuaggguauuugaggccaacagaauauuuucagcacauucauuucaacaucgaguuauuaacaguuucuucaaauccaucuccuaucagauauagccacucagccaguuucccuguucauaaaauuaacauuaaggagucaauuuauaauuugccauuuucucagaacguuugcaaacaagaaaggaucucuguaugauccaaucaagcaauaaacaaacaaguaucucaaauguuucuacuucaaaacacagcucauugaacaacucacaaaauaauuaguuuuguuuucaauaaaugcccagcuacugauuuucauucuagaagcacugacauuagacauagauugugcugcagaaaaacacacaacaggugaagccuccacaccagaaagcaccugcugucuccgcaauggccgcccccaguuuaaaaggaaaacaggcugaaaggcaagcucugaacuugcuucaugcugauuaauaguucaaauuacucauaaggcuuggaaaccugaaacuguaacagcuaacccuccaggggcacagaguaucuuaaaacuguuaacuaaccauuuucgauagauauuuucagaagucuguauuucccguuucuggcucgggcaaagaucucuuugacaucuucgcuugcuguggaaaaugauaaagggaaaaaguguuuaaaccuagaaguaguuuaguuuguauucaccuaaagaaaacauaaauuaaagaaacauguggagcauacaggcccuucuuauuguuacuauaaaacagaagcauaaaauaccggccuuggcgaggagcaaaaacuaaauacuagcauuuagaaguacaggaacuucaacauuuuagccacagaacucaguagcagaaguaacacuagggugaaugcuuucagucaaacccaguaacagacaaauugcuccauguuugaaaauguuaacaaguugcuucuaauaguccaauuuuaaguuugugaugugugcuccuucaucaaaucauguccuguaucuguccaucaagaacaacaggaucaaaucucauauacugauuaaagaaaaaaccuguaaaauacacuagaucuuacauuuuucuugcaucucuuuguaaaaaguuauagaagccacccaggaaauaaacauuuaauaaccuaucccuuguguagucaucauugcuucaaauucggucuuguguuguugauugccaagcaagacuaauauuuaugucuuguuauauaaaaggcucaaacauuaaacaauaauuuugauauauuuaaaugucauaaguaacacgggggagauuaaguguuguuagaucggagacuauuuuugccugcaugugcacagaauuaagugguagugucaaaaacccuuaaaacacaaaacaaguuauuaaguggucacccgggggaaaggcucgguuaacuauuacgggaagugcucuaguuuauauuagaacucguuaaauaaccccgggauauauuauuugauuccguaggagguugaguacguccaaguugccuauuuuccaaccaggaaauaauaaacggcgaguaagauacacaaguaaacugcacauucgacugucuccacgggguucaugaggugcagcuacacagaucagacuuugcagcugccuggggugcaagcauccaaagauggaaaaacacucccuacucgggauuucuccggaaggaaggcacacccgcguucugagagaaaaauccggggaguucgggaggcagccuacagcggugggagcuguuugguuuucaaacgaucugagugcuggagcaaucuccuuuggcgggucccgaggaaaaagucgcucggcuggccggcggcaggagcccagccagcuucggucuuccugcucucggcacgggggccgggaugcagcggggucgcccgggacauccucacauccucgguucucuggcagccaccaccggccuguuacguggcggccgccggggagggccgcgagggacacagucggggccgucgcacccagagcagcuccaaugccgugcgcgccuccagcguuccggcccgcagccucccgggagccccugccccguggcgccguuaccuuggaugccugucuggugggacauggcggcggccccaggcucccggcuccggcgcagggugcgguagcggccccggccggcggauccaggaaguagcggcuccgccugugcgucaucggcccgcgacucucagccccg

SEQ ID NO: 7952 - RNA, 36746 nt, Mus musculus
aggcgggggcuggacucuuaaagggcuacuuacagagcuuagugagguacaaauguaaguggcccaagaguggccuccgcaucuguuuccagauaacccaagacugcccgaaagguaaacgaaaguaggguauauuuagagcauccaggaccuaggauuuucuuggcaugccucaguaacuggagaagugagaucucaggagccgaauuguaaguuaggaaauaagaugcuguugucaagugaccggaaguucaauaccaguuauaucacuuauuuggugugaaaaggcucaaggaaaguguucaaugcuuguaaggauuuuuuuuuuuuuuuagacaaugugacucaaguuagggaaaaggagccucagcuaagaacaugacuccaucaaauuggccugaaggcaagucuauggagcacuuuuuaaauuggugauugacacggaagggcccagcccauugugggcggugccacgccugggccgguggucguggguuguauaagaaagcaggcggagcaagccauggugagcaaggcagcgcucuuccauggcuucugcaucaauccuugucuccagguuccugcccugacuuccgucauugaugggcuugugacacggaaguaaguaaauaagcuuuucucuguccuuggcugcuuuggguagagcuguuuaccacagugauagaaagcaaacucggacagaugggacgcuccccagaccgcagcuuccucauccaucugaugagaagaacaaagcuuucuagaaccgcuaaauggagcagagucuguagaauggaaaauggccagaaucgacuguugaugacggccucauucucauaaugauuuuaauccucggcauuugaaauaucauucuauuuuaaucauaacgacagccgugauagccuaaugguuucgcugggcauuuuucugggaaagaaggcuaagagaauguacucuuccggucucuguauucuacugacaccgcaaccuuccaacacagugcuguucgauucugugagccaccacaguaauaggcacacagcaucccucggcagguaccccagagggucacuguaaucccgggccugcuguucacguuccuagcaugcuaugguggaguuagucagguaauugggcaaugagggaccuuuuggaggccugagccaucuuucugagacuggcuuaauucaaucauuaugguuaucuauagguacauccauuuuuuuuuuuuuuuuugguaugacauagcucuauucuuuaugggagaaaaagaaaaaagaauccuacuguguguauauaccauauuuccuuuacuucuccaucugggauugcuccgccccagguugcuucuauaacuuaacuacugugaaauguguugugauaaacauugacaugcaaguguggcauuugauuuggaucuguugggugacaccaagccugcuuggguuacacggaaggucuguucauaguuucuaaagggaccuguaaacugauucuguaguggcuggacuagcuuacacucaucaauaacauagauuggcuucuuuuugucuuuauccuacuugguacuuacugucuccauuccaaugauugcuuauuugcuaguuuagugccguugugugccaugguacaggugugccgugguauaggugugcugugguauaggugugccaugguacaggugugccaugguacaggugugcugugguauaggugugcugugguauagguguggaggucagaggaccacuugcagaaguugguuuucuccuuccacuguguagguuccagagaucaaacucaaguugucagauuugucaaaggugcccugguccacuaagccaacuuggccaugauauaaguuuucucaauaacuugccauucggacugggauaaaaugagauuucaauguaguuuuuauuuauaguuuucugauggguggugauguugagguuuuuuuuuuuucaugugguuaucggucauuuguuuuucauccuuugagaaccgucagcucauuugauuggcccauuuacugacugaaucauuugaacuauuguuauuuguuuuuguuugauugauugauuuuagaucuuuauguagucuagauauuaauccuccaugagauacauggcuaacaaagacuuccucggucucuccagucgguucauuauuuccuugaaauaaagaagaguuauuuuauuugccaauuccugggcugauuaccugugcagcugaguucuauuacgaaaaugcuugcuuaggucaauaucuuaaaauguguuccuuacuucuuccucuauuaauuucagagcuguaauuaaacaggcuuucaucuauguagagucuauuuuaaaagucauuuaaaaauuuuaaaucucucucucucucucucucucccucccucccuccuuccguguguguguguguguguguguguguguguguuugugugugugugugugugugugugauuuuuauguacaccacaaggggccuucagagaccaguggauaucacauuccuugaaacuguuacagucagugugagcugcuuuagggaaccuggguacuggaccuuagucuuuuacaagagcagugaguacccugaaucgcugaguuaucuuucagugaguuuuguauaggauaagcaauagguaucuaguuuccugccugugguuuuccaagcaccauuuauugaagacacugucuuuuaucacaacaugcauuuuuggcaucuuugucagaggccguguggcuggaacuccccugguucuuaugugaguucuucaucuguucuguuguccugcauugguuuuuuguuuuuuuuuuuguuguuguuguuuuuuccuggugccaguuccuugcucguuuugugacaauggcuccuucaucaaaucugaagcuuaccuuaaugcuagcuggguucguuuuaaaggacaacuugacauaaucuagguaucaccuggaaagcaagucucagggagggacugucuagaucagauugaucuauuggacauaucugugggagaguaucuugauuauguuaauugaggaaggaagauuugcccauuaugggugguacccuucccaagacuugggguguguagugaauuucacggaggaaaccagcuguauccuaagaauguaugcguucauucugucugcucuugacuguggaugugucuagcuacuucaaguucuugccaccuuggccuucccaaauggaguguaacuuggaauuaugagcuaaaaacgaacacuuccucuccuaauuucauuuugucggggcauuuuagcacagcaauggcuagggaaauuaagauaacucaguauacacaguauccuugacaaccaagggaugaagugaccaagccaguggacaucugccagccugcuguuggcuaacccagggcuggcacagaagucggaugaacucaaugaacguggaagcagaagcagaaacucaacauggccccugcagcaggaacuucuggccacaccuggccucucugauucucugcugacugccugcucagauagccaaagagacccacauauuuuacuuucucacucuuuaccaaauccuuguauuaccucuccuuccaaaauacccaaaucaggacaggccuguugagauuaaucuuggcugucagaucgauucuaucuggaauaaucuaugaugccagcugcugggcacaacucggaggcuugcucuucacugggguauuggaagugagaagaccuacccuaaacauaguggcgccuucuguuggcagccaagacagaaggaaccugagggaaagcuuuugcaucuccuugauaccggagaguccgcuccuaucuugauuacggguucauuuauucugcugcugcugucacugcuguuacauucccgugcugucaucuggaucagcuucuccaggcuucuggcuuugcagugugaacugaagaucgucccucuucaggaacccuccaggacuucuucaccagguugggcugugagugauucucagccacuccgauguacagacagcuagcuguuucuggacuaaccagacuguagcaccuaagaucaaucuaauaagccucccuuuggauguauuccuucugucgggaagccugacugauacaacggccaagcuccuucuacugggaggcauuuuacugcgacuuccccauuucuagcugcuguguauaggaaguguuauagcaggcacuauccuggcaggacucuaagucuggccagugcuguggaggagagagccaaguuuuagaccccugggauguggguucaggacuggaaguugcacauacuacagccaaacaugaggcacacugaguaugauguuacgacauaggccuggcaaaguaaagucuugaaagaugcagcagccuccagucaaagccuuggggacaaucagacccaacacaucuccuaagccggacaagcccucuucccagugggcccaagaaccacacagaugacaauauaacauugcaguucuuugaauaugauauuccauuaccucugcucugaaagguuucugcuaggaaauaugucaauaaucaaaugaaggcucuuuuguacguaaaaauucucugcuuuuggguuuugacuacuugcucauaaggacuugggauucccuagccuaaauccauggauuuuacagcuauagauguauacuccuuuccccgguggcuugcccagcuuuuuaucgcuguggcaaauauuggaaauacauuauuuuaaaaacagaaaaggguuuccccccucaaaauaaaggguucaguguacggcccacauauccuguuguguaucauggugagucuggaugaagauuccauuugcuaugugagaggaagaagagagccaaaucccauaacccccauccugggcacacccccuagacagucccauucauucuuaccuuguuauuuacacuucccauagcaucaggcuggagccaagccuuugacacauggacuugggggaacgugccagucagacugccagaaauaacuugagguuggaaaggcacguuucuggcucaugguuucaguccauugaccuuugccccacugauucugggucuauggcgaggucaaucugcagagauuaccuagcucaaggcugacuggugggaagggagggaccaugaacaaccucugaagguaccucaggguggcuccagcuugccaaaacagcaccaccugcuggagacauauauauucaacucauaacccuggggggcgacaauucacaagcaaaccacaacugguggcguuccugggcuaaaugauugccgcccccauguuuggucaacguucagcuguaauuaauuucuauauguuuucuuuuucucccgacugucucucuaugugguggucagguugcuagucucucgggauucuaggguucucuuccccucauuuccuuugcuguugugacugacuaaugcccauucucccgucuucgcgcucacccggcuucucaccggccugccccagucugcugugaagcaccuucaaugaccggccagcucaguggcuguguuccucagcuccguuucuguuggauguauguccgaccggccagcucaguggccguguuccucagcuccguuucuguuggaugcggauguuauguccgguacagcaauggaugcgugcuuaugauucugucuuucuguaagaaucuuugucgucaugcaguaaguccuuaacagaggcugaacaggggcugcugagauggcucagcgguuaagagcaccgacugcucuugcagguccugaguucaagucccagcaaccacaugguggcucacaaccaucuguaaugagaucugacucccucuucuggagugucugaagacagcuacaguguacucacauauaauaaguaaauaaauauuuuuuuuuaaaaaaaagagaggcugaacuguaaagggaacugaggaggccgacaggcaaaaagucucgaaggguucacucuuuuucucugggaacagaaagguauaaagccugaaaugugugucagcuaccacacacguuuacauauauauauaauuucauaugucaugagugaaccguauuuauaucauuuucauucuauccuuuccuacuucaucuuggacucacgacuuccucucucuacuucuugcuuucuuucacacacauauucuuucuugcucucuuucacacacacaaagucucucucucucucucucucucucucucucucucucucucucucucucucucucaugcacgaacacaugcacaaacgagugcauacacacaucugacacaauuuagugaugcucagaugugcaugugguagacaccugaagauaacucaguaugaacaaaauccaaacugagagucuguauuaagccaucaccuacacagaacagccucaaauguagaaucagggagccuuucaaagggaaagaacacaggaaagcuacauccugguugucaguugcaggugcaagcaagcaagcaagcaguuuaacaaaagccaaaauguggcaguuagcugguauggucaucauaaagcauccugguccucugguccuucuaaaauguucccugaggguguuguacaguauaugacuaacuggagacaagcacguuuucaaaaaacggaacagaauaaaaagccucuaugaucuggacagcucaucacucagaaguuaauaucuuucuugguuuucauauauauauauauauauauauauauauauauauauauauauauauauauauauaaacuuuauauauauauaaguuucucccuauaggaugggugcuauguccauugccuuuucacucaugaaagcaugccugagaaaacaacucaccacaggguagguuuuagcuugugaauucgguuccuagacaguuggcucugucugcuuuagacucuagugaggcagagcagcaugccgggagcacaagaugguggaugcuaauuucaugaugcuuagagccaaucagagcucugggucaggaaccacacauccucagaggcaucuucaggaagccacgcccccagucuggucccacuuccacaguugcaguccuuccaaaggucugauggauuauggcgccaucgguagaugaaugaauccuuugauuagaugaaagccaucacgauccaguuacuuuccaacagcccaccugugaauauggcauuggggaccaagucuucagugaauggguuuuucaggggcuauuuuauaucucaaccacgaagcacuuugacacaauggggagcaaaaguggaccucccuagcugccugggcaucaccuauuagaaugcugucuguuaccaucaucgaucuuaaaacgagggagcaaauuccacuaacccuacacuaauuccuaucaccauacagacauccucugagaacauauuacucauaugaacauagacuuuuguuuguuuggucuucaggaccuggguuuccaagcuuaccuuucauccauuauguuauuaaaugaauuauuuuauuuuauuuuuaaucuagcagucuuuugucugugccuggacuuccugguagaggguaugcacaauucuggcaaguuaaagcggaaugaagaggugcuaggagcagagacaguuggugaguguucuucagauuggaaaacuuggcacucgacggcaguggacagaguccagcaguuaauggcggagggauugaaccaugacuuauucaguacccauccugcuugcgguauuccaaaugucaaggauucguucuguuacauuguuuccauuuuacauccggaaauuacccgaagcauucauugaugaccaaggcaugaaguccuuacaaauuauucauuuguucaaauuguucuauaggccauuagagucuuuuaugaagccuuuuuaucaauuauuuguaaugacaauuuacacauuuagcuauauuuuuaguuugcugcuuguuaagccuuaaagccuuaaaaugagacaaaaaaaccugcuugagacaauguuucacaugagugaagugauucaaaaacaacagccaaagacguggauccagcugaauucccagggaguuccacugacgugauucaaaagugucuuuuauuauuacuucacaacauugaaaaaaaguacauuuacuuauuuauuuaggcgggggcugggucaucuucagagugugggaucugaggucagcuuuugggggucaguucucuccuucuaccguuagggaccuggggguugaacucagguugucaggcugggacuugaacccuuuacccacugagccaucucaugagcccccuuucacaacaucugccuguccuuuagagucaggguuuccuuaguuacucaaauaauauggugagaauaauauucacacagcaugcccccacacaugcagaauugcacaguggacuuugcuaaugaugccacauauguccccaaggcuuccuuuaugggacccccuuucuuugucuccucuccccuccuucuguuccuuguucaucugucaucugguuucgucccuccccaccucccuuuucucucuccucuccucucccuccuccucuuuuccauucagucuucuccucugcagucugugcucuguccuuucucuuauucuucucucugaguaacaguugucgauguaucaacagauuguuuacauuggaaggccaucaacagguugucuacauuggaaggccauggcccuaguuugaaaacaggucaaccaggaacagauauuaauuuacuuugugcuuacagaauacacgagcacugaugucuaaaguuucauuuuaacaccgugaugugccacaaugacaauaauaaugauguuggggcuaaaugaugucaugggucacuugucugggucuggugacagcacuugggagucagaggcaagagaaucuuugugauaucaaggcuagccugguuuauauagugacuuucaggcuagccagggcuacauaaugauguucuaucucaaagagagagagagagagagagagagagagagagagagagagagauugggggggggagugugcaggugaucagauuugccaagcugauugggcaaaucaguaucaugaucagcacucagacauuauaacucuggagucaguguguaccacgaagccgugcccaggagcaaccauuaaaaauaaauauucuaguucucuuuaaaacccacugaacagcucuuauggaugaaauuaauguugcaagauaguauuaugccacaggagaggagaagggucuuuaacguccugucuccaaauguucugcuaucaccaauaagacaggaccuguaggaugcuuuuaaagaaucaucguccagcauccuucugauugguuauuuauuuauuuauuauuuauuauuauuaguuuuuuacuucagucugccuaaaugcucugaacagagacacaccugcuaugauccuggagacagcaacaucuaaugagucagcagaacggaauuugacugccuaugucuugacccaguagccaaccacacccgacacacccccugacuauccaagccggaguaaggagggauuugagugcuaacuuccccuacaccauuuacgcagggcucccgcucucccaaucagugcacuugaaauaagccacuguaccuugggaugaagagucugcaggacuccaagucauucaaaaacagagucuuaugaauaaauauaagagagagagagagagagagagagagagagagagagagagagagagagagagagagagaggagggagggagggagggagagagagagagggggggagagagagagggggagagagagagagggagagggggagagagagagagggagagggagagggagggagagggagagggagagggagggagagagagagagagagagagagagagagagagagagagagagagagagagagagagaaagagagagagagagagagaccugauuaggaugagcaaacagaccuagggaguucagauaaccacggagacucagcugagcuggaccaaagcuaaccucuugauucccggcucugggcugcccccuuguggucagccuugaacagcgcugguuaaacugaccaccccugacaauguccucucuuucauuucuacccuagaaggaauaaaaugacaaacugauuuacaaaacaacuagcagucgagucuccaucaggucgucgucugcuuucuauucuagugcuucuaaacacugugaacacgccuagccuuauaaacgcugugaacacaccuagccauggucacaucgcauguaucuauuuagucugugcaaguuggggggaaaaguacaagauugucuaccuacagugacacacugguuuuagggguaccacagaaccacaaaauucugccuuuguagauuaucuugcuuaugccucucacuaacuucccugcuugugagaaagcacgaaaauugacauuaaaauucugccgcgugaagcugcugucucucuuuggcaacgacucucaaccuuccuaacacugcaacccuuugauagagucccucauguuguggugaccuccagccauaaaaguauccuguggcucuuucaugccuguaauuuugcuacuguuaugugucauaauguauauaucugguaugcagagagucuuaggcaacaccugugaaagggucguucaaccccaaaagggaucgcgacccacagguugagaaccagugcuuuagagccuugcaaagacacgcacuguacugaaauucguucuucucauuuuccccugacgugcuccucaaaaggacgcaagguucacgugaugucaagcggcuuugcuauucuuggucugaaguuucagagauuaauguccaauauuucauacacauaggcacauauaugcacacaugcauagaaaauuguccccuaauuacuauguuuuacuaauuuuuauaagguaugaaaaagggggggcaagcauuugacuaaagcaacuuccauaccauagcugccuuuaucuuugugagaugcauacaagaccuacagauguugccugaaguguagagaugaccaaauccuauguguacuauacauguccuacauaagaauguguaccucugauaaucuuuaauuuacaaauuaaacacaguaacuaacuagcaacagcgaauaacaaaucagagccauauaaggauacaauaucaucacagcugugugaguaaugccacaucuuucuguaaguaucuuccaugauaaacucaucccuccuauaacugaaauugugagaggcccacccacacauaaggugggcuaccacaucccaguucagggcaaaagucaaagcaaccuuagaaaccauucuucuaaauccgcaagccaagagcauaaggugagcagucuguuuuuaacuuuacaaaaggaggugggagguuccggucccugaacuugauggaaccugagcguggguuaaccuucaagggacacuugcugcugcaguucuggaaaggccagcucuggacuguagucugcacgggcucagggucgacuguucccacaacagguggagcagauggcgacuucuccuggacucaucccaaguugggcuuugcauuuuuuuuucaagagaaaaaucaaaugcuuugaugaauguauccuucuucccugaugcuagaaggguuuaguucuggcuuccuuuccaauggucugguggagaggauggcgaauuuuuaugaauuuuuuuugcuguuuucaggcuggaaaagaaagaauagauagagcuucugugggauugacuuggaaccauugagauauaugcauacuuuuguggucuuauuuccuuccuuccuuccuuccuuccuuccuuccuuccuuccuuccuuccuuccuuccuucccucccucccucccucccucccucccucccucccucccuccuuccuuccuuccucccucccucccacugaaacaugaccucucuacgaaaucagagaugcgacuuucuuugcuaacugauguugaagguauauaaugagaguacuccuguuuaccaugacaggaaacaucauaugcuuucacauggucaaaaccaugcaggaagugcuacuggaaguguuucgaagggacagaugaaguguggcaguuagggucccugauugugagucgaaacagugacuuauacuacuucaaauaccugaauggcgcuguuaaugccagaaacaaaggcaaccaucuguauuccauuuuuauuacuuguaacuaauugaagggaugaucuccccccgccccaaagucuccuuacaggcagaauaacaccugguggcguucaugagaugcuagcauaguuaagacuacgucccugagguucauagagugcucccaaagugcuuucuggaguaagacaaucaccaucucgaguccuucuguuuuuaaaugacuugagccauuaggcacgcuuucucacgccaagguggacucucucuguaaacaccaucccuuccccucuacugugaagcauuaaaccuaagagcugucccucauugguguuagacccagcagguauggacaguccaggccacucuuggguucuggcaucucccccucucccgggucaccucgcucacaggguaacacccugguucucauccauccugccaacugugcuggucugcugccuggacgcuucuaacauuuuacaccaucaucaaaugcccauucucugugcucguguagguuugaucucuuaaagcaagucuuuccuucuuacccuaccaucuucaucuuuuguuuuucaaugaaaaaauuauucuauucuuuauuuucuuccccuuuucccuccagaccucaugaccugguaucugucuucauggucugcugacauggucugugauggugucacuguggaccaugaaggugaguugacaagaggcucugagaguagacacgagggucaauaggugcagaucagcuuucaauucacaccucuggcugcugugugguccuggugauguguuuacauuuucucaguguuggauuccuccuuggcgacaggaauuauugugaaggcuagauaaggacacaguuugaagucuggccuuuacugacaugugguaauuguuacuaauaugaugcaauuugaugcuuugauacccauguguggcggagaguaacgagucaggcugauuagcagucccucaucucaaauauuuaucagcuuacgguauuuuugacuauccccucuuuuaaccauuuugaaauauacaguauguuauuaaucauagucaccuugcuaugcaauagagcugacugcgccauugaaccagugucucaugguaaucaaugcauuauuugcuaucgcccacagcuauuguguuagucuauuugugcuucuauaacaaaauaaccaaggcugaauaauuuauaaacaacaacuguguuuauaauauuauuuucuccugguuuucucccaucccuuugaacauuucuucugcacuuucuccuggucuauagcuaaaaugcucuguuuggucacucuguaugcacauguuauuuaagauuagauuuagcagugagaaguuccaagccuccccaaacaaugacgucaacaagaaaaagaauaauuuucuucucaacgucuggauguggagagaucggugcuaaggugacaacuguucacagaguuccugaagcuccuccuagugugguccuugcucuguucagcauccaucuccaaggucaccugugccuuaagcucaguccuucaggucugaauucucacaggaagggugcagagcaaagggcaaaaaggaguugacagcugcuuuugauuggucuagacuaacucguauggccacuccuggcuucccuaggcgugagacaugcagguuggcuggguuaaaagguaaggauccuacugagcaaucagaucuacucaccggccuccauaccaugccaaaacgcuccuggguguuauccauuuuacgacacauggcauucacacaacuaucuccagaaguguaccugagcucucuagggauguccuaagcuggguaacuuaagacacagaugcugucucacaguuugguaugguauguauucuguacuguauauauguuuacaucuguaugcauugguaugcgcauauauuauauauaugcacauauguucuucuuucguagaauuaccccacaggagagucugauaaagggcacaugugauuuugaucuggcccccuuagggcuguaacgacaauuucagcguggauuugaggcccaugcuuucaguucagagugugcucuguugugguaucgucucaugcgcuucucauguucuguguguuguucucacugucucagacaugauacccauauuuaccggauuuuucagcauaguucuacuaucauauaauuuuguuuuguuuuguuucuuguuuuucagacaggcuuucucuggguaguccuggcuguccuagaacuugcucuguagaccagggcagccuugacuucagacaucuaccugccccugccucccauuuacugggcuuaaaaaggagugugcccccaccaucuggcuauaauucauuuuuuuuaaaagaugauugauaucuuagauugcugaaguaucaguggacgcucacacauuuguaaggauuugaugugaaaauuacuaauuggagagaccuguuuuagacucuaaguucucauuggcuggaccucugaaauauggccaauagacucgaugcugguuuuccgguucucaucccuuccugaauuguacuaagcaugaggggguguuuaugagaggcagcaugcagagcccugccucguucuaggguaagugagguagcuaacugauggcaccaggcuggucuguguccucucuuuaccuccucccacaccacagagcuuucacugcgcaguuaacacagaugccagcagcauuucuucacaguccucacccuguaaccuagauacacacuuucucuagucucagguuaacaagaaaacaagcaaaaaguauuacccaaggauauguugguauuaccccaagcgaagucagcagacaagaaauugaguccaguguguaggacacuauuaggaaucuaguuuuuuguuuuuuuuuuuuucagaugagcauuuccccugaggauaacuagcuaggguuuuuuccccccauuuuucuuauauguauagguguuuuucauccauguaugcaugugcauuaucugugugcaguacccaauggggccagaagaagaaacugcacccacucagccuggaguuacagacugcuacgugccaccacgugggcacuaagaauugaaccucaguucucugaaagaguagccaguguucuuaaucacugagccaucucucuggcuucuuucaaguauuuuuaaucgaaugacaauuuauuuuucucuuauuucucuaauuuuuauacuaccguauaaugaaaucauuuauaguauaagccccuagcuggguugaggggggcacaucucaggaacaggucauauauugggaccuaacucuuuugcuacaagagugucaagugaagaagcucuuaacagacauuucuuaagagagucuagccacugugugcaaagagcacuugagacucagucugguuugccaucaaccagguguagaaacacagcguuuugggcccaucacuaugggucuucugugaaaggaaguaugauuacaucuggguuuccuagccuuguugcuacugcuggaagaagaggccucagauacuaucaaacacacuguugggaagcugugaggcccacucucugcugcuccucgcagcugcucugacgguugcugagucgguugcuuacacagcuguuguagcugagggcgauccaggcaccguuccagccuucaagcuguuuguuagcccuuagcagaugccuuagaaguccgaggaagagccugcucuauagugcagaaacucgguucugaccauucccaaccacucgggcugccgacucugaggccugccuuccugagucacagaacuuugcaugugugagaucgaaagucaauuugcuuuuuagguuuuaguugggauccucuauuccugcuccuucaaccuaggauucuguuaauauucucaagccacccuucccuuagcaagauuucaauuucagaauucccuuaaugugaagaacaaaauucuggcaugcccaauuucuuuugauaguuuuguuuacauuuggggaccacaauucaauuugucaaauguuauugugagagauauaacaagagaaagauggauuguuggcugucauuucagacuagugccacauuuagccauaucacaaggacaagacuaugagaagcaggcuggguuuuagacagacaagaaaauugcccacaaaacaaaccagcauugcuagggggcccuuaaauguaauggcuuuauugacaucauuugauauaagguaaagaguguguaaacacguuuucauucugccacaaccaagacaauaugaaggacucacacuguuuauuuccgugucccuuaugucaggcgugugcuagucaugaugguguagcaugugagagaucauguuaggcaugugcuagucaugaugguguagcaugugagagaucaugucaggcaugugcuagucaugaugguguagcauguaaaggcaacggacauugccccugacaugauggagcucacuucuuuuuuuuuucuccauuuuuuauuagguauuuagcucauuuacauuuccaaugcuauaccaaaagucccccauaccccccccucccauaccccuacccacccacucccccuuuuuggcccuggcauuccccuguacuggggcauauaaaguuugcaaguccaaugggccucucuuuccagugauggccgacuaggccaucuuuugauacauaugcagcuagagacaagagcuccgggguacugcuuaguucauauuguuguuccaccuauaggguugcaguucccuuuaguuccuugggugcuuucucuaguuccuccauugggggcccugugguccauucaauagcugacugugagcauccacuucuguguuugcuaggcccuggcauagucucacaagagacagcuauaucuggguccuuucagcaaaaucuugcuaguguauacaauggugucagcauuuggaagcugaucaugggauggaucucuggauauggcaaucacuagaugguccauccuuucgucagagcuccaaauuuugucucuguaacuccuuccauggguguuuuguuuccuauucuaagaaggggcaaaguguccacacuuuggucuucguucucuugaguuuaauguguuuagcaaauuguaucuuauaucuuggguauccuaaguuucugggcuaauauccacuuaucagugaguacauauugugagaguuccuuugugauuggguuaccucacucaggaugaugcccuccagguccauccauuuggcuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggcgcauguguccuucuuaucgguuggggcaucuucuggauauaugcccaggagagguauugcgggauccuccgguaguacuauguccaauuuucugaggaaccgccagacugauuuccagagugguuguacaagcuugcaaucccacccacaauggaggaguguuccccuuucuccacaucuucgccagcaucugcugucaccugaauuuuucaucuuagccauucugacuggugugagguggaaucucaggguuguuuugauuugcauuucccugaugauuaaagauguugaacauuuuuucaggugguucucugccauuugguauuccucgggugagaaaucuuuguucaguucugagccccauuuuuuaaugggguuauuugauuuuauggagucuaccuucuuuaaugggguuauuugauuuuauggagucuaccuucuugaguuaaagaagaucucagaagauggaaagaucucccaugcucauggaucggcaggaucaauauaguaaaaauggcuaucuugccaaaagcaaucuacagauucaaugcaauccccaucaaaauuccaacucaauucuucaacgaauuagaaagggcaaucagcagauucaucuggaauaacaaaaaaccuaggauagcaaaaacucuucucaaggauaaaagaaccucugguggaaucaccaugcccgaccuaaagauguacuacagagcaauugugauaaaaacugcaugguacugguauaaugacagacaaguagaccaauggaacagaauuaaagacccagagaugaacccacacaccuauggucacuugaucuuugacaagggagcuaaaaccauccaauggaaaaaagacagcauuuucaacaaauggugcuggcacaacuggcgguuaucauguagaagauuucgaauugauccaguucuaucuccuuguacuaaggucaaaucuaaguggauuaaggaucuccacauaaaaccagagacacugaaacuuauagaggagaaaguagggaaaagccucgaagauauggguacaggggaaaaauuccugaauagaacagcaauggcuugugcuguaagaucgagaaucgauaaaugggaccucauaaacuugcaaagcuucugcaaggcaaaagacacugucaauaagacaaaaagaccaccaacagaaugggaaaggaucuuuaccuaucccaaaucagacaggggacuaauauccaauauauauaaagaacucaagaaggagcucacuucuuaaugcaagagacauucaauaaguauugagccaagucaauaacaggcaauucuuaagaacacgaugaagaacauucaaaugaugcgaugagugggugggauccgacccgacggugaucaauucauucaugcauguuuuuauugaaaauguauaauauguuuugugcaucaugguaggagaugcuuaaauaauuauuaaugggaggcaucgcaagcauuguaagcguuuagugcagacacugcacaaugcauuauuuuguauaaucuaauauaguccuacauguuuuguuuuguagcucuuuggagagacuauuucaguaugcagcccugguggucuccgagaaauaucagagaggcuacacacgugaaaagacccacaacauggcugccuaaaugugacuaaauaaggaugauaugaacgaucgaugcgcugacauggaagggaaaguucaggaggccucgacucuagaugaagaacugaaaauaacaugcacacacacauaccaacagugaaagaaaaagcagccaagaauuugagagagccaagggggugucuuacccgcguucggcaccaacucuuacgcgcguucacgaccggccaggaagaacgcagcaaaccggaaucuucugcagcaaagcuuuauugcuuacaucuucaggagccagagagcaagagagcaagagugcaagagagagaaaaagaacaagaacaagaaagcaagagagcaagaaugagaaaacaagagaaagaauggcaaaaccccgucccuuuuaaggagaauuauccuccgccuaggacguauuacucccugauuggcugcagcccaucggcucaguugucaucacgagaaaggcagaacacauggcgggaaaacugccccugcacgugugcagauuauguuuaccacuuagaacacagcugucagugccaucuuauaauggcaaaugugagggcggcuucccacagggguguauauaucaucuucugaaagacaaacuuacaugauguuagaagguaaaauauaaacucugaagaaagagucugcugugaagcgucacugggggguagcauuccaggugccuccugccacucucacguguucagagguugaggauuuugagaaaugcagugggucuguaucauucaauguguuuguacugagugaguaacaccuccuauuuccagagcucuccuuaugucuguguuaggggauggguaagauaauuguuuuucaaaguaagcuugguuuuuagcucgaaaagaaguauuuuugguggacuuuuugguuugggaaguugagcaagucuuagagacucaucugcguaagaagggggagugggucuguccucacgguguagguguaagcaaccauucuguaugcgugggaggggacgugggccuggguuucuccucccaguggagacaguugguauucugugcaauugucagcucuuucuuguacacugucauaggaguuuguggucuauggggaggcugggugaaagccagagucucacaugaacuggcagugacuccagagaaguaggacccaugaaagagcuauagaggcgauugcccacagaagacccugcaauggcauggggugguggaaugaaaagagagacuugaagucccacaaggcuucucuuuucuccacuggaaucuaugcucuuaugucuugcacuguccuguggggaaugcacuucugugcugggauaaggcauagccgcaggcucccaaccaaccaccagaagggauggggagcguuggagaguggcagucuggaaugaggaaauggccgaggaugaagacugcgagcacauccugguuguucuuugaacuucaguggcuucuggauucuggaggcccaggugguuccacucagcacuucagacuuaugggauuauaucaccagagaaaagaaagaaauguuggguaauagguuauggguccacagaugguguuguaagugacgucaagggugugauuuauuuucugauagagagcaagaaguagagaaaaacauagagauaugaaggauauucucuagggaggaggcagggcuugcaggagagggguguguguguguguguguguguguguguguguguauggugugggaguguguguguguaugugugugggagagagcaugugugugguauauguauauguaugcguguguauguguauguaugugugugugcauguagggagaauguaugugaguauaugugugaguguguguguaugugugugaugugagugugggggggagugaggggagauugucugugaguaugugugugugugugcgcgugagugccugugugugugugugaugugagugugggaggaaugaggggggcugugugugaguaugugugaguaugugugagugugagugccuggguguguguuugaguaugugugagugugugugugugagugccugggugugugugugugaguaugugugagugugugugugagugccugggugugugugugaguaugugugagugugugugugugagugccugggugugugugugugaguaugugugagugugugugugagugccugggugugugugagaguauguguaugaggguguaugagugugugucacuuuguguguuauuauggacugaacccauccagagacuugaccucucccaaugugcuaccucuucagccuuucucuugcuccucuucuggaggaggcaaugucuccuauguggccuaggcuggucuugaacucacagcaaccuuccugccuugggaucaaguguugagauuggauuucggaaaugcaccuuagagaccgaacauugcaugguaagcacacaggagggguaaaaagagcagcgagcagggaaguuuucugaggggccacacgacucuucacgauucuauccaaggcuuccuucuguuuucagagagaucacagggcucuuuaugauccagggcuuccuucugugccuagaagggaccuuuaaaaagacaaaccugaugaccucagccaucaaacuggaaacaugucagugguuucccacugucuguaaaacagaaagucuuagcugacuugaugggcccugccuaggcuggcugauacccaguuugcagugccagcugagcacgcccccuucuagucgucccugguccuacuggaucuaguuuuuaaaccugagcuuguugcaucugggccucaagagaagcuugucacucacugugugaccccuccccucuccucuucagcgcaccucguauguaucagauguagugcugcuucaucgggauuaucuuccgcggcccugaagaguaggugauguucccagaaugcaucuguaguucucuguacucugugguuccucuguuuguuuagcuaagcaccauucuguacauugaagauaccacagugacaguaacagacacaaaccuuggccuugggagcucuauaggggaggggacacuuuaccuaucucagggguacagcuuaguuugggaaucagauugacauaagaaagaguagagaaaacucugaaguuaaaaaaaauugcauuuaauguaaguuuccuuugacaugggagccuuuauaaagaaaggaagggcccaaagcgguauagacucaaugcauauauaccggauugaacagacaggacaucuuggagaaauaaccaaggcgcacagggaacuaaacgaacguaacaaguaucuuagugagcucuucuuguucagagcucuguaggucuccacuuccugucuuugugaggagaaauuaucguuccuuccgccgcagggaaggcaggucucgcguggagauguggggauuucaucaucucggguuggagaaaaaggacgaagccgaugcuuuauugaaucugcuaccuuuuacaagaucguuuaacccucgauaaccgauuauuucagaauggcauguuuugggccgaugcuuuucgaaugcuguuagcuuauauucgucccgauuggacuggcacauuuacuguuuguauugucuauugauucagguccaugagggcagagaacacgucggucuuguuuagcacguuauacuccagcguggaguauugacugauacacuagggaugagucaguaaaacggagaguaucaacauucgaaauucacugggggucguucuaucuauaauccggaaguauuaagacaccucacagacguuugcagcgcagccgaugcuguaaagcugugcaccaggcuuggaaagcgccgacacuugcugggaauuaugauugauauuuaagaguggcuugacucguugggugaauaaacuucagccucucuucagccaaauauugauuccaggcacuuaaaagauauuugaugcugacagggguaggauagaucaaaggaaaacccccacaacccugguggcuugucagaggcucuggcaagccuucauccauucuuguagaagcaauuuuaaaagcacaccuacaucuuggagacagccuguacuuguagggugcucagaaucgauuuucuuugugaguguaucuaccguuguggaauaauagaacuaagagagaaacuuguuugcucucagaaugagucuuuggcaaacuaguuuuuaacuguacuuaaaugcaaguucugaaagaacagugcaaacaaguaaaaucucaacucuaggugguacauuucuugaggacaacucuuugucauacucaccuuuggauucucugaacugagagauccgggcagugaccaauuauccagaguauuguuauuuuuugaaugggagauaaacauuacuuaguuuguuuaauuuacuuaccaaagugaugucaaaugaugaauuggcaugacaucucuguuuugauagguuauuuugauacugucaauacaacuagaggaagcagucaaccaaaucaaaagaaaauauuuaggucacauugucguacacguuuauaacguaccuacguucauaagggagucaaauaauaaaugcaaaaacaacaaaaacaccacagaacagacccaggagaagagaaggacauuaaggaaacauuugaggaaaaccacagcaauuuagcauuaugccaaacucugaguguccuacuggcucacaccaagagggaaacaugacagaauccuccgcucuucgcccuccauuaggaggaaaugucacuauucaucaggagaggaguacuuuccucauccugaggucugaggaaauuuaucaugucagucuuuauguagaagacagugaaagaaauacagagaaaaaguuccugucaguuuuagaagugaagacggaaagaugaauauaugugaggccccaucucuuuccaucagugaccaagagaggagggccugucagccaucauggcaagagcagucccguuaggauaagaugggcguugagcuuguaugggauggugugacauuaaacuuggagaugaggaacuuagacuuuuguaucucccuaggauccuugcauuucaaagcuccagggaacuggaagugugucagaagacaagcaggagggaccugcagugugauggagaaggucagaucuuugggggaagucucugcgucagccugugauggccuucucuucuaggcuuuguauuugggggguccuugugagcuuuucuauugacggaaaguuguuuagagaaaugcagcuugugaguuuuuauguuuaccgacggagccuucugcuuuaguaacuucggcuucacugugacccaaguacccaacgaaacaacuucagaaagaaaggacuuauuuaagcuuauguuucagaggauucaguccgcacauacaagcugcauuguuuuugggucuuugaugagauagagcaucguggacauagcuggagcguguggcaaagguuauucaucucaugauagacacgaaacauggagaaaugguccagauggggccaggguuaagaugugcccuauguuguauuuccuccagugagaucucauguuaaagucuucagggcuuucucagauaggguuaccaauuggagauugaguaugugagcuucagggaacaucucauaugcaaaccauaacaccuuccccuacugucucaguuuggguuccaugccugugaacagacaccaugaccaaguuaacucuuauaaaggacaacauuuaauuggggcuggcuuacaguuucagagguucaguccauuaucaucaaugugaggagcauggcagcauccaggcaggcaugaugcaggaggagccaagaguucuacaucuugauccuacacagccaggagaggacuaucuccugcagacagccaggaggagucucugucuuucacacuggguggagcuugaacauaggaccuuaaagcccauccccuaaccgaaaacacauccuuuugccuggacccagauucauuaucugcuuuuacugauguguguuucucaacagaccucacaacaucuaacuuaccauacacugaauuuaaucuauuguacuucauguguguauugggcagggugauacuagaucgcauucuugagcagggugaucugaggacacaauaaaaaaaaagugguuaacaaagaugugggugggaguauuagugaccucugcaggcucauucggcacuuggagucagcuccugugguggcaguggugaauggggagcuagugccgugcuugacccucgcagauuguauuauuauagauuguguucuugucuuucgcuuuccuuucauaggugauugaacguuggaugaagacuucucuuuccacguguugcuaucuggagaggccauacaacuugcccuguugauagaauaaggaagguucucuaagaaccagcuucgugcuucuugaccucauuggguggcccuaucagucuggaucuuaaagugaacacaacgugcuaaucugcaacaggagccacaacuugauagggauggagaauaggcauguuuuguaaaaccgcuguuucuugguugcuugauacugcaaugugacuccccucgccccccaugaauacaaagcaaugauucugucucuuaacauccacguuuguccauggagcagcuggagacagcuguucuggagagcaaguggucaacguguagaccucgcuggccccguaggguuauaaugaaaugaaggcugaugaggagaagcaggugccacagcagcagcagcagcagcagcagcagcaguguagugagagauuaguaagaaguaauccuugccugccuagaaacaggcugaaccuaaguguuggggggagccaggcuccucugauuguuuaagaggacagcucaggaucaugcuggccauuugagugaguuuccuaggugguaucugggaaggucgucaacaagggaguuguuacagcauucugugccccagauaugaaaaugauuggcaugucuggacauguaacugcugccguggugaugcgccuggagcuggcucuccagggcaugcacugggcucugcaggaggcaggagccgcauuaguaccugucaagugcaggacacacaggcuagcuuuaaugggcgagcucaaucugagcuggaccagauacauccuaucacccuccccuucugcagucacccugccuaggagacauauaaaucauagccagugaccuaauaaaauaauagaguuugucugaguuuugacagcagaaaauaauagaggaccucaaauucagagggagagaaauaggaggcuuuuaaaaacuugcuucuuugccaaaacagaggugaacaaaaagugauauccguaaguuguugguauccuggaaguccccauguaucuaugacaccagagaaacuccaggaaagaguggggugaggcgggauuguuuguaagguagcacucacuguauuaugugcgaugcucucuuccuggcauggaauuaauuacuggagauggagcaucccccccccccauucuuuuuugcauggugacagucuaaggagugggcuguacagcaagcgggucugaguuuaaaucucagcccucccugguggacagcgccugggugcuuacuuucucugagucaaucucuucacuuggcgccauggucagugaaacgaaacaaugcauuaaagugcuuggcuuggagucuggcauagcucggaccuuguuaauuuccuucuuuaaucuccaggaaugugcagauaggagaggggauucgggccacccuugcugcauacuccugcuuuaugggguaggaagcacacaugaucaucaugacgagagagagagagagagagagagagagagagagagagagacugagacuggguguuuaugcguccguuucagccaccugcuuguucaguccagugguuucaaugguuucguuccucacuaggagcugguaguguuacuaguugacaucuauugaaugcaaugaaccaggcucugggccagacacuggggugguuuguuaaggccuggcuuugcucucugcucucuuuccuuccccuuuaacaaaauaaagagaguggcuguuuugcucuugcguucucaguucugcccuuuccaauacccauugucucauugaugacuucgucccccauuccuugccaucucuuuuuggccagauuuuccucuggacagagaagaacaaacagcccgaaauacgaaccagagcauccucacgcuggagugcagcuccuuccguggggcuucaguuacaucccagccaguaggcauaaaaugggcaaauggagcuaauuaccaggauaauugcagcauauuuaaaggagguugugcaaacugcacccucucccaauuccccuuucagagcagcuaggagugaguaagcuuguuacucuaaagauuaacauugugacaacuucacccuagugagaaggagacugcagugcugcucugaacagaggggcuggggaggcagucaggguucucuggaaggagcaaggauugguaccaggaaggaaaagcaaagcugguuauauucuccuagucggaggccaacuagagagcaguagcauucugaaguagaugcugccaaagucaaauaaagauugggcuuucauucccaggggauggaugacugacugaccaguggagggaguuugagucccacuacugaucagaggaaguggagaacugggggauuuaggugcaguuuuuaaaaagcaggucaaguauaguuguuuucugcccucuuucccuucacccaucccuccuacccucccugauaagagagggaaaguauuuuagcuacugaaugaauuuuugugcuguagccgacaugugcagacaacagaaagguauugcucacucuuggggaagugcucaguucuuggacuuccaucuuccagaacuuuuuacacaacggauagcuuuaccaagacacuggucaggcaaaggaagaggaucaaacauuacucccuugugcuuuauuuuauuuucuuuuuuccuucuuggucacaauaaaacuuuugguguuauuuuuuuuuuauuuucuuaugaaaaagaauaaccuuccaagcccuacacugacaagaugcuacucugcauuuuuaugcccuuucuggugggaacaugaacuaguagcuacuccgccagauggagaaccaaugacagaccaccgacguccagcuuggugaaccaauguguuuccugagguuauuuacaagaguauggaugaggagccggagaaccgugugugacuuaaagacaucugcaccauccaaaaguccauuuuagccugggugacgguuaaugaaaucgaauccauggugccuucuggacagcucgcagagcacuggacaggucagagacucuccucauuucagcaauuguuacugcuuacaaagcuuuggagaagggcuuugugcccuuguaaguuuuagaaacauccugggacuugucaguuguuauuuccccggccuuguuggauuuguuugcauccuaaguguuccggagccuugcuccagauggaguguuucaaucaagaggaaacugcuacacguauacauacaccauacaagggaucugaucaguaauuguuucuaaacccauucaauaagugccacacuuuagucaaguuaagucugacgcuuccaaaucuccugccuuuccauagaaucagccuugcaauuacaguguuucuauuuaagagaaccucccugcccccuccaacugguuuuauugaacuuggacacaaacagcaaaugaaaacauagccaagaacagacuguaacaggcaaacgcuguguaaaccuaauaaugugcaaauaaugagaaauaugcaaaaugucauaggaaggacacaggaaggaaccacaguuuuaauggagaagcagaagggcuuguugccagcugcuucauaugaaaggggggagaaggaggacuuuguuccuucugauacaauuauuuaauuaagggaaaaaacacaaauaaugugaaaguuaacugaaaaguucaugguaucaauuuagcaucauuugcgaugaacuaaccuaugucuuuccagcaguuuguaugacuuuuaaaauguggucaucagaaugugaugggauuuuugugaaaauacaucauuccauuugugcugccaaaacaaaaugccuuguaagggaugauuauaaacaacagaaacuuaagguucuuauucuggagucuggggaagcuaagaugaagacugcagcguccgucugguggggggguuuguucuucguggaugacauugucauauaagguaucagacauccucacaccauggaagaaguaaacagcuccuugccauugcucuuaucaccugcuaaacaucugucuuuguuaggguuucauugcuauaaagagacaucaugaccaaggcaacucugaugauggaaacacuuaacugaggcuggcuucuacuuucagagguucgguccauuaucaucauuguggggaugcauggcagcauccaggcagacuuggugcuggaagagcaguugcgaguucuacaucuugagccuaaggcagccaggaggagacugucuucugcaggcagucaggaggagggucucuucuacacugggcagagcuuaagcacuaggagaucucaaaguccaccuacacggugacacacuuccucuaacaaggccacaucuauucuaauaaggccacaccuccuaauagcgccacuccccaugggccaaagauauccaagcuuggaguuucaagccaccaccacauccuguccucccaauccaaucacgauaaccacuaaacugcaaccaauuaacuagggaggaaacacugcucaaacuacagcaaaaucaugacuaacguuucaaauuguguaacucugugaacgaagcuucaauaacccuuuucuuuggcauuuuagacuguggguagcccauccagcagguuccuggaggcuaccggcuaucgacgggcaagagacaacacaagacaagcuggaguuucagguugagaagugcuauacuggcauaauaaagaugugcaguguccaacaaugaagcuaauaauauuggcuagaaaaacauaagauuuccucauaucauaagcuauucuagagaacccccuucaguuagcuauuuaauauucucuucugcaguuggaugaacaaaaugagcucaacccuugacuauaaggacucucccacaguaccacagcaaugcuuuauuucugagcuuuuuauuaaccuacugugacucagaucaguaggcucagagaaaaagaaugaugcugaauagugaagucacuuggaaaacuacaaagccaacuucauucucugucccccagucgucucccaucguacauagauucgauuguuuuucuugaaauuuuauaggaaaagaugaaaaaauuccuccagagucuuauguuuaagauauagauuugauaauauuuuauuucucgguaagugguagcuagugaucuacucugauuuuuguugauaagucaaucuuaugaauuuauguuuuuggacaagguuguuuaucuuaagauuaaaaucuggggacauagaguuaucaauagccccuacaaccaucuauaauucucccuuuagcuuuuauaauaguuacguuuuaguccccguuaugauuugucugugacuucccacuuucguccauuagguucauuggagguucaugaauuacagauuuauuuuuaucaagaaauuauuauuuauuuuuaaguuacucaaaaaauagaauaguuucuuuaauagaauaauugucuacguuugcugacuuucuagcuuguucagggauuuuauuugucggagugacugaucgccauccauguuucucaguuugaguuggaucauuugcuuucuuuaauuuuucuaaaaauaaaaauuaagauucugugcucgccuuuccauggaauugaugauuuauucaucccuuuguuugauucucuaugugagccaggaaguacuacgggugcuugagaaauagcagcaagcaaaauauacagaaaucucuggcuucuuggaguuucauuccaggaaacuggaaugaagucaaagguguacccagcagaaagugauaaaugcuaagaaaaacgucagccgggaggugacacagggagucuggaacguagcacuuauaauuuaauuuauaauguuagucuaauuuugaucuaaaguguuguucuugaauucuuauugucuguuaccgaaaggucuucugcaaacugaucuuaaaauuugcuguuuagcuuacuugaauuguggccagagguuagaacacccaugugguuucuguggucagaagacaagaggacacaucuucucuagguguuacauugacauauuuaaagaaguuauucaguguuggugaacucauggccauuagagaagcaucuauaaccacuaauuuacuaagccaguacaaccccuaucagcagucuacaaacauuugucuguauuuucacugaugaguggaaucgucaaccaaauuaaggaaacuucucuuuguaagggauggagauggcaacauaaaaccacaaccaaucaaaaugcagaguuguggagcucaguccccagggauacaccugcaaaaacacuccugcaccgaaggcucagggaucauugaagaaguggggcggaaagguugucagagccagaagaucagggaguugcugugagacugugucuccuuguaaugucagaagcucaaccauaaagucucaccaacacgacugccccaacgugagcugaacaaggaggacaccaauggacccaccaaaguggacagggaaaagcccaugagaacucaacccuacacagagaacuaggcaaccagggaaugcugggaaugcugaaguggcuuuccccagggaagaacacaccagugccaaagagucagcccugaaaacauguaugcaguaugguuauacauauuggacaggcuauauuuaggaauauaauaugcuauaauauauaacacaugauacauuauaauauacaauauauacaauauacauauacacauauaacaucuaacauuauauuccuaauuuauauguauuuuuauaaaucagaaauuaauaaauaauaaauaaaaguauaaaucauaacauuacauuccuuauauuauuguaauauauuuaauauauuaauaauauaaaauauuuuauaauauauaauauacauauuauagcuucuaguguuuuggaacugccuuuauuuaguacucaagggccaauuauaugucucuguuguggacugaugccuuuuaccuuguuuauuuuucuuuggccugaauuuacuuuuauacaauuuauuuugcuccuuugcuuuauuuuaauuuacucugaucugaaaaaccuuggcuugucauugaguuucaaccuuuggugaagcguauuccuuuauuguguccuguguuuccccauucgccuacccacucauuagccaaacacuugcugugauggauuagguaauuagaaagaauguuacagguuagcauacaaaguaacguguuccauugucauuuccauacagaccugucauuacacauuguuccuuuuguccccugccucacuucucgcuccugugccaccugcccaccucuaucuaguuccuuacccuccuccuggcaggcggucaacccuucugauuucaugucacagguuguacuggacuuucccccccccccccacuugagacaaaacuagacauguuuggaggaagaaccuccacugagaaacugucaacaccagcugggccuguaggcaagucugcguggcguuuucuugauuaacaauugggguaggagggcccagcucucuguggauggagcuaccucugggcaugugguccugagguguuuaaggcggcagcagagugagcaggcuaguuugugagcaucaucucuucguggccucugcuuuaguuccugccuccaggcuccugcccuguguuccugcccugacuuuccucagugaaggagugugaccugggagccuaaauaacccaucccuucccaaguuauauuugcucauggcacuuaucacagcaguagaaacccuaacuaacacuuguuuucuuacuagcuuuuuuuuucuuucccuuucauggucucuuuuccagguguaucacaugcugacacacacacacacacacacacacacacacaccacacauaugcauacacaaacaccccccaaacauauauguacacauucacauacacacacuacuuaugcacacucacaaacauauaccaccuccaugccccacccccacacauacaucauucugugcuucugucucuccucucuggugauuguguucuuugcuguacaguaguuuucaauuucauguaauccugcuugucaauccuuucuuuuaccuucccuuuucuuucuccacucccuccuuccuuccuccccucccucccuuucucccuccccucccucccucccucccucccucccucccucccucccucccucccucccucccucccucccucccuccuuccuuccuuucucuuguucucucuuucuuuuuguuuuacacaggguuuuacuguguagcucugcuuggccuauaccucauuauguagacaagcauggccuggaacucauagcgauccacuugccucugcucacugagugcugggauuaaagacaugugcuaccaggcauguuugucaauuuuucacggaacuuuccaguacuauugcaauuuuuuaaagauuuauuuguuucauuuauaugaauacacuguagcugucuucagacauacaccagaagagggcaucggaucccauuacagaugguugugagccaccaugugguugcugggaauugaacucaggaccucuggaagagcagucagugcucuuaaccacugagccaucccucaguucuuuuuggcaaaugcuuuccucugccuauagcugaaaauguuuuaucuaugcuuucucuaacaguuucaaagcuucuggauuuagauuaaguuuuuuggacuuguugaguugguaauuugcacacacacacacacacacacacacagggagagagagagagagagagagagagagagagagagagagagagagagagagagagagagagagaggacuccacuuuuguuuuucuauauacgcaaacaguuuuccuagcaucauuuguaaaggagguuauuuuacuacaauuauguuuuuaauagugcuaucaaaauuaggucacuauaacugugaaaauuuauuuccacaucuccuauccuauuccauuuauuuacauagcugcuguuuuuguugcuaaggcuccauaguauaauuugagaucagauauugugauaccucuagcaccuaccuucugcuaaggguugcuuuggcuuuucaggguguugguuucaguuugaauuguaggguuugucuucugguucuacgaaaaauguuguuggcacuuugauggagacugcauugucucuagacugguuaaaguucuguagcuauuuuucccaauauaaacuuguuguaauccguaaacacaagaggccauuccuucuucuagugucuucuuuguccaucccauuucuuucuugguaagcuuguuugggaauaucaaagcuacuaacuucuaacauaugcaagucucucuguuaaaaagugucagcauugaaguccuuugaguaaauauccauaaaugguaccgccuggucauaugcuagaucuauuuuguuuuauuugugacaucuccaugucagcuuccauagugacugaccuagauuucguucucacaggcacugugugaagauugcuucuuaucuccuuacucauuaacucgugucauuuauguuuauugacaacugcguucugaccaguggaggggcauggaaacucagugugguucugaguuguguauucuugacagaaaucuucugucagauaugaggcuagcagcuagcagcacuuucuuccaugcuguacacugucucuucauucaacuguuucuuuuucugcacagaaaacuucaguuucaucaaguccuguuugugaauugucaacacuguuuccugagcaacuagaguccuuccagaagguuuuugucuaugcccgaauuuucccgucuuuuuccuaaauuucccuuuuaauaguuucagaguuuugggucuuacauuaaggucuuugguccacuuggauucggcauguggaaaggcugagacauuauucaacacguggcuguauacguucccccaggaucguuugcuggugauauccuuguccacaagguguauuuuugguaucuugacaaauauucauguagauguaguugcaugguuuauaucuggguccucuguucuauucuauuucauugcuugcaugacagguuuuaugcaaacaucacauuucuguugcuauggcccuguacuauagcugaaaccaagugugaauuuaccuucauuguuauucuuuucggucagaauuguuugcacuauccaguaucuucuguggcuccauacaaauuuuaagauuuuuuuuuucaguuucugugaagaauggcauugaggucugaugaagauuccuauaaaucugaagauggcuuugguaggagguccaguuucaaagcauugauucuucaaauccaugcgcacaggggacauguccaccuuccagcauccugaaguacaacaucauauguaccacugugucagaaaccaucuaggaaagacuaaggcaagcaaaugaguuuucuggaaauggcccaccauuuugcauggucugcaauggaugagcucugagaggcaaggucccaagagacuucaucccaagaugacuuuuugcugaugauaugccuuucuagucacuguuacguagacuaaugauaucugggcauuaacucacccuauugggcagauuuucugcagagcaaauaugaagauguacuuucauauagcaaugcugugcaaaucaauugaugauuucauaauucucaauaaugauuuuauagaauuccuaaauuuauacaaguaauuucaagccuccuauagaauaaagcugcaaaugucauggacauugucaaccuucagaugucauggaccaauugcucuaggguaagaaagcaggcuuggaacaaauuugugaccaagggaaaacauucauucuaggucagguucaagggugaagccacgggugugcacuaugauaaagcugggccaugggaaacuguugcuuugcgcuuguaaugagcuucgagaaugaaacacugcugugaauucacugucaacauccuucuggaacuccccucuuguggaacaucuuaucuaugagguaauuuuauaaagaacguuugucuaaaaagguauaagaagggcagagagaagaaauaaaguguggcauuugggggcuuagccucacccaccaaaugua

SEQ ID NO: 7953 - RNA, 744 nt, Mus musculus
gggcucucuuaccagaguagccaacgucuuguggagcaucaugcccaaguuuuauugugacuacugugacacauaucuuacccaugauucuccgucugugaggaaggcacacugcaguggucggaaacacaaagagaaugugaaagacuauuaccagaaauggauggaagagcaggcccagagccugauugacaagacaacggcugcauuucaacaagggaagaucccucccgcuccguucucugcuccuccaccugcaggggccaugaucccaccucccccagucucucgggcccuccucagccugccacgaugccugcgucccacaugggaggcccucccaugaugccaaugaugggccccccuccgcccggaaugaugcccgugggaccagcuccugggaugagaccacccaugggaggccacaugcccaugaugcccgggccucccaugauaagaccuccugcccgcccuaugauggugcccacccggccuggcaugacccggccagacagauaagagcagaagcgcucuugaugguuuuguauuucuuguucuguuccaccaggagcucuuggugcugagcccgaguguuuacuacaugcauggaaaggaaacuucccuuccuaacugaauauuuuuuggagggagaaauaauacaaaaaagugcaguuuucacuuauauugugaaaugugaaaauaaaaucaucagcucuuuuaguuaaaaaaaaaaaagaugggcuc

SEQ ID NO: 7954 - RNA, 3789 nt, Mus musculus
uaaaacuaaagcuaaaauauuuuuaauuaauuaauuuuuuuacacuccauauuucauuccccaaagcuaaaauauuguaaugguuagaguucuuuguucaaagagcauauaagguucuguagcuguggagucuccaacuaaucuguugguggucugacuaacugcuuuugcaaaggcagaaggcgagccagguacgucucucuggcuuuucacugcaguccacauggcugagaugacaaucucugugugagagagacauucuuugcuuuucagucugggugauugagguucuggcaauccagguaagggacagcugccaccaugccucaccuggucaugauccugacccuuugccagugcccagacuucuaggguggucucaaguaugcucaggaggauugcagagauugaagaauacagcagcugcuugcuagcccauuuuacagagaccuggaaaugacaaugagguauugcauaugaauagaggcauugucccaucugaccucacugacaaaauuaaauuucacagacaauguuauuuacaaagucaagguugccuuuuggguggugguggugcacaccuuuaauuucagaguuugggaggcagaggcagacagaccuuuggguucgagaccagccuggucuacagagcaaguuccaggacagcuagggcuauacagagaaacccugucucaacaccuccccaccccaaaaaaaggaaggaaggaagaaauaaagaaauaaauauaaaauggcaauuguaggguuuuaaauuuuucaggagcuuuggaauauaggggccugugugaguacacuguuuggaugcccauagaacuuuucuuucuugguugggauagauaguaguuaaaauuguagaacagcaccaguucuauauagaaggagaagagggcugaacacugaagccaguggaguaccagcauccgaaggcugggcagagagagcauccuggcugaaaacaaaugaguaggaaaguauuugguuugugacccugacuuugaaaagccuugcaaacacaaauacuggccacauaaugccgcaagcauuuuaucucacaaacuaugcauuacacagacauuccccccccccuuaggauuaagaguauggcuccuauauaggacuauaacuuagauuauuuuugcagcauauauugaucgauugaaaaaaaauaaugcaugagaaaaaaaacuguaggaaaugcauuaauguaccaaaugggguguacuaacaauagaugcacagcuggccuaaguaauucaauuuccuuguggcaacagucaugucuacacaaaagaccacaauggcucuguaacacuuaucaagcaagaagcaaaaggcaucuauaaaaucucuuacaauuuccaagugacucacugagacuuaggucagaaucaagcccaagaauuuucgagcuauaaaguagcuuuaggucggaagauccagaacuucuacaucugcugagagaaccuagcaggucagugaugagaccggguggguuggaagaaguggguggaaaggccucuggaggcacuuucugaggugcauauaguaaaagggccaccccaacacuggcuaucugugguugcagacaagaugcucaccuaucgggcggucaggugaaacaguggcaguaacuccuaggcagagaugaagcgaccacuguaaaaacuuuuaguaccggacucagcggacucagcgcacgaaaaucgccauggcuaaaugaagauggaaacuuccuccugcaacccacacaccucuggaaccgagaguucacuaaagccuucccuucccuucucaguucccagucuguccugaagccgaguuuugcuucagagucccccugcuucggccucuggagggcuggcauuauaggucauaacugguauuacaggucgcagauggcauuucaggccauaggggucauugcuagcauuacuggucccggccucucuuccucucucucccucucauagucuccucaucuucucaagaucuccagaguucugcacuuacuuuucauguuacaaguagucuucuuugguaaaaaccggagcuuaaggagcaaggagagcgucuccuggacguuuucucuaauuuguacuguccuuuagugcauauucgugauuaaauuccugcguuauuauugaucgcaauguuuuuucccuucaagugagaacauuaacuaugagguugggacuauagauaaguggagaguacucccuuagcacgccaggggugcugggcuggacuccuagcaucugagaggcgaaagaggaaaaggguaagaauauaaaagaauaaaacacacaguggauguaguagugucuugucauugaacauugacuaggaacgggcucaggaggcaagugcuucuccagggagugagcgacaacccgggcacugcagggaagccaccauucaccagcguccuugagagcagcugugcagacccaaggacuugguacucccgccgcaucugcgccccaguccuuggguugucagggcggcauuccuucacucucuaccgucauuucccccuuucguuucuuuguccuuccugguacuacaguuucccauauugucuuauuaaagaguuuacacguagcuauggcguguuuuguucggccuaguuccggggcuuggagggcaccccgcgaccacuccccgcaugugcuccuucgggcgggggcacaggggcucuccgugcgcacgugugucguuuuccucccccacacuaagcgggcaccuugcaacgucucgucauucugcagauuaaagacccucgugagcucauagaagccggccugccucugcggcugcagcgcuccccgcaggcgcggcgcggcucgcccggcuucugccacuccccuucccccaacccccccagcccgacuuccucccaggcuccucgcagccggggcgguuugaucuggggcgggagcggcggcgucccucugggcaugcucagucgcaggcugagcagcgccugcugaagcagagcgcgggcggagcgcagcggggcagugccgagagggcagagcggagcuugcggcccgagccgagcggagccgagcggagccgagagcagccgagugacggucuccgggagacaugcagaugaugacuaggaagguccugcugaacauggagcuggaggaggacgacgaugaggauggagacauuggugagugccggaaccggggccagggcaagggggauccggggcggacgccucugcgcggaagccgaaccucccaagcaacuucgggucuuuuuccugcguccgcuccgggcgguguuuugggggccccugcucccggguucacgacacaccugagccggauucuccgaggccacaggcugcgccgcugcaccagcccgcagagacacaaacaaaagggcuggagccgcgggcgcggggcagggacgcggggcgacgccgggcggaggaccguggcacguuuccaucaggccuccuggaugucaaaauguucccucucaaggccuccaaacacuuuacaaaguaaauuuaggaguuggguguggcuuuuccuuccuuucagguuuugcucacagaccaaucaaaggaauuugguaacucccaggucuagacgaacuugggaauuccacgccgcgauuuagccuuggccuuucauugugacagcgguuuaucaggcacuccucuuuguggagagagcaaauaguauuccuuuuuaaggagaggagaaaagugugcccagguuagccuuccuggagccucacacugucaag

SEQ ID NO: 7955 - RNA, 186160 nt, Mus musculus
gguuugaucuggggcgggagcggcggcgucccucugggcaugcucagucgcaggcugagcagcgccugcugaagcagagcgcgggcggagcgcagcggggcagugccgagagggcagagcggagcuugcggcccgagccgagcggagccgagcggagccgagagcagccgagugacggucuccgggagacaugcagaugaugacuaggaagguccugcugaacauggagcuggaggaggacgacgaugaggauggagacauuggugagugccggaaccggggccagggcaagggggauccggggcggacgccucugcgcggaagccgaaccucccaagcaacuucgggucuuuuuccugcguccgcuccgggcgguguuuugggggccccugcucccggguucacgacacaccugagccggauucuccgaggccacaggcugcgccgcugcaccagcccgcagagacacaaacaaaagggcuggagccgcgggcgcggggcagggacgcggggcgacgccgggcggaggaccguggcacguuuccaucaggccuccuggaugucaaaauguucccucucaaggccuccaaacacuuuacaaaguaaauuuaggaguuggguguggcuuuuccuuccuuucagguuuugcucacagaccaaucaaaggaauuugguaacucccaggucuagacgaacuugggaauuccacgccgcgauuuagccuuggccuuucauugugacagcgguuuaucaggcacuccucuuuguggagagagcaaauaguauuccuuuuuaaggagaggagaaaagugugcccagguuagccuuccuggagccucacacugucaaguagaaguuucugauuucccagaguugagcaaguuaaggcucugcaccuggcggcugauuggguaaaggauguaggaugcucuugucucaugagacugaacaguuaagugaccguuuacauaaaauaccacccacgggagcagcguuaaaaaguuacacucguauuagcacaguuaguuucuuagggaaauauucuugucugucauagugaggcacucaagugagauccagccggaauagaaauugacauaagcaagaggcucugaguguaagcccuugcugcccucagauuucaauuuagaaagaaaaucuaauuuggucuagccucuguuacaugauaggcaucauagguugucuucagacccugccaguaggcuggcuuugcuuuuacugacccauguaauucaugcuuguuccacgaaguaaaacagccgauguaguuaacuaccucugccucuucuuacuguagccuccaguauuuagauucauacuuuagauagcagacagccuguuuggacaggcaacguuuaagcagguccuggcaauuuuugguuguccuuuauugaauuaugaauuucauguggaucauaguuauguuuuugucccagacguuuuaccaaaccuaugaacguuuauguuacuacagaauuauaagccuucuugaagguuuacugaaguagguugauagacuauuaugaacuaauucuaaauccaacagugggagaggaggcgcuggugaaauggaggacugcaauugaaaccucugccuccaaucuuguaguguuaaagcucuugguuagucucucucuucgggacuccucacuagagggagcguuguauaguuguuuaaagcauaaucagcgcccauguuaauuucuguuaaauuuugcuuagcuuuaaaauucagagcaggaaaguuacuuugacacgaggccccaacgucaucuaaggcaaaccucaaacaacgaaaguaaaccauuuuaaaguagaagauguaucacggagguguuccacccgcgugugugaagccgagucuucugggaggccggguugcccggcuuuauaaacaguuacuucagguuguugcucgguacuuagagaacuaacucuggccguuguucaauauuuagguaccgcuuuaggugcaggaguagccuccuugccuggcaugaacccacauggagaauugaaaaugguaucuuucccaugguugucuuccuuguuaagucgugaccaucggaaguaacccaaaaggugcagugaugagugaacccauggggcacaguuuuuuguuuuuuguuuuuuuguuuuuuuucuuuucuuaaaaacuugcucaauuuuaccaaggagccacagaaguccugugugggcagcgguugcagaagugcccugguggagauggcuguaacugcaagucucggaaaugcagaguggucuguccuuggcagcuuuugucuccacacuuuccaccuccaguuugucaguugauucagcaucacuuccucuugauuuaaaacgugauauaggacaggugagaugacucaggggguaaaggcacccgcuaccaagcuccaggacgugaauucaauccccauggaggacgugaauucaguccccaugacccacaugaugaaggagagauuauuauacuuccacauauucucugaccuucauuucugcuuuggcucucuuacaccccccucccccaucuuaaaaaaggaauagcaauagcuuucauggcagaauguagaugcucuugguuaauauauuucuucagugccucucacuccucuauaguuuguauaauacuauacaaaacuauaguuuguaugauagguuuaaaaaggcuuuuauuuucuuggauuaccuguggcucaaacucugcuaagggaaaguaguccuagaccuggcugcucucaggaaggacucaggcuucagauggaugcguuugaaagcucucgguuugccguccguuucuggucguugacuuugugguuucucagacggauugucugucgccugggaaauggaccgaggccauguuagaugauggcccagccauuucucuguccucuuucgguguggcagucucaggaagacuuaucuacccauguaaacuauucccgagguccauuucauguuuaaucaucccccacucuaguccuggucuguuggaccucaugaacagugguggaguaacccuucugggcuaagggcagauggcugugggguagauggggcaaggcacacagcccugucccagggcggggggucccuugaaacaugaaaagucccuuguagaggguggcuuuauugaaguguaugcggaacuaugggaggacggcaggaaagggaacuuuccagaagagguggugguuaggcuguggaaagccuacgcggagcagagaugccaggcuggaaggacauggagggacucuccugugaagaauccuccagacauuuuaaagaucuugagcugucuguaacuugggagcccuagaaagaugucuuagaaguaaggaggagggagaugguacuuacuguaaacccucccaggaguuggguuuagaaguggcugcagugauccaagguguaaggguugugucccggagcuuacaggaggaggagcaucuccaagcaucccauucuagcugucgaguauaguguaaguccgccucuugagcugagugguaggaaggauggguggggugggguggggucugugaagucauacuuuucuuggcugcuuuggcuugggccauugcuuccagccucaauuccucucuuucccugugagucauccuccucccaagccuguuggaaacuccuguagguagugcugauaacugcuucucuaaaagaccccagugcauucucacaccccuuguuucuaaccucuauauacuuagccuucauuuauuuguucugcucuuguguuucaugaucuuuacucuuauuaucucucuaucacgacauaucucucugugugugcuauuauuuauuaugcuacuguauguguguguuauuuacuuauuuuuauuuuaucauuuuggagacacagucucuccuaggcaggcugucucuuuggacucuuuaaguagcugaggcuggcucuggacucccgaucugccuccugaacauacgauuacaggccugagccaccacaccugaaugacucacuccugagauaauuggacauaagacuuaacgguuuuauagcuuuguagaaaucucuucuguguuaucugaagaauacauacuccuaguucuucugcuucauugcacaccuuauugccauaaucauuuacuaggcuguaaucaagggugugucaagagaaguccugguacggaaguaguacagaggagaaagcuuggaaccuugccaggcuaacuguagagcagugugggcggcagagccauccaggaggccugggaaggcagaugauggggcuaugauuccuaaagacacaauggguuaaccuccaaaugaacccaguacugcuacucccagcuuaugcauuauauuuuacauucauguguguauguguguacaugcaugcauuuuuuuuuuuaacaaaagaaugaggauuuaaaaaaccaaacaaacugugaucaaagucuuuucucuuucggccuggccuugcucaguuccacacacugucaugucucgcuguccacauucuaacuucugagucaaacagcaacuuuccaaaauguccccuagccuuucucaacucuuuggcaaccucacuguucugcaugugacaaaugagcccucagagaauuauucugaaagagcaugugggggcggggcugccaccauggcauguacggcugguuccccuuuccccuuuagaagccaagaaauuuggaucaaacacucccagagacaucuccacuagagauaugguuuuaauccugagguuugcgggagauaauucuguauuauuaggaauugccugcuaugugcccaugguagagggugggauugaacuccgcugguaguguuuguagugcacuagacugaaaugagugucuuuuaguagaaguuuuccuguagcgaacgcuuugucucgcaucaccaauaccucuugaccaaaagcuguggucucacugugagaugcuuccuguuccucguccugaugcuuuaucacauaguagguguuuuaggaaagcauuuguuauagggcugauuuagguuuucaugucauaugauuuaagcugccugauccaguuuagacaggacauucaggccuggguccgugggaaaagaggcuaguuuuagaacaaagaggagacgccucuaagucccuucauccgaggcagugugcuucuggacugaucgaucgaucgguaaacuuuaagauggagaauguggggauuuaauacagccacacgaucacgauaugcucuuauggccauuguuagggaaccccagccucuugcaugccuggcaaaggcaccacccccgagcagcccacccacccggcccaggucauuucuaugacuccuuuuugcuuuugcuuggcuuugccacuucagcuuugcagcuaaaauuaauuggcaccaagaaucccaagaaucagccaguuugaagagcauaagaauauggcaacaguggauuuuggaugugggccaagcagcaaugaagauaccguucagccaaggcauccaagagaacgugcacagagagagacaaguugaaggguuaaugacugcucucccugccucuguauuuauggguaccccagccgcauuucuuuuuuauuucuuuuuuuuuuuuuuuuuuuggcuuguuuguuuguuuuguuugagacaggguuucuccguguagcccuggcuguccuggaacucacucuguagaccaggcuggccucaaacucagaaaucugccugccucugccucccaagugcugggauuaaaggugugcgccaccacugcucagcuagaaaauacagucuuuuggggaguucagauguugcuuuuauauuuaaugcuuuuauucuaggacaccggaacucuacaauuuguugcaucuuuuacaaaaauacaacuaauucaagauugggaaaaagaggguacugaucuuuuaacguucucuucucuguaauauuucuuuuaacuuggacaacuuuacuacugggucaaagucauaaauagauguucuuucacaaagcacaaauaugcaaauuaaaggcuuauuuauaaaguuuguuuuguagaauccaagacucuguuuacauaauugaaauuguuaucgucucuccaaacauugcagcuagauaguugacaaaaccuugcacacucucagcgauggcugaguucuucuuguggcacugucacacagaugcgaucuuaaacguucuuuuuuuuucugacuugugcugauuuucgagggaaaauauucgaaagaaaaacaaccaguuuuauuuuaaaaaacaauuaguacuguauuguuuuaagguuuuacgcucuuuuccauacugauuaaacgugguugccuucacuugaaucaucauauuucuuucuguugcuuaugaaacagauucggaauguuccaguuguguaaaacacaauacucuguucugaagaaaaggaaaggaaaggaaaggagcggagccaggauugcucaguaauguguaaagaaaugguagauguuuugugacuuuggaugcugcuuaagaagaagcagaaguagauuuuuuaagagcuuccugcucucuuuggggcaaaggcaguucccgaagaacuucuauggaggaaaaggaagucguccuuacagauacuugcugcucuuugcugagugacagcugaguuugugucagcugggaagcaccugugguauccacacggagcugagugcuucaccugaggccagcgucucagcugucucuucagcccugugggguuccuaggagggugugggaggauguuuuuagaacacacacacacacacacacacacacacacacacagacacacacacacaccccuaccuuccccccuucaguagucaguguuauucauccucucucuuccucauccauuccccagaaacuguguaucagauuccgcgccucucacuaaggccccaugcagucucuugucacagugucuccacugcauuccaugcuucugccuuuuaaaggcggucaggggaacugcucuuaaccucugucaccacuggaggguuuucucuggcccacagcugcuuguuucuguucuaucuugugcacccaggagcuuagugauuuccuggcugggggcaguccugagaguggcuguucuucaguccuguguauuuaaaggugagaguuaaggaacaauagccaacaguuucugcagagguaauuauuggguuuucccuauauucucacaguuaggguuaaucguguuuccuagaccucgagaagcauauuuuaucaguaauucuuuuuaggggaacuuagcuaaaggcuauaaaaguuaaugcguaguagggaccuuaauacauggcugaugaaauauggagauuacagccccaucgguagccucuguggcacauaccuugcucuggugguugccagaccauguuugcaaaaguuugugucuaccuuucauaguaagugaagaaggagagauucacauaggugacugcggugguuugaaugaaaauggccuccgaaggcccauagggaguggcacuauuaggagauguggccuuguugagguagauaugucccuguuggagaaagccugucacuugggcuaggcuuugggauuucagaagcuuaagccaggcccaguggcucauucucucuucuugaugcuuuggauccagauguagaacucucaguuccuucuccagcaccacaucugccugcgcgcugcccugcuuccugccaugaugauaauagauuaaaccugugaaccuguaagccagccccgauucaaugguuucuuuaauaaaaguaauuguggccucauggugccucuucacagcaguaaaacgcuaacuaagacaacggcuggcuuuucuuacaaguuagcucuuggaacgggacaagacaaggaacagagagcgguaacuggucaggcucuuccugaacagagcucugcaugaccccgcggguaaugcuggaaguacagaaucgcguucaccauucuacagaggucagcccgucaggaauccccugagaggcaggauggacauccugauguguaacaugcucuuaaacuuuccacucauucagcuuugaaguucuccaccagcguguauguagcgagcacccccauuccagucuuucugucucuuaaggucuuguagaauucaaggguaucuggcucuuggccuucccugcuacauuucuucuuugugcagacuucagggcuauaggguugcuuugggaaucuauggaucuggaaaggagaagggaccaggccaugggcugggggauuccucuuccauuuugaauccugggagguacagaccugguuagccagaggucuggaucugagggugaaaccugagcgggcaugccaggacuucuucugaagaugaagaggaaagggugcucuucucuguguucaaagauuauuucugccaucgguuuagugauaacuucacucuuauugggccaaagauguggacugacguccugccaugcuucagcuagcugugaugcacacugguagcccugggcuagccuggggucuguccuuugcauggaagcaguuccuggguggguugguucucugcuuuuucgucucaugucagcugccuggccuucuuaguugcucaucauuuuuucuuagagucuuuccuugucugccuccauacuucaucagaugccuuagccuggcucugcacagaguugcagagcaugcagguucacggucugguccaggcagucaucagccaugcgaccuuaggugaucuacaugaccuuccucuguaaaauggggcuguggcaugcaaggugugggaaugucaaaugaguaacagcauuuaaaaccucggcaugguuugcaggauucuggugccuguugaacugggcccucugcacuugucaacaauguugccagugcuuuguguagcugguuuuuaucuaagucuuaacccagguuacucuuggauacucuacaaaguuuguuccuuuuuccuaagacagugacuucuacacccgcuuuucacguuguacuucucauuucuuacuguuacugucuggagggugguggcccuagucggcagcauggugccugaugcuuccgcucugaugaauaaguaagggaaagauacugacuacuaaagagcugacauaagacuuuggauaguaaccagcacuugggugcacaaguuggaggauuaauacauacaacagaguggauggggcuugacccaauggcuagucagucacagccaaaguaugaagaaauguaagugauuuuacaguaguagaugcauuucauaacaggguuguaucaccuugauacaguuuuaguaaggaagauaggauauaguauaaagggucaauaugacaaagccuuugauaauucuaaagauguguaagaaauaagaccauacauacacacagaacauagcuugaucauaccucaugcuuaucucuccaacuuccucuaaaaccacccaacaugucccuucaacucauguucccuuuccauaugguucuccccagccuucauuaaauagccacugaggccaauuggugcugacugaauagauauggagcuugggcaaccugucagucaccauauccucaaggaaaaaggagccuucccucuuuuagcuugggccuugugagccccuccucauccaugcuagauuuuuggcugccuugauccuuaacagguuuuauguagguaaccaaaccguguguucacgccuguaacagguaaccauacccgugcauucaugccuguaauggcugcgucauuuaugacauuccucacuuccccaccuccaggcuacauucuuuccaucccuucuuccuugaugcucccugggccaggggugggagcacucacuaacuuaaagauuccaucugaggcugaggacucagccacuucucggcauuuggaugacuccucacugccuguugcccaccgcaccaagacacuucugaccccugaggaugagcgcgagcugcugccacauuugcacagguugggaggugaaguuccuauccuucuacuuuuuauaauaguaggggauuuuuuuuguuuguuuguuuguuuuguuuuuugagacaggguuuuucuguguagcccuggcuguccuggaacucacuuuguagaacaggcuggccucgaacucagaaaucugccugccucugccucccgaguucugggauuaaaagcgugaggggaauuuaaaaggaaaaaguccaaaguguuuaauugcccaugaaacuuaaaguuuccuguucauuggguagcauuuaaaagucugaaaguugguuaaaagacacaaauagauacaaauagacacaaacguagauaaaguggaagguuugcguuugcuuuguguuguugcccuuguagcuuaaaucuccuggauuuaaugauaacagaagggaaagcucugugucauuugcaggcuaggcgcaggagacaaagcuuucucauucuguguucugagaagcuuggggaccacugauucacuguguccaguuguuggagcugggcggcaggagcaccagccggaggacagcuaaugcauugcaucucuugggguggaaggaagacgggaguugaguuuaagguuauuugacugacacuucugccuuuaauagaagugacgccuaguggaagccuaauuccguccuucagucacagugccuggaguccagccucugccacgagggccgcucacgguuccugccuucauuuaaauguaaauaguguuuagugaccacuggguacuggcaucuauaacaggcucauuauagccuacaaaucauagaggagaugcgaacacuugcagacaagccuuucaucaugcucaggguaagcgaacaccaaagacuuuuuagcaaucggguaaucaugguuuuccugggcguuacagcggccucagcuguggcuucuggcucgucccgagcuccguguguuuauuuugaagaguucaaucguagauagcguugacuaauuucuuugaccaggaagguucccuugaacucuugacuggauugccagcagugagcccggcuuacaaaucaagccugauguuuuugguuuuguuuuaaauccauaugcauagaaauuccauuuaugcuagcacaccgggguggucucaccuuccucgcuguauuaguuugguagcuuuguacugaagaccucccguaggccaugcguccuaugaugucugaggauacagagcagguagagacagccccaccuuuggugcaguuuguauucuagaugugauccgugaaagccaaaugcacgcaagauuaugcucauuuacugaaagucccuuuagugccuugugugugcuagguauggucuucgcucugggaauugaucaguagauaagacauauggccccuacccucagcgcaugggcugccuggcagggugaagcagacguaucaagugggugcagcaaguuauauuucaaggcuguaaaaggagagcaaaccaggauggcacagugagaagagaaucuuggcugugcccaccacucuccagggggagggcuuucacuggggaauggcuggcccugcagcuguucuuuucauaguucuaaaaauacccugaucuuaggggagcauggcuuugaaaagcagggcugggugaagaaggcucaaguguacauuuggcgaacaugugaaacccugccuuugcuuucagguuuccagguccaguugcccuggggaacuagucgggcgcaggcuuuauuuaugaugauauccguggucuuucaugcaccuugcagaggugguucauaguccuaagccccacuauuccuugguguguuuguuggcugcaauagcuacacuggguuagaggcaauaaaauacaguugcaucuucaggucccuucaugauggcuuuauaguucaacuuagcacgaugcucucccuuccguagguuugaaagggaugcuaagaccuuugaagucaucaguuguuaguuuuucuguguugcccaaggaagaggggagacaauggguacugccauucccugcucacaucugugccucucuugaccucaagggcuuggggaccuagagcagaaugacucuucuggacuaagccagcacugaguucucuucucuggcugcucuccugggggcuaugaaucacuucuguggggaagaggcgggacugacuuugcugggagucacaacccagccccugagggcaugaaucagaagucugguggagcaggaaagccccacaggugacugaggcuuggcuccagcuucuccuccugaaacccuugcuggagaaucucucuuuccugucagagcaccuagaguuauauggaaggacgaaaguuaaggcuuguuuuguucucaggucguggggcaggagggcaugagaacaaacucuguucucauugacuguuauaaacaagaguccucucgcuugagauucuguguuagguuguacauccuagaauggcaucucaccuuacuugugguuccuggccaaacgggagucuucuugaugggugaacucgagggagugugagagacugaugcugccuucugccaugcuuuugucugauaggagcccacucuacggaugcucuugauuagauuuuuaaaguucacuucauauagugagugauaugcgauguaaacuguaaagcuuggcagauccugggucugacugccacccacacucagguggaggccacgccccuccacccccaccccuaccccacaucccucauuucuuuucucaguucaggggaacaguuugaagaccucuucuguaaacugagggugccagcuguuggaauugacccaaauagaacaaaguagaguauaauaaucuuuuaugcuugccccuuuucaugucacgugguauuuuuuuggagauuaaucuagugugguuaucuauucccauuaguccaguguauuugaacuacaagaauaucuggaaaagaccuuuuuuuugguuaaaucuuaacaugcuaccuaacgcuaccuuuucauucuauuuaaagucagauuucuuccuuucuuuuuuuuucuuuuuuucucuuucuuacuuuuuuauuuuucuuuuaguuauuuuugugguuguauccaccgcucacacaaugcuuuugcuuauacuaggaaguuaacugacuuuaaguuggggagguggguacaggcaaacuguacucauuuuaauugcuuugcugucugaauccaaacucagagucacuucauacgcugucccugagugcccaggcugcugggugcaacagcaauccauagagaaauacaugcggguuuguuccuuccacacaagaaugucaaguauaauaauuaauuuuuccaaaaggucagcacuugcuggcauuuugacuaaggcauguuucggacagauauucuuagccuucaucugguaacuaaagagcucuaagaacccaaaacuaaaacugaccugcaccaagagaggaggcaggacuuaccguuggccccagauauaauauuccacaguguuuguccaagcccguggguucccaguucucagagaaguuacuuggcgcuggcguugcuuucccugccgcgugacucaugauuucuuaaggcugauuagucauucacugccugaguuauggaggccuaggaacugccugaaucaaauuacagcccccauccacacucccccuagagcuagcuccugagucccaauucuuagcagggccacaccccagucagaggaacuaauucuggcucucugugagaagccuugaagcacucagcauuccccaggagccuagcaauagccuagcaauggccuugagcucugaugccauugccugccucccaccgaauucccccauguguccauauuccuugcuuggaaauguuuuuccucggcuuagggccucugguucaaucuggcucugguuugugucuuuagaagccuuguccaauguggugcuaccugccuccugcuugagguagaccugggguguguguguggggggugggggggggaugccugccuggcuuggugucccuuaguggauuuaaucauuucugaugugucccaggugggacugccacauugguggugccugaaaucuugcgucugacuguuauuuuauuuucgcuguccuucuucggucauguuaggacuguuggauauaagauggugaaagggguaugguaugagagagaggcugagcuucagcccgccaccugaaaaagacccagugcuuucuaggauguggggaagucauaucccuccuggugguaggcagacauguggaucuggcagcugacagauccuuugagaagcagcucccaggggccucgugaccuugagcuuccugaugcugacguagugaaaauggcacgcuguccaggcuugguguggaugccuuaaucccagagcauguggcugaaaagcucccuucuguauuuuacaucaugagaaguggacauccccucaguguuugugagaagcccuuuagucaaaaccagcauucuguaguaaacuguuugcaucugaugagucaugcaugacucucaaccuuuuccuugccucauggagacuggugucauuccuuagcuggcauggccaggugucugucucucacgucuugaugacuguguucuccgagguggcuuugcuccugcacccuccugcuuuuuuucaguuucucccuggcacaaaucuuccuugcagggucucuccucuggccugcuugaauucugaguucagauagaugaagggagguuucugugaagggcagaauggucuuccuugguuuaauagagggaaauuaggcguuugugguuaagugcacaggcagcgcacccugacuguuggauagagcugagacacacaccugguugguuuuauguguggcuguguguaugggguacugggucaauuuuuaauuuaaaaaauuaauucugugaauaaguaaacuuuaggguucacugucagacuuguguuagagauagccugugugugaccuguuguuugcuuuacuaauaaagaguuuuaugaauucuuacauauuaaguucuaaauggacagggaagaguccugcccuggauuuguuucugaugcucugauaaaaucccacuaccggggcuggagagauggcucagcgguuaagagcacugacugcucuuccgaagguccugaguucaaaucccagcaaccacaugguggcuuacaaccauccuuaaugacaucugacucccucuccuggugugucugaagacagcuacaguguacuuacauauaaaauaaauaauaaauaaaaucaaaaaaaaaaaaacacuaccaaaagcaacuuaguagcagggaaaggacuuuaugucuccuauaauuccaggguauaggccaucaugguggggaaauuaaagcaggcacuucaaacagcugguuauauuacauccacugucaggggcagagagaaaugaaugcaugcauuuguauguguuaagcgugauuucugugcucuuaaacaguucaggacuuccuaccuagggaauaauaccaccauagguacugccuagggaaugaugccaccaugugaacugccuagagaauggugcugcccacaguggacugggucuucccauauuaauuaagacagucucccacagacaugaggccagcucaguauguagacugcccuacaucaagacucuugccaaugauuccagguugugucaaguugacaguuaaagcuaaccauccuacuuccugaguuuuuuuuuuaauauguuacaguuuuuauauucuuuugaauaauguuuauaucuauugauuuuuaaccuguauaucaucccuugguaucuguggaggacuggcuuuaagaucuuaaaguccucagguguucaggcccuuuauguaagugguaugguguuuccauauaaccuacaguauacuauaaguaaauucuauauugugggaccacauacacuguaaagacuguuaauaccugcccuggcuguuccagugcuaacacuguauuccuuaggggaagugugaagaagugugugcucagcccgcaguaggugcaggcuuuuuacauuuucagucugaaguugguugaaacucuagauguagauccggaaggcagagaaaggcuggcuguguacuaguuagguaucugcauacaguuguucaacaccaucacccaugacuucugcuguguaaaauauccauuugcuauuauguccccaguaaugagagauuacccggauagaguaaugacuauucuagauugcuuuggaguuuuuugcagucuaaauagauuuguuucuaggaguccugugggccuugcauucuaaacuuuaaaugagauugcguuuguagcauuggcccgccgugguaggcugcaguaaaggguuuaguuuuucuaugucuaccaguuuccucugguuugggucuuaagagaagugcuuuuuucccccuuguuggagacagaauaucacuauguggcccagccuggccuuaaaccagagcucuucuugccucagccucucuggugcugggauuacagguacacauaaaggugccaaccaccuuggaggagacgaguggaaaucuuaggauagugaacggcacuuuugaaagacugagcgagaaguugcuuucugucuugauucuguuuucuucauuguugaagcaugagcacuaggaagaaguuuguuuuuguuuuuguuuuuuuuuaaagauuuguuuauuuuuauuuauaugaguacacuguagcugucuucagacacaccagaagagggcaucagaucccauuacagaugguugugaggcaccaugucguugcugggaauugaacucgggacaucuggaauaagagucagugcucuuauccgcugagccaucucucuagccccaggaagaaguuuuuaacccaggaucucuggacuacauagguagggaaagggaccuugaauccccuaagcugcaugggaaguauauucuaggucuuuuugagucucugaugaacacagccauaauugccuuagaugcugaaggggcccccauugcccauucucuaggauaaguaaguuaauugggaggcguuaagguuucacugcuuaguauuguggaguucuuaaccagagcuucugccuuuagaaacugaauuccaaugcuguugccuuagcccuuuccaacgaguucccaugaguugcuguguugggugagcauaagagaagugcagaaggcccuuccccuucccccucccuuuguuccuuccccuucucucccugacuuuugacuuccuguuucaaugacuuugggcacaggaagcuuaaaacacauggccuggacauggaagaucgcggcuugucagagcauggcuugucugucagagugcaguuucagaagcugggcugguccucugcuccccagguuucuggagcuacucuccacuguaguggcucugcucuagugguuuccuagcugcuaaaccucugcagcaagaaugaccauguccauacccuuaccuggcgccaauaucgagcgaggccuugcaccugucccuugacaggucacagcccuagguuagaacccgcugcuguaacuuugcaaaauggauacuggauacaguauuguaccugguggcuucuccaaacuccccccccccccccaagauggugauugacagagagacccacaagcucagggugcagguaauaggacacuguggggugcucggcuuuauaggacaucuuuaucacacacacacacacacacacacacacacacacacacacacaccccuccucccaagggucaggagucauucuggaagaagggacagaaagauuguacgagcuggagguggugcauggcuacaauauaacaguguuuucuggacacugcagggccauugugcauaugaaauuuacaacaguggaaguagccugcacaaccugugcacacuauaaggccagaugaaauaccagcgugcagggcagagguguguguggacauuagguaucagcaaauugauaguucugguagaugaagauucauuguauuuuuaacgaaggguguggccccugaugguuugucuacucucucguggugaaggucacauaucuaagaguauacgggcaacacaaacugugcuccguauguuaacaaaaaauggaggguguaauguuggguggguaagaaaggggguguggaucugaaaagaguguggguggguaugaucaaaacacacgcuaugcaauucucaaagaacugauaaaugaagaaagaaaaaagaaagcauucuggcagcuucuguucucagacgcccagcaaguggcucuugugggauccuagaagguucuccagaccaccuuugugggcaggugucagucaguauuccuacacaccagcaguagaacuaccucagccacaguuggaaaggguaauacuucuuauucaguuggaaaugagacgauuucuuuugaagcuuugugguaucuuguagugaugucaucugcaauuuuaaucuacggccauguaauuuuuaauauacuguuugguuuuuuaauauaaaaaucaaaagcauaacauuuuuuucauugauuugucauauuaaaaacaaaguuuaaauugauuuuuuuuccuccuuccuccuugaguuauuauuguugguggcucuuuuauagaaaauaccuuccuggcauuaaucugcuuuuuuuuauuguccuccuggcaaauguuuuucagauuucugucuaguacacagcagcgggaaagacucauuaggagauuuuucggauguugaaaucucugaauaaaguaaugacccugcuacacacugacuuuccaaccuuagcaagcuguugguucuucagagccuuuuguauuuccugcuaugaagguaaaaugagauagucuaugcccauggcuuggcauagaaccuggggcuacuggcuauuuauauuggcccaauaauguaaaucuucugauuucaaaugaaacuacugugauauauaaaauaccuuaacuauagccauucauugaaugggcucucagcuaauuauacugcuuauagaauaaaucuguuaauuauaauuuuccauagacccucuugggugggauugcagaaguuagauugacauucuaguaaaaaggaaggcccaagaucauugcauugacggugauagcacaugcugcacuaauacugcugauaagcauuaccuguguaacagagcuagggccuggaaauaccaagagggaaauuagcgugaagcaaugaauuccuaagucugucugaguguaggcacacaguacaucuuuaguuaauuuuuauuccucuggugacuucauucagugaauacuggggcucacuguucuuaauguuguaguaggaaugaauuaaaaugaauauauucauuuaccuucugcaguaaaugauucugaucgggaccauucaccagcaaccuucuuugaaaccagcgagugacugaaacccaggggaaguuuguuuugugguuuugggguuucucgcacuuucccauauuaauccucuuggaguucuucaggauuuuucuaaccugggucaauagagugcuugaaauacuucuauauuugagaacucaagucaaagcaaacauugccacgggaaggcgagagcaguggagaugauguccuuggccuuugaggagaagccgagaaggggccugugcuaauauggagguggauagacagguagucaugguagguuuggggaguuggugcuuauaaguuaauuaagcacuuggugaucucccaaauauagacuuguuugcuuaagaauacuuaaaaguaaacaaggcagugguuggcaugauugcagacuagaugacgucaccuggcucaguucugucuuuauaaggaagucuguccuuuagcccaagucugaagcuuguguuccaaaagcacuggggaugugaguggagagugcagcauuucugccaugaucucucaccuaggcuugcaauggccacuucugucucaggugaacauugaucccguggugagccuuaccuucaugaccucaucuaacccuaauuaccuuccagagcccccagggaauagcaucggguugacagacaggauuucauguuaugaaguuggggaggauacaguuagucuccaucccccccucccccccuauguuauguugcaugcauaaacaaacaagagcgguauaacugcuugaguagcuaguauccuggcaucuuaguaauuuuauuucaauuuguuuguuugagacaggggucucauguagcccaaucuggucucaaauuuucuauguguuguagacugaccuuaaauuccccauccuccuguaucauuuugagugcuaggguugcuggucuaugccaccaggcccagcuuagauuuuauuuuuaaauguguauuaucuuaucucuauuaaauuuacuuggucggcucgacaauucugcugcacucucccugaguagaaagcuagguagauaguguaaugaauuaacaagaggaaaaagccaacaguagauuaagacugguaugaggucacuuccuuuccugacguuaguaggaucggaccuggcuucauugggugaccuuguggcucaguuagggcaaacaugucuucuuaggacaagcguaugaaguugggaggacaucacuuugauagaugagggagcugaaguacagggugacucuacuucugugucauagucuugccucuuccuuaagaaacauauacaggcacaagacucuauuuucuuuuguguuuaaaagacuacaugggaggaugaagaaugcgugaaagcaggagcuuuuuaggaaaucaaaauuaaaguagggguuuggaguuaauuggugugauggguuuguauaugcuuggcaugacuacuaggagguguggccuuguuggaguagauguggucuuguuggaggugugucaacuguggguguggguuuuaguacccuaguccuagcugccggaagugagucuuccucuagcagcccucagaugaagauguagaacucucaccuccuccagccccaugucugccuaaaugcugccauguacucaccuugaugauaauggauggaaccucugaaccuguaagccagccccaauuauauguuguccuuuauaagacuugccauggucauggugucuguucacagcagcaaaacccuaucuaagacaauuggccugaaggacuauggagggugagccucacacagagcugagacaagguguuaccucagauugcuauugugucaaacuuacaauucacugcaggucaccugagcccccagagucuucugaaguggaaaguguugcuggagugaaagcuguuccucuagucagcuggcagccuugacguggcgcaucccgccucucaggcccucaccuccucuaacaaucaccagugucucugccugcggcaccauggaggacuucugaggcagauaaacaacagcguagauguuaaccugcaucgaagcacguaauugcaggcugauguggaggauugucccaacugcugugugucauagaccugagaggccuuguaaauacaauaaugcaguuugaaccagaacucaguuuccauaucaaagaagcagaaccccaauaugcauaauuuaaaaaaacacacacacacauugucugugagagugcugucccucagggcgguuccccaucucgucacgcucaugaaauauucaaagauaguuuuagguuguacucuguuugguuuugaguaauccuucugagauauuuauuucuuuggauugcggucugucuuuuugauuuuggucuguuaaauauuccgcaaguaauaaagguuugccaauucggaaaauaccuuugagagugucagaacucuucucacuccugaauguacugcugcagagcuggaaaucaguguuuacaagaaccggcccauuggcaggucaagugguuccaaaggauuucagcccccuuccuuucgaagauuuauauuuuacccucgguggggccagggauggggccugagaugggcaggaguaggauugcucuccccugcccuaggcaugugugucuugguaguguguucuuauagacugguggccagguuaaacuuccucuccccuuauaaggucaugcaugcccagaagcaccuggaaugccucuuaugcaaaugaggcaucuccccauuaaaauaagcugucuuacugaagcugccucccaagagucuguucucaccaugaccugagugaggacuuucagccccuggucuugggaggcagcuucaguaggaacauaaauaagugccuguaacacugaauuuggggguucauuuccucuucuguugagcccaaacaauccucacaguuuuaugagaaucaaagguaacaguuuggauguggaagaccagcguucugugagguauucugggugugugcaugaccaaaauaucuggcagacaagccaauggauggaaggugucucugggcucacgguuucagagacguuucaguucuucugguagggagggcgucaccgcaggcagggguggcuggcucuaucuuugaccacaggagcagaugcuggcaagugaucacaugauacagaccaggaagcagaaggcagacuggaacagggguggggauagccaguaaguaagggccugcuucuaguagccugcuccucuaacauucuacugcugaaguuacaccacaggaucgcaccagaggcuuccaaaugugagccugcgggggagggagcgagcacuguagauuuaaaucacagcaaacuucuauuucaauuuuuguauuuuguuuccuuguauuucuccuaaggugauuuagucaucagcauacuuaaaaaaaauagauguauggauaaauggugacucugaggaacaaauuagccagguuaugauuuuuauaugucuuuaauaaauggucuuuuuggaauuuguggaaacugucacacaacaggagaguaccaugguuccucacccaguaaaaagcagaauuaccauugcaguuuugugguguauucuggauguagaacgugacauaacguuguuuuaauaggggcuuagagcaccuguuuuuguuuuuguuuuuuuuuccucaagacugcaugccucuccuuguucuguggaagaugucuacuuuguugagagugagguguacauuaagacccucccauguuggguuagagguggggaggaucauggguaguuccagcuguucaauaucaucuuccuucaguuauccaauaucacaucugucaccggaauaaccaagaguauucagagaaaggggaaauuugauggugccuaaugucugucaauauucaguuuuuaaguaaaauaaagacuguucaucagucacuauaacaacggcaucagaaggaauccuggcuuucuccguggaaauauucugcuuacagccgugggaggucugaccacugggccuguccucccugcauuucaugacacguuagagagucuggccguagcuaugugaccuucaccccuccugaagcucucucugcagaugucaucgagggauggagucuauuucuaacauaagaauugaggccacagaauuaaaagaucauuuaaauuuuucuguuuuacauuuuuugauuuguuaguuuuuugaguuaauuucccucuauugccaaagcuggucuccaacucccaauucuccuguuucauacaucaucaauccuggcauaaauuuacauuuuacuuaguuuacuacacacauaauauugggaguauuucucuagagcagaucggaggacaucacaucuuagggaaauaaaugaaguuuuaaugauuugcuucaucauguagcuccccaccaggcuuucucauuugaagucaacaggaguccagaccuugauuuucaaucuuccuccaagcccuagcugcucuuaaucccauuguaggcagagaaaauaaaauucagauccuaaacauacagaauuauucauugcuugaaauaauuugagagcuacguucuggugccauuaauaacacugauguagaaucggaguccagggaagaggcacaaaagauuaaaaccuccaagcguuagccuuagagcuacacaaguuggaagauacaagguaucauuaagaacccagauuuaaaugaauaaccucauucaacaggacuucagcucucaaagcaggaagauauagaaugacggugcucugcccacguuauauaaacguauuagguuacuuugagucaguuauuauucuuguuaugcuucaucaccgauauccuagcuccuuugucaguaaacuuuggaguuuggauuagaucguuuguuugagaguccucccauuugacuguagauuagauagcaccuguaaagaggcuagggcauguugauuuaugcuuuagauuugcaaaagcucuucccaaggguucaaccagccauaaaggagagcauccauaggugcuggauggaaggaacgcaaucaggacaaaccuuugcucugaggucugaagagccugagaggagguugguucccugggagauucuagaaccugaauuuguaauagucgcguauaccuucugcagguggcucaagcaggggugggggugggguggagaugauguuaguaauuauugccgggggaggaaauaucucuguaccugcagcaucuccacuuuugcauacaacccaaauauccgggcagagcugucugugacacaagcgggugccccuuccuucauuauucagaacuaacccagcaccacagcuguuuaccuggccuuucaguggccguggcuggcagugggcuccagguuaacaguguagagauuugacaggucgcgugcaaacaccacgugaagggacuugagcgccaauagaguugcuaggugaugucugccugcucagguccauggcuuuggcucagugaagaccagcuuuccugcgcccuuaccaaccagagauucuagaccagcaaacaagagaaagugaauguuuugacuccauuuuccuccucccguggucucugggcaaacaggaaggguauauuuuucuuauguccuuugcggaugugguggcaguguacugggaaccauugagaccacuaagaaaagaaggggcuuuaucuuguggcaggagaucauacccccagcccuauuucuccccuucacuggccuuuggcgaauaauagccuuuuguaguuaacuaagagcauacuuggccuuagauuauaauuauggcauacacggaaauauaggauuauaugaccagcugauuaauacuuggacuugaacacacagaccugaguugggcuuuguuucauucaguucccauaagauggaucauaauuauacuauuaauauugaugaugauuauaaaaguauugcagugagccaguucuuacagaaggaacaaugcgcuggguucuuuucuggguacgcuucuuagugauuccucacaagggucuugguggguggcuaccaccgugaucucuuuucauagucagagaagcugaggcacugacuagguaacuuagcaaaaucacguaauuuaagagggggcugaucuuacauuugaacagaggaccucuggugucugaguucaugcugguuaucauuggaccuuucccaacagacugggcugucugggagugggcaguuugccgcagguguuauagguacuacgagcaacugcuuguuggaacgacugaacauauauauguauauguguauauguaugaauauggguauauauagagauauauauauccacauauagguguacacauaucugcuuaguaguuauuuauugaaaagcuguuuuuuuaauuuaaaauacaucuauuuauuuauuuauuuauuuauuuuuggcauggauacaugcuugccacagugcacacaugcggaggucagaggacagccuuuggcaguggguucuguguccaccccaagguuccuggggaacaaagucagguaaucagauuugucagcaagacggucugcucacugagugugucucuccaggccaagaaccaauuuuuauucucauauucuaaguuugauuuuagaaaaguaaugcaaguacuuuauuauuguuguugcuaugguguuucuguuuguuuaugcauuuauucugagacagagucccauaucuggccucgaauuccugccucucccuugccuccaccuccccaaagcuaggauugcagguauuugcuucgacauccagauauuucuucuuaucaaauguuugucacauuuugguagagacuguagucuuuaaccuuuugacuagaagaccuaggguuaaacaaauuaugaaaaacuccccacauugcaaaugagaaccuaggaccuaccaacugucuaguaaugagguagagaccuggauuaugcacauggcguauuuaaaugccugaaagugaauauuccugcugccugcugguguuuuauuauguguuaccucugauugacaggucgugaaacaaucgcguuuuaaaaaaaacuguucaagauuggaccucacauuugacuuuuguauuuuauaauugagaauaagcuagguuuuacuuaaaacuccuccauguaauaacaaccucuuauauuugugauccaaucaagccaccaguauuuuaacaugcucagauugucaaaaugucuauuuauuagagaauucuuaacuuuaugggcacccguuccuguaauuuaugcaugucaucccaucucuugccuuccuucucucucuuuuuuuuuuaauucuaguuuugcauguuuaaucugcuggucaucuguaacccaggucaccuuuccacuuggagaagaccagugcucacugcagcagcuuuguccucugccuuggacaucuuuuccuccaggaaaagcagggcugugaggguggagguugccaugguuaccguuccuuggguguugucuguaaaggagauaccuuggaaucacagacuucuuaguuugguaaggaccgcucugaacagagcagcaaaaccagccaggugguggugcaugccuguaacccccacauuggaaggcugagacaggagaacuaugaguuugggggcucagcucgguuuuugagacagggucuuaaaaacacaaaagcaaaacaaaaccacagagaaacaauccuaaacugagaauccccaucaguugagacuauaaugcugaucccagaccuggugacuuaauggcaguguuugcuaagaggagauacuggaauugggauaguccugaaugacuccgccugccccugggaguuucuucuuuugauccugauguuaucacaggucaguuuaugaucaugguaucauaaaguugaugcuguaccugacacaugugugcaaaugcauucuugugccuguacacccaagcacacauacacacacauguguacacacacacaugcaugcgcgcgcacauacacacacacacacacacacacacacacacaccauggaugaaggaucaucguguacugcaucucuaucuagccuuguuaaacaccaccaaagugaucauuucagacucuggaccacauuuuccuaagguauuuuggauaguuuauuuuccuaucugucugucugcuguugcauggugaccugagauaggcugugcuuucccauuuauuugguuguuacuucuguuaaucauuacagaaucuuauuaugacugccugcauauaaaucaagaaaaacaaauuugauuucuagcauucuaauguagcaaagcaaauuugugcgucuaggaaguuugcucugucaaugucaggaacagagagaaaauaaauguggcugcaaaugcuagcuguuacaaucuucuuuugaccccaauggcccuuuaaauagcccaaauaaugacuguuugauauuuauuauuaagcauauuaaauuccuugauuaauugaagcauuuaguccucuuuuuuuuguucuguguagcagugaaaauagauuguucuauuaucauucuugcuaggaaacauaaaauuauucauaaauguauuuuaaacaggagauauauucagguaucauuggguauacggagcagaaaauguuucacauuugaauggcaggcacaagauuauaaaugccuuuccuacugaauauuaaucacuggugguuccauauggcugguggauaaagcucugagaggcggcccagagauguaaauuccuacccuacugugaacuuuaugcgauuaguuugcuguuuaaaauuaacugacuggccuucaaauuauuuaaaaaagaaaaagaaaaaaaaaaaagaaaauuauuagccgggcgugguggcgcaccccuuuaaucccaacacucaggaggcagaggcaggcagauaucugaguucgaggacagccuggucuacagagugaguuccaggacagccagggcuauauagagaaauccugucucaagaaaaccaaaaaaaaaaaaaaaaaaaaaaaaagaaaaagagaaaauuauucuuuuugggaaguccaaaggcagaauaggcucaaagugacccuccauuucuccucuugguuggccuuucuccuuccuuggcuccacugacuuaauucaaauugaauuugugcccugucugcccuggcucuaccaugccuauucucuaggggcaauguggggccaugagcugggcacagacagccugauccccuguugagcacaggucuugaacccugugaccugguggguggugacuuccaccuacaagggacagcagguguuuggccaugaccccugggacccugguuccuguagcagcuacagccucccacagcggggggggugggggggggugggggggguggggguggggugugugugugugugugggugggguggggggcagguguguggccaucagucauguaggcgaugccccaagcuccugguauucugucuggacuccaccccuacaguuaccuggcaacaaccaaguaggcccaacccacuacaaaagggacugcuuauccccucccaccucucuugcucuuacucucuuucucucuugcuccugccucucuuacucuugcccucuugcucccccucacuccgccuucccuucccccucucuccacguggccacggcccuccucugcuucucuacucuucucccucucucugccuuuauacaauaaccgccuuaagcugggcgugguggugcacgccuuuaauccuagcacuugggaggcagaggcagguggauuucugaguucgaggccagccuggucuacaaagugaguucuaggacagccagggcuacacagagaaacccugucucgaaaacaaaacaaaacaacaaaaauaaacgccuuaaaaccauggacugccucuucucaucgggaucugucaugcuggcgcaauggaacagagcccugccugcgcucuccagccaacucaacugagccaccgaacaagccuaggacucuugucccugugguaaccagcuggagcccucuccugccuuuuucucuucgcccugggccagaguccaaccgcgggcccacacucugggagguuccuagcucuuccaaggcaucuguggugcccaagagugagaaccugccagucucgcccucugugcaggcugggaggcucccccacaccccgcaagcagcucccggaaguuccucagggaccucagacugguccuagcccugugaugagcuggacgcggaagcccauuuugacccacagggcaaugcugugcacaucccugcucuaggguacaucaggacucccugucuguucuccuguggccccauuccuucugccccaggaucccgggcuuccgauaagcauuuggugacugacugcucacagugcagccuauuaccuucacuccuucagccacacauccccgcugguucucucuaaggcacucacuguccccuuacaguguuccauuuccucuuccuccucauaccuucacaccgcuuggugcucucagcggaacaccagaucccuuuaauucuuccuucucugguuucucagccaggcuccuggcuugcuccaagcgaccacauguuucuaggcccgcagagggacgacaucguuguuugcaucucguuuugcugaccuagucuucccaaauggcaccccuuuccacuccauuuucagauuuauuuguccagagcagguauaugaaaugucacccuccaggucuuuugggaggagaaggacagauuguccugagaacaugaacagacuugugugggagaaugauguaagcaagagcucacgucccaggguuauuagcgugcuaaucaggaucccaaagggacaccucucagaaaacuggaaaaauaaauuaauuuuuuucuauaaaucaagcaagugggaaaaaaaagaaagaaagaaaagaaagaaaagaaaagaagagaaaggaaggaaggaaggaaggaaggaaggaaggaagggaguuuugagaugaaaacuguuaaacucugcuugguucagcugcaugugaauuauauggucuuagugccaagcaucacccauuaugaugguuuguguaugcuuggcucagggaguggcacucuuaggagguguggcaugguuggaguaggugugucacugugggcaugggcuuuaagacccucauccuagcugccuggaagucaguguugugguagcagccuucaggugaagauguagaacuuucagcuccuccugcaccaugccugccuggaugccgccauguuccagucuugaugauaauggacugaaccucugcaccuguaagccagccccgauuaaauguuguccuuauaagaguugccuuggucauggugucuguucacagugguaaaaccauaauuaucuuucaaaaggaucaugauuaauaguggucauuaaaugauuucauauucagcacagggucugguacauagcaaacauaagacauuuuaguaagauagaaacaccacucgucacaugugcaggugugcauguuuauaaaguacauaaagacgaaaggcuggugcucaucuacguacagugaggucgagauugcuuauuuauucuuuccauuacuuuacuaaguaaaaacaagaaacgagcaaagccaucuuccagaggauaaagccaccgcccuguauguuucaucccaugauucucuuucucgccugcucccucuuuaacucuugguucccaaaccuucugacuuguaccauguuccucguucacgccggcuucugacugcccuugcuguccauccuugugucuagguuguugccauggcuccuuuaagguuuauggugacaucacuugucccagcagguugaguguuagggacauguauauuaaaagugucugauucauauuuguuuaccucaguggagugcuuuccuccugaguggggacuuuacuagaagcugaaaauggaacgugauuuaguugcugagcacgcaugcccuccacgcugcugacaguccuaacagagggaaaggggcaugugacuucucgaggguaggaagugccaugggaucccugguacaggggcuacugaaggagaaaaggaaguggugccucuuggaggaggggcuugggagcguguaaguguugcguuauuucuguccgacaggauagucaaaguacugacuaucuguuucccgaacagauagcacaaaggcagguagaaguucccagcaugggggcuggugagauggcucaguggguaagagcacccgacugcucuuccgaagguccggaguucaaaucccagcaaccacaugguggcucacaaccaucuguaacaagaucugaugcccucuucugguguggcugaagacagcuacaauguacuuacauauaauaaauaaauaaauaaauaaauaaguucccagcaguuuuacagggaaccaaggcaggucgugggaggaugggcuggcagucagaagguggggggcugagcuugagguggguucuucuuggugcuuggcauguggcagucacccagaaauguucagacugcagaguauuccuccuccugguauguauggugggcuuagggguucgggauucucagagcuucuagauaauucuuucuacguguuucugcuuuugagguuuucuuuucccccuagggaaagggguuucggauuuuaucagauccugcuaaaggaucaugugugaaaagcugagagccauaguuuuugaaaaacaaaacaaaaacaaaagaaaaacaaaaauucaagagagugugcaugugcacacucacacaugcauguacacacacacacauacacucucacacauacacuaaauggaugaggacagcgacagaguacagaaaugguuugaagaugcuuugacucuggcugagcuuggcagggauguccuuggcgcccacaggacaggcccuuaccggcuagaaccccacagggacuagucacugucaugcucuggaaguuggcuccagauacucuuuccagauccuccuagcaggcugguuucugccucuuugguucuucucugacaccucucuagggcaagaaacauggguuugaaagacuggagagagaauggaagugccccaugcuuuguuccgagguaaggagagcaggcaaguagguauuacaagcgugguuccguggugcccguuuuccagcaguaaagaaggagucagcaugaacugaacccucucagaggcagagucagucccauuccuucauacccagcagcccauagagagaugcugaacuacccagcccucaagauccugcccaggcagauuccucacccucagugcagaauaacccucugcaucccuuuguucuagugcagcgguucucaaccugugggccaggaccccuugugggcgucacauaucagauauccugcauaucauauaauuacauuacaauucaucacagccgcaaaauuacaguugugaaauagcaauggaaauaauuuuacgauuggggcacacccuaacaugaggagcugcacugaagggucacagccuuagguagguucacaaucauuguucuacaacgugauggaccccggcaaaguuguuuguauuuucucuuucaucaggcaagccuggcuuauugcugauaugcaugcuuaugaauuugagcuccccagcccuaagguagcgaguucagcuuguguaguuuauugugcacaaaggaaauucccaacggcugacuguucucugguauucauggcuuaguaaggcagaguguguuuuuuuaugggaaggagguugaucuuagcaaagauaggagcugccuuucuacagggaggguuuuguuugguguugaucugaugcaacguuugaugcuaucagcucccuaagacauguggguaacuucaaguuugcauguagaucaacggucauggaacagacacagugcccauuguuggucacacuggaccucuggguucucuugggagcaccauagucacucagaaucaguuuuuuuuuuccccccaaagcuugggagcuagccugguaguguguucauccuugucaggguaacagaccuuucugaggacucugaggacccacugcaguuaaggaaugcaagauuucaaaagaggauuaucaaaaaaggaaaugcaagcgucuugaugguuucucugguauaugaggucacugacaaauagugaugaauaguuuucuauuauugaggaacaaagaguaggaaaauucucgugaacuuuauuacaagguccucacuggggucagugagaaaguacauuuuccugugcuucugucaccgcgccuguuaacacuaacacuuuuagcauuucacuguugguuuuuguuuguuuguuuguuuguuugauuuuuauuagacacuuugaacaggaaauggacggaagcucaugguauggauugaucaccuguugagagcagacucagaaccuuccauccuguuaaauauucaggagggaagcaugauuguccccacuuguggggucacuaagacagggaguguuuucauggcaugugugauaauggcaguccuuucgguguggcaucugccugaguuugugcgacucugaucgccuugcuucuagaucuuccacaauggugagucugguguuuccuucaggucaccuccacaucuugucccagguuccuguccugaagacauucacugucucuugagaacaacuguucacgauccagucagucacuuguauguccagagcaagcccaucaguugugacacuaaggcuggcggaggcaugucuaguggugcaacagaucugagccgcaugcuuucuugccagagagaaaaagaaaaacaaaagcaagcaaaacauuaccuuauaauaaagauaaaacuuuuaacucacgaguuugggcugccacagggauggcgagcacccaacagugauaggcugcaugaauaguccaccagguaaauugacuuugauccgcauuuaaccugcuggugauaagccuggcaucuccugcucuggcuauaccacaccccuuuguauuugcaaggguugauuaugugagcaguucuagagaauuuggaaaccauggagaacugcaacaaacaagcaacaaagaagcuggaaaaucgcaacagacaagcucacccggcuacauugccucccaaacacaagcccuggaaaagcuucggcaagccgcuucccugcccuuucaaagggacguuuguagcuuuaugcgguucagacauagacucuuuuucacuugccuugcugacaaacgguccuuccucucacuguauuucuuucauugugguaauauguacauaacauuuaucauuuuaaccuuuuucuaauuuucccuagcacuaaguguacucaguuauucagccaucaacguuauuaauuucuggaacuuuucauuauguauucuauaccuauaaaauauauaucacaaaucacacugaauagcugaguaauauucugucacaugcauuuauuguauccuguuuaccugcaaacacauaguagagucuuuuuuuguguucacugccagacuuuaugucuaagggaguaaacaaaaugcgguccaggggucggucagggcuggagaggugauggcucagcagugaagggcacucacuggcugcucuuguaggggaacuggguuggguuccaagcacccccaugguggcucacaacugaguuuccagggaccugaugcccucuucuggcuuccuugggcaccuggcaugcauaugaugcauagacacaaauguagguaaaacauuuguaaauguaaaaaggaauaauguuaaaaguauuaaaaauaugguguguguucuacaagacuuuagaacucuaggaggaaguggccagcgucaguccuggggugcugucagcacagggacugugggagcuuauaaacgaggggaauuuggcgugaaguuucaucuaugaagucauucguugauuauuauaaaucgcaugccucagcuuuuucauuuuauaacgaauuauaauugugagcuaucugucaguauaaaucucaggccacauuucauaguuagccuuuguuuucucccuaaaggaauucuugucaucacccccaccccccacccccccaaugugccacuuuguaucucuguuuggccucaaaauuacuacccuccugcuuccucuguguuccaaucccugacacuguagauguugucuccugcuucucuguaggacagcauuaauuuucaguguuaaagguguaucuuuaguggcugguggcuggaguagucacccgucacgcugguguguacguuucucauucucuuuggcccccagcccauaugcugcggagaggucucuguaucucagcugcuucuuauauuggaaaguuucuguuuccagaaaacagaaaagguagucuaggacgccuugcucagcucauuuaguugcuuucgauuuuaagagguaauacauagucuggugauacagaaaaugcagggaccugucuuugaacaggaucauuuuuagacagaguguuagcgugggcgguuugagauccgacgaacacuuuugauauauuccuuucaugauagcugaaagauaauguuaagcuguuaacacguaccucuacacacccaugcacguuuguguuaguguacauggguuuuuaggauauauaauuaauccgcccuuuaaggccaaauucacagagcaaaaaaagguguggaaauuugggucauggguagagucacuugcuugacaugugcaagaccgucaucgggaucaccagcguugcauacauguaggguguuagcauggcugaguuagacauggugauauccucuuuacuucugcauaauggcucuaaccacaggaccaggggcugugauagcaagaaucagagggucugggauucugggaaccugggagcucugugucaagugucgagcagcugggaaaguuccagguuuaaauucuagacaguuuccaguaauucaaauugcaaagccuuucacaguguucucaacuguuucauuugagagcggaaggagugaguccucgcuucuuguuaguuuuuuauguuggcaauuccauccuuaauuaaaaaaaagcaucggcauuuucauuaugaaaauggcuuuccugaguuuacagcuggaaccacuacauuuaguuguuuaaaacuugcugccauuagccuaugcaguuacuuuuauguaaaagcaaccucaaauugauuuagggcauucaggguuuggcaauuuccauucgcucaugagucacaggagacugggagagucaggaugagccacggaagagucucaggagucucacagguccacugccccgcaacaacgggaaaagcgucacauguucacugcccccugaagccaggaagagucauugcuguucuuguucaaggaguugagucugccuuuucuucaguuguuauuaguugcuacggcaaccguaagagcaucccagaacaggucuugaaacaacagaugcuucuuuucaugcagcccuggaaggccuaggucaaggugucaggucagccucccugccggcacacagaugcccucucuuguaucucuguaugguuuuccucagcacgcacacaggcucucggcaccucuuccugcagcaagaauucuucugacugguuuagggucuacccuacuagccuaugcuaauuagcauaaucuuuaccuuaaaggcugccucuuccaguagucaucuccgaaggagcugggugguaggacuuggacaccgggauugugaggaguugccguccccagcccucuguuuaacacaguguugcuuuguuugcauguggggagauuaauauaaagaagaaccccaaauaaggcuccgccaaguucgugucuguuauuaaaggggaaggaggccaggcggaggagaagagaguucagacugcugugaaggaguuugaaggaaggacauucucucuccgcgugcucuucugccaagugaccaccuccucugaccuccgacuuugcacuuugcguucuggggcggcaguuuucuccauguguuaaugugucauaaggaggcauccaugcacugacuggccugagauacuauguagcaauccaagugugugugugugugugugugugugugugugugugugugugugugccugagauacuauguagcaauccaaguaagugugugugugugugugugugugugugugugugugccugagauacuauguagcaauccaaguaagugugugugugugugccugagauacuauguagcaauccaagugugugugugugugugugugugugugugugugugccugagauacuauguagcaauccaaguguguguguguguguguguguguguauaugugugccugagauacuauguagcaauccaaguaagugugugugugugugugugugugugugugugccugagauacuauguagcaauccaucaagugaguaagucagugugugggggguuggguggggggaugggguuguuuggucagcuauuagugggcauucaggcuguuuccggagccacccccacuccaacucccaaaguggauagcuggauucccuuuaaagccaagauggaaagaaccacuuaauaaaggcaguaggucucugccuuuggugaaaacagucuuugucuucgcuuccuguuuauuguuggcuagcacugagagaaaaaucuuccagccucuccagagaggcccaugcugcgcagggagggguuuuccuuggccacugaagucaucucaacccucagccagccgugcccaggaauaggggucccgucugagucauuaauuagcaggagugcccacuuucaguuaaacagucuuucuuguaaggacggcuguagcaugugacccgcgccuuucugccugguccuagucuggcaagguggcaaggggccgcuucuuauggaaugugggcagucguacuucucaucaaagaucucaguguaggccaggagggccagcaacuccugagguuagcaggucccaugagccaaccgcuguggcuuggauacuaaggauggaacgcugcucuguguggcccugaguuucccacuucagccucucagccuuaggcaucaccugccuuuauuguauaaacugugccacaguggugccgaugcgcuuuugguuucuggaaguggaaaggcugcuccuccgaggcuuucucuuuuauuccaggcccacggagaguucauuuucaccugggacuucuagcugugagaagggcuggcagagguuagcccucuucuaaagccaucuuuagcagucccaaggagguuccgagauggcuuguguguccacgcucauguuucugaggcucugauuuuauggacgcuacggacauguugugcauaugggcuugggugcaggaaaccuguaauucagcaaacguuuaaaaggcugucugcaguguuucuaauuacuguuuguuugcuccaccagugccuaauaaguggauuuaaguaaccucaggagcgaggagugcaaugcucauguuacaggcaaucaugcaaaucaaauucugacugagaguugcagagaacacacugcagagccauuguuagagaaguaugccacuggguuuuaaauuuagaacaagagcaguuuggaacuuucccaccugucaggcaaggacgugaaggacaaacucaccugaaaucaacugcugucugcagaccauuuauaagucaccagcagccucuggcauccggcugucuucuuaauuuaacaugggaaggagggagggggagacuuaccagcuccucuucccuucuuucucccauccaucauugccuguauaggaaccggaaaugcagguccggaacacugggcgucaaccuuggguacggcuuggcaccagcuugggaauuuucaggugcccgggaaccgauccccaccccaaggugcuggcuuaauguuugagaugcagucuacacugggauuuuaagacggucucaggaggauuauuauauaccaagauuaagccggcagggauuugagagguugcuucgagcgagagaaaucucagcccugguuuacacguugguaacagcuggagguuugggagagacaaagaggcccauccaguaaaaccgcauuccuggaugagggaaccaggcuucugaaaagcuccgggcugggccguccuggugugcagcaagagucuggcccacugaccgaccuaccuaaccaaguucuaacgaaaggaaaauggagagccuggaagguuagaaugacuuggucaaggucagacgcuugucgcagagucaggccugggacccaggucugacaccucuucugggcucucuguugcccaacgccagccguuauguuuguuuauuguauuuauugauaccuccucguccuucaggugauguuccugacuccaggaggccuuuucuggcuccucauacuccucuaccauccggucuggguaagauuccccugguuguguuugaacagcacuuguauguaggucuccccucacguggccgguucuggagaaaagcccauaacguucuuguguacuguguaacuugaugguacguguuuguuagcuccgaggcaccacuuguucaauugcacugcccuaaguuuugguccacauggguugcuaaaaguaaugagaugcuauauaggagcacuaaguguauuuccuguggcccacugcauuaugggucaggaucccucuggggggaaauguucugcaaggcaauguuaauguuggcaugauugaaaacaggauuuuggugaccucggauguugcucagggugcuuugaauggcaugcugcugucagggugcuggugugaggaugucugauggaaauacuauuucauggaaccgugcuuuaaaucaucuuuguguucaugcugaagauguaauugugaguggucacaagccaaauagcugaauuaaauuuuuuggcuccguagauuuuuuuaaaugacaaaaaaaaaaaaaaucgugucuuucgcugucauccuagauguuuagagucaugguuuucacggggaaagcauugccagcuccgugugcuuguguuuccuuguuguggcucuguagccuauagguugccguguggcucaguguaaauaucacacaaagaaauagcugucuuugguggaagauucagagcugaacuuccuuggaaccagggccacuaacugggcaguguugcggguagacgcaaggauguuaagguguugaggaacaauggccaaaauguguagaacuacuuugccaucuauauaaacauguuucacagauucguggcuagcaagggcugccacaucccugggagguguggaagcaaaaccaucacacaugagggaaauaaaauauuuuuguucgauugucuucugagauggaugucaugucccugugucugaaggauguccuuaaauacuugaguuuccuguccccuaccuccacaguacuagaucaugagugugggccaucccaccucgcucccacuguaagacguuuccauaguauuucauuuuacuauaguguacaaaauguauuuugcaucacuuuaaaaaaauaucuagaaaaguuucuaccaguuuuuuuuuucauauuuuuggaugaaaaauauuuaacaggccagaaaaagccuaucagugagcaacuguuccugucagaacuucagaggcauggccguauauucuagaauaaaaaggaagagaacacuuaauguucuaaaccuauaaggaacacgguucccaccuaggucacaccgaugaccauguguaacugcccugccauuuaggacucaaguuuuacaaguacguacacacacacacacacacacacacacacacacacacacacaccacaugggaacaguuagaacuggaauuuaaacccaagucuuucugauuuuuaaguccugugucuuuggcccugugaugaggccuccaaaugagacuacuuauuaacuuugagcauuuacuauguuggaagaagagcgcuugcuucagugucuuagaacuucuauuaagcaauugguaaguuggugagacgacgauugugagguguggagaaaagcgaacacauguauaccuccaugggaaugugaauugcugcgccauuaugaaaaacagcauggugggucaaggaaagguuaagaguagaacuuccgcacuaucagacagucguaguauauacccagaggaaaugaagucaagaucugcauuuccacaugcauugaaggauuauuugcaguagcuuaaauauggaaauacccaucuguuaaugauaaauggauuaagaaauuaugggauauguauguauguguguacauacucacuuauguguguguauguauguacaugccugugacuauuaugggguauguauuuguguguacaugccuaugaguauuaugggauauauauguguguauguacaugccuaugacuauuauggaauauauauucaugucuguauguguguguaugacuauuaugggauauguauguguguguguacaugccuaugaguauuauggggauauguaugcauguguguauguauguguauauaugcacaugccuauuaguguuauucagccguauaaaaaaggaauugugccauuugugauagcauguaugagucugaaggacauugugcuaaauaaauaaggcagaaaggaaagccaaauacuguuuauauguggaaucugaaaaugucaaacucacugaagcagagcgcugaaccgugguugucaggcccuggaggagggggaaugggcagguaccaucagcugguucuuaaaguugaggugagugaguucuaggggugcggugcccagcagggugggaggugguauaugugcuaaugaacuugacugcagugaucgacccaggauguauaugugcagcgaagccuuaugguccgugaauggguucggucugugccaguugcauauuuuaaaaggaccaccugugguuuaaagucauggguuuagaaauuugugauuuuauucucagauguguuugauuuggaggaauuggaugagcaaaaugguuggugaucugugcuucaucguugagaacugggauuugagaaccccaccucuccugugucucugcaucagccaaaugagacauucuagcuucauugcauuccuuucuucccacaggcccugagcuagaaaaacacagcagccggauaaaacaguucugccccgugcucacaaaccuuguuuucucugccaggacauugucugcuuccagcgugggaagcuugcccaucagagccuuuuuugguucacaggugggucccaggguuuccugguugcucuccaggagaccucuuacuaagcuuggcgggaugggacguccuugagggucacuauucgggauccuuaggucaucggaggaggaugagcaaaauggucggugguuugugcuucaucguugagaacugggguuugagaaccccaccucuccugugucccguguucuagaugagcacucugagacagaguccugugccccugcacagcgagucacaguggcccgugaguggaaucccgggguuuucuucugucucuuuucuacaaugcuuuauuucccuagcuugggaaugcuacuuggauuggauggaugcuacuuccuugaaacucacucagggcucacuuccuucuuguaauuacuucccaauuugucuucccaguuccugcugucuauuuucugguccuuugauagcauuuccuucuuuguaggauguuggaauggugacuuuauuuuuuuuuuccugcuaugguuuugcgccccauuuucucugcauauucuucugugcccagggcuuugauauaacacuuuugaacuguuuugagcuucaaacacuccauuugccugcuucuccaagaacgaagucuagauuugcuucaugugucccugacucuauccugccuccuauucugguaccuucucugucuguggacggacaguguuaccuccuccccaucuccagaguugaaauacuaccuacaugaggugggaaccgguccggguuucuccuuugauaucuuuuucuuuuuucuuuuuggauaucuuauuuauuuacauuucaaauguuauucccuuucccaguuuccacuccucaaacccccaucccaucgccuucccucugcuucugugagggugccccccccccgaucgcccuagcauuccccuucacuggggcaucaacccuucacagguccaagggccuccccuuccacugaugccauccucuguuacaugugcagcuggagccaugggucccaccauguguacucuuuugguaccuucauuccuuccagaaccugaguucuccuuucaaaaugaucuugacuuugucuucucugucuccacuucagucaaccuuguuagcugcccccaacaguagucuacuggcuggugugcgaugcccacucuugcaucaggcagcucugugaugcugggguacucugcucuugucugccucgcagaaugcguuucauuggaguccaucuggauuccucuacuucagcuuguuccucuucucugccuuccuuuggggucauauuggcuggguauugagagguguauuugaggguggccucuuuucucuuuuauguucuuucagucuuggugacugaccccaaggcauugucgugagcacacccaaaccuuuucugcgauugcaccaucggucuccccuccuccccuaaagcuuuucuuuuuccccacagucaacuucugucccauucuuucagguuucagaugucguuccuuuccccacccugccccaaauaguuaccugagauauagucugacauagcaaccuguuaauguccuucuuuucucuaagcagagugaguucccacaaaggaacaucuuaugguugguacacugauacaucuuuugcauguagcguaggguccggcauauuguagguacuggcucucaugagauguuugaagugagcaugcacucucucucucuuuauuuucuuaggcuugaugauugaccccagaguguacgucugcuugucaagugcucuaccaaugaacucuuucuuccuuuuuguaaaaacguguuuguuuauuuguucugugugugaauauguauauaccuacaugaguuuauguguacuguguccugaaggacaaaagagggcaucugcuuccccuagaauuagaguuacaggcaguugugagcugucaggggguaucaggugugccuuucuaauccacacacugacacuguaacuuaucuguuucucagguuuaggcaccauccuuuggugccagcauuuaguuugcuuucauccccuccugccccuugcuucucaguucucauuuuuuugccagcuguaaucauauuguaauuguacuguaauuuggaugagaucaauauccaguguuuacuuuauugcaacuguggaaucuucuccacagaugaaccguuuaauauaguuugauuuacuuuugccucucaugguuagguugcacggccaauauugacuuuuuuuucauuguuaaucuuugauauaguuaugaauaauucaaccucaaauucuauaccaguuguaaaucucucuucgauauaaccagccacacagggauucugucaaggucaucuuuggaggaagagccucuggaaccuuccauugcucucagggcagagaaugguuuccacuuagcaccuuccugccagcuccuuuaggcucugucuuguaggagggccuugcuauguguugucuuuccuguugguugaguguuccauggacacauuucccagggccucacagaggaaggcuggaguugcagagauggaagagacacgucugaaaaugccuuccucuuccuggauuuuaacugaugaccuugcacucaaggauguuucuccagcuaguucuugacaaguucuaugcaucagacucugaucuucuguauauaaacccuuuccucugggauuuugugggcuuuucuuuuugaguccugauuuagauccuguuaacauguggaaacauuagcagauccuucgcucuggccggccuuuccuuuucuuuuuuuaacuguuguccuuggcugaccuggaacucacugacuauguagaccaaugguucccacgcuucccagggcugugaccuuuucauauauuccucauguugugcugaccccccagccagacaucauuuuuguugcuacuucaugacucucuuguugcuacaguuaaaauuguaauguaaauaucugauacucuacccugggaaagggucagucagaccccaaaggggcugaggaccacagggugagacccccauauagaccaugcuguccuugaacucccagcaaucggccugccucccaagugcugggauuaaaggugugcaccaccacgccugaccacuuuuuuugggggggggggagaaaguuuaauuuggggagcaaaauagccuuuaauucuagaaagaaaaaaaaaguguuauaugcugggauuuuuuuuucuuucucuaucucagcuugugaauacuucugucaucugauauuggcucccacacuuugcacgauugcucuuugaucucuugauccaacuuaaugagcauacccggaauuggauggcucaagccugcuggugacuuuaauuucugccgcaguuugaguuuucauaguuuuuuuuuuuuuucuuuuugguccuccaaaugcuucuugcuuugugucucuuuuugguaaugucuuuuguucucguguggaugcauuugucucagaugaccagucugaagauguguucguuccucccuccauuggcguccccuccaacccccgaaccccgacuuuuaucuagagaauuuugcugauucccccugcaguuccaggcuuccuucaccgugacuuggcugcaccguuugcuguuagaaacccucagugcugguauuuuuagcucuuuauugcccucagcuccagcuauuuaugaaauacuucaaccagaguacaagaggcgaagaagagagggaggaggugggcugugugugugugggcucuaggcacuugugcaggcuucuuccugcccuuagcguggacucucuaacccuuccaaggauggaggacucauguuagauuucuaugagaaaacagaagcaguuggagagcuugguagacaucuuggacugucuuaucugucccaucccauccccugucacauccccccccccccaacaacccaccagggugggaaagagagaggggggaggggggaggaauauuaacugagacaaagagggagaggugauauguuaaauagucccaggauuuaaaacaagagauaacugauuuuuaguggaauuuggcuuauccuucugcccucugccccaccuuggccuucaguucuagaagaaccugugugguugaaauaaacuugccucuggcccuuccucauuuaggaugggacuucuccagugccuaagccaguugcuaagugccuguguguugucuuucaagcacagguccccauguccucugcccuuguugguuuauguccugguaguugaagacucacugaaggagugucucacagaaacaagcugggacugcugcugagcaggcaugcaaucacacuucugugcaggcccugacuccauuucacuggcuagggcucuguugaauugggaggagaggugaguggaggcucugggccguuccuagauugagccccagcucugcaaacaugcccacucucuccgagccucucuccucccugccuuaagaccaaggacaugaagcagaugagugcaagucucucuuuauucaccaggcuuauuuuauuuaaggaaauuaaggugcucuguaauugaacauuagcacagggagcagagaccuacuguaguugacagaagaaaacaugaaauuaaaguuuuccucauauuacucaaugcacugauuccaaaaacccuucaaguuuuaacuaaaauggcaacccaugguucaggaaucaggaacuuguaaaagguuaaauauucugaagguuccccccacccuccccgccuugggcauuguuagcugauggcuaagcacacuggauucauguucucaguacccggaugaaguuuauuucaauugggaaacuaagaaagcuaauaguugaggggugaguuuucccuuuguccucuggcaguggagacauccccgguagcaccugccaggaacuuuccuuccugugagggcucuguauguggggauaaucgcccuaucuguagauucuuuucucuaaguuacuuuucucaguugagacggaaggcagugggcauggucugucuuugugguuuugccuggaugguuugaucauuaacccaguagaggucaccgcggucaguacagugacugaggggaaagcuggguugugaaguccuuuacccugugaccugaaaaccagagauaucuuuccuagggcaggguugcacagguugaucuuuacagcagagccaccccuagcccaguugucagcccagacucuccuuggcaaacugcacggauuauucugagaguuuagcaagcggugguuauuuauuugauucuugcacugacauuugggaaccauuauuuuagggacgggaggccaaaaagcaacucagacucucaaguauuugcagaacucagggaaagaaaaacaagacaaaagaaacagaacaaaaaaaaaaaaaaaauccaguaugccugaucagcugacccucuccugucaaucauuguucauacccauuucuccuucgcagugagaucuccuugcucaaaggugguagaaagguugaggagccuugccucagcauagcucuccaagguguguguguguguguggugccagggaaaugcuagugauccccucucccccaaauagacaggagccggucugauccaacucacaguagggucuuuauucuauuuaagcuaacucagggcccccucaaugcauugccaucaugcaggaugguuuugguagugggggagccccgaaugucuguggggcaaggcuuuauaguaagcggcaagcaggagugggugugcaagcauaugauuggaaaagcuacuguagccuuuaacaugauuggcuggugcugggagucauaucauaaauguaauuucugcuccccucugcauugguggucauuaggcagguuuguugggggaauaaccuggagaugcuggucuuguugaugguguaaccuggagaugcuggucuuguuggggauuagccuagagacuggagcuaagcucggguuucguggggguggggggggggaaggcagggggaggggcaacuuggacacuaaagcuagguaccagccuguuaguuuacaugaguucaaaauucaggucagggucucugaaauggagucugaauuuaaaagcuuuggccucucaugugaauaauacauaugucaugugucauuugaauaguuucagucacacacacuuuguauuucucuaaguguaacgcauguguagugggugguuguaguaugauuucuccgucuuucuuguuugaauguuuggacuugugcacgugugcacauguguguguguguguguguguguguguguguguguguguauuugcuccuguggcuaugugcaugugccaugugggugugugugcuugugggggccagagguuagguaccuuccucuaucucuccacccuggugguuuuuguuuuguuuuguuuuguuuuggaccaggucuaucacugauaagcuagguuggauggcuucugagaagagucugccucucugucccccugccccuccuccccccagcccucagguuacagauaagugccacaaguccuuguccuuucaaguagccucuagggauccaggcucauauccuugugcuuacugacugagccaccucucagcucccucagccccguuuuacacguuaacuuugucuccugucuaugccugcucucuucagugaccccuuccguuuuccuuucacucuuuucucugaauagauuugugugcgagagacuauuaucauauggaugcauaaauaucaucugcaaagucaaucgcaggaaagacuuagagucucuuuagcuuuaugacuguaaaggauuccgcuucuugccauugauucagcuuuuuugccauugauccuuuauuagagaucaauuagagucguauacaaagaccuuggcugggcccugagggucuaucucaggcuaggcccugagggucuaucucaggcuaggcccugagggucuaucucaggauagauggauuuaacugcuuuucucaagacgcuuuuacucucucguugaauucuuuuuaaacuuuuaauugacauuguacuugcauucuuaugggaaacagggugacccacacacauguguacacagguacacacacagucaggucagcauagcugguauguuguuguuuauguuggggacagucagauugguauuguuuuugcacugugcuguggaacauuggaaaaccuuaucugauggugacccugugccuacuaacagcccucacuaggauacauuuuggagucucuggcaaccacaauuuugcucuauuuccaugaguccagcaucucuacuacugcauagaaguaaaaaaaaaaaaaaaaaagcaugcaggcugccuuucugugccuggcuaaucucacuuaacaugauguccucuaguucugucccuguuacugcaaauggcagaaauuucauuucagugugguaaaugucacuuaugucauuccacaguggucuuuauccauugguggauaucuagcugauuuuacaucugggcuguugugacaagccuugcuguguacacgagagaauggaugcuauagggacucagguuccuucuaauucuuuccugacccuggccuccccccucauuauuucugagaaucgugacaggauagcuuaccuacucaucggcauuccucucuccagguagcuuagaguagccuuaaguugcuuauuagcuuaaguugcugccuccaccucccuagggucaggucuacaggccugugccaucacacccaguuuuaacaguuuauuuuaaccagacuuuuuuuuuuuuaauguaaaauuugccucauuuauuugaaagucauuuauaacaaauugcauauauauuuuaugcacuauauuuuauucacugucccccuuaauaaaaaaaaauacacuuuuccauucucugauuucuuuuuaagcuuuuuuaugguaauuaauugaugaauuuuuuuuaauugacaauuauuuuuuuauagaauauauucugcacugggcagugguggcgcacaccuuugacuccagcacuugggaggcagaggcagauggauuucugaguuugaggccagccuggucuacagagugaguuccaggacagccagggcuacacagagaaauccugucucaaaaaacaaaacaaaacaaaacaaagacuauauucugaucuccucccucaucuucucccagauccuccccuccucacacucuguccaaauccagccuucuuuuacucucucuuuagaaaacaaaaagacaggcuggagagauggcuaguggguuaagagcacuaacugcucuuccaaaagucugaguucaauucccagcaaccacaugguggcucacaaccaucugcaaugugaucugaugcccucuucuggugugucugaagacaauuacaguguacucauauacauaaaauaaauaaaucgcuuaaaaaaaacaaaaacaaaaagacagacaaaccagaaugaaacaaaacaaacaaaaaaauaacaaagacacacaaaaugcauaaaaacauaaaaugagaaaccacaacauauaaacaaaagaucaguaaaguaaaaaaaaaaaaaaaaaaaaaaaaaaaaagcccaaaaagcucauuaugagacaaaauaauucagaaauaccauugaguuuguuuuguauuggccaugucuggcuggacauggggccugccuuuaauccuguuaacuagacuucuaucaaaaugguugucuuagcuuucuucauuacagaaauuccaugugcuugguacaaauugcaaagugguuuucuucauagaaagccauuaaaggguuuacaacacaagacuacuuugucagaguuuuguuuucaaaggucacuuagauagcuaaaaggagaugggguuaggaagagagugagagucucugacagacagauuacagguacucguguugugcagagcagugugcagggaacuggcagcaugagaucugagugggagaccauaggaugccgagugugcgggaauaaggcagaggggagaggggagauggagaaaaaggagaaagcgcuuguggguuggaguguguggagaugugacuguaggcccuuuguaaaaccugaugccaggacauaucuauguggcagaaucacauugacuaggggacauaggaaucuagagaugagaaaugaaacaggagcaugcacuagagcagagaugcuaacagcugccacgguagcgugugggggagcugaagggcuuccagaaggggagggaccaagaaaagaguccagagagauagaaggaccucaggcacagaggacaccccugacaucucagcacuggggaagccaaggagggagauccugacuucaaggccggccucagcuacuaaggagcugaaggccaggguguggaaaaacccacaccagaaaacacaccgauggaacgacagcaagagucuuuaaagacuggcuuggucagcuaugacagcgaucacugaggucucugggaggcaagaaauguaagacauugggcagaacagcauaaaagccauggucaacgguugccagagcagguugggagcaaaugcccacuggagggaggccagcuguacauggcuacucaguauaguaaggacuuggacuauggguuguuuuuuuuuuuuuuccccuuuucucuuuguuuguuuguuucuuugucucuuuguuucuuucuuuguuucuuuguuucuuuguuucucucccucucucuguuucucugucucugucucugucucuucccuuuucccuggguaucagucuaggaccuugcucaugcuaagcaagcgugccuuccuccggagccaugcucccaacccuuaggaguuuggacugugucacagcacaauaaacuacaucgggaaaggcugauuaagguuguuguuuuaacuucuucagauaaccuuaucuuuauuguuuuauucugauuauaaagcagcauauacuuaauguaaaagcuuuaagacuuaaaaacauaaccgagauuaacguccauaacuauucuuuuauguguagccaccgucguuugggauaugccguucaagauucccgugagcuaacauacgcaugcacacacacuugacaacacuuuacagucaguuuauggagaugcgggugggcugcuugcuuccugugagcugcgugugccauugaggauugcagggucaugucagacgugccuccgccugcagcugaggaguacugcucaguuguacugcagcguuuucuggacgucugagcuuuguggugacauucucaugcucuccuauagcuuuacgcuggguacaguugugucuuuucccugacagucuugcaaaggugccgaagugagauuguggguucaaagagcaaguacaugugaugguuuaauaaugcuucauuacugagaaggagguggguuuuguuguuguuguuguuguuuugguuugguuuugguuauuauuguuaaauauagagggaaggccuguggccaugaaaagugauggugagaagaauaaaaaaugaguuggcucuggucugagaucagaggggaaagccaccuguacugucugguuuugugugucagcuugacacaggcuggaguuaucacugagaaaggagccuuccuugaggaaauaccuccaugagauccagcuguaaggcauuuucucaauuagugaucaagcgggguggggugggcccauuguaggugaugccaucccuagguugguagucuuggguucuauaagaaagcaagcugagcaagccaggggaagcaagccagcaaggaauaucccuccaugggcucugcaucagcuccugcuuccugaccugcuugaguuccagugcugacuuccuuugguaaugaacagcaguaucaacaucagcaguaucaaaguauaagcugaauaaacccuuuccuccccaacuugcuucuuggucaugauguuuucucaggaauaaaacccuggcuaagacaccaccuauccuuaaggaggagggcgcaggugggcugagagaccuaggauccuccacauuccuguauccaccgggcuugucuggugcaggcauuccaagaauuuuucugcuuagcugggugaacaaucaaaguugcuccuuccagagaguuuaguauugcuuccaugucagagcuaaggacuggggauuuggaagcccauucuuacaucaugaacucuggcccaauucagagaagacacccaaucuaaucauuacaaauuugauguuuuuauuagcauauguuaauuauacauaguggguuucauuaugcuacuuuugguauaugagcaugauguauuuaggucaucuucauccugcuugccucucuuucucucuucugacuucucucacugccaguuuuauuuuguaguuaugugugcacaagcucccauuuuacccagugaguuuaguuuacaggagcgugacugggaguuuguuuacaagucaugugucauacccaugguuaucccacugugggaggucucuccauaccugcauaagaguccucagagauagguaccccagcuccuaccaugacagguugaugacaaggccaaucuuauggggaucauguauaaguaacuaguaccaaagacccuauauaucuuggucacaggacauaaagaaaucaaacaccuaugggaggagauacagagaccaaguguggagcagagacugaaggaacaaccauccagagacggccccaccuggggauccauccuacauacaguuaccaaacccagacacuauuauagaugccaacaaaugcuugcugacaguagccugauauagcugucuccugagaggcucugucagagucuaacaaauacagagguggaugcucucagccaaccauuggacugaacacagggucccuaguggaggagcuagagaaaggacccaaggagcugaagggguuugcagccccauuggaggaacaacaaugugaaccaaccaguacccccagaacuuccagggaguaaaccaccaaccagaguacacauggagggacccguggcuccagccacauauguagcagaggauggccuuaucagacaucaaugggaagaaaggcccuugguccugugaaggcucaaugccccaguguaggggaaugagaggucagggauagugagcagggggaagggggaugggauaggggauuuucagaugggaaacgaggaaaggggauaacauuugaaauauaaauaaagaaaauuaguaauaauaauaauaauaaagaacagaaaaaaagaaaccaauguaaaucaauggaucauugaguucaguaguguggcagccauguuauacccagaagucaaugcucucuguguccaugguuccccaggucuuacagucuuuccgccccuuaucucugaugguccuaaugcccuggaagaguuguuaggaacaucucauuuguggccaggcucaccacugaccacuacaaaaagcuucucuagccaaagcuggcuggagcccuaguguaagggcacagauugcuaugucgaaugaaauuugacagggauaucagguccacuuagcaaaaacuacaguaguagguuccucaccaaggccuuugcucuccccagcccuaggcuuuugacuggcuuuauaggccagaugucaguuuucucagagguagcaagucucaagucuaaccuaauuaaacagcuggcuacucccauaacaaacggcuacuguugcuccuugucugugugguccucaucauugcacaaccacagaauccaagcugagcaaggcuacugaagacaguuucgcgcugcagcccauacagcaccuguuagcucaccagcaggagacuuccaguccagauccacugacuuacacggauuucucuaucaugugaccaagguauagcgugucuucaggaauaggaucuuaccaacuaguuucagugggcaaccaagaacagugguaauuacccguauuguuuugagucucaagugucuccuuaggaaacaacucagguggaaggccagcccuggaguuuuguuuaauaaccugaugguuucccauagcaguuuuaucuaccuacacagaggaccucuguucaaacuuuucucagcugaaguuugggcugaucagcuuaucagcaaucaagauuucuuuuuguccuuuauguuuauuuauuuuauuuuauuuuuuuuaguuuacucucuuuccccccuccccucaucucucugcucccuguugucuuaaaccuuuaaccuuuucuuuucacuuccaguuucccccuucaaccucuauaccacacauugguauuugccuccuaccuuucucucucucuuucucucucucucucucucucucucucucucucuuucccucccucucucccucccuccuaccucccucucucccuuccuccuuuucuuuuuuuaagcaaagagcuucaaaagauuugcaggggcgaggagggagaaggguacaaauagauuaacagaugauggauagauagaugauagauacauagaugauagacagguagacagacagacagagagcacacacaguugacaggaugcagacagacaaacagauagacagacagagagcacacacaguugacaaaaugcauugugggccccuccaggaagaguugcucuuagacuagacaccuuuaaccuuccuuuccaaccaaccugcaagaccugugcugcucguagcuuuguguugcaacacuccauugacuucaacucauagcuacugcugcucucauuauuuuagucccagccccagauuucuuaccagccugaccucuuagacggucccugguuccuacuaaagcgucagucagggcuugguuugagugccuaagcacugugcagccaucugccguccauagauguccauuauuuaaagcccucauguguguguugguagcuguuguaucuuuucuguuuccaaggucuacuacaguaccaaccgaguacuaaauaagugauaaucaaguuaugugugcaggugcaaugaugagguagaccuggcacaugaaaagagcuucuggggggucggaggcaggaggaucagaaguuuuaggccagccgggguaauuuaguggaacugugucucaaaauaaaaaaggcaaaaagagagcugggucuggaagagcauuugucuagcauguaugagguccuagguuaaacuuugagcugaaaaugugugaggucauaguuuaaaucaccaguacugaagggggagagagagagagagagagagagagagagagagagagagagagagagagagagagagagagagggagagagagagagacuagagagagagaaagaaggaggaagaggaggaggaagaggaagaggaggaggaagaggaggaggaaggaggaggaggaaggaggaggaggaaggaggaggagggaagaagggagggauaaauuuauaaggacaagaguagacauuauauaaacuccaaaagggccaucaucugagaauguuuguuugaccuugaaccaaguagcaggauuauugcucccuagggaagagugacagcagucauguguguuaacaaauuaaauucauauuuaauaaauccagaauagcuagaaucucuaaggugauauagcuacauucacacacacacacccaccauuaaaaauguaaaacauacuauauuauauuuuggguagacauaucugacuuuagcugccucuggccugcuaagaauuauuacaagauugaagucucaguuaggguuugcaaaauaaaugaaugaauuaguaguaauaguaacaauaauaaauauguuugggggucauccaauucagagccugguggucccaggcuuuucuuguugcccccuuggccaccgcagcaacaagaagaguaagaaugaccagcucccaacugccaccucagcaaaauaaaaagaguggaaaguuacaaaacacgauuaaauaaguuaccagggaaaaagagguacaaggagcugguugguuuccaguuuucuaagaccuugcauucagggcugagaaaugcuaucaucagaaggcuacaaggauaaucacucagagcccauacaccacagggacagucucucgagagggcugcgggcaucgauggcucugaagcaucacuccuggcacagggccagacucuguggcacacgcccuaacccuccacccaagccuugguuuuccucagaauggccaguuuacccagggugcuuaguuagcucccaggcuaacuguuaccaccuccgccucuuccuuuccugaaagacuggcaggagagcucugugcccuacaucugagaaguugccuuuaggcuauuggugggggcccaagaagcugggcuguaguuuuaugaccagcauccuaaguuuugagugauagcaacuugugugugguggcugucugaguuguucaguuuuauuuucucugaaauauuaacuugaguaaaagaaaaaaaaaugaacccuuuuagaaagaaccuuuuguugucugucugagucuguuauuuauuaacuaguggcuuaaaauguuuccuuauauccaaaacugagaaacgcauuugguuggugagugcaugcaaaugggauuuagauggaggucucucauuugcguucaguucauuuuagugggggcauuuacacgaauauagaugcuuucuuauuuucugcaguacaggcuugaaacagcaccccgcugugcucugccacugaacuccacacucagccccauacuuucuuaaauuuugcuguaacagggcauuuaauaagcugcugguagcaucucacucagcuuaucccuaugguauauuucuucucauuagcaguaugaauacuugcuguguauuucccauguauagguaccaagcuaaauauugaacacacuauggcuuauucaaaccaagccuuaggggaaggacaauuccauuuuaaaugguaacgacgaugcuuagagagguugaguuugcugcccaguucaguuaggaaguaguagguccgaggccugagugcagaucugucugucucuaacaaccagcccaacaaagagugugcaaucuuccguggagccauccacaagaaaucacggagggccuaacagcccagcucuaccuuacuccugucuggcuauaaacaaggagaacacggugcccucagaggacuuggauucaguguagacuuaggacuuagacgacaggagagaguucagagggaaggcgacagaaugguguagagauuggaaccccgagccccugguuugagugcuaggacugaggcguggcugcuuuaucuaggacccugggagaggagaagcagcugauuugugcgugcagcaccgucacgugaugaggcagcauugucacgugacgaggcucauugaggaaguggaugaagagaagaaugguagauucaggcgcgcaucuguaaggcucucugugacaggcauaagggaggguaggcgugcuaagaugaaguugcaucugaaugugcuaacuuuuuagucucauaaagucuuaggucauauaauucagagaggcuuuguuucaucuuugaaaauagcacuuucuuggcagauggccccuggcagaggggaacuuuagaauccugacacccugugaggucuccgcccauucccacccaccacggugcaggucuccagccugcagaggguucugauuggggaggguggggcauggggcugagcuacccuguuucuagacauuuccugcugccugggacaguccaacugacaacagguuacagauguuuuuaagccuucuuuccucccuucauugugguaaaauauauauaaucuaaaauguaccaucucacuguuuguaauuauauagcucagaggcauaaaauacauucacacugucagcaaucacccaaguccaucuucuuucaucuuggagacuauuuucaucucacacccaucaaaccucgcuccccaugaacccccccccccacccacaugacaaccaccaugucaugucucuguggaguugaucucugugguacuccauauaaauggagccaucuauuuaugauuuuauggcggcuuauuuuacuuagcggaauguccccaagauucucccauggguuuccuuccccuuaugcuagcauauucugucuuggccacguuuuaucuguguguccaucuguugguagaguuggguagcucaacuauucacuguuuuguaaaugcugcauugcuacacgcgguauggagauaucuauuugaacuucuguuuucaguuuuggggaaacaacccaguuucauaauauagcuccccucccaacccccacugaaauacauuaaauuuuuucuggguggcuauucucuaaguuauuuaaaaccacccaauuuuguuaucauacagcuguauucuaaaagauucaagcaccuaaauacugcuuucuuuauguacuggcugguuuugugugucaacuugacacaagcuggaguuaucacagagaaaggagccuccauugaggaaaugccuccaugagauccagcuguaaggcauuuucucauuuagugaucaaggguggaaaggcccauuuuggguggugccaucccuggacuaauagucuuggguucuauaagcaggcugagcaagccaggggaagcaagccagugaguaacaucccuccauggccucugcaucagcuccugcuuccugaccugccugaguuccaguccugaguuccuuugaugaugaacagcaguguggaaauguaagcugaauaaacccuuuccuccccaacuugcuucuuggucaugauguuugugcaggaauagaaacccugacuaagacacuuaauaauuacaaaaucaagaaguauaacuaauauugaagauuucugugaucuaucagguugcucaccaaacuaaacacagccaguauauauguguccucugacgaugcacguuuugguaacuuuuuuuuccugcuaauuuaacuaugaaaaauauaguaucauuucugauuuuuuuuuucauuuaacucaaauuuaggauagaguugcuuguaggugauugguagguuuguugauggagcgggcacucagccugugagauggugagagaaucuggagccccuucccucuuccgguuggugucuguucuuaggagcugucuggcuucccucucugcaugucuauggccgucugcugugauggguuugcgcucuguuguccugugaggggaaacauucuuaguucuuacagaaucguaguuccucaccauaaaaacucagaaacugcuagaaggaacugucuggucaugcuuuugauugcucugcccgacggauuugagcccacuuagugaagugcuuguuuaaggguguugcgcuaggaccggccgagguugucuuagucuacagugaguacgugcauccguucuuccguuuauggauucugaagaugaaauguuuuguucuagaagguguaaaauagggggaugugaaccugguuucuuuguuugcuguccccucucauuuuuuucaggcuguaauaacugauuuugaugucaggccuacucugguagauguagcauggcgguguaguuuggguucaugggcaguagcagagugaguggugccuuuuuuuuuuuuuuuuuuuuccccaucucagggcauuuaugucacuagacccaaucccaccugagcugcagccagcagcaaggucuggauggugugcacugagaacccugguggccccaggggaccgaaccccucagauauaaagcaacugugagccuuccaagaugugauuaggagguguuucuguaaugaagaccauuugucuuuucuggagccuccgcuuucacagccuugacuuaaaaacaacucgaaaccagcacaauuaaauaacauuacuuuucaguuauauaguagauuauuuuaauuuaaagauguguauuaaaugagaaaaguuuguagcacuguaaacgucgauuauguguacuucaguguuccccaaagugcccaagacaguuggaggagucacaggagcugauuuuaaaacuuaaugcagagucacauggagacacaugagucuaguucuaggacucgggaggcagaggcagaggcagaggcagaggcagagaggcagaggcagaggcagaggcagaggcagaggcagaggcagaggcagaggcagagaggcagaggcagagaggcagaggcagagaggcagagaggcagagaggcagaggcagaggcagaggcaaaggcagagaggcagagaggggcagagaggcagaggcagagaggcagaggcagaggcagaggcagaggcagaggcagaggcagaggcagagaggcagagaggggcagagaggcagaggcagaggcagaggcagaggcagagaggcagagaggggcagagaggcagaggcagaggcagaggcagaggcagaggcagagaggcagagaggggcagagaggcagaggcagaggcagagaggcagaggcagaggcagaggcagagaggcagaggcagaggcagaggcagagaggcagaggcagagaggcagaggcagaaaggcagaggcagagaggcagaggcagagaggggcagagaggcagaggcagaggcagaggcagagaggcagaggcagagaggcagaggcagagaggggcagagaggcagaggcagagaggcagaggcagaggcgcagagguagagaggggcagaggggcagagaggcagaggcgcagaggggcagaggggcagaggcgcagaggggcagaggcgcagagaggcagaggcagagaggcagaggcagaggugcagaggcagagaggcagaggcagaggggcagaggcgcagaggggcagaggcgcagaggggcagaggugcagagaggcagaggcagagaggcagaggcgcagaggcagagaggggcagaggcagagaggggcagaggggcagagggacagaggggcagagaggcagaggcgcaaaggggcagagaggcagaggcagagaggcagaggcagaggcgcagaggcagagaggcgcagaggggcagaggcgcagaggggcagagggccagaggcgcagaggggcagaggggcagaggggcagaggcgcagaggggcagagggccagaggggcagaggcgcagaggggcagaggggcagaggcgcagaggggcagaggugcagaggggcagaggggcagaggcgcagaggggcagaggggcagaggggcagaggcgcagaggggcagaggggcagaggggcagaggggcagaggggcagaggggcagaggggcagaggggcagaggcgcagaggcgcagaggggcagaggggcagaggggcagaggggcagaggggcagaggcgcagaggggcagaggggcaaaggcgcagaggggcagaggcgcagaggggcagaggggcagaggcagaggcagguggauuucuguaaguuugaggccagccugcucuacagggcuacacagagaaacccuaucuugaaaaauaaaccaaaccaauaacugcagaaaacuugaugcaaagccauggccaucagcagcguggcagugcagcagagucuggguccagaagugaagucacgccuucauggcugccugaucuccacgagggcaaaagggagacaggggucucuuaacaagugauguuguguuaacuggaugcacacacacaagaagacugaugcuggguuccuaccucacacuuuauauaaaaauuaacucaaagucaaucaguaauguaagagucaaaaccauaaaucccucagaagaaaacagaaacaaaucaggugacccuggauuugauaacagcuucuuggugaaacacaaaaagcuuuagcaacagaaggaguauaaaguagaucguugaauuucaugagaaccuuguacacugagggauauuacugagaaaugagacauuuuaggaaugauaagcagaaaucauguauacaguaugucuuuaauagcucggguauauaaagaauuccuaggcuccacaaaaagacaacccauaaaggucuugaguugacaggucucuaaauaaugugcacagaugugccaguagcaaaugaaacauaucacaggagcauugaucacgaaaggacaucgaauucaaaccucaguaccauuuugcaucuaccuggaugucugcuguugcaaugcagacacacacacacacacacacacacacacacacacacauguauauauacacacauauauauguauauguauguauauauguguguauauauguacguauauaugugcugauauauauagcggcaacuguggcaaacuauuugguagcuccucuaagagcuaagaaguacuguuugaccuaccaauucucguccuagguuccuacuuagaagcaaaguagggacuuggguggccacugauauccaccgaggcacugucuguaagaucccaaagacggaagcaacccaggcauuugccagcagagaaccgagcaaacaaaaugugguacaugcacauguacaauggggucaaucauaagaaggaucauaggugggacuuccaaucauugcagagugaaauacugagauagacacuagacugcagagauggcucagugguuaggagaacuggcuaaucgcccacaggacccagauucaauucccaucuuccacauuguggcucacaaccaucuucuaugcccucuucuggccucuguggguacuguaugcacacagugcacagacauacucacaggcaaaguacucauacacaugaaauaauaaaugcauaauuccuggugcaugacauauguggaagaaagcaacugaaucggaacagaaagauguuagagauugucaggcagagggaaggggaacagggaguuguugcuucuugguuacagacucucugaggugauugauuggguaacaguggcaaugguugggugacauugggagcgcagucacugcuacuaaaagguccgcuggaaacuggcuaacaucacaguuggguauauaagugacugcuagaaagcgucaguugguuaaagaaccauagacuuuaguaugucuauugaucgugaguucacaacacccuguggcguucucuguaaagcauuaaccagccacgugggcuguugaacaaaccgcaugauggcguucucagcuuuccugaagcacaucuguugggccuaggaucuuuucagugcugaguuacugcggagggguguggugacagaaugugcaaagagaguuuccccuggaccccuucucgaggaggaugcuguucguggaugaaagucaucugcggaauuaguuucucuuagacugaaaccaggaaggacagaggcucccuccucauuuuguucuaccauggaaugccuuguucuccuggcuagggaguuuggggacagagaaucagguagggugagaaggaacuugacucuuuuccucuggcaaguguuugucaaguauuugcagaauauugagugagagacauauugccaguccuccuuugugcaugcaaaccuaacccuaacccuguggcccagggcagcacguuucuucuuaugugaguaacuacacgcauuaggaagacuucuggggcaccgggagcuccuccuaguuuucuguggcuguaauagaacaccgugaacagaagcaggggagggugggguuucuuugugcuuacaguuuauauaguucaccguagaggaaggcagggcaggagcucaaggcagaacugaagcguacaucauggagaagugcugcuuacggacauacucuccuuggguuuucccaguuuacuuucuaauacaccccaggcaccccaggacugccugcccagggaugggacccccccagggugggcugggucuucucacaucaaucaucagugaagaaaaugccccacggguaagucuggggcauuuucaaaauugagauuuuucuagccgacucuagcuugugucaaguuggaaaaaaaaaaagcaaaaaacuagcaaacacaauugacugcuugucacuacacacacacacacacacacacacacacauacacacacacacacacacacacacacacacuucacuauuaaaguauaaucuucccuuucuugcucauccaaagaugccauguuaauauuacacuauuaagcagauguuugaaagucccacaguuuuuaaaggaaaacucaacacuuuaaaauaaaguucaguuucuuuacaacaucuaaagucucucaacucuuccuaaaaauacaauguuucuuaacugugggcuccuguagaauaaguugcaugcuuauuucaagagggacgugggagugcauagcugagucugaacaaaggaaaagcaaacuguaagccaaacccugcagcuuauugccuugcaucuggggcucguucaugaucuucuggaaccaaagugcgugggcagcuccagcugcugggcccugccaugcgcaguucacacaguacaccuuagagucuccagcaggcuccucucuguaacugcugcuauccuugguggucacccaauaguccuggcaucucuaacaggcugugauaugucacagguuacaccuuuaccagugagacuuuacaccuggccucugagacucugacccugccacagggugcuaagccucagcuguucuccaagacccuucuguccuggggucuccgcagcuccugaggcugugugucuucaccaguggcuucuccuggccucucacagugccaagucucagcuguucuccaugacccccuugugcuuucauaacugguaucauguaggggugguaacagucggguaacuuacacauuacuuaauccagcugccagcuucagcagcugccucagcucccucuggacacagcuuccuucugugugcugacacggaggaacacuuccagaagaugacccccccccccagccugacucugaggaacauucccagaagaugacuccagagacacuggucucuucuuaaucacaacugauuucucagcuccagcugaccggaugcacauacucuugauucacaacagcacucaaaccaccccgauugagucuuucaaguuuucucuggaucuucacaagccaggccucugucuucugcacuacucccagcuuuaucuuccgaguuccccccacagcagcucaauaaacucuguuuacuugaugacuuuuucaccccaaaauuccaaacuucuuuuuauagacauggcccccaaaacaacacugacaaaaccuaaccacuacacuacuaauauuuuucucaguuaucacucugagugacccuauuauaaaacccugugguaacuaucuguagccuugcaaccuccugauaguuugagagauggcauucauuugucaccagaguacaggagauacuguuaaacugagcacagagaaagagacuuggaagcuggagaccaaaugugcaggucaaggauggugugggauggauaggcuaggugguuaagugacaugggagugagguggggcaggccagugcuucuggaaggcagaggaugcugggaaaaguguuggaaguguguuagcaugguggcuggugagggcuggcuuugcggucaaguaucggauacccaaggauccaaauuccugaggcuucuaucagcugggcccagaacauuccagguguagaaagaacaucccgguccugccucuaccuccugagugcugggauuccaggucugugccaccucaccuggcguguuacucuguuucuaucuggccauuuguuggcauaguuuuuuguugacacuuuugauuguuacuuacaauguuaucuuaauuucucaucaacucacauuuaauaggguauccauagaaacccagaagacaaaaauuaauguaucuuaaagauguauaauucuggaaucagacagaugcagaauccaauuaauuguuuuacuuuuaguuguugauuugaagugacugacaaccuuaaauuuauuauuuaugaucugaggagauaaggaaaaauuaggaauacguaugaucgggauuuuuggaaaugccagcacaugccaggaaaugcuccguagucuugcauuuccauuuuuccacauuguugaguuugcauaugcaaacugaauuuguauuuacauaguauucaauuuaaaaaauaaugacuaaaguauggguguuuugccuccugcauguuuguguaucauguugguaucagaagacggagggcauuggauccccagagcuugcaucacagaacugagugugaggaacugaaccaggugcccuggaaggccagccagcacuuuuaacugucaagccaucucaccagccccucauuuuuuuuaaacugucacuaguaucuuuguacugcccugcgauaucaccagggagaugguuaucgccagcuugggacaaauaugcugaaagaaagcagacucagcagguagcaugaggacuugagcccuaucaggggcccuuaguccaggcccuuugcacuugguucugucauuguuacucuuuuaucccagugcuggguguugaacuuggagccucgcacaugcuaggccagugcuucaugccagagcuacacccccagcucaggccaggcauuaccugcugucuuauauauuuacuguggguuuugucauuucaguggcagccagucaccuugaugaaugagucagcuagccuccgcucagugcccaugcuuguucagugcaguagauacauugucucccaguacguuagcuacauugucucccauuuuaauuaccuuuauuccagagcucuacauaccagcuacuuuguucccucaaccccccauggacuuucugagaggcgguuuuguguuaucugauagggaauagguugucugagcuauaagaugauagagaauggcucuuuauuggcuaccuuguaucacaguuucaaucacuguuguaguacagguuauaucuguuucguaaucuggggaguaaauuccagucacucuuuuuuaauugguacacaaguaaccacacgacugucacuucuuucaugaggcugccaaugucuuuuuauuaacccauuaauauggccaaaccucuacgcuguuguauuggguccuugguuuuacagugcugaacaagccagaauagcuccaccuaaaaacuuuauuacauuaacuauauugauaagguuuuaaaacuaugcuuaguuccuuugauuuaaacuaauugguagguaccugguuuacuguuaaauuuauaaaaaguggguauuuuauaagcuucuuuugaccuaaacauucagguuuuugauuuuuacucauuauaauccaauuuauaauauuuuauuuauuuuacguguguaagcauuuuugccuccauguauguguaccauaaacaugccuagugccuauggaggucagaaguggguaucagauccccuggaacuuuaguuaaagaggguuacagaucaccacaugggugcugagaauugaguuugggucuucugcaagaacagucagugcucuuaacugcagagccauaucuccagcgucugguugacaguauucuuauaguucucuguaaaucugucuagccuacaacuuacaaaugauucugaaguuagcaucaauuaugucuugaaaaggggucuuagucgccuuagggcuuuaaaccaagguuuuggcauuuucuguguuugggugagccugaugcucaguugccgauucacugcgccucugcacagaacgccauugauaugucaagacuuuggcuugcgccuagaacacucucucuaguuugccuuugauagguggguaacauagauguacucaggacuuuuuauguuccaaguuuugaaauuaagugaacugauaagagcauucaugguaguuugccuacuguuuaauacaaagcuuaugggcaguacugaaggcacauuccaaaaucuauuaaguaauguauuauuuuaaagagagcauguuugcuuuuucaaaaguuuuucccccacccauuguuuuaauaaauucucagguuuucaucuuaauuuuaaaacuauuuuuuuuuuugcaaagaaaugauuuuuuucccuguuuguguuagguuaucagaaaugagaguuccaaagaccuccugagcccccugaauagaggaagauuaauuauugcauuagcaucacauaucaccuaccucuuagcuguguuagguccuggggaaaauagcugaggcuuuguccugcccacacgggaugccaggaaagccauuuuuguuuuuauuuccucagauuacguuuuucuucuguguugacauuagcugcaacuguguucauuuucauuacgagaacagugagagcucuaagccauucucuaccuccacaaacccauucuucugucuuugugccugggauuuaacagagcccuggguccuaggucuuguuuccucugcuauaugaaugccuuguucugaacgcccucuuaagucuaucugccugggcagaggagaagagaaggaaugaaagcgaacacauggaccucggauccauaauagacaaauuguacaggucauacuguaagaauccagagaagauggcaaacagucacgccaccugauuuauaguggucuuauaaaaauacgcacagugugauauuucauuaacuuucuaaagcacuagaccauacauaccacguuuucaguaucuucacuaucucugcaguuaaugcuguacgaagguuaggucuuuuauuccagggugugaaaccaagcugcacuccggcuguggggaaccucucacagccugguguacagacaaccguguguuaggacagucguucucauccuuucugaugccacgacccuuucauacaguuccucaugcuguggugacccccaaccauaaaguuauuuucauugcuacuucauuacuuuaauuuuucuacucuuaugagucacaauguaacuaccugcuacguaggaugucugauacaagaccccggagggguggagacauggguugagaaccgcucuuuuaggacacugugaaggugguugcaggaauauaguuauuugggacaacuguucuuuggcuguugaaauauucaacucacugugacccuacucucugaacucaacuggucggauggaaauugcagaccuccugggcaucagagccacucgucuugucaccuuugggagcugccuucucucgccuucguuuccuauuucuucucugguacuuacauagaggguccucugauggacucuucagaagagguggccaccugcuugugcuggcugccauuucugcuggccuuucucuucaggcauagggauacuaacauguacguuaagugugcaaacaaagguauucugugugaaucaaaucuguaauuccaauacggggauuuuuuuauuuuauuuuauuuuauuuuauuuuauuuuauuuuauuuuauuuuauuuuaaaaaaagguacaaguccuaaguaauguggcagagaggagcugucucaacucuuggcugaugacuuggcuuuguaaugcucuuucagucagucucucaggaaucucccuaugcaagcugaggugguuuucuguuuuuguuuuugcacugaaaagaagaaaaaaaaauugcaucaauaggaaccagugauuucacaaauccuuuuaauguagucaagaaaucagcuguguagugacuuugaaaauucauacuacuacuacagguagaauuaaaggcuguuccuagcuguucugucaggagcaucugaggaugugugcugcuaaauguaacauguaccucggcucucuucaaauccuuaaccugucgcuuuucaggucgguggcuuauugaagagacguggcccugucgauaaaugagaaugucuguuuagaccuuuuccaacaguugacgcucugucagcaaacuuaacuauuuaaugccucuuuaaggguguuucuuucuauauaaucaaaguuacaugauuauauagugacuucuaguauaauccaacacuuucuuguuauuugaauuuuucugccuuuuucaagugaacacgaaugaacaaggcaaguucugcugauuagccuccagcacagaacauuuuuucuuuuucuuuuuuucauuauuggauauuuucuuuauuuacauuucaaauguuuuccccuuuccagguguccccuucagaaacccccuaucccaucccuucucccccugccucuaugagggugcucccccccccccgccucuaugagggugcuccccccccaacucccauacuccugcccuggcguuccccuacacuggagcaucgaagacccucaugcccaagggccuuuccucccaaugauguccaacaaggccauccucugccgcauauguggccagugcuaugggucccuccauguguauucuuugguugacgguccaguccccgggagcuuuggagggucugacugguugacacuguugcaccccccuacaccccccccaugggucugcaaacccccucaagcuccuucagucccuucuccaaacacuccauugaggaucccugagcucagaccaaugguuggcuacgagcauccgccucugaauuugucaggcucuggcagagccucucaggagacagccaggacugacaggaggaggcuccugucagcaagcacuucugggcauccacaauagcacaccagguuuggugacuguauaugagauggcuaauguccacuuaucagugagugcauaucauguguucuuuugugacuggguuaccucacucaggaugauauuuucaaguucaauccauuugccuguggugauuauggaggucuuuacuucaggcuucuucaaggcuauuugaucuagaauccauagagugcauagauuggucugcuuccucaggguccaucacacugggcuguucuuucauuuaugucagggucuuaauuccaacacagggguugacaugauagaaugacccaccuccugaacuugacucuucuacccaaccuuacacugcagucaccgaauaccauggccaguagucuccucuggccgcugaucuuuugaccucuggcucaucuauucugagauuuguauucauaauagagccuggauccccaagacuuaguccaagaaaaauguaaaauaguucacggaugacucuuaauauagacuauauucauauuauucaaauguauucaaauguugauguuuugcuauggauuaaauuauacuauuauaaaauaguucacuaguaauuuuuaauauggacuauguuugaaguguuaauguauuauuauugguuaaauuauguuauuauaauuaacuucacuuguuuguuauuagaugaaaguaucuacuggaaauuuuuacuuggcucccauuaaaaugucugucagauacugcucuucaauauauuuuaaaacagaaacugacugcccucguuugccucuccaucaguuucccgagagaccagcaggauaaugacuuccuuagcugcacuacaacauuuaauugcaguggagaggcugguaauuuuccaugcuagaugcagccuagagcauuuugagaccuagccacaugcaugaacuaguugcugaagaugucgguagucggagcgcucaaucagcucaaccugcagacgggccucggacgcugagguccaucgcucccuugaccuaacuuauuuacuguuucucugcagugcuggaaaacuuugaccagacaauugucugccccaccuuuggaucacuggagaaucagcaggacuucaggacuccagaguuuguaaguaacacaucuuaaaauuauuugucaguaagauuuuucuuugagagacacauucuauucuucaguggcuuagucugccacaggaccccucagggacuauugagacuuuggugucucugaggcgcaggugaacugaccuccagcaucccagcauccugagcucuggauuugauuucgcccccuguaugugauuucggacaggaacucaucccguaguaaaagaacgaggcgauguuugcaaagcuuccugcuucguuggcugauuucuguugcucuugguuucugcuuucgauaaccuuggaaaucagucuugacugagcacagaugaugcucugaccaaugcaguuauucauagugaagcggccuguuucucguuucugucaggaaccuucaguaaugcaaccccagaaggacuaggaauaucuuacucguuucuaccaagagggaaacuaauguucucacggagucagacauugaagauuagccauggcuccuacccucaaggaauuaaaaaucguauuagaugcuacugugauuuuauuagugccuuguuuaaagaaaauuaagcauguaggaugucuugcagaaugccuuucaaagcagauuuuauauuagucuccuaaagugcuugucucucugacucacgccuuauuaaggcagcagagacucagggaagcauggcagccuugacuggauuuaccugguuuuuaccuuccugugaaugacuagucuaccauuuguauuggcaacaaaagugugugugugugugugugagagagagagagagagagagagagagagagagagagagagagagagagaguaugugucucuguaugugugcaugcacgcucaugcuuacaugugcaugugugucuuuguaccugcguguauauguguaugcauauaucuuuuggaggguuuauuuucaaagugugaugauauuaccuucaccgcuccagcaguuggcagagugugacugcaauacugauucugugugcccccccucaguuacaaacuuaauuguacagagugcacaccaugcuguggacugagaaggacugcacauaaaacuguacccacaaugcagguucauuucugaguggggcuccugcaguauccuugcacagauggccugcuuugaaaagcacuugggucguaauauagagaccuggcacucagugacuccuguuacagccugugugagugccagcgaaggggaacugaguacacccagucguuccccaucucgaagggcagagcaguuugaugcaaaggcaggaagcgcugauacagacuccgagagccacucgacuguuauccuuccgaacggauucuaguugaaacuuuguaaggaucauaacuaaugugacgaggggugugugcagccagggguuggugugccuggaaacacacaugcuuuacacccauucucugcgugaaaaugaaaguuuucucagcagcuucuaguguacugaguugcuggugcuuggcucgccccagcagcagcugcacggauagagggcagugcacauaacccgugcaucaucuaaagcagcagccuuaguuucuugacuuucaugguuuucauucccaaaguuagaagacuggcuagucuaagaucaaacgaccacaagcaaagucuagagucaccaacggcggcugccuuggagagacuuauuuccaccaugguucugaggacugaggaaccagaggggggcucccccccccuuuuaaaauaaccucuguuuggccucaagaauuucugcaagucauuuuauuagacuauccuguugauaacaauauauacaauugcccuguaaguguaccagauaacauaucucugugucccuguguucugauugcuuuuugcaaacuugacugagaucaagacacacccaaaaagagugaaucucgguugaggaaucaaucgccuuuauuagauuagucuccagccaugucuguaaggcacuuuucuuaauugcuaguugaugcaggagaaccauaggcugcugugugcagggaccucccucagcaggugggcaugaguuguagaagaaagagagccaaacaggccaguugguugggcucugccuugguuccugccuuaaguguccuguccugacuucccucagugaggaacucuuacugaaugcaugagcugagauaaacccuuugcuuaccaggcugcuuuugaucagcguuuugucaagcaacagaaagccugguuacugucuuucucuaauuacaugugcuuaccaugcucagggagcaauuauuuuuuaaaauauguuuuaaaguuuauucuuguaaaauuuuauauauauguaugcauauauauguguguguguguauguauauguguauauauaguauauauguauguauguuauaugcuugaauacuauguguauguguauauguauguguguauguauauauuaaauguauguguacauguauguauauaucauaugucugucuguauauaucuauguauguauguguauauuucauaugucaguauauuauauguacuauguauauguguauauaugauguauguuuguauguauguguauauguguauauauguguguauguguauauauugcaugucuguauauuauauguauguauguaugauguauguuuguauguguacauguauauauguauguauauauauugaaugucuguauauguauguauauaugauguauguuuguauguauguguauauguguauauauguguguauguguauauauuguaugucuguauauuauuuguauguaugauguauguuuguauguauacauguauauauguauguauauaugcauauauauauugaaugucuguauauauauguauauaugauguauguuuguauauauauguuuauaucauaucccuguacauauuauauguguguauacauauauauauguauauauguauguauauauuauaaauuugaucauauccaccuucuacuuccccccaccaacaucucccugacaaaucacuaccauaucucccucccaacuucauuucuucuuucccuucaccuguucacucaauccaguuaguacuuucaguguggacauggauguagggccuuccacuggcguauggacagcuuacaggggguagggcacaucccugagggaaacagacucccccucagccagcagccagcagcuaauagguucucugcugguguggggacuugggaaggauuucuuuauguucccaggccagccuguuugugaugcucaugacacauaaguucuugugaugccuguaaauagcuccuuguguuuuccucucagcaccacuguugccagcacuccuggccuuauaaucaacauagcuaccuuaugcugucucugugguaaacaaacaggucacagaaggggaucccuugggacuaggacccuccagggagcuacaguguuauauuuaagagaaggccuuuauguaggcaagagggugcagcacuggggaagacaguccuacugcuagaggcaggugagccuggcuaaugccaggacaucagguaaguugauugaaaucugauuguuaaacuggggccgauggugggaccugggagucagagguuuuaauggcaaagcagcaucucaaacagugcuggaaaagagaaagagagguuggaaaagucaguuuccuaauuuucuucccaucuggccuuucggaggaucacuugcugccugcugaauugaagggaggcagagcgcaugcuugcuugagccuuauucucaaauaguugagguuuuagguggacacagagagagccauugcuuucuguguaacaguguauuuaucuaguuugcuucacggggacaauaaggugcuuucagagugauugcuucagaagauagauuuuagagcucuguuaguuggccagccuuggucucuggcaucagaaggaaugacacagcucaugagcacugugauucucaggcugaggcagagugugguaauugaguagauuggcagcccugucagcugccuggggccuauaggcaguagcagcuccaccucccucuccucuuccucccugcagcucugugucucugccccccuugcccagaggucuguccuugcucucucgccuacuuugcagguggcagcuaucgagguagccaaaauacuagaugguuaaugggugaucauagaugcagauauguucucaguuaugucagacacacgggagcuggagacuuguugaaacuaguaauaacauaccaucauuguaaggugaggcagauguguguguggggagucaauaugaaaaggaugugacuaaauacugguuuacagagacacuuggugaucuuguacgguaggacaccauuucaguccuggugcaguuuugcuugaaaauguaaaaauaguuaacauuauauuaugaauguuuucccaauagugcuaucuuuaaaaaacaaaccucuuggggcuagagagaugguucagugguuaagagcacugacugcucuuccagagguccugaguuuaacuucuagcaaccacaugguggcucacaaccaucuguaaugggauccgaugcccucuucuggugugucugaagacagugucaguguaccuacauaaaacaaaucuuuaaagaaacaaacaagcaaacaacuuguuacuguugguauugggaggggucacaggugccuuggcacucaugugcagaccagaggacaucguuguggaggacaccuuucucuucaccuuuauguuggguucuagggauuaaacccagguggucaggauuucaugucaggcagcaagaagcucugccaaugaagcugccuugcaucuugcagaggacuucugugcucuuguauuuuuucaguauuaucugaucucuuccaccagugaagccugacucuucauguuauaguugcuaaggcaguuaguucaugaucaagagaaacagccauauaaguaauggcuaucauuuggagcauggcugggaauagaugugaggauuaugauucuggaacugggugccugagccucaggucauccagaagaggucagaauuaguagaaggcaggguagacaagauggcuuagugggugagggcaccagccuccaagccagguaaccuggguuugauccccaaaacccagguggggggaggagagaaaugauucucacagguugucuucacacacucacgcacacacucacuaagcauaagaagaagacaaaccagccaacccagaugcuauuaagaacaggccacagaguuagaacuuaggguugauuccauccugcuggcaauagaauaauguucugcucccugacucccagucuuguaucugguuaugagcucuaagggcuaaauccaagggcuagugagucuugucuggccauguagacuucacgcuuaccccaaguggcuagggagucauggcuggaccuguagacuucacacucgccccaagugcuaaggaguuugaaguuagggucaggaguggggagaggucauugacccaggaacuuaugguggucugagcacacacaguugaagaaggggugugggggacguugaucuaacaucauuacagccgugaucaacauggaauuacagggauggaagguuaagggacugcgcugugaucugagcuccaccauuucaucccuaccagccuuugcagaacuugaaguuuagggacaggaauaauuuuaccacuucugaucucauguuaacuuaaguuuuuccucguugcuuagcuucuaccaaauccggaguaaauaauaaaagcuggacuggcuaaagaaugcuacaauaggauaaaccaggaaggagaacugaagucuuaggacuuaauagcuagauggggaaacagacucagauggacgaguacugaaguggaagcugccucucuccuuaauuaaacaucaugguacccucaggaaagcagagaugaagagucugucuccauuuaggaucuggggggagcuggcuccucuuugaaggguaguuauugcuugugacauauugagugagaaugucccccuauaggcuccuguauuugaauaguugauucccagagggugugcccuauuuggcagaggggggggugucaccauuccaguuaacucuccgccuuguggucaucucucaguguguaagcucuuaguuacugcuccagcacuaugacugccuaucugccgccaugccccuuaccacagugguuagggacuggaacaccuucuggaacagugagccccaaguuaaauguuuucuuaugcacguugccuugguuaugaugucuuagcauagaaauagaaugguaacuaagacacugcugucuucuaagaauuauugcuaacucucugaaauucugauuuaaucgucuucaaccagcugaaaaauguauggucccaaggaagaguucuaagugugaauuucuccaacaaauauuuauuuggcuuuuauuuuagguacuauaaugaauauucagaaaagaugaaaaaucuauaucuuaggagcuaacacuuugguaagagagacuuaagauacaaaguaaauaauacaauauaaguuauaaaauaauauaaauagggaaagguaguagggauuguaugaguguguguguguguguguguguguguguaauguauguguuucagcaguugugggcguauaacaguuauaaauagaguauuaaaguguaucuuacugagaauuggaaaugccugcgugugguacuggagcaaucuggaaggacagaugucuaagcaggaguccuagaaaggggacugaaacggacacguuagugauacguuuguggacauggaaggcaguccaccuggcuguaguagauuggcagaugggagaauuguugguuuggggcuuuguaggugacugucaagacucugguuuccuuguuaagcuggaaagccauucagagugaaccuucucuggauaaggagagaguucucagcagagccccgaccuaaguggaggaauuguuuuucugugugcccagaauggaccgugaagaaaaaaaagcaaaaguggaagacugucaggcaugccaacugucugacauuccacaugauacugucaccugugcuguucgugcucaagaaccacacauuccagcuaucagggagagagagagagagagggagggagagagagagaggaagaagaggaggaggggggggaggaggaggaggaaagaaaagguguuggucucauugauaguuacccuuggcuaccugcagccccgaggccacagauugagugaguguucaaaggaauuuaauacuuagcuuggcagaaggacucucagaagaggaggaaagucaaagacgagugagccagugagaagugcucacuugggucauugugccucggucaguauucacaaggagcauuaacauugcgcgaguaccacgcacccgggcaagaagccugugugcacguacucugucugaccguagaagaacgcuuacgugcucugucuggcugauccagaggcuaaacgcauggauugucagcucggaggagaaugagcagaagucgacagacauguaaagaggccauucacaaaucuccgagucacuucucuggaaugcccaguaucuuuucccagagagaugguaguaauuagaccacaggaccagccaggccguuuaacucaaaauauuuacaagucccauucuguaccuucugcaacauuguaaucauuuuuaaaaaaucauuacuucaaagauguuaagauaagccaguccuguuggcacaaggcuggucccaggcacuuuguaugcugaggcaggcaguuugcaaguucaaggccacccuggguaacuuaaggagauucucucucaaauaaaaggugugagggucugggucagagauagagugacagcuuaccaugcacaucacuccugguucaaaucccaguaccccuuucuacaacucugcaguaggucaaaguccaaaguucggucagcaaaugcuuagcgugacaauaucgauuaacugauugauugauugauugauugauaacuuuugaguuauauagacgacaaagcagcagcagcaguaggcccuaaggggggaggggaggacaguuucaugauggagguuaccaagcauacagguugucgagcuucugcgaaugccagugagcucuguugaagugguucagcccuaucgagcagccacagguguccaggcugcucaaggaugguuucagagacggacacccguaaucucugucuugggaucugagacaggaagacaaggaguucgagaccacagugagacugccucaaaccacagccucggaggggagccagauugcccccagauaaguuugaacuuucuggcugguguugcuugucagcuauggucuccaaaagcaggaguacugguugguggaaccgcagugaacagucuugaggugccagaugacuaaagugacagaugaggcauuuaaaaaaaauaagugugugugugggagggugggagcacauugauuagggaagacauugggcacagaccaaacugauaaaugaguaugucgaagccagaguguuugucuccuagcuguuacagaaggucugugaguagauugcuuaugaauguuagaaagaggucaccaggagccagcaugagguuggucaucucagccugaacagaauuucugccuggacauguuguuauuauuauuauuuuuaaauggaguuaauuagacagguagagugggugaaagguacucuauguguuuugauuuuaguaagggaauauagaaggaaaaaaaaaaaccugccuuuaaauacaaaaugaagaaauguggcccuggggauugcacucaccagguaauugaucuuuagaagaaugugguauaauggauaaaagucaaucugcggaggagacaaaucgauaggaagcaaagucaacuccugccccugauucauaaauaccagcugugugaggagagaccacgaggguagaagccuaaggcugaugauguggaagguccaggcauugggcuaauuaagcacaguaagaauugagugugugaucacagugacaggaagucagucacucacagugacaggaagucagucacucacagucaggcucaggcuuggugaagccaccucacacucugagugcucccuuuggagaggggccucacucuccauauugagaggugguugcugauaacuuuccaagaacaugacaccaucaggcagaagcaauugguaaaugaagauacagaguagauuuuccccuucccuucccuucccuucccuucccuucccuucccuucccuccccuccccuccccuccccuccccuccccuccccuccccuccccuccccuccccuccccuccccuccccuccccuccccuccccuccccuccccuccccuccccuccccuccccuccccuccccuccccuccccuccgucuauuuuuuaaauaaaggacaauucuuuuuuuuuaagauuuuuuuaaauuuaaaucagagguauauaugugccugcauguaugccuguguguguguuuguaugucuguaugugaaugcaugugcauauuucacaugugcauacuucagcaugugcucacaggaguauaagaaugcagggacccaaagaggccagaaguguggcauccccuugagcuggaguuacaggcaguugugaauugcccaucaugggugcuaggaacugagcugggguccucuuggagggcaggauguccucuugaacucuuuuuuuuuuuuuuuuuuuuuugguuuuucgagacaggguuucuuuguauaguccuggcuguccuggaacucacucuguagaccaggcuggccucaaacucagaaauccgccugccucugccucccaagugcugggauuaaaggcaugcaccaccaugcccaaccccucuugaacucuuaagagccaccugggcagcccugagaagcauaguucuaaggacugaaugggagguaaggcuagcugucagacuguauuccaguaggauggcuucccucaguggaaacaccugacaucccaggcauuuggaugcagucagaugaacaggaccagauggggcuaaugaacacgugagucaggaugugucugugggugggaagacaggcuguggaugguucacauagagcgggacucaauagugggauguguagaaugaugaagaccaacuguggcugugaguauccguugccuucgccuucgauguggcucauugaugcaucugcuucauuucacauuguguuuugcccacacucacccuauagugaucagcagccgaaucaccugaccgauuaaaauccuccuuuccucauaacuguucauucuaccugguuuuacccacuucguuuucagaaacccaugacuguaaaugccuugcgagucuuggcucacaaagugucacauuggacauucagugagucuucuguugugcagggaugucaaaauuaacuuaacaaaaacauggcgaggcaaagcagaaacccugggcauucugaacgguaaacaguaaugaugucugcauuuuccauggaccucauccgauuacagagcaucuggaaacacaacacaggcacagccagggaagagcaugcuggccagcaaccugaccgugccgugacccaucauagcaagaguguggagaucugugauaaagaaaaaauguaaagagaaaacacaggauguggcgggaaugcgcacacaacuaggaauucacaggauuccuagaaaauuaaagaagaggacuagagggguuggcacugugucugugugucccuccauguuuuacacauguuacaugcaaaagcuuuuuauuuucuaaaaccuaguuaacuacaguuuuuacuauuucaccaaauagagauaaagggcaugucuuuauuauaagccuuaaauucuuuuuuuuuuacauuuauuuauuuauugugaguguguaugucgggggggggggguccauaugcaucuuguuccgcauguggaggucaccccuguacucugagccaucuugcuggugcuaugaaaaaucuuuuaagcguuccuuaagugaguuucuggugagaaaccauagacucauuuuuaccuugaagacccaagugcguuuauacuuccuuccaagucaccuugugaaauacagauuaaugugaccugacagauuguaauugcuaccaaacagcaucuucauuaauuauaaugagccaaccaaccacagaguguuccauucugugguguuaacaugaauuggaguauaucaagacuggaccugaguuguugcugggguaaaguuugaucgcagcuaaaugguguaaaacagaaagaggucgucagauuccacaggagguacagcgcggcuuuuguuccaugcagcuucaagugcuuuuuguuggugguuuauagacaggguucuuacuguuagcccaggcuggucuagagccuuuaauccuccugccccagcauucugugugccgaaaccgcaggcaugaaccacuuugccuugaaacauaaugcauauuuacuguaaaugugugacaggugaccuaagggggaugaagaagagaugagugcuuugagggaccucugggaguauaaacgcauguucaguccccaacaggaacuguucuuuuccuguagcacaagcuguuccacaaagcuccucuaggaaguggagucugaaauggaacugggcaccggaaccgucugagcccggaaccaucugggcccggaaccaucugaacccggaaccaucugggcccggaaccuucugcgccccugcguggcucugcccucuggcuccugugggcagcuuccuuuuugcguuagcucuuccauuucccuauacauuaaaagcaagaaggucaguggcagauuuccucaccaguguguggugcugcagcuagcugcacagggauugagagguguuugaguguuguggaaaacauguuccuaaaguuauacagagccuuagcuuaguuaggggucaugaauguugaaaaaaguauuugaaucccagccgggaccuuuacucuuccuuggaccauauaaguucccggaaggaagauauacucacagccuuuauauauauaauaagccuuaaacagcacaguagcugggcagcugccuacccuccaugcuauuagauucuacguuccuacugauaacuccccaaauuauuacuuacuauuuacuauguuucaacucggcugcuccaauugggcuagcccacagggccauggcuuuuguggcucagauaacccauggcagcuucucauacucccuccuguauguucuucuccucuucuucgguccccaagcccaggaaaccuaaaccccaccuaugucucuucugcccagcuguuggcauauuuauucaccaaaaggaauuaacuuggaggcagggucacagagcuaauugaggacuccagaucuugggggccugcacuuagcauuacaauagacaguaaaagagaaaaccucaacaaggcaggccaaagcucagaauggacaucccucgaccaaccauaccacuuuucuugaaagcgaugucaugugaugucccacuguagguaucagaaccuggcuucauucuuagaagaccaggcuguagcagaagacuaggcuagagcaucauuaacuuauaucuucaagaaaguacucuuacuggcucuugcauacugaccauauuaucagugaguugggaauuaauuauucccaggaguauuauuaaauaccaacagcacauccagucaauaaagauacugagcccuuucuaaaacucgcuaauagaauuuuuaaugaauuaagaagaaagaccuauuuaaauuauucaguuuugaauaaaccacuaucaacgucacuaaauuuugcaguaaaaauuuauucauuuagucauucaauauuuauuaaccuguguacucaguggggaaauaaaaaagacugcaucucagauguucacccucaaggccaaaggugguacaguguccaccucuguguccgguugcuaucugugcaagugaugcuggcugacugauggucagaagucugggaggugcgauggaguguuuggucaguccuacugugcacacagaagagcugccugugagucaggauuacccugauagugcuuucaacauagaaaggaccacaccguaugguccuugauccuggauagaaccuuaguguguccauguaaaccuuacaaagauaacauacuauauaccuagauuguuuuugcaggaaguaguaauauucuucagcuccuuuguucccuucacccugcuuccuugaagccauucucccaucaccacugugccauccacugguacccacucuuguaaaugccuccuuuaaaaacgcaaaccaggcaggccaucccuuuccagucuaguggaaucucucucccauuacuucaucugccccauuguaaaaugucacaggguaaaugaggaauuaauuucaguugauuuauuuaauaauauuuacccauuuaauguuucugaaauucucuugggaaauagcaaugaaaagauggcacagucuguguccccuuggggcauacguucuagugagagacaagacauugauuaaaccauugcacaaauagcucaaccauuagaauaugagacaugacauuuaaggaaagggaaggugcucugagcuagggaaccucagcaggcaggcaagggaaaaucccgacgcuuuaccauggaagguaaaggagacccuagaaaauggacccacgacacaaagaugaggggauuaaacacugaagcccacugugaaugggugcagcgccaucagccugaaaucucagcugcacaggagggugugaagcaggaggaucuggagcucaaggcggucccaagugucacagaaggagccucagccccaucccaaaugagcaaaccaaagacauaaaaaugugaaggaauggagagaaacugggggcugcaucaagauggaguugcugcuugccuacaucauccacagcagucuccgcaaaccugcaagguuagauagacuguugguccugucuuuuggcaacuaaguauaagacuuuaagcgagugguuacauuaacuaauuucacuggaauauguuacaucaaguuagugcaacaaguauccauuggauugcuuuucccgguguugcagguucagagcaaaacagacuuuuccuucuggauuaugguccaauuaaaguuacugauaguguacccacaaagaucuauuauguuacacauguaugccauuauauuaugguacuuuauaucaugcaauauuagaauuguauagaacuauagcucucaacuuuaaagucuuaacauuuuacacucaauaacaugggccuacauaauguucaguacacuagaccuuaaaacugugcacuaaaacuuaacacauuuaauaguuuaaauaugaccaacaauaaaccaaagagugcuaauuaaauuaauacugaaccauguuaauauacauucgcauauauuaaucuagaauaugcagaagaaaugacauuguuuuaucuaauuuuuaggucugugcaagaguagauagcuggauuuucuucuuugcuuaugucguaguaaauauuggagauuagcagcucuuacaaagguuuacuuguuuccuuaugcaaaaugagagaaaaaaaaaaggucacauuuccuaacauuaccuucagucucaacaaaaagucauuauuaggaagcaacuggucagucaggaugcaaacaagugugcugcguucuuauacuugcuugaaguuuuaggauauagucauuaauggcaaguauguuuucucaacaguaucugucagcuaccuaagucucuauaauuauauuuuagucaauuucaguggcauagaaagaacccuuccuggugcacagggauauuugaggucacaguucagaagcgcuuuucccagggacuucggggaacucugauguggagauagagaacagugcuuuacgagaacuucugucuuuacacagcauguuaaagagcugggaggugagugugccagguggugaggcucugcaggaaggggagaguguggcuagggacugauugcaagcgcaguggggucacuguguucagcaaagcaguggucuucacccuucauuuuugucuuagucagggcuucuauuccugcacaaacaucaugaccaagaagcaaguuggggaggaaaggguuuauucagcuuacucuuccacauugcuguucaucaccaaaggaagucaggacuggaacucaagcaggucagaaagcaggaacugaugcagaggccauagagggauguuacuuacuggcuugcuuccccuggcuugcucagccugcucucuuauagaacccaagacuaccagcccagagauggucccacccacaaggggccuuucccccuugaucacuaauugagaaaaugccuuacaguuggaucucauggaggcauuucuucaauugaagcuccuuucucugugauaaguugacacaaaacuagccaguaugauuuuguuuuaaacccuuuuuauuuuauagauauggguauuuugccugcauguaugucuauacuacaagcgugugugguggaagaggaggguaugggauccucugcaaccacagaugcagagguuguaagccgcuaugugggugccgggacucaaacccagguccucuaggaagaguaaccagcacuccuaacuaccgagccaucucuucagcccaccuccaucacucuuaaucacugaccugcagauguuaacacuagaaagauaaacaccaucuucuaaguuauggaaauguucuuggccuuucagagacccucccccaaagggucaggagucuucagagguguguacagcacguauguacugacuuagaaaacaaagccgaacuagaauuugcauaggugguuagagaaggauggggggagauuacaagagcaagaagauggcagucaaaacccugguuagaaaaaguaaggucagacuggauaguuagaauagggaauaacguguuuauaaucuguagguuauagucagaucaagagccguguuacguacccagcagggacgcccaggcuuuccgugaaaucacugggagcagcugaaggguuuugucucgugugggacuugagcauguuuguuuagaaguguuaguauggggugaacuggagagcagugaguauguagugugacuugugauucagccacugagagcccagcacagggugggugauaccccaaggguccugaggguuggggagacagcuuuagaaggaaacuugagaugaaacuggagccagaaaggucagagguuaucugcacuguauuuuaucuccccagucccuccuaagggcauuguuagagaaacagacacaaucugggcguuucuguaaaagguccccauaaugacuuuguccucccagaugacugagaaugcuuccuucugauaacgcauuuccucuucaugcuccugccagaggcuuccagccaguguucauuacuaggguccaacaguugaaguugucccaguggcuagcacauuuucuuccacccgccuucucuggcccaaccuuuuaucuuuauugacuguucauuauuguuccugcacucacucuccgugacaaugacaugccuucuuuuagcggguugcuccugccgggcagcacagcaguucaggguucauacugcuuuugcagagcucuugggcuccuuuccagagcccaugucaaguggcucgcacucccucuaacuccagccucaggaaagccggugaccacuuccggccggccuccuagaacccugaacguacauguagaaaccuacacucaggugcacgugcauuuacauaauaaagaauaaaucuuuuuuuuuuaaaguguuuuugaaauauaccgaauggaagggcagaguacaguuuagugguaaccuuuauagccuuagcauacuuucuuuauuuggggaacaggaccuuccacuuuaguacuuuauuuauuuauggaacgggaccuucuuccacuuuaguucuauuuuccucaaacugaagacaacuaacgugucugauaccacauacuaaaacaccaaggcucaguuucauagaaauucaucaaauuuaaccuggauucuacuucaaagucagcuagaagcagugaaugauagaguguuacagugcccacuaaaggcagcucauagcuaggaaaggcaugagagagagagagacagagagagagaaagagagagacagagacagacagagagacagauggagagaggggagaggggugguagguaugaacacccagggaugacaagguucaggaaaggacacauuuaaguagagagcaccgaugggucucccuuacugaccuuugucuguaccccagacuuuaggcugauugucucagcagagaacacggucuuuucgccauggcgcuaauccugaaaggauaacaugcauacaccaaggcaugugacugauugucugcaauagaguugggauuugagccuagaucuccuggaccccaaaguccucauucuuuuuucuccuuuuggcuuccuaaguaacaguaugcaauaucuuguuuuaagauaccaaaaaugccauauacugugagaaauauucaggcauaaaagcuuagccacuuuuaagaauguguguguauauguauauaugaauaugcauauauauguguguauauaaacauacauauucaugugucuguuuaugugcacauauguauauauguuuaugcaugcauguguguauauauguauauucauacauauguauauauaugcauaugcauacauauauguguauauaugcauguauuauauauauauauauauauauauacacacacacacacacaugaaugcacacauacauauacauacacacacauauauacacaacuccuagccaucuagccaaucagcugccuuuaguggguacuguaauaccuuaucauugacuguuucuagcugacuuugaaguagaagccagguugaauuuauugaauuccuauaaaacugagccuugguacauuagugugagauaucagacacuccucagcucuugucaacauauacacacauaaacauauauauuuaaauauauacacacauacguaugcauguguaucuuucuguguggguguaugugcaugugaaaucaggugcccagagaagccggaaggcauuggguccccuggaacagcauuuacagauguuugugagcugccugauguggaugcugccaacugaccugucauuugcaagagcagcaagugcguugaacucuggcugucucccuggcucuauugugagcuuguuccuuuggagcauuuaauucauagaccauuucuaacaacugagugagguuuuaugaacucucauuuuuauucuucccugugaugcauuuuaaaugcuuuccugccauugucauaaaugagucguugggacuggguguuguggaucccaucccugcacaaccagcagcacuucuaagacggccugagucgaagggggaaagcaguaucucuaugagucugacaaauacagagauggaugcuugcagccaaccauuggacugagcacaggggugggggggugcuccaauggaagaguuaggggaaggacugaaggagcugaagggguuugcaaccccauaggaagaacaacaauaucaaccaacuagacccccccccaccccccagagcucccagggacuaaacuuucaaccaaagaguacacauggagggauccauggcuccagcugcguauguagcagaggauggccuugcugaguaucaaugggagaagaggcccuugguccugugaaggcuccaugacccaguguaggggaaugugaggguggggaggugggagugggugguagcgggugggagaacacccucauagaagcagggagggggaugggauggggauuccuggggaugaaaccaggaaaggggauaacauuugaaauauaaauaaagaaauauccaauuaaaaaaaaucgcccaauguaugcugaccuacauggcccucuguuuccugagacucuagguuuuccuuccuguugauuucaaugaaauuaaaaauaucaguuuccacaguaaaggucaauggcuugagaggagcguggggcuuagaaaaacugagggagagcaccccugcugaguacccugagcagaugaagagcaccauagauaucuuaccacgucaagaaaacccuuaggugacugccaaucucaugucaccaggggugugaccuuaggugacugccaaucucacgucaccaggggugugaaagacugcaaccuugagggagucuguggaagaagaauugcacaggagggaagaucugaagacuugcuguguuccaccauacccacagccgugcucugcuuagcucacagucggucuggauagcuguaucaggaagagcacagucagucucuggauagcuguaucaggaagcuggaagucuagauaacugacucagcaaacugcagcguucauccugagcugaggaaccuguuggccagcgccucuuuauuuagaaacaaaacagagacuauugacuugggagcacugacuugaacaauggagcaaagggggugucuuagucaggguuucuauuccugcacagacaucaugaccaagaagcaaguuggggaggaaaggguuuauucggcuuacacuuccauacugcuguucaucaccaaaggaugcaggacuggaacucaagcaggucagaaagcaggagcugaugcagaggccauggagggauguucuuuaccggcuugcgcagccugcucucuuauaaaacccaagacuaccagcccagagauggucccacccacaaggggccuuuccuccuugaucacuaauugagaaaaugccuuacaguuggaucucauggaggcauuuccucaacugaagcucccuucucugugauaacuccagcugugucaaguugacacaaaacuggccaguacaggggggcaguuugcagguaugaguuugaugaaugggaccuaugggguuuaagauauaacaaauuagauauguuaaaaguaguugagauaucacuaacuaagaaggaaaacacagguggguggggaaaaauauagaguuacaaaguaacauugaaauuauuguacugaagaccaagaauccuacgacuuagcuuacagguagggcaccaugaaaaugcaccaagacaccaggaacuggugagcauuguuuggguuccagcugauucuggaauauaagguggggagcuuuuucuuaaauguucaaaaguguaauguagggacaaccaucuuguuugugguggaaaccccacagcauccuucugaauaugguguagacuaagauuucagauggagucaagguuuuaugccagcggauggacaaugaacccagacauacugaccugggcgucugagaccucaggaggccagccuccaggaggacaguccuucucucucacagcuuggauuguaccagucaucuucagcuggaugcugccucguaucuagagggcaguauguuggaaacuccuuguagacacacacucucucucugucucucugucucucucucucugucucucucucucucucucucucucucacacacacacacacacacacacacacagcucuuuugcucacacugccacugacagcugaaaauaaacagauacugguuuauucuagaaaaggaaauuauacaagagcuuccucgggcacuuucacuuuuccuucucaucguuugauguuucuuugcuguuuuauuucuuguuuugaagacuaaacugagauuccccccacccaacaccccaaagguggaaagcccauaggaaaacaggaaauuaaaaagaacgaaguugugcugaugaaauuggucacacugaagcccccagggcuuacgagaaggcugugaggguagcuccccgcccagcaggauggcaccugacuggagucucccauaagacuccauuuauuuccauagcuaguuaauucucuauguguggugcuuugggugggacccagggcggggcuaguaacacugagucaucuccaggccuaauggauuccuuuuaaggagauuuuauuucaaaggucugucuucauuaugccuuccagucuaguucagaaaauuuaaggauaucuaaaauugugcaagaaugccacuagacaaaagaacugagcccuugucgugagcuggagggaaaugguaacagugaugcuggcaaacgcacacgccagaucaggaggccguggcauguaagaagacauuguaaugauacaguccgcuauuuacaggcgaccacaucugugccuuguaagaaauagcugaaaauagcaaguucugccacuugggggaaaauguggaaauaauuuacagcuaaaagauagcauuuuuaagaacuugacaucaaauuuaacuugaaaccaaaaccuccaucagccaaauaaguagaaaguucuaaauauagagaaauguauggguuggagcgcguaaccaauguuuggugguugugaggguagccuguaaucugugaugaaaagucagccggggcccuggugaccuucugaaaugaguuuaauguccagaugaaaauaacggggucagcgccgcggaacccagggcaggcugacggugccuggaguuugucucccuuuucauuccaggaugcacuugggacacaugagcacuuuccaaggucucucccuacacaguucccugucuuccccauaaccacaggcugcugccucucuaacagugucuuagccaagauuacucugugucagguagacaccaguguccccagugguuacggaacacuacuucugcagauagcuugcugggggccuccuucaagagugcacaggccccucugcuggcccuucccuccuauccccaccacggggacaccaccuuugaagacauacaggugcucucccugacuuagcaguccucuuguggccaugggguuuucagacugaaucauauaaagguucugugaguuuguucugugcuguucuggugcccucuugccccuuucccuguguggucucagauuucaccaccaaagcucaagagaaucuauuaaagaguccaguuaggucaaagguggcaauagauacuacuuaaaaguguaguaauuccuuugggcggggccuggaaucaugcuaguguccuguaguuacgaggagcaaaagaaaaaaaggaaaaacccaaaauacacgguuuggcugcgguagugggaaaguggaaggcuguaaucuagggaggguggcgcccggcacacucacauucuuacacugugcuggugggugugugauuugcaugauggcuuagcgacucguguaucagaggcauuugaacaggccguagcgcuuagaaaucugcuuccagaauuuagccuaaugaaauaguaauugaacaugugcacauauacauauguacaagaaagcacacugcagcaguguuuauagaagcagaaaauuggaagcaacuucuguguucaucaguggaggaacuguuuagcuaaauuauauugcagcuauuaaacaugaugauucagagcuuuauauaaagcuaggagaugucucugaucgauguuuguacaacagugcgugcguguggugccauuuuaguucauguggaugggagugggcuuggaagacuacucuguaaaaauauuucaaaucucagcucauuucugagagcugggguuacauaugacuuuuauuucuccuuuauacucuaccauguugcuugaaguuauuuuguauuuuguaaggaacauaauuuuuuuuuuccauuaggagaaaaagagucuuuguaguuugggaggcgagggugggaacucuggggucuuaauacguggagaggcccagcgugucaagugcuggucauggccuugggaacagagagccaaggggagacugauuucugcagaaaucccuggguuuuuccugagugcauguugauuaucacagagucaacaccacauguucuuggaacauccugggguacacucuaaaaacagcccucacuccggggccuauccucggagagugggugccuuugcuuguuucucugaagucagcaauguggaaugccuagucuggucaaagagaagcuccuguaugccggcucugugugcccacagacuucugcuuccccugugacuaaucuguuacguccuucucuucccuccccugcuuucuucaaauauuugucuuuccccucaacccucagccuccucuccuguagcugcaacccugggacuuuuuuggcuccguauuuggcuuaugacauugacuguggucauuugcauuuugaucaaaauaaagggagugaaauuuguccugcuuuguagcaugcuuacuauauuguacagaggaaaacacuucacuuauuuauaucuuguaucuuucuaguuguuaggaaauggaccuaugccauugguaguaugcaaaugaaguuaaguucaguguuuugagaucugaauaaaggcuuuugcuugagcugaacuuggugugugugugugugugugugugugugugugagagagagagagagagagagagagagagagagagagagagguauuucagaguuucugcagaauggaugguacucuauuuuuaauuuaguucuguuaugaacuaaauuaugccccuuccuccccccacauggucucagaauuaacuacuuuauuuuucuagucauauaaaccacagagagcaguucuugcuacccucauauugcucuuuaauuauaugaaaauuuuaauauuuuucaccgugcagcuucucagcuauugugggaaaacaaaccuuuccuacagccugcuuugugugacgugaaugcaguuaacccagaugagcuuggggcacuccaguguuucaggauaucgggaaauuucuucagaugcagucaguuucgucguccaaggcaaggaagggucagacggccucaugcauaaggaugaguuugagcaaagauuccaggagagccacaucucauccugauugugaauaaauaauuuacagucagcauuuuggacgauaauagauucugcugcagugaggugggguuccuaggcaggauuuuuaaagacccauuuugaugauguuugaagcaugugagucuagaccaguguugacagguuguuuuguagccgcagaaauacugacaucaaggauccugggaguguuuaccaguuccacucugccugcccugagugacacagaguaccugcacacaugcaguccuucccucaggccugugucaccccuacaccccuguccauccaggagacagacuccacauggcccuaccauuucccucuggagugaugguagcauccucuuuaagggaaaccucaaugccacauuucaaccagauugcugagguagauuuccgcgccaaguuguuacuagaaaagauucacguuugggacauugucucucaggcacugcccugcaguaaccugcaguuacacuugagccaguggcggggaagaggcucugcaugggcuuccuuagcaacagccaagaggacggacaggauuuaccuucucaaauucacacuccuuugaaggcacugggcaaaauaacucaacuuucuucuuuuacccuuugaaaauuccauacaugacacgagauaucuugagagugucgguucuuucucugucucacccuccuacccccacccccauaucucuguucuuauucccccaaccccugucuucucccgaguccauguccuaucucucuccuagcaucaugaauauuuaacugaccugaccuaauguagguagccacaguugcuauucaauucauguguccaauagcuguguccuguucagaggacagcacuucacaauagccucugccuuuuauaccacacuccuuaccuucugugauguugcuuaagccuugggcagggguguggggugguggugguuacauagauguccuaucuauggcugagcaguuacagccuuacucucagcacuuugaacaguaaugagucucaacauugaccacuaccuaccauauauauauacauauauauauauguguguguguguguauguauauauauauacacauacauauacauauauacaugcauauauacacauacauauauauacauacauauauacacacauauauacacauacauauauauacacauacauauauacacacauacacacauacauauauauacacacacauauauauaauuuuccuuauucuugaaagugccauagauguaaacaauaaaaugugaucauauccaauacccccuccccauuucuuucuccaagcaacuaucuuaguugcuuuucucuagcuucaaagagacaacaugaccaagacagcaacuuauuaaaaaaacauuuaauuuggcaccuaugguuguggauauggaagguuagaguacaugauugcuguggcagagagcauaggaacaggcaggcaugaggcuggaacagagagaaagagaaauauccaggaauggcuaggguuauguggagucugucuccuggauggacaugggguguaggggugagaggggccugagggaaggacugcaugugugcaggugcucugugucacucagggcaggcagaguggaacacucccucacugguaaacacucccaagguccuugacaucaguauuucugugacagcaggccuugccuccuaauccuucccaaacaguuccaccaacuguggaccaaacauucacauauaucaaccuauaggaacuauucuauucaaacuaccacagucccccacccagcuucauggaugugggagcaugcacagcaccuacagugagaaccaguggggaaagaguaauucucucucccacagcggcuaucaacagccaagcucucugucuuaaaggguggagcuuggagaauacuuucccuaucuaugcuggaauuuuggccagcuuuuucggcagguagucacuguuguuaugaguucacgaaucuaauacccacguccaaauauaaauauuuagaagguaguucccucaaagacaugagguucucaaccuuccucacauugcaacucuugaauacugcuccucauguuauggugaccccgccccccuccaccaacauccgaaauggggagcccacaacccaucagaugauaauuuuuuuuggucuuacuuuggugcaaugacaaaugagaguguauguugugguuugcacccuuaucaaagcugaaucagguugggugggguuauaaacagagugcauuauagacaugcuguuguaacuagaagucugcaaagcucuuucaggaagaaggugaaucauacagacuagaaagguugcuuauugccuugacauugaaaacuuauccccaagacuuuugggguaaaaguuuggggucucuuugaugaacuuaagaauuaaauguccucagugagaaagcugguagcuauauauaagcucuugucacuaaaaugaguuuaccuaauaaaucauaaacuuuuucuguaaguauuucuaaacuugagcugcuaaaaaggaaugguugagcuucauacguguugacuguuaguuucugugucauuaggcucaggcaaaaagaauaaacaauucaguagacaacaacaagaugauuggucugucuaugaauuuucagucacuuaaaaaauuaucaauguuuguuuggagaaacuuaaauuuuuccuucuucuagaaaaguaaaacuuugggaaaaaaauauuuuuuagguugccugugauuuuuaacgggcuacuacaugaguuaggccuguaagugaaauuuacacugaaaaaaauccaaauuuuuuuuucccagaaaaaaaaaauguuucuguucuccuuuuuuucuuuuucuccuuucuuucuuucuuucuuucuuucuuucuuucuuucuuucuuucuuucuuucuuucuuucuuucuuucuuucucccuuccuuccuuccuuccuuucuuucuuucuuucuuucuuucuuucuuucuuucucucuuucuuucuuaaauuuaaacuuguuuguuccuuacaguuaccugguagugugucuucugccaagagcugagagaucuggacuuugcagcaguagguaguuaguuggcacccuuuuccuggcagccauccuaaguuccguaucacaccuuaccauuugcuucacacagguagcuguugacaacugauggagucuucauacaaacaaagagcuuuggucuuauaucccaugcaagagguuuuugugcccacuggcugauuugggagguaguugccacccugucccacuaugcagggguggugccugacuagccugggccacuguguaagggugaugcaugggcaacgugggccacuaugcaggggugacucauggccagugugugucacugugcaggggugaugucugaccaacaugugucaccaugcaggggugaagcauggccagugugugucacugugcaggggugaugucugaccaacaugugucaccaugcaggggugaagcauggccagugugugucacugugcaggggugaugucugaccaacaugugucaccaugcaggggugaagcaaggccagugugugucacugugcaggggugaugucugaccaacaugugucaccaugcagggaugacucauggccagugugugucacugugcaggggugaugucugaccaacaugugucaccaugcagggaugacucauggccagugugugucacugugcaggggugaugucugaccaacaugugucaccaugcaggggugaagcauggccagugugugucacuguggaggggugaugaugcauggucacuugcccuguggugcuguacacuccaggccugguucucuagcaccucagugagcugcuggcuccaccgaagucucuggagagcagguugucuugugcacuucucagaugucuauaauaaccaggcuuuccugucauaugcuaucaauuuccuauucugagaaaucacucccgguuuucccuuucucaggcccuuuccucccagaagcugccgugugcaucacccgucauuuaccugggguaaaacccccaucaaagggaagauuuggaggcaccugaaaagccugugguugaaaugaaaaccacagaguuuagcauuuccauauaacuuuauucuucaggcucauuaguuuaaauaacugaaaugggaaaugaaaaaauaaaaaaggcaguaaugagccagagccagagcccagagcccagagcccagagcccagagcccagagcccagagcccagagcccagagcccagagcccagagcccagagcccagagcccagagcccagagcccagagcccaaagccaggaauguguguugcuucccuggacauucugugccccggacaagaacaaucccuaagcagaaccauccuguucaugacagcccuuagugcgaggguucucaaccuaugggucgugaccccuugugaguuaaaaugaccucuuuauaggcaucaccuaagacuaccagaaaaugugacauuuauauuacaauucauaagaguagcaaaauaacaggcuaugaagcagcagugaaguaacuuuaccguuuggaggucaccacaacuugaggaaccuuacucaugugucacagcuuuaggauggcugaggaccgcugccuuggagggagguggggcuggagguggcuacacuuggcggugcugccucugcggguuggguagccugucagcgacagugagaagccuccaugcacccugcuuaggagagaggaaaugaaggacgcgcaagcggguuuuaugaguugcaaagauuacaucuucucagaaguguggagaaaaggaggugcugggaugguuucugugcuaauugaugcugaacgcagucgagaauuaaucacaguuaaugaacauagugugcuggucguuccaucaaaugauugccaggcacaauucccuauuuguuuuuaaugggagaaaucucaaaaccaucacuuaccaguuaaaaagcagccugguucuuaaacaacgaaguugacauaagcauuuuuuuuuuauaggcugugaggauaucgacucuucucacagcugauuaaaccaacuaugucuguguguugaggaucugagggauagcgguugcuuuaauuacauauguguuaaauuauacguacaaauauaauuuaauucuauuaagcccaucuuuugcuguaacaucuuauuuguugccauagucauucuccuguguacccuucuuuuugagagagagcaucccauuguagcccaggcuggccuguggguccuccugcuucagguaguguuggaaucacaguagcuuguaccaccguaugcagcucacaauacaaucuuuuaagcuauuaauuaaagacucaguuuauuaccauagaaauuuacaaugucuaagguuuucuucuccugcgucagggccaccgcuugugggcuuguaggcaaacaccaaugacuaaugugacuuuguguacaugguagcuccuuuucucaccuguuuaaagugauaccgugggugaaguaaugauguccagagagaugucaugaaaaccaaucagaagcuaggagauaagacagacaggugaugaggcccccaccgguaguauuaagucucauaguuuucuucuugcuaaccaauucagucccucauccaggaaguucucauuacugaguuucuuuccagcucugacuccccucuguuauccaggcagguagaaucugggaugauuggauccugcacguaauacugccuguucccaagcauucuaggcuacugccauucacagacaucccccaaccaagaacagacacacuguagagauuagguaacucgguaugacuguaucucucucccccucagagagcucaucugugagccagugagagucaagagguacauaccugccagucauuaccuuuccaauaauucaccuuaccgcuguuuucccucuucuacacacaggaagaauuuaacgggaagcccgacucccucuuuuucaccgauggccagaggcgaaucgacuucauccucguguaugaagaugagagcaaaaaggagaacaauaagaaagggacaaaugagaaacagaagguaggacuugcauuccauuuaauuucucuuuuuauucccuuuaggauuguaaagugaacagcgugcugguuuuagguaagcaggcaggugauaaugauguggaguaccgugaaccagacaucccuccgauguucucucagccucagauccuucaaggcaugguagcaggaaauuucguugauuugaaacagaagcuugcucggggcccuuccccagucaguuucauacggaagggacuuugcuggguugugcagagcagauuugcaugaaggcacaccaggcaggcagguggccuuuaccuggccuggagaggaggcugaugacuaaggacaaguguaggaccuccuaguguucccugugcgcucggaucacucacuucugcugccaggggugugggcucuuccuucauggcuuuucuuuucucucauuucacucuuagcacacacacgagcugggcucagucaucacaccguuugugcaugagaguuugugguagagaagccagauaaucacccacgaccgugggugcuucgucuauucagggcagagagacacgcucagccucucggcuugaauccagaccccacuuccgacccucgggccuccucucaccuucuuuuccucuuuugcaccuacaggcagcuaugcugcuuccuaccuuuccguugcuccugccucuugcagaaacaaaaccauucuuuuaauucauuuauucauuuacaucccagccguugcccacuccugguuccaccucccacaguuccucaucccauuccuccucccccuugccuucccacucccuggagccucaaauuucucaaggguuaugauaccuucuccccacugaggucagaccaggcaguccucugcucuauauguggcuggggccuuggaccagcccuguaugcugcccgguugguggcucagucucuggggucugguuaaguugagacugcuggucuuccuaugggguugcucuccccuucagcuucuucaaucuucucccuaauugaaccacaggggucucugacuucaguccaauaguuagguguaaguauauaugcaucugucucagucagcugccuuguugggccucucagaggacagccuugccaggcuccugucuguaagcccaacauagcaucaguaacagugucaggccuuggagccucuccuugagauggaucccaaguuggggcugucacuggacuccauuuuuuaucccuacacuucuuuuauacagggacaaguuugggucagaaacuuugacuguggguugguaaccccaucccuccacaugaggcccuguuuauucuuacuuugagaaauuaaaaagcaagccaggguuagcacagacauccggaaccucuuuauugcgacacaagcugcacugaacuuacggagggcaaaaggauguauucauggaucuuuacauaaaugcuggaacucacugcaccgcuacccuccccaucccgugugugccaauugggggggaggggcuggcgagauggcucagcggguaagagcacugacugcucuuccaaagguccugaguucaagagcugacgcccucuucuggugugucugaagacagcaacaguguacuuacauauauaauaaauaaauaaaucuuaaaaaagagagagagagagagagagagagaaacucucuuaaaaaaaaaaaaaaaaagaaccgugugugccauggcaugcacacagcuuucaggguccuugucuaugcaguauucacagacuauacccaucuuuaaccuuuuaaguucuccuuauucauuggaagcaaguggaaaaacuuuuuuuuuuuuuuuguaaaaugaaacaaauaacuguuucauucauguguucaaacuuuugaggguuaaguuugaagucuguccagaauaaggccaggauuuagaaacugacauucagauuccaauuuagccacuguccuagcuggaguaguuucaguuauauggaacaauucucccagguaauuggcuucacccaaaagaaagggucaggggaggggggaugcauuuaucaguuacaccaaaguagaaaguggcgguucuccuucagcacauagcuuaggguugaggcugugcggcauguggucauuugggaaccuaggcugaaacagaggcucugauguauucauuaggcaguuccagaaucaaccggggcaucaacacaaggagcagagacgaugacagagugagugaaggagcuccuggggcgucacugcugggacccggcagugacugcagccacugugcucagugguguccagcagagcucagcacuggcaggagugggguugugucucaggcaaaucucccugccauucuguaaccuuuccccccacaccuacacgcacauuuagacuucuuagcguuuacauuacaucuuacaaauagguuaucauaauuuuauaguugguugaauguuuuuuuuucuuauugguuuauaaaauguugguucaucguauaaucaguggcaucauagaugcuacagaacagggcuccaacaccuaccauguggcuauaauuaaaacuaaauaaaauaccauaugcaggcaucauguagauuuucuaauacacauaagucacaaauguuaauaauguugugcuuucucuuuuuuauuuggugagauccuaaggcaauggucugauauaaaaggcaugacugccuugcuacccggcucuaucacugaaguagcuaguggacuugaucaugucccccggcugcuguaguaauuggugcuuccacauuuacuauuaucaaauugucauggaccagccgucuaccgauagcugggcuggguuuguguaaagcaaguuaaacagaacaaauccaagaaguauaaaggagucagucugacuuuagcaaagagcuuugcugcugcgcugaagggcaccgggagcuacucacauuauuaauaaguucuucauuugcuuuagacgggaacguaggucucagggugacucucauuacaccagggggaaaaaaguugucauuaauuugggcaauccuccaacccagugagugauaccuucguguugcuguucauaagcugggcuuugaaguguuuucagcuugcauuuguauauauuucuuaauuuuauaaucugucaaauuucagcacccagcuuuggaaccacauuuuuuaauuaauuggacagacguuucugagcuuuguuguguuccgugucggggcuuaguggggauuuagaaugacgccucggaaaggcaacuucaaagucccguuuucccuaaaaggaaaagguuugguguaugccacauugauuuccuaaaucaacaccgugauugacuuugccggaacugaugaaaggaguucuguaaacaaguuuuagggccguggaacuacagguacccugaagacucacagagacuuaaaacccguguauccucgggaacaagagaaaauucuggucuagccuagccuuuaaauacuauguuacucuacccguuuauauggcugaagucauguccuaaguuugacauaagauguuugcuuuugcacguuguguggaggugauuguaaauugguucagcuggccuucuucggcuuaugcuacacuuugcacagaaucaguuuggaugauuuuacugcaagucacaagaaaacaacguuucagaugucuucauugcuagaaggaaaugauuauguaacugaucaggagggagagccauuucugaggcaggugaucuuccagcuuaaugaagccaucccauccugcugcccugauccucaaaacaaacaucuccuggguaaugggugacagcugagacuccaggcagccagauugagaggaauaugucucuuuugaaagauaagcuccuguggaaggacccuguacagacuuuccacuguagcucccugucuagcgugggucaucgucucuuucuuccuaaccuccauccucauuccuucccucuccgcuucucuuucuuccuuuguuaagauccugguguagccuagauucaucuuaaauucacuguguagcgaugaccuugaacuucuggucucccugccuauaccucuuaaauauugggauuguagauuagugccaccaggccagaagugguggcuuaucuugguuggcaaccugacacgccucacaagagauccccucaauuaaggaauagccuuugucaguuuggccuauaagcaagucuucagguguggggauggagguggggguaauucuccauugcuaauugaugaaacagggugucaccuaaugugggccacgcuaucccucagcaaguagaccugagguguguuacacagacgcagaugcagggagcaagccagagagcagcauucauucauggccucugcuucaguuucuucuguaagcgcuugccuuggccucccuugaugauggauggacucuaaccuguaagauaaacccuuuccuccccaagcuguuuuucaugguguguuuaccacagcagcagaagccaaacuaagacagcagguuuauugauuagggggaagggaacccaaggcaucaugcaggcuaagcaagcauuuucuaauugaguugcacucccacgccaccucauagacuguuacaguucaacaauagccacccuucuagguccauuggcucuacguccaugcauuuagucagucacagauuauaaaaaaaaaaaaguucagaauggagcugagagaugucuccgugauuaaauguacuugaugcucuuacaaagccccucacuuucucagcacccauagaguggcugacaaccauccacagcuauaguuucaggccaucuaauagucucuuucaaucucugugggcacuagacaugcacagcagacaugugcagaccuccaagcagacagaacacucacacccauaaaauaaauaaaucuaaauuuuuuuuaaaaagguuucagaaaaaaaacuuggcuucuguugagcacguucaaguguauucuuuuuucauuauucucuaagguguacaauauaaacaaccauuuauauuaugcuaaguuaaauagcaauugaaaaggguucaaaauauaugggguguguauacaggugauacucaaacacugugccauuuuaugucagagccacuucaguguccauggagucuguucuccauggacacucuagaauccaugcaugugucugccgccggggcuggacuaguaaggucaggggaauguuucauugacccaagauagucgggauugguccaguuuauuuccugcaucgcaggaccaccuaguaucagaaaaguguuuaggguuuucuuuggaaugguggagggagagauagccgucaguaagcugccaucgguguccagaguccaaacaucugcuacuaaguaugucugaccuguguugugaugagcagagauguuuuaaguaaaacagaucccugugcgggacaccaauucuuacaucacagucuggguagcgacggcuucuuucccguuuuaaggcuggccugcuuugauuucgcuuugucuggcacuugccucccaucggguacuccuguuccugaccacgugaggauguuauuggaugacgguggaagcgggaagaggaaguguguaggcagaacuaaagcaguccacgugguccugaauaaguuuuauuucguuucuaucuguuccuaguaauugauggaaacucagcucccuuagacucgaggaaagguguacacaugaaaggcagaugcuugaauuucacauucaccuuagaaauucucuagaaaggucugguucagagacugacacauaaaaauuuuaaguaaggaucaagcuaacuuauauaauaaaugcagauauuaguuuuccauauugugagccuuuaaaauuguugggcguugcucaggugagucaccccuggcagaauaguuuccauagaagcuggaugaguucgcuuuagaaaugcuuucacguucaugagacgucuaguguuauacuguaauaguugagaagaauuuauguccuuuagugauuuuuuuuaugguacucaugcgaguuuucuauguuuuuguuagauuuucuuaguuauucuaauuuuuuauugcuguugucaaaauauguuaaauuauaguuugugacguguuuuauauaaaacuuuugauuuuuaagggucuguacagguauuuugauaaacucuuuaguucuaauguaucacugcuucuucuaauauuauuuuucagaugaagaccguauugucuaugaauuauaauaguuuguuuuguuucaagacaguacugucuauucaagaccauauuaucuauaaauuauaacaguuuguuuugugucucuguguagcccuggcuguccuggaacucacucuguagaccaggcuggcuuugaacucagauccgcccaccucugcuuaccuaguguuggaauuaaaugcgcauaccaccacugcccagcuuacuacaguuuugauuuuccuuugccuucuuaugggucuuucuuauuucucauugacauauaauugcuaggacuucugaaguaaaacuagcaacucauaguagcaaugguuguauuacuuaugguuuuaacaggaauggcugcaaaaauucaccaguaaauauaauuauaccaguguaaauucugguagaguccuuuuuagaaguuaaguuguuaucuuuuaguuuuaaguguccuuauaguaacuaagguuugaacauuaucuuaaguacuuaaaaaaaaaucuagugaaaaccugggugugguaggggcauuccuuuaauccuagcacuugggaggcaggcaaaggcacagcucuguaaguucaaugccagccugggcuauaugauguguuccaagccagcauggauuauaaagugagaccccaucucaaaaauuuuaauaaaaucuauugaagugcuuggcugcuuauuaagcaaauucuaagguauauuaauuucaagugcaaagauagacuauacauauacccaguaguugauuccaauguaccauuggauaccaagacgugagggugcucgagucucuuauauaaaauggugcuccggcaccauuuuugcauauuugcauauaaucccauauauuucuaagugcuuucccucaucacccaauauaaacacagcacaacauaaguagcuguuaaacuguguuguuuaggaacaacgaggggaaagacugucugagugguuccagaugcacgccccugccccaauaauucccaucuuaauuuaguuggaucuguaaaugaagaaccuacagaugggaagaauggacuaucuggggcuguuuguggccaguaagacaacagagagcaauguagaucacacaaaaccauuucuuacugccuguaaaaugcuacauggcuucauauuuauuagcucccugcuuauuuauaacacuacacuaaauaguuugugguuggaaagacuuggcaguucucuggaguauuaaaaguuaagcucauagaugaagaaauuaggaugggcuucccagaccuuugugugaguagaaggugugggaagauguuuggcaguggguagaacauuuuuuuuuugguugggaagaauaauuucaagacaucuuuuguauauugauagagaccauagugcagauacuguguucuugcaaaugagaauaguguucauuuccuaagauaaggaagagauaaucaauugccaaguaguugaaaguuagccuuccacauguauaaauauguggagugcauuuaggguagaugauaaauccguaugauucugucagcuaaagcaugauggucauuuucuaccgauuaccuucucgucccaucccuggggagcccuuuguucuaaacuacaacccccugacucuucuuguucuguuuucugugugagcauuuggaggaugguauuuacuggaccagggacaacuuaacaggggcuguaucccugaagaaaaggaccccucuuccucuagccacugauaacugccaauggccccucagggaaagacaggccccuugagucccuccuccacccuugauagacugcugacaggaccaucaugugcaacucuuccguaggcaagcacagccucugugaguucgugaguagaacagccgugugaauuagacagcccucucucucuccauccucuggacagcaauauuugaccggaucuagguugaccugguugaagauuccuuugccccuucucaucgcuccugaaaccagcaguucuagaucagugguucccagccuucuuaacacugagacccuuuaacacaguuccucauguuauggugaccuccugaauugcaaaauuauuguguugcuacuuuauaacuguaguuuugcaacauuuaggaguuauaauguaggcacuugguaugcaagauaucugccaccccugugaaaggguuguucccugcccaccacccccacagguugcaacuguuguuccucacugaaggccugggauuguauuugaaaauagcucuccaaauuguuuuuagaagcuguuaagggcagaaaccaccucacaucccuugcuucuuuuuuuuaguaguagauuauaggccauuugccuucugauguagcuuugacccauaaugacuguguauuucuuuuuuauuauaucaaaauauuaauuuaaaaguaaaauuugaaacugaacuucaucuaaauauucacuucacuuaugcuugucauugggaaccgcucaucugcuucuggcccuucacgaacacacauuacccgcuugagugaauuccucaucacagcgguccaccaacguuaaauguaucaccagcacgugaauauaaauuaaguggcaauuaauuaguuuauguauucuacuuaccaaaccguuuggagcauaugcuauguaacuaauaaauuagcacaugaaguaauuaauaauuuuuacaugaauuaagagccuuugacucauuucucaugaaucuuuguaggcuuugcagagauuagccagaugaaaauaaaauaugaaaauagaauaacagagccauugguacuuugcuuaacagaguuacaaggauauuagaaguuaaucuacauauaucucauagagucuuuucccaguguccuucacucucugacuccguagucuccucagucccugcuuuuuccacugacaaggcagguucuguguccuguuuacaaucaggauuuguacagugugguucacagguacguacuguagagcagucacuucacgaagccagugagacaugaagucaguaauccacgguguugagggacagaaggcgucuuuaauuaugucagucuguccuuugcagcuuuaaucucugaauucuuuauuucccugacagcuucauuagucucacgaaggugguauaaauaaauugcguuucuggagggugggugggagcugcccucucccuucacuuuuugcugugagccuacucucccggauggugagagacgcgugugugcuuguucucacgagggacacaucgugacaaugaguagccacuuugucuuuacuggaauucuguauguaaggaagguggaucucguugccuugcugauggauuuggcuuccauagagauguaggaauucacagggcaacuuacuuuaaugacuugauuaaaaaaaaaaagacuguaagucuaauuuuuuuuccuggcaaauacaaaucggagagcauagugaacgguuagauuucauauguaagauuucccagcgagccccugagaugaauuucuguuaaaccuaugucuucagauaaucauuuauucaacaaauauuuacugagcauuggcugugccagucacuaugcaauauuaauugucuuuggucuuaacguagaagacauuccgcacuaguguuucaguugucaagagcgguuacugacgcagugugcguucguucuacugagaagugcagaugacgguuucacaggcugacuucagaagccuuugaagugagcggccccuucccgcuucucgccuguuugacaaauagaguacacacucgugccuucgcuuccguugccugacacaaggaguaaaagugguuagaucaauuuuuaaaauaugccacugguucuuugagaauuggcauaggaucugucuuguuaaagcgacaccagguuuauuagcguguucaagcaaacguaaaugcccuguccuugagucaacugcugagguauuuauuaugcuuuguggggaggcauuuaaaggcaacuccaagcuccaccaacuaugugaagacaaggcagguaaauaucuugugagcucuuuguaaagaaccaaauaaggacaaaaacaagauaaauuagugcaaccuuccuggagggcagcauggcuguauguggugaaggacuuugaaucacacuugaucgaacaguucuacuucugggauuuugcccagaggaaguaacaaaaggugcaugaagacuauuucauaaggauuuuuauaacagggaagaauuaaaaacaaucuaaauaucuaaugcuuugagguuggcuaaauaaaauuagcccaucuccucugagagaauauuauuaaggcauuuaaaugagauggaaggaugcuuuuauguuuucugcaucugugaugggcccaugggcaacacuaucucguggccuuggggcacucagacgggaggcagaagaguugaggauacaucauuuccccaagaggauggaaagaauacacacuuauuagauaucaaagacguaguucaaagaucaagaucaggauggccacaaaagcacagaaggcagaggaccaggucacugaagguuaagaucuguucgaaguaugucuguagaauggcccagguaccucaguggagggaccgggcucauuggguguacaguguagaggcagaguggaugguuaguuacugccagucuuuucagauuucuggcauuggagaggagaggugauauucuugacguccugaagaauaucagugacuggguaccaggugucauguguuacacugaaucccauuagucauauuaaucuuuaacccuagagugaagcgauuucuccacugacucaagagauaaaaacagugagcgaugauccugaucucaaauuaucaccuagcaucacagacgugguaggugggagagcuaagauuugaaucuugccccaaacccagggauaaagagaaauccaaauuaugagagccgaaggggugugugugugugguagaauugcaucuaagaggagcgggccugugaaacuagugaggagguguagccgccauucagaacaucugugggaaaauggaccacaucugguuugcuacauucaauauauaauacccgugacuggugcaguggacagugcaguuuguuugguuguaucugaugagagaacagcccagcucucagaaccuuauuguuaaacucucuggcaugucuaugagccuccacugcccugcucucucugauauugggguacuccaagauaaaacucuaccucuccuccuccaccauaucuugcaauacccacaugaaggaagccaguuguuacacuguagcauuccaacaggccaguugaucucugcauagcagggagccauuaaucuagagugcgcucaguuuauucauucaucaaacauuuauggugugcauacuauuuuacaggccuauauuaaguacugaugauacugauaauaaaacaucaacaucucuaggggcaggagugguaauaaaaguccagaggaccaugggagaugugauggucauagaaaggaaagcauuugaauugauuuguggccaaccaguaaggacagugagaaaacagaaggcguuucccgggaagcucaagacauggguggauuucagcugccaugaagagagaugguagcagcaguuaaugggcggggaggaagaaaccugugggugugcagugaguggccaccauugucucgaugaggaaggagccuagcccacagagaauaggguucugcugguuaggugccaagcaagaggggaagcucccuaguucacggcugguggccagaaaggaaacagcugaacauuguuaugggucuaacuguaguggaggaggggauuuguaacagagccaaucacuguugauuuguuuucuacccguauuuaaguauuaaaacacuccuuaaacuaugggagaugacccaccucuggcugacuccacagcugucccuaagaccuagauacuugagccugagucuucacacauguuagauuuuugaacugaaauaccucccacacacacauaccagcucauguucccuggcuuguagagguguuuuagaaagcuguggaacucucagaaaguuaggacauggcuggcagagggagggucacgagggacaggaucuugcaggucgugcucaccuuugguucuggucugcacuuccuauccacugccauauaaacaggccacuacuacacacucccacccccagaagcaccagcaugccuucacuguuuaacucuccuuccucccuuaaguuauuucugcugaguuuugucacacugacagaaaaggaacuaguuaaacauugguugaaauccccaccaccacuaggguagccaacagcuuccuguuaagucucuggaguuggcauccaucgcaucucuccacaguaaguucuuccucaaguggcaacacaugguuuccaauucagggugucauaguuagggauucuguugcugcaaugaacaccaugacuaaauuuaauuuuuucaaauccuauuuuuaaugaugguccuuaaaugcuuuaaccucccuuguagcccaccacccaccagaggucaugggaaagaaagggugcgggggaaguggaccuguuuagaaagguucguuggagcagcucccgucugcgucgucuggaaauuggcaguucaguucacaggucagcagcagcagcuugaucggaucgcaaacgcuucacagauacaccagcaguccaguuagguagagucgggauagcgaacacaaaucagcagugauugugguacugccuagcaacgacagcuaagccucagccuuggcaggagucagcaggagggaccagggccaacaggaacaccaggaaaaguucuuggcugugccucucucagcaaagugaagaucagcaaagaugcaagacccacaagcauugcacagcuagcucaauaagcaagccaaggucagccuccaucacuguucauugaguccuuuuuacauucccuccaaacaucaugggcuucccucagcacuugcaucugucucagcugacaucacucugccaaucagucuacguccuugaaaacggcaagaagcuguggcacaccagguguuugccccagcaaaauaccauucaauacaacugacuuuccaaagaaaacucaauuuuccacuuccauaccccagcaacugagggagaugguggugggaacagaaagugggaaaccuagaagcaagaacugaugcagagccauggaggauacugccugcuuacuggcuuguucuucauagcuuauucugacuacuaucuuauugaacccaggacugucuguccaaguauggccccacccgcaguggguggggcccuuccacaucaauuaucaaccaaggaaaugcccuacagauuugccuuacaagcaaucuacugggagcauauucucaguugagggccccucucucauaugauuguaacuuguguuaacuuggaagaagaagaagaggugaaagaggaguaaaagaaggaaggaggaggaagaagaagaaggaggaggagaaggagaagagggaggaggaagaggaaaaagaagcucacaacaacugcaauaacaaaagaaccccucaggacacagggucuggaguauugcugaacuugaccagucacuagggcagugcuuuucaaccuguggguugcaaccccuuugggaauugaaugacccuuucacagaggucgcauaucagauauuuacaucacaauucaaaacagcaaaauuacaguuaugaaguagcaaugaaauaauuuuaugguuggagucaccacaacacgagaaacuguauugaagggucacagcauugggaagguugagagccacugaacuagggagaggaagaacagguacgcaugccuacuguaguggauacagguucugcaaugaccugaaaugcuggauguccaacaggcaccugcugcauugccuagaaacauguaagcguuucugccuuaaugugggagaaagucugaggucauggacaguuucucuguagaucuucuauugcacacauggaaaacuauucuuuguguuuugagaaguuuguaaauucccugaaaaaaaaauaacagaaccuuaguaagcauuuauauaagaagcuaauaaaugcagagugcagugcucgccccucaucugugaggggagcccaccaccccaagggaugucccaagucuuaguaccaaauaccaaacucugcacacaugugcaugcgugcacacacucacaggugacacacacacacacacacacacacagacacagaugacagacuccacauaaugcuuucucacuaacuuccucauauccuguggcucucacaucuguggugugaauuaguaugaauuucagcaaacuagcaugaauuucucucccuuucacaauuucauggaagauucauucucaccacacaucuuagcaacuccagccuguuauuuucuugguauaguuaagacuuuccgggggcuggagagauggcucagugguuaagagcacugacuacucuuccaaagguccugaguucaauucccagcaaccacaugguggcucacaaccauuuguaaugagaucugacgcccucuucugaagugucugaagacagcuacaguguacucacauauaauaaaaauaaauaaaucuuuaaaaaaaaagaauucccaucuuuuuauacacacacacacacacacacacacacacaagggguuagagaggcugacugacugacugacugacugacgugccugugcucaaaccaugcccuugagagugacagacccccuucaaacgaggccacgccucuuaacccuucccaaacaguucuaugaauugggaaccaaacauucaaauauauguaccuaugagggccguucucauuccagcucuacauaauccaaauggcugucuucacugguaaagaaguggucaggaauaaggucucauugcccuaagagaacaaaccugagcauuagacucuagaugaagaaauacuguggagauaagaguuauuccccaaggugagcuggaaauaagacaggccauggguagaaaagauaaaaaacacccaaagacuauucggagagauggugaggcugcccucagaggguccuagcaugugcugggacacaggucagaaagcagcgccuugagccuucucaugguuuugaguccagggcuuccagcuagccaagugcuccucucuaggauauucuagcacuugcuucaguggcucucucuucuagguuaugucucauguaugcaaaguaguauuugcuuauuguuagaacugugggauuacagacuacaaauaaaaccauauucaguuuuggcauuucuguagaaugucaccagggacauuccauauagacacaggguuagccacauacuggguguucacaacuuauuaaugggauuuuucuguguuugggggcacagcaccucagggccuucucacaggggcaagucaggaguggugcucucugaguaaaguggcugacugcuaccccuggacuguuauggccuuuguccagcagcauggggcuguugcaaaaacaaggcaaagccaagcaaaacaaaacacaacacaacgaacaaaacaaaacaagacaagagaaucccaaaaaccucauucacccuucucaucugucaucagugagagagcuguguugugcauaguuuuaaagucauacuauugccuuagcaugggagcuguggccgaguuaccagcuccuccugccucucuuuuguuccucccagccuagcucugggaucaaacacuccagcccacucccaagacucuuguuccagaagggguuucagggcugccucaugaaugggaauucagccccacccaagauccuugauccuugaauucccagauaaaagagacacacucaguuugucacuuuauagcuugucucuuguggcacaauuguugugcacagauaucucccaccuggaaagacaugcccucgccaauuuauaaucuucauaaucuuuauaaucuucugcccuaaaccuacugguuuuccccugccaaacauguuugaccacccgccgcaggcucuagcugcccuaagauccaacaugauugugguguguuacgcaaagcaugacaaaaaaaaaaaaaaaaaagccccuuucucuuuuccugcaucuccuucuccucuugggaccagacggucccacuuguaccuuucgucuuacaauuggcucccucgucuucuuuauugacaagucaagaaccaauuggggaaaaagaccuuagccacagaacccuccccuuacaggacugccucaagaaugggaauucagaucuauguacaucagauuguuuaccuuacccuuguguggaaauuccuccugaaguaugaccagaugaaaaggcagggcauagggguccuccauuuccuccugugggcuguggagaugaucacaugcagucggggcuccagcccaguucgcgcuguguucuucagccccuguguguucacccaucuguugcccugacagcagagcugcuuccuaaguguucucuuuccuuguuacugcuuugcucaacaccauggccagaagcaaugugagcaaggaaggauuuauuuuaguuucuuccucucaguacaccaugaagggcucucagggcagaaguccgcacgucuaccugguuucuuguguccugguccucugucugcagauuccuagccauauagaauaaaaugguacauuuauuguacccagcaaaaguaaagucauagaucugcagaugauuauacauuuuuugcuuaaagauaauucuuugguuugaauuaagaaacguaagacuuguaguuucuuaaauacuuauuaaguuuuauuuccauucauauguaugcguguacaucuugggaguuggccuuguaacuuaggaguggcacgauaucaccagauaguuccuuguuuauauaacaucuuguuuuauaaacaucucuaagagauguuuggcuuuaugaccauuucauugcaaauccuuugaaucuuauuaacguuuuauguauuguuguauugucuuaguuaaggcaugcauggagugugugugugugugugucugugugucugugucuauguauaagccuacaugcaucuaauauugaaucauuugaauauauaauguagaaauaaaaauuuaauaucuggaaucuuuaacucuagaaaauuaacaucaaugaaugaaacucaaaaaguuccuuuucuguacuaucucaggagccagagauuauguaacagcaauuuuuauagaugccuaauggaccaaagucccacaagagauucuaagagaaugcagggaauccauuaaacacccuugcauucucuuguaggcuaacaccucuguuaaacuagagggcucgcuacuuuuguuccauuuugagcaaauaugucucuucaaggucaauagauuuuuaagaaaauaguuucuuaaaaaaguuuuaaggaaaaaaauuagucuuuucugccaagccuggcagucuaucuaacauguauuccauuucuuuugucagaggaaaagacaagcauacgaaucuaaccuuaucugccaugggcugcagcuggaagcaacaagaucuguaagugguaguuucuuugaaaccauggcuaaccacugugccugagaucuuaugcaucuccuggaauggggggcuugacacaggaaauacagccagagugggaaaggaggcaaacagagccuguaccacaggauggugagauggcuccaugugcaaagaacccuccacaaaacccugauggcccaaguucagucccgggauuacauggcugggaaugagggcuggccacugagagucacccucugacuuccacaugugugaccaaaggguacaccacauauacacuucuuucuucgaaaaagggaucacuucaguuuuauaacuugcuuuuuccuuuaauacaaauacuacauauauauagcaacaagguauaaucucuugacaucaauggccauauauauauagcacaauggauagauauaauuuaagcagcccauuuacaggcuuagaauuuuuuuucauucguauuacacugccaugaauauguuauuccaagucacuaacagauugugugcugacaaauauacagugugcuuuucucacuuaaaauauuacgagguugagccuugggggauggcucggcauuuaggaacauuugcuacuccuguggaggaccaacguucaguucccagcacaucugccuguaacgcuaugcuagcuccauggaaucuggcacucucuccuggcugcuaugggccaccugcaugcaugugcccgcacauagugugcuugcacgagugcucauaccugacaugcacucacagauaagacuuaaaaaauaaauauuuaaaaauuacuggucuuauguuucuuaacucaaacuaaagauuuaucuuuaaguuuauauacacauauauaaucauuuauagagcugaugucuucacuuuggcuaauguccuguuuacauggauuuuuauuuuaaaaccuacuggaacaggggccaggaagcugugccuucaacuuguaaaagucgucguuuggguucuguugucccuucauagguuucugaugacaagcuuguguucguaaaagugcacgcgcccugggaagugcugugcaccuaugcugagaucaugcacaucaaacucccgcuaaagccaaacgaccugaaaacgcgcucgcccuuuggcaaccucaacugguucaccaagguccuccgggugaacgagagugucaucaagccagagcaggaguucuucacugccccuuuugagaagagccggaugaaugauuucuacauccucgauagagauuccuucuucaacccugccaccagaagccgcauuguacguccaaacccaaugggguuuuuguuuugcugugacuugaaaccuauugcauagcugugguuuuguuuuuagaaauagaagccugcuaacuauuauuagcaguguugguaugauuucagugcugacgguuuucugcuauaguaacaaacaauggucgcaugggcugguucuaucguaaaaagacacauagucuguuuugucaucuuuuuuagguuuauuucauccucucucgggucaaauaccaagugaugaacaacguuaacaaauuugggauuaauagacuggucagcucuggaaucuacaaagcagcguuuccucugcacgacguaagucaaauggcaaaaccuaagguguccaugaguacucggugagacagggaaggagucaacuucuugacauucugucucuuccucaguaaggcagagaugaugucaugaaagaucacaagcugauccagggcaagaaagaugcagagagccuucucugauggagcccagggguagagacggugcuggguuuuaaggacuagggggaauggacgguucccugccgugagcaacguggcaacaacacuucauacagggcggaacucacucugugucagaaaguaaagcuccacucucgguccccagcucaaugcccuugugacacgucuauucucccugcucccucaugucuuuaucagugaggaaugcauuguaacuguugcuaccucauggaguuguuucaagagucaauuagauuuauguaaacuauuagucccagucauauaaaugguagcuaguuucauaaguacugacagaugucugucauuaccagaaaaaaagcagggcuauuuguuuguuuguuuguaaagaaaacauguuagaaauucucauuuggcauuuucuguaaagagacuuuucccccuugaaauacuauuuccaggcuguaucguggcuuuuaaaauagggcuuauugggguucaugucaacagugacaaagcaccauguuauuggcacuaaggaaggacuguucaagggguauagcggcccauuggguucaggaguauguauaaggcugccaacauaucucuuauggacugaaucuuuuaaguacgaucacuccagcccuucagggccaccuauaugugaggccauuauauauccaaaaguguuuacuguguccugucauugaauuaugcuaaauaccacacugaucccauuguuacuucguugcacuuauuaccaaucugucuaaaucucugcaaccaaagaaaacuaaacacuuuguuugaccauugcuacuuuguguuauguacuguggggguugaagacaaucuugaagugcacaauguguccaaacaaacccagaacaucaaacaagugcuugacucacauggauaagcagagagugggaggggguggagauggcaaggacggagucuccagggagacccaguggccaccaggccugacaguuuguucuauuuuugugccccagcagaauuagcaguggaaacuuaugaaccucugggacaguugcauauuguucucuggcuguuagugugggacaccaccauccuagaauguucgguugacauuugucugugcucccaaucuucccugucucuaagucugaaguaauccugugguggaaguaggagccaaacaaagaccagggcucucaccaaggauggguuuugugauacugcgguucuguacaugaauaggagaaugggucagacaggagaacaggagcuuggauucaaacagagucaggaggcucuguuucuugggugacucugcuacuuauuuuccauguauugucaauauaacugcugaacugagugacauugaaggaccggcuuuagcagugaccugccguucaccagccaguguucuggucuccccaccauccaagaugggguaggcuuucagacagauguuccuugauugggagaaccuacagucuugagugguccuguuucucaucgauuagcacagccuuacuucagggcaucagcauccuuggggcuccuaccaccuggcugccuugcucucuaggagugacagcugcuagcaucaccauccaagcauccauugcuaucucuauucccaaacaacuuccaggggcaacaaugaucaucacccuuauuauagaaucacuaauuauuaaauggcaugucugucccuucugggagggggauggggggcaguucccucaguggccauuagugcccuauuuaagaaucagauuuguaaacugagggaggacccugacccucauuucuuucuuucuuucugcuucucagugcagauucaacuaugagucggaggacaucaguuguccuagcgagcguuaccuccuguacagagaaugggcucacccucggaguauauacaagaagcagcccuuggaucuuaucaggugagcaggagagaguaguccacugagaaacacucagagaugcccugagguaugugcagggcagcugucacacaccauugccaaccagaggaguucacccagcuuuguguuacccauagguuucucaucccagggugucuuauguucccacagaagauggaucauaacuuaugugucucagugucugcucuuaaaucagggcugaaaccugcccuggauuugaucccugguacugaacauaagauccagucccuucuugcccugugguccaacggucucacuggucucacagcccagcuugauugacagucauagaugggucuucugggccuggccgacucucucuggagucaucucgugggcacacucucuuggccccagcauuuuagugggcagaaaguaucaguguguucccgccacgaauggaaagauucccuucacuuucaggaaaugcccagggauuagagauuaccugucagggacuuagaauucuuuuuuugcacaggaguaaguguuauuaacucaucgugugcuguuagauguuauuucauuaccucauaggaaaucgugacugcauggggcuugugucuuagaacauuuccuauuagaagcagguaguuugggcgcugugauguugaagcaugccucuguccugugugucugcugcagugacaucaucccugucuaaugacuugaccugcuuugugcagggauacuugacauguagcaucgugugcuccuguuggcaugguuuccuguuuccucugucuuugugaaggcaaaggaauugagugguccaguuuaucguugguuagcauggccucacuucagggcaucaacauccucggggcucccaccaccugcugcuugcugucucuauuccccaauaaccuccgaaggcaauagcgaucacucauuaaaaaucauuuguuagauuaauuaucucauaaagacucauuuaauuauuucauuggguccucuauaguccugccucguuuaauauuaucuggacuauucucacacagguguacuucugugaacucugauuacccuguagauaaaauaguauguggauguaggcauguagacaguuucccugggcauccaugagggaccucuggauccagagguauccagagccucugagaauaaggaaaccuguuuguaagaauaaggaaacccuuuguaaaaggacaucaucaccuuuacauggccugugcccuuccucccauguaccuuaaaucauuuuucaaucacuccuaauuccuaggaugguguaaaugacauguauguggguggaugcucuucugugccauguaaaaaggcaggaagaaaagucucaauaugaugaaugcagauggagucugcccccccccauccccaccccgugucuucaggccagacugggugcagucagcaugguagagcuguggacuccccacccccaccccuguguuaucaguuaccaguugacugaaucccuggguguggaacccacagauggagggcucacuauauuugagguugucauuugugugacguuucuguuuuguuaaugaccuuacauaggaaaucaguuguguagauggcacagcaagcaguagguugaacgggcucuuauuuucuuuuuuuuuuuuuucauuuuccuucuaauuuauugacucagauuuuuuauuuuauaaaauuaugaauuugauuuuguggugggcauacagcacugaauguuaaccaacagaaauuaaccacucucccaccaauacucuguacuaaccaacuuuuguuuuuccucaaucacguuucccuucccuccgacccucuccauaaucuggcucuaaaauauaaaaauaauauaaaauauuuuuuuguuucuuuuuuuuuaauuuuuuuuauuagguauuuuccucauuuacauuuucaauacuaucccaaaggucccccauauccacccccccauccccuacccacccacucccccuuuuggcccuggcguuccccuguacuggggcauuuaaaguuggcaaguccaaugggccucucuuugcagugauggccgacuaggccaucuuucgaugcauaugcagcuagagacaagagcuccgggguacugguuaguucauauuguuguuccaccuauaggguugcaguucccuuuagcuccuuggguaauaucucuagcuccugcauugggggccgugugauccauccaauagcugacugugagcauccacuucuguguuugcuaggccccggcauagucucacaagagagagcuauaucuggguccuuucagcaaaauuuugcuagugugugcaauggugucagcguuuggaagcugauuaugggauggaucccugcauacggcaaucacuagaugguccaucuuuuugucacagcuccaaauuuugucaauaaaccaauugcauuuguuaacugcuccuaccccguucuaacaguuuccuuucuuugcuucuccaguuaccuccugagcacucagguugacaaccuuugccuauaauuucaugggaucaucaaaagggcgaaauauaaccaggcggugguggcacacgccuuuagucccaggacuugggagguagaggcaggcagaucucugugaguucaaggccagccuggucuacauaguaaguucuaggauagccagggcuacauagugagagaccuuaccucagaaacagggggagggggauucuuucuguaaaagugaaccgaggaaaugagaaaaggcuuccagcccacaagcccuuuggcaucacuuaagccucuuucgaaguacaguaagaauauguuaaagacaggacaaaaugacagggucuuaccuccaggcaccaucccaagccugcuauuuucuggcuaucuaagagccagacaccaagccccugucauacgaaagugucaccuuaugcuccucucauguccuaauucuucuccaugugggugccagccuucccuuggagccuguggcacugggcugaccucugaccugggaucugguccagccuccuggggaucuaggcuaugcuucuagauggauucccuacuagaugagagucuuagugaggguuuuacugcugugaacagacaccaugaccaaggcaacucuuguaaggacaacauuuaauuggggcuggcuuacggcuucagagguucaguccauuaucaucaaggcaggaagaugacaacaucccggcaggcauggugcaggaggagcugagaguucuacaucucgucaucugaaggcggcuagaagucugacuuucaggcagcuaggaugagggucuuaagcccaugcccacagugacacaccuacuccaacagggccacaccuucuaauagugccauucccugggccaagcauauacaagccaucacaaaugagacucaaagagacuggcucagcuccauacuaaaccugaagacccauauacaucuccaagccuggaaacacuuaagugcacagaccaagacagaaauaaaagcagcucauagaaacccacaucacagugcugcccgggccucccucaccacucuggcgggaacagucuuuuccugcaucuugugcaucuuauuaccuacggucaggaagagagcaauguuuugugagagagagcaccuucacagaacgacuccuauuucccuacugguauuuagugccccauagguguauagguacauuuguguagagaagccauggucuggaugugggggugacaccauauggggucagacauguacccuguacuugggacaacaccugucacuaucuguagaguuuggguuuuucacggcccuucuugcauuuucuccaaguacucaauacagccagcugaccggaagacucccgcacagugaagggucuuucagaaucuguaccauggugcucaucuucacggagagcaagggauacccugugugccccaucugcaauucauuuuccuuccuugcuuuuaaauucacccugcuucugcucucuguuccauaguucaacucgggcgccugugaggcagagagcaugcugggagggugaaugcaauuggauuuuuucauuaaaaagccuccuuuaguuaaaaaccgagcagccaggcuaggaugaagcugcaccguggugagccucuaaaaauaccuucucucucccucucucucucucucucucucuccaggaaguauuacggcgagaagauuggaaucuacuuugcuuggcugggcuauuacacgcagaugcuccuucucgcagcuguggugggcguggccugcuuccucuauggauaucuugaucaggauaacugcacuuggagguaaucccacuuuaacccuugucaccacaguaauuagucugaaaguguuuccaggguuuuagacugucugggcaaagaagaacucauugcaaacacacauugcaucaucucuccccuuuguucugagaauaguaacaaagaaaauggaaaacauuuuucucagauaaucuaacacagcgucugauaggagaauuaugucuaggggauauauauauauauauauauauauauauacauauguacacacacauauauacacauauauauacacacacacacacauauauacacacauauauauauauuccaauauuuuauaugaaaaaggaaggacugaagauaagguugcccuugaacuucugccuucuaaggacugcuuugcacagcuuugcagaccugggccaguaaaagcucugaauucuuaggguccccgugagaaagcuggugcauuuccauguuuagaaaugacuuuuucuuaaauuaagagauguaugauugaaaacucaaguggcuuugugguuuuguugucuuacuuguacgagcuuaucccauauaaugucggaagggggaauaacgcaguaccucauaaccuguuugcguuggguacuggaauuuaaaugcuagcugcaucuuagauagugguucucaaccugugggucgugaucccuugggguuaaaugaccuuugcacaggggucauuuaagaccaucagaaaacguagauauuuacauuaugauucauaacuagcaaaauuacaguuaugagguagcaacaaaaaugauuuuaugacuacacuuuuuaucacuacaacaaaugaggaacuguauuaaaggguuauaguacaagggaaguugagaaccacugaucuaaggggggguugcugggugcugggaacacuugcuuuugaggugcucuuguuaauuguauuaucaugcaucugcuuuugguguucucuguugucuccugauggacuggccucuguccagguguaauuggguagaugguggcucacggacuucagugcugaggugaugacauuuuucaagcccugagcaugugagacuggcucugaggcuggaugguugucggccugauauagagaaacauugccuguuccacugacaggccacagaacccgugugcccaagauggcuguuggaagucuugucucuuuaugcgaaaaagaaucugcaacugaggucugaacucugcugccugcucccuccauuugucuucugcuucuucguugggcuaauguugggcuaacuccuacuuggcaucccagaauagaucuucagaaugacagggcuucacuuuuguaguguccauuuguguaugcauaucuguaugcacuggauggugacgauggugguggugguggugguggugguggugaugguguguguguguguguguguuagauaaguuggauguuggcugugguccaugcacaugaauacaggagcauguagaagccagagcagaacuuguaucuuccucgauugcugucagucuuaccaucuugagacagcaucccucgcugacccagaagcgccccuguuuccuaaacugacucaccacugaguuucugggauccuacugucucucucccccaguacuggaauauagguaugugcagccaucauuaagugggugcaggaaguccgacuugacacuguuguucacacggugcuggcuuuggcagcuaaaagaugaaagagagagaggguauggccucuuccuccacaguuucugaaagccacccaggcacaggcagaguggggaagagccggguuuuuuugcaugaaggcccugaggguguuuugugaaacugagaaagaaaagucuugauuacaggggagagcccaugagguggaagaugccagagccaugagauaucugccaggaagagcugcaugcagcgaguguaagcauuccaggaggcuugucccuugcagccagcagaacuggaugggaagagucauccaagcacuuugaaagcaaagucuaagacagcagauucagaacuaugggaucuguaguuuccccugcugguccuggucugucuuugguccguuauuucuucacugugccccugugccucucccuucagauguauaaucuguaccauuauaggaugaaagugugugguuugcuuuuugauucuuuggaggaggugcaauuaaggguucgccuuaauucucaaacgaaacauuggguuuaggacuuggaaauuucuguaaagacuauggagauuuuugagguuggguuaaaugcauuuugcuuuaugaugcagccguaagccuaugggggccaaggaguggaauguggugguuugaaugagagcuguuucccaguggcucaggcaucuuaacacuuuguccccagcggcuggcgcuguugggggagguuuaagaaguguggcucuacaggaggauauuacugggaugggcuuugagaguuuagagucucaccccacuuccaguuugcucccucugcaucaugcuugugguugagaugugaucucucagcuccuagauccugccacgugcagacaugccucugccauaaggaacuccucucuggagcuguaagccaaauuaaacucuccuauaagcuaccguggucaugguauuuaucacagcaacagaaaaguaaccaagacaacccccaaagaagccagugcccauuagcagugaucuccugaguggccauucccuuaggcucuagaaagcacuaaugcacuugguuucuauagaucuguggauauucuauagguaucugagaauauucuauagaucuuauggauauuguguaagucaagcuaugcagugcguggucuaucaugauuauauggccuccggugauuauguggcgucucaugauugcuuucuaccacucacgcugucaucaacaaguccuuuguugauguauuuauuaacaccccaaucccuuuuggugccaaaugauaucccguugcauggguaugcuacauuuccaaucuguacaucaacugauggaugcugggacgcucaggaauauuaugucugcugagaacauuuacuugacggguugucacggggacaaagguuucaugucucuugaggauauaccaaggggcgggguuucugggcuauauauaaagucucuguuugacauugggagacacuaccaaaguacuguccagaugccugcuguuuuacauccccaccagucaccuguagggacuccagauucuccagggaccaauggguacuuucuuugguuuuguuuuuguuuuggaauuggcugugaugguuuguauaugcucauuccagggaguagcacuauuaggaggugugaaccuguuguguagaugcgucacugugggugugggcuauaagacccucaucuuagcuaccuggaagucagucuuccaccugcagccuucagaugaagauguagaacucucagcucuuccugcaccgugccugucuagaugcugccacgcucccaccuugaugauaauguauugaaccucugacgcuguaagccagccccggugaaauguuguccuuuuuaagacuugacuugauuauggaguguguucagcaguaaaacccuaagauauuggccaucucauucgguguaagugguaucucauggcuguuguggguuuucccaaccuagacuggugcugagcaucuucucugaguuuaucacuggugugacuuuagagaaacgucucuuggaaucuucugccuguaauuguguugacuuggaauuaauaguucucugugugcucagcauagaagccccuugucagauccugucuucuucuguuucaaauaauaucacaacagacaggggaguuugugaguaaugagcuuuuuuucucacaauucugcguguuaggagcucaacuuggugucucuugggggcugggcagaguuuggaaggagucaauguuguauccuaccuggccugagagcccagugguugguuuguuuguuuguuuguuuguuuguuugucuuuaacuuacaugaguuccuccuucauucuugaugacuggcuucacagguguagaaucuggguacacagcuugcuuuuaugacuuagcaaacacugucccacucuuucuggacccuggguuucugacagggagucguguuuucuuucuggugagcuuucuggguggccagucaugucugccucugucucugucucugucucugucucugucucucucgcuccauucuuuccuaggacucucucucucucugugugcccuuugaguauggugucccuagguuugaaucuccuugaguguaucuuucuacgaucuugccgaguuucucggauguaaagaugaaagcauucaucaaaguuuggaggucgggcucauccuucaaugguuccuuuccuguaugcgacuugcccagugcaugugcugauggugugucugauagaguucccugguauuugaagcugacuuuucaggucuuuccuacuccuuuuucuuuccauuuuucagacuguauagccugaagagauacauuaaguuucuugucugcagaggagagccuuucaggacuuccgcauugcuguuacugugcuuggcuucaaugucuuguucucguuagcauacugcuuuccucauucagugagacgccgucacaucguuucuuuaaugcccgaggugugacuuccuuuaguucugaguucauauuugcucacuccugauucugaugcaccuucgacgggcacauugagaauuugacauuuuaaguauuacacuguaagagccaugggaaucagauuucccccucuggguuuauugcuacuucuuguugcaauuccucugccacccuuguuccuuuccuagacugauuccauggucuguguucccugccuuguaugggcacugaagucugugugugcaauagaucacuacacgccagguagauucagugauuccauccaugcuggguccuguccuuucuccuugccauguguaucgggaaugugucugacacuccaacagacugaauucuguucuccuaaggcuuccuuucuggcuuaggcagaaggccagggucagccuccaggaucuuucagaccuguccaggcuuaugcacucuuaucuagaacauaugcacguggccuccuguaucacacagauaucuuaaagguuuggggacugugguuacaccauacccacuucuuccuuuuagguuucauuagggcugauauggccacuccagacacgcuucccauacccauguuccucuggguuauuugcaaggucaccugggcagcuguaaugccguccaucccccauucucgcaguguccaucugaaauggcauccccucucagagcagucuacaaccccuggucuauuuucauuaaaucucaaaugugucgguaacuuccucugugguuuucguuuccauggugacagcauuucuccuuauccuaagauuguugagauauucuuuuguuguuauagucucuuaaaaacauuucuuuuauuuucaauuacauguguguguugauagcacaggugcccgccucccccuugcccuccaaagccagaaaggguaucagguccccuggagcuagaguuacaggcaguugugugcugcucucuguaggugcugggauccgaacucaggucuucuacaagagcaguauguucucuuaacugugaagcccagcucuccagcccugucuguuuucuuuuucauauucuguagcugucauucuuguuucucaaauagaauugacuuuuaugugacacaauggggcuuauuugcauucauguucuaucauguaucaugaauugagcugucuguuccuauugccuaaaucgggggccagaucuuuggauauagguaggaaccuuugcguguuuuauuuuaugcugcuguuggugguuuagacugugucagcugugucuaauuggucugguauggacuuugggucuucugugagauuuguagagcaauagaaaaagauccagcaagaauccugauauuccccacgcccugccaccaaacaauucugaaaucauagcgcagaucuuccucacuguauaugacaaaguuuuauaguauuuuuucauauaaaucuuaauacaucuuugauuagauucauucccaaacacuauacuugugaaacuacuaaaaaauaauaauauuuuuaaaaauguuauuucccaauuguuucaaguggauaaggagaaaaucucuuuuuauuucccuguguauacuuuauauauuaauuccguguccacaaacuuuacuaaaaaugcucuuauuaucucuggguucaaggugagaccuaaugcuacgauaaauacuaggaucucccugucuugaaaaaacaaaaaauaaaagaaauaaaccaaacaaacuaggaucugugcaggggagcgguguggucuucaguugcucauggaagcagaaguaguaaugugauucccacaucaaauucaaauagcaacuggagggguuuuauggagaacgguaggguccuggguggugugcggagacagcugggaccugugacaggcugugguuucccuccugcugguguucaaagccuuacauugaugggcugucugugcuuuacagauccaagcaaagccauuaggaggaccauuucucauagcccugaguuaagagaacgcuuggacauuguauggaauucucaaagaauuaguaaaagauauuacauuaaaauaugagcgccggagagaugccugagugguuaagagcacugacugcucuuccuauggaccuggauuccauuccuagcccucacgugcuggcucacaaccgucuuaucacuccagccccaggaggauccaguguccuggcuucugugcauauggugugcagacauacaugcuagcaaaauaccaacagaaauaaauaaaaauaaaggcuuaaaagauuugaaauauguuuuaaaaaaaccccaauuuuaaaagaaaggauguagaucauugacuguucugugugcuuuuagaguuucugauucauagguuucauuucaguuuuguugcuugucauggauggacucggauuuuaucacguugauagaauaugaaagccucuuucuuaacguuucugaguuguuuuauuucuuuuuuucuuuagcaaagaggucugugauccugacaucgguggccagauccugaugugcccccagugugacaggcuguguccguucuggaggcugaauaucaccugugaaucuucuaagguaacuuucagcauuccagaugugugcagaaaauagucacuuuagcauagcauauagaauuauucucccucugaggaauguauaaaggacuuucauaaaugaaguuucccccacgcuggaagguagcguccaguccacauguuuauucugcauuuacagaucauaaagugacagugaccacuucucagaaggcucaggggaaguaaggauguggugggccugaagcuaccuaaggaacucaguuaauccaaacggaaguuccaaagucagcuugaguagagauuuuguuuucucgaggcugggggcugcccuuccauggagcuguagccucagccauacguguaccauugcaaguguuugcauucauucaaaugaguagaagccuaaaaugugugcuuguagauuuguacuuaaaaacccugcaguuuguacagcuuguguuuucugcuuucagcacgugcagacacucuauaccuuuggauuuuuuaaaggcucuucugcucauauuuagacuauaucuguuacuauaaaaggaaaguuuuguauuuugaugauaaaagaugcuuggcacaaaacauccucacaaaacacugcugacaccccgaauacuggcugguggggugagcucuuaagacccaggaaacuugggucgaaccuugagacaggagggaagugugcugagaagcugugagcuuugacagacagcuugaccucuuaggaccgcaacguuucaaccuguaaagugggaaugauuccaccuacaucauaggcgcuuuaucucuggauguaaagaaauagccugucacaauagacuacuggucucugauaugaauuuugucuugccaugggagaccaggaaucguguguuccuggagcauucugacauaaucuaucaaagucugucauuuaagaguaaugcuagaguauuaauuucuuuuugaacuuuauuuuagacuuauuuaugugaguacacuaucgcuguguagggcauuagauucccaggacagaugagauggucaugagccaccacguaguuacugggaauugaacauaggaccuauggaagagcagccagugcucuuaacuucugagcuaucucuccaucuuuuauacuuuaauuguguguguguguauguguguguguguacacaagcaaguguuaaagugagaggagaaauuuuguggaguuguuucucucuuuccuuuuuggagagguuccacaucacagacuugugcagcaaagcaauuuuuccugcugagccauuuugagaguacucuucaguguucuuauacugauuacaucaccuuugacacauagcaccugugauguaggcagaaucacucucccauuuuacagguugaaacacugaggccaugagaaacuaaacagccugugaagcucacacaguuaggaacuggcaaggacaggagcuacagcagaucugcacugcccaccaugccacauuucucacagacugguagcacugggcacacaacccugaaauccagauuuguguuugaaaaacuuuccccacuacuaguuaugaugacaguggcacacugucagccuaauugauuucuauacuuaacuaagauuaaagaggauuuaacugccugucccuugagccaaggcagugcccagacugaacuagaagacugugcagugauuaguaagacucaaggaagccgcuggcugauggcuuuggacagaugaaucacaggcaguuguuagcgcauuuccccaaggcucugcacccaagcaguagccguguacccacgaagccacaguggaaggucugcucugaagacauccauuacacuucccuccccucgccacuucauuccuucggcucuaccuacaguaccuuagcugaggacuuucaagugucuuucauuguucgggguggggguuggggugugugugugguggucuuugguucugucauguuuccuaaaggauuucuugaaucuugugggagccauuuacaaagcgaaggacacauagauaagaaucggagagaaaggaugaaaggggugggguaagggugaguggggugggguaaggaugagaggagcggggcaaggaugagaggggcggggcaggaaagauguuucugauuucuuccauccuuauuacauugauucacuuacugauuucugccucuccucugaagagcuguucacuugugacuccaauaaaaugcugacuuggggcugcucuuaauguagccucuggaccacugugccagcucagcugcccaucaagauaagcuaggcuucuaagcaagccuguaccuuaccaucuccccuacuccugcuuccaaagggcucucgggacaaagcagagagaggccacauaucuacuuaguagcauggcagauucaucuaugcccaaucuugcccugggguaccaggcacaucccucacugggaacuaggcaguuggccugacuuguaucaauuccaaaaugggagugacaguggauggggucuugaggaaggagauuucacaugugggauauuucucacggcacuuugugugaagcuauuugcuguaaaugguugaaggacauuucagagcaauggguccccaaaggcaaagagaaaagauacagaaagcaucauuggugggacauccaggcauaacaaguauaucuuccuucaccuggagauuuuucuuuuuaaagagggguugucuccugaaaccauuuagaaucaugcuguucggguaaaguucacauggaugagggaggcacuugugccugcuauggaaacccugaggauaagaauguaacuagauacauaguuucugaucauaacuagauaguuucuaaugaaaauaaacaaugacuguguucgugaaaaugacacagcuuugaauauaaaaggcaacugaaacaaagaaaccuaucucggcagaguacacuucccacuuagaaacaccuuugaaugucacaguuguagaaguuccccuggauccucuucauggcccccuuauccccuuuacucuucccauggccucugguaaaacaggcagacagaacccacugcucccacuuagccauuaacuuugugaguccuuccuuaaggaaguuuuuaagugcucacaaaugaaaagaugguaacugugaugguuuguauauacuuggcccaggaaguggcauuguuugaaaguguggccuugcuggaguaggugugucacuguagguguggguuuuaagucccucauccuagcugccugaaagcuauuuuucucuuagcagccuucagauaaagauguagaacucucagcuccaccuauaccaugccugccuggaugcugucaugauaauggacugaaccucugaaccugcaagccaguccuaauuaaauguuuuccuuagaagacuugccuaggucauggcaucuguucacaucaguaaaacccuaacuaugacagaagucaauuagauuuuuuuacccagccagucauaaaggcaggcagcuaggcuauguauccaucaccaaagagguggaguuuggcagccgugguagcuccgccucagugagacaguaauccuuucugguaauuguaccagugccaucagcagaagcaccugcauugccuugaucccacugaaaauccucaucaucgcuuacagaugcaaagccuuccucggguggguggaagcagaaggcuccuggaggagagccaucacuacauaaacucagcuuuguauuuuuuuuuuaauaaggaaaggaauauuucuggaauuuauccucugaggggacugagacacugauaagaggcaaaccauaaacuuacuuagagggcacuggauccuuagagccguucgcuacguucucccacucacucugacagcucauaaaagaggcuuuaacggccugcaaucuuagcagaugugccuaguccuuuaucgccgugugggaagauuccacuggaaaauguacucaaggcucagacggcgaaagcuguuugcuuuuaaaaugcgagaaauuccaucuguggguaugucauacguguggugauuguuaaaccagcauugggcucagcaaacacugcaggcugcagaguguacgaaguguuacguauuugcugaauuucugauaagugaggaauugauuuauuuaugccuugcugcucuguuuuccagaaauugugcaucuuugacaguuuuggaacccugaucuucgcuguauuuaugggagugugggguaaguuacuuucaguuuucucucaguuugauggugucugugcaauuuuguguaagcuauuaaauucauguacuuuuaggaccauguucuggcugaaccuccauuccuccagagcuuugcugguaguugucauucgauuuuacuguaugaaaauuuaccucagagauccauggcuucaaccacacacgguuucauucuuuuuuguuuuuguuuuuuuguuuuucuucucucaguucccugagucacacauggccugaucucuguggugagccauuggcuucucuguaaagaggugauauagcaguaagaagccuggccuggucugugggguuccaaauggugucacccucaaauuaucuagccuaggauucuguaugggucuucagagauacaaaaggacgcaaaggaccacagaccucaauggguuuggcauuaagguuauuauugacauuuauucuuugagaaugucauacaauuaaaucuggucauauccacccccugcuucaugucucaaguugcccccgauccuccccacugcgucuuccucucaacuucauguucuccuugucuauucugaaauagcucacuaagcccaguuggcgcugccggggugugcaugggcucuuggccagcuucuggagccuaggcaacccuaccucuggccaacccuccagaggagaaugugucuccuuccccaggcagcugcugaaugccagcagcuccuccaguagagaugacuuuugugagcucaccccuagucuauguuguaauuuggauuggcuuauugugggcaggucuggugcagguaaccauggcuacuaugagucuguguguauagcagccaugccuuauccagaagauaauauuucaugguacucuucccuguccucgaaccauuaaauuccuccccucccgaucccccucuccucucccuccucucuccuccuccccuuccucccaguccucccccuccuccucugcagugauaccugagccuuggcaggggucugguaagagaugucccauuuagggcugagcacagggaagcagcuuuaccgacauggagagcauccuagaacuauggguuuaaauuaaaugcucagacagcuuggcugcauggccauuuagcaaagucccaacaguaggucccaccuuagggauuaugaucgccucaggucugggcucuuagcucggcuuagaguaccaggccugacuucuguccugugcagcacaccccaaauccaaucagaaggcaacuggcuacccuauaaaagucaugccacaacugcacccuggguacccacaagugcaacagcgacauugggcccaugauuauaguauuugcuaauguccuggcagcugaagcagcaaggcaggcauccgagccugagggauggaguggaggaaaggacccaggggugugagucacuggaggccaucacuguuguuucgguguccgucgucucaaaugcuaagaaccagagcuccucuuuccccugccccucccccucuccuuugacuagacaaucacaggaaccucguuaguccccaaauacaaaaucuacaauaauccaaaaucccaguguuaguguaaaucagcgcucagcauguuuccauauuccagguugguagauaaggaaugcuuauucuuagacuauaacaguccccacaguuagaauucagccuggggcaggggcagcagugaggaacaggagaaugcccgugagcuugcuucuuuuuauaguuuuauaggaucggaaaguuuuuaaguauauuucacugugguaauaauagccaguucucuguaauagaaaagaugcgaucuugacgcguaaguucugccuagaaacuggauguuguuugucccuuuuaacguggguagcaucaguaauauagcgaggaaagcauuucauuuaaaagcagaugucugaguguuugauuggcguaaauacucuaacguagaggaaaaugucccaccaucaaggauacaugcauucgauuuccacuugugucuugugcauugagaucagcaaugucaggucacaggaaaguguggggaagaaaccaggccacaccucucagcuugaaaggcaagucuuuagugugugcacacacacagaguuggggauugggguuccuugcagggcaggugguggcuuuaccugugaagggccaccgaaugguacauuguacccuuaagagauacauuguacccaugugcugggugguauagagagaaucuuacacaucuggauggauguuauaccugucaauaauaaaucugaccacuuguagccuagguaggaaauagaaggugggagggacaccugggaggcagaaagaauucugggauagcacaggcagaagaucagccugggaagaugugacaagacaggugcaggguaccugagcacaguuaaccaaccagccauguggcagaauguagguuaaauuaauuaggguauuuuaguuuugaucuaguuagagccuagcuauauggccaagguauuuauagauauauuuuugagucugagucuuuauuucugggaucacgggacugggaguaagaacugggccuaacuucuacaggguggugguggcuggcacacgccuuugaauccagcacucuggaggcagaggcaggugaaucucugaguucucugaguucgaggccagccuggucuacagagcaaguuccaagacagccagggcuacacagaaaaacccugucucaaaaaaaaaaaaacuauaaauaaauagcaaaccaaccucugaguggcaaggagagagggagagagaaaagacugaccuguggauacuguucagggacaccgaaaucuaaggugaccacacuuacccaguaagaggcccuguccuucagacacuuggcauguuuuacuggaaaccaugcacugagagauauggcacagaagcauagagcaggcagggggugcagcucagcaggaggaugcuugccuaccgugccuaccaugagugacgcuuugggucagauccauguauuaggacccucuguguugcccuccacuguuguaaauacaucaccuuccuccaguaguagccagggagcuacgcacguaggucaguacucuuaauguugugugagccacagcuugugaucucuacagcucuaacagaagacauuuuaaguaaaaggaaaaaauauauauuaauuuugaugaaggaaggacaaagcccaaauuucccuaaguuuccucucucugaucguuaacugcacccugguuguagaacugucaugcaucaggcugucugccaauccugucugacuuuaggaugcagaaagcgucucugcuuuuugcuugugguaucguauguacaucuuuaaggauauccaucugaugaacucucuaagugcuuuacagcaguuuccucauuacuucugccuucugaggacuacugcugugaaccucauuacagaaaagucugaaauugcagagucgaggcggcaggaggcucugaagucauugcuagccucugccaauccuguggcagcuccucccgcacagcguaucuggcacggacuaauucuccguucucuagauggaaaugguaaacguugagggcggaaaagcuuuuauaaucuuauauaguacuaaucacauacauaccuagaaauagcccgcauuuaggcugcaccaaccugggagauuugggggaauucgugggauccuaagcacaagcugugguuaaaacaaagauucugaacacaucccaaccucauuucuccuucccugacuuucccuggcuuagacauguggucauacaauaccauuuuuuaaugaucacauuuaagggagaguuuuaaacaagguguagugauuucugggaaagauccauggacucagaaagcgcagcacccacacuugggaaucaagaaacuggucccugggccggagauguuccggaugcucucgcuucugucucuguuucagggacauacaaccauggcuaaugagcauuuuaagucauuucuaguaccccagugcaagagagucuggguuaggaagguggaauggggcgagaaagccgauuuaccauauagaacauuguacauaacggcaucugaagaguuuuaagacucauggcagagucugaaugcauccaccuaucagaguuuaugucuugcccuuuuauguuacagaauguaacacuauaccacgcucaacaauuugguuuuuguguguguguguguguguguguguguguguuugggcaucuuuauccaauacauacuuucuuagauagaaugcugucauaauuaagauaagauccaugcaucacccccucaucucuuauuauguugguggguacuggcagaauuuuaacugcaucuaguugaccagagcggugguucucagccuuucuaaugcugaaacccuguaauaaauauaguuccuccagauguuguagcccccaaccauaaaauuaaugaauugcuacuuuauaacuguaguuuugcuacuguuaggaauuguaauguggauaucugaugugcaaccccugugaaagugucaccccucccacccccaggggguuguaaccuacagguugagagccccuggccuagagccuccugguauauggugugccuggguacugaaguacaguggagcccagcuuguuauauugcagagacauggagcaaaagauacaggauagcaguuccucccauuugggacacacugcauauugaauaacccugauaacucccaggaauacuccaaacauuggguagcugcaccccauagaguucucggcugugaacaaaaaugaagacucucccuccauucuuguaaccccucggggcuuaccuucaagguugagacucuaacaaccuggccacuugcucgcuucauauccauucacuuccaagggugaacugcccaagaaguaggcagcuuccaacccuuggugccagggguaggguuagguagcugcuacuuucuccuuaggaguugguuagaauuguucauguugcuuuuugagaguaaagguaucuucaugaauccucuuccacugguagaguuguuucauggagucugcgugcaugccaugauuuuaaaagugagaagaagggcagguagcccgugaccacccagacagaaagugacaagcacaaaauaagagcucuguagaaagcuuggcuuuucccaggcuucaaucggugacagauaaaguguaagccacgcaugauggcccgcccuuuaauuccaacacuugggaggcagagguggguggauuucucugagguucaggcccaccuggucuacauagagauuuugaggacagccagggcuacauggagagacccugucucaagaaacaaaaugacuacaacaaaaacguucauuaagaaauuugcagcuagguucuuagaaagaggcagagauguuugguuucauugacuugauuacauuuugaugugauuauguuuuguuuaggguucagaaaaguagggaugggcaaagaaauacuuucucuaagcauccuuggaacuuucuccaagguagauccuguucuaagacacaaagcaagucuccacacgucugagaagauuggaauaaccguagaaaagaggugggacaguguaaaggcuuagcagaggauccauggagaguccccauccccgguuuuaggccacuuacucaucagucuggcuccagaggauccaacaccucgggccuccaccagcaccugcacgcgcaguuuuaaaaauaaugaaaauaaauuaaaaaaccaaaaagauagacucuugaaaaucaaacaacacacuuuugauugaugaaugaauaggucauugaagaaauccagaaagaacucgaaaaaguuccuagacucaagugaaaauuaaaacacagucuaccaaaaccucuucaguacaaugaaaacaguugucagggcauuuauaguugcaaaaauauacauaaaaaauauaggagaggcugcaaauaaguaacuuaagguaccuugagggcuuggggaaacaaaaagagaaucccccaaucaguagacagaaauaaauuaauuaauuaaaugagauacaaauuaauaaauuagggagaaaaacaaacaaacaaaaacaaaacaaaacaagggggcuggagagauggcucaucaccauuaagagcacugacugcucuucuagagguccugaguucaagucccagcaaccacaugguagcugacaaccaucucuaaugggauccgaugcccucuuuaggugugucugaagauagcaacaguguacauaaaauaaauaaaucuuuaaacaaaacaaaacaaaauucaaugaaacaaagcaguggcccaggucaacugacauagcagagaguggggcaguguuaacugggugcucaaagaugacuggucccuuaagccaagguuguaggguacccaguuucuggcacauucccuucaauguaugcaaucagugcauuuguuaagcucaguugugcaucugugaacaagacauucccucccccaugacagugacagguaggcauggcagaccacaagccuagaagcaaauauagaccaggcuuacauguugcaugcguugacgaaaagagggugcugacaggagaaaugaagcgcuguuugugagagggcgcacuuuaccagaaggaccucagacuuaggagacagaguggagucaacuucuggcauggggcaugcuuggcagaguacuuggguaaguugacguaggccuccgugggacuguguggauguuuaccgaggggcuuuaauuccauagucacccuaagaggguugacccucacacucucaagaagugucugucacuugaggcuagcauagcuccuguggguugucacagccugcuccacccaacagccuagcguccugaagguauuuauccaguggcaagcaguuaccucaucuccccuuaggcaaguucaaagacacugaaggccugaccauuuucucaccuucagugggugaacugauucuaacugcccaggccauuucuaccacugacuaacuuguuggugaaguacucaaugcaagccugggaacuggguccuugagcaaaguguugaauucuugcuccuccagcauccuagcuuuuccuccaagccucaggcuucccacucugcccugcagcaccaacucucaacccuaacugcugauuggaagacaagaaacacccgugcucaggcagcaucccuccuuccagaccuguuaagccagaaagacucucagggcuggugccugugcucaggacuguuuuaaagcccccuccccaccaccaccacccuccuaauugccucuuaugugcagcccaagugagaucugccacuguacacaccucauuuagccaucccuccacucccagucaacacugaggacuccugacuuggcugggucuucucauuccucuagacuagacaccugcccacgggcaccuauuaucacuuacugucuuaguuacuuuucuauugcugugauaaaacaccaugacggaggcaacuuacgaaaguguuuacuugcgcucacuguuucagaggguuaagguggcaaggcauauugauggcgagcgguaggcauguuggcuggaggagcagcugugagcucacaucuugauacgggaauaggaagcagagagagagagagagagagagagagagagagagagagagagagagagagaacagagcuuacugggacuggcauuggcuuuugacacaccaaagcuugcuccagugacacaccuccucuaauaaggccacaccuccuaauccuucccaaacaguuccaccaaguaggcaacaacuauucaaauguacgagccugggggaucauucucauucaacacccgcacagacccagugucgucuuucccgugugccccuacacuacacuaggaucaaggacucugcucaaagcagaagccuggccugcauuguccucuuccagccccuucauuacaccuugcaucuauccugucagcuucaacguccuucacacgugcauccuuaucugguguuaccuacaauguaggucccccugugccuguguucacgcaagaccaccaccagugcccccucccauccuuuguuaaacuccuggcuccuuuuggggucuauacuauucuuuguaaggcgcccuccugcguaucugucacuuggcuggcccaucuuccucaucuuaacgcugcagucagagccuggcuggaaagcaccugguguccuggccuccuugacgugggcagcucgaugaggaagauaaaccuuacaccugccaucuuccucccugaccugaucaugucagucaucccaagaccuccauggcccccuccucuggaagucugucccuggaggucuggaagucuacuguaguguuuucaaccuuccagaugcugcgacccuuauaccauaaaauuaucuuguugcuaucucauaauuuugcuacuguuaugaauuguaauguaaguaucugaugugccagauaucugauaugggaccccugcaggggugugacccccaggcugagagccacuggucuguuggccaagucuagcaccaucugcucuugcuugcucugcugugccucccaucuccaugcaucacaucgaagucccuuuuucucuuucuuguucucagccuguaguggacacgugaacagucauugugaacagaaccaugguaaugucagaauguuuaugugagaaaggcuagagacagugcacuaauaaaagggccuaggaaacugaccuggaagccauaucuccauuuaauguuugacaguuuuaggguuuuuuuuuuaauuagauauugaaaaauaaagaugccuaauugcuucauguuuguacaaaauugagaaagagauugguuuuccauguaaaaauauuguuuuagcucauuuagagggcacuagaauguucuuucuagcccagucccagggggagggaggaagaggagugcggaggacauaaggaagggcugagccauggaccaagcuugaguaggggauuacuuguguguucaguugacgaaguguggguugcaagcuuugugucugacuuacacacuugccuucugacccucccuguggcaagcuuugugucugacuuacacacuugccuucugacccucccuguggcccgacucagaacaucauguuuuacaguguuugcaaauuacuaacauuuucauuuaaagaaaaaaagaaagaaaagcacuuccugccuuuuaaauguuagcaucuccuauaaauagacugcacucagcacaaugaggagugguaauucccagcauggagucugacaccaaccuuaaagagccacacuguccucuucucuccugucaguuacauuguuuuuggaguuuuggaagcggcgccaggcagagcucgaauaugaaugggacaccguugagcuacagcaagaggaacaggcccggccagaguaugaggcccagugcaaucacguggugauaaacgagaucacucagguacgugucuguucugcugcagugcagugcucuccuaucccugcagguucucagcaaggggaugcagugcagugcucuccuuacagguucuuagcauaaugaugcagugcacugcacucccuacagguucucagcaagguggugcagugcagugcucucucugcagugguucacaaugugauccaccaggccaucauggggcuugaacaguguaggugccugagcccaucauggcaccauugaggugcugaguaucccagaugugucuggacacugcuuaggacaguguauguagaagaccacuguggucccucucuuacaguaacaguaaaauggguauauuuuagagagugaaaggggcgugguuguuuaaggaagccauguuggcauguacagaugagucucagucaucacaggcagcuuccuuacagccaguuaucauccuaggcuagcccagcugcccuucugucuugugcucagccucagucacuggcccagguuuugguugggcuguacacaaaauaauccugugacucuuauccuaaagucauaagggguugaaggacgggaaugccuauggcccuacuguguaccagcacuguguguggcaucugucacuggaagagucugccuguugucacuacugcugccaaaagaagaaaucucccccuaccauccccaaacccccaauaggugauuucuggauguuugcaguauuucugucaacagagcuguucuuagucaucagugugggaaucuguucccacagaagguuuugaauaggagccaccacuccuggaaggaaaauucuuuuaccaagugucugaaauguccccaacuguaguuuucuaagucaguacccuccagauuuucagacugugggugcuauaagggauggggaacaccugagcauccucaucuuauaaauagcauagcagguaacauuugggaugcaggaagcccccauccugaauaaugacugcugugugcuagagaggacagggcaggaccuaggauauuccaguaugaaagcuguaacucacgcaaugacaaagccuccagagaaccagaggggagaugguccggccauuuaaaauggucagcuaaugaaauaacccccacccccaccccacccccacccccacccccacccccaccccaccccgugaaaugcuguuugauaaaauuuccaaaugaaauuucacuguucuuuauuccuuguucuuccucuguugccuugugcauccuccuggguuagagagcagaguccugcgcugcugacacugcaagcugaggcucagguccuaacccagcagcuuauggacggacugaucccagaucugcgccucaguccccucauccauaaaauggacgugauagagugucagugcugcuauauugaggauuggggagaggggugcaucugaaggucacuucggguaccuggcacagagugagcaccagcuaagguacacaccuggugcuacaccucuggcuauucuucugaggaaaucaggaagagucuugucuuucucucuugguaaauuauaagauggaaacucuccagaaguucauuguuauaccacacuaauauauaaaauuugagcagggcaugguggugcacgccuuuaaucccagcacuugggagccagaggcaggcagauuucugaguucgaggccagccuggucuacaaagugagauccaagauugacaaggcuacacagagaaacccugucucgaaaaaccauaaaaaacaacaaaacaaacaaacaaacaaaaaaaaaaccuugaccagaacccauggcucugauggcugagagccuuugccaggugaguaaaaauccaccaccaaaacaagccaacccugaacaagaccucucugugucuaucugagauuacuaacuaacuaagaggucacaagugagaacaguaugccagcaagcugggguugguuuguuuuuaagucuaagaucuguugaugcaccccgagaugucagcagcuguguuggugcugcucccuugaccagccauuucuguucaccaggaggaggagcgcaucccauuuaccaccugugggaagugcauccgggucacgcugugugcgagcgccgucuucuucuggguaagaugucucgagccucuguuugaguaacuguuuaacuuucuuuuuauuacaugacacuuuuuuuuuuuuuuuuuuuuuuuuacuauuuccuuuaaaauauugagggaagugccaggcagguauggugccuacauggucuccucuagaaagguguaguugcugcauggucccagagagagauggcgcuagagcacucccuggcugucacguggaguauugccaggucaggguuccuucuccauuguccacuguggcucuucuguuccuucacucaauuccugucagcagaucagggguuuccggcaauuacugaagagcccaaguaggaggcagugagaacucuaagaaauugcagcagcaacaacuaaauguuaauuaguuaauguuuaaaucuuaggaauuaccauaccaaaaagauaagccaaagaagaagggauaagggcuggugagauggcucaguggguaagagcacccgacugcucuuccaaaggucaggaguucaaaucccagcaaccacaugguggcucacaaccaucuguaaugagaucugacauccucuucuggaaugucugaggacagcuacaguguacuuacauauaauaaauaaaucuuuaaaaaaaaaaaaaaaagaagaagaagggauaaaaacuaaagaaaagaaaagagguuuuaaaaucucauuuuagacgagaaaaaaaauugcuaaauccaucagacuuuacaaacuagcucuguuuguuauuaauaaaagcauauuagcucaauagugguggcguacaccuuuaaucccaguauccgggaggcagagacagguagaucacugugaguucaaggccagccugguccacagagcaaguucuaggacagcuaggaauaaacgaagagaaacccuaucucaaaaacaaaacaagcuaacuaaacuauuaguaguacaauuuaaugacaguuuuguuuggcuuaggauuaaagagauuaaagaaugugacguggcagccggauccaggcucugaggcagggauuuaaugcaugaggaaugaagacucguagcuccagagugaguuaaugaacacuggaaacaccugcuaguugcugaggcaaggaaggcaaccacuugggauggcaugccguaacaaaugccaaaauaccuuaaaccacaagccaucaauuagaaacaaaacugagugaagguacuuucugggucuaaagcgacuuuucuaaacuccacuagcagcggaaggcauuuaagaaaagucagauuuugacacacuggauauaaacgaaauacccgaagacauauaaacacacgggaggugacacaaggcugauaccuuaggauggaguccccacagcugcaggagcucaguagcaggugacagcacacguaugcaccaaccgagaaaaauacaguggcccauauaggagcgcauccugaaccugguaggaugagauccgugcucauugcacauucugcucucugccucucgggggcgccaugucgaggugacgggcugccuugucagccucucccacuagagcaggugauuuuguuucucagucuuuccuagaaagcagguggcucagaaagauguguguguguguguguguguguguguguguguguuagcuuacuuuagcuuuuacagacuguccaucaagaaccaccucaaaguccggaguggccgcacugaucugucaugucaguuuucacagauccaagacaggauggcuaauccgaagucaucuugggccacacagcaagaucuugucauggaagggauagguguuauggagaggcgagaauauuuucacagacauuaucacauuuuauaacacaggugcucacacauaggccuauacacacuugaacaccacagccuaaaauggcuuacuucagacucagccagacaguggaaggcugcauuuccauaaaaagaguuugcucauggaauauccaugaugugugauauuccuaagguuuaugaugaauucaagggaaagaaagauacaaaugauacaaaagguggcuuuuaaugugcaaauaaggcauaauucugaaauaauuuugcuuuucauaguuaucuuaccuauuuucuugaaaguacuuuuuauaauuaaaagguuuguuuuugguuuugauuggaggugauaaagccaauuucccuuuaguguauaugauagugacguuggguuucucaguuucugaaagucuggguauaauuuuggugaggucugguaacuacaacuuaauuauccaguagguacccagucggcugaggguuuagagagguugacucuacagaggaaaggccagcuucucuccucgagggggaagggaucuaugucaguccacuguggagcucuguacagugaucugaaauaugucagaguccgaaaaagauaaaccugaggggugagugugcccugcuccaagaagaccaagcaaacccagcaaagucauggagcccuagcagguuuuauaacagcccuggaagguaccagcauuuguuacccaagccaagggcggggcaggccagugggaagcagagcuuuggaggucugugucugacucccacgcuucccccuccugugggcuuaaucuagaacaaauuuuuacucuuucagccuguguggcaucucaggcuucuaacccugccuacaggguacagacuaauuagacaauccaccggcaaaagagugucgagguuggcagugagggcucacuccaagggugcucuggugaugaauaauuacaaaaguaacuggggguagggaguggggaauuauuagcaagguuuuuauuaaauggccuguuugggaaaaaggcagugacuucuuccaucagcauaauacaauuuuucucagccuuaguuaauuuacacaugugcacacacacacgcacacgcacacacacacacacacagauccuuuucauuucacaagacuuaacugugaaagaggaaaggagauaaugagcgagaauacagggaaauacaaugccuucucuguaugcagauggcacagcaaggaaggaaacgucuuuuuuaacacuuuguuugccauggucauagcgaauacuacccagugcuaguccuaggccuuagaggaguauucugcccauuguauggggagugugaagccaggggaguggggagggggguuaacauguucagggguccgcagccagcggcagagcugggguucccaugcagggaucuguagcuccucuucccuauaaguugacguagggugugccuugcuagguucuggaguucuuggucucuguagcuccccgcacccccaccuuggcugucaucaugagcaaugagacagagcccacgguacuaaaguauauccaaggaagaaaccacagggacaaaugguuuaaaacggccucuccgacgguguuuaaaccagugcuucucaaccuuccccauccugugaaccuuugauacaguuagucccuugugcuguggugccuccugaccauaaacuggccagaggaagcaaacccguuuacugagaaaguaccaucauguguaggcucuguugagggcacccuggugauccugggaagugggauucagaagugcagcagguccacagagcggagcuccuggggaugcaggugcgcaugacagcucagggacuccugagugugaaaccaggagaagcccuuaaagcagagagcugcugccaauaccagcuacccgguaccucggcuggugcuccagucagacccugcugcucccgugguaaaggcaaagccagcccccauggacuguucguaacugguucucugaugggagggauggacugcagaaacccuggcuaacuacacaccuaagggacacuuucauagcuucugggauccugaacacucuuucuacuuaggacagugguucucaaccuuccugauacuccgacccuauaauacacuuccucauguuguggugacccccacccacccacacacacacacaacuguaaaacuauuucacagcuacuccauaacuguaauuuugcuacuguuacgaauuguaauguaaauaacugauaggcaggaugccuguuacaugaucccugugugaaagggucacuucgccuccaaaggagaaccacugaucuccaagguccuccaccuuugugcuaucugaagauaaugcuccuuuugacauagacauucuuuuaaaaaaaaaagauguauuuauugauuuauuuauuuuauauauaaguacacuguagcuguacaggugguugugagccaucaugcaguugcuagggauugaacucggaaccucugcucgccuccggcccucagauuuauuuauuauuauaaauaaguacacuguagcugucuucacacacaccagaagagggcaucagaucccauuacagacgguugugagccaccaugugguugcugggauuugaacucaggaccuuaggaagagcagucagugcucuuacccgcugagccaucucuccagccugacauagacauucuuuagugacacuuuacaggacaauuguacagaacacacagcaagugacauaccauguccucuccugcccggcacacagugugacuaucaauagcaucccucucaggugggugcuuccucuuugguucucccguuucucccuacucuacccccauuuccucucguggcacuuaugugagguucuccccauggggcacccgccccuucauuaugugagcauggguccagccccagugcggcgcugacugacuccugcggaggcucacgcugcggcaucgcugaugguuucagauccugcucaucaucgccucugugaucgggaucauugucuacaggcuguccguguucaucguauuuuccacaacgcuccccaagaaccccaacgggacagacccgauccagaaguaccugaccccacagauggccacauccaucacagccuccaucaucagcuucaucaucaucaugauccucaacacgaucuacgagaagguggccaucaugaucaccaacuucggugagguucugccuggaaagccacugagcuguucucauuccugcggguuaagaucgguagcgacuuuuccagcaugagcauaucgcucuaucccguacgggaaguaagcugugcgcaugcgcaucuuuguauuugaagagacaacggaggucauguccgagcucuauaggcacgucuggcugaagaauauguucaguuccauuagcuccuguguuccgccacugaaagcacauggugucuuuauugcgaacaggcagaauagggucucuguucugcuccaagcgcacgccucugucacagagcaaacagucacacuggugggugccugcugucucccaggccaccucuguuaacgaaguucucuucagugcugcuugcuguaacaagugccgcuucuggauggcuugcgucccaggcagcugcuucauaacuagaguugggggcuucccaaaugccucuagccaguuacuccugccccacuguuuccaucagaucuuacaguuccggaagacgaaagaacagucuucgcuaggcauuucagagcugauuuucuaagggguuggcggaguugcucuguggcacaggucguggguuuaaucccuagcaccacaacaaagauagcuagagauuuuagaaccaaaacaguucuugcuaguauuugauaacauagcauuuauagguuuuaaggagaagugugcgugcgugcauguguguguguguguguaugugugcacacauauaugugcacguguaacuugccaugggggguaucauguuuauuugcuaagagaacgcaaaacaauguguaaacucagaauuaacacagcagcuauauuaaggaauggaaagcagauuaaauugaaacagugugaaucguauuucuuucgguguguguguguguguguguguguguuaucugggguagcggagucuuugcuuugggucucagcgcuguuuggaaucucagcgucucucuuguugaucugaccgcagagcucccaaggacccagacggauuaugagaacagccugaccaugaagauguucuuguuccaguuugucaacuauuacuccucaugcuucuacaucgcauucuucaagggcaaauucgugggcuaucccggggacccaguguacuugcugggcaaauacagaagcgaagaggugagaaaaacagacauguuacucuccugacggcugagucgucugcuugcuuucucucagcugccuaaugaauagugacuuccuuguguauuucugagauauuuuuagccaagagaacaaauagagauguuaaugugacgcuucuuugcaaguuacuacaccuggaaccuaaauguuguucucuuuguaacacgccagugugacccggggggcugccuccuugaacugaccacacagcugacgaucaucauggggggaaaggcaaucuggaacaacauacaagaagucuugcucccgugaguacugcauaggugguccuggguggcaggaagggggacaggccagcccacccacugaaacaguuuacccauggagccaugcgucugucucaaaagcagauuagaaugcauugaaauugaaggccucugggcaaaagguccaaccggggaguuuguuauguguuuaauaauuauauagaaaagcucagcagacggcucaguuguaaugugcuuccuggggaauuggggacucccagugcccauguaaaaaaccaggcacucccacaaacaccugcccugcaguguuggggagggagaaccaagaggagcccuggagcucacugggcagugcgugagcucaacuggggagcucugggcucaaggauagaccaugccucaaagaaacuagaggaugaagauugaggaagacaugugaugucaaccccuggacuuuacaugcuccugcacacuugagugcacacccgaacacacgcagaugcacacaagcacaaaugguaguuauagaagaccuucaucuucaucucuaacagaaaucccaccugcuguaguuuaugucucucauguuaucacugagauggcuguguaaauagaccuuugagaaaggguccuuguggucuggagagauggcucaguggauaagagcacugacugcucuuccaaagguccugaguucaaaucccagcaaccacauggugacucacaaccaccuguaaugagaucugacucccucuucuggugcaucugaauucagcuauaguguacuuauguauaauaauaaauaaaucuuuauauauauauacauacacacacauacacacacacacauauagauagauagauagauagauagauagauagauauagagagagagagaaagagagaggggggguccuuagcgcugugaacuucauauuaccacaaauuugcauacaucccccacccaugcauacagaagucaucaauaguaacaugucacaugccuaauaugugcccaucucugaacuaagagcuguguguuuucauguguauguuuaugugugccgguacauacucacauagcuugauuucauaaaucuuaaucucccuuuugcuaaugaagaucuguggcuuaacgggauuaagugacuuacccagaucacacuggcaggguaaacuuacagugggauuugacucuaggaucccaugacuucagacaccuccugugaccccugagauaucagaaacaaucaccacaggaguuuuugaaugguuucccuaaaaccugagaaaguggcagagcacagcgacuccccauuguuagcaagggcccugcuguaggaucuguucacaguccagcaccgcuuguauuuugugcaaacaggacacuuuuuuuuccacugcauuuuuuuccauugcaguuuugcacuaguuuuccauugcaguuuaacaaauuauuacaugcuuaauaggauaaaauaagguucaaugucuuccugucccagaggucagaagucuggcaugggucuaacugaacuaacuucaaggcguugguuacccaaggccuuuccaguucuccagugaaucugcuuuggccuuuucgggacuugaggucuccuggaccuuugccuugggaagcugccugucaaagugcugcucuauucugugguucucagcccucacugugccauggaagguggccuccuguacuguagucaauucuuucuugggaacugacgcucuucagaucuucaggaggccugcagggaaccucccuggaggcuguucugaccacacacauccuuuggcaaaagcacuuucuggcuucccuuuuuguuuucaugaaacuucuggucgcccuucuacugugccuccucuguuaaguccuuucuauucugugccaguacuaacaguguccccucuccuuaacguccuccagcguggagguaaacuuaggaaggauuuuaauuucuuuguaaugccuuuuaccccacuaugcagugggauggacuugcucagaacucacgccgggugcaggcugaugcccccugcauacuucacugcacugccucuccacauacaacaacucccgccacauccagcucccagcucuuuuuuugcccugacucuuugccucccucacugccagguuucuguucauucucucuggaauaguuagccgaccgaguuucagagcacccacauucuuugcuggggcuuuauccgcccuguucugugugaccugucaaggcccuucuuaaagcaaagacaacacucccaucccaggaaaggauuccagcuuuagcugugagauaacucuaauccugcugcacagcaaacaacccuuccuuucaucaaguucauauuuguguuuuuccagauaagugaaaguaggucaugcacaaaucaggcuguuucaauaugaaaauguauuaaaaaaaaaaaaaacaaaacacuuaacucauucuuagacuacuaagggagcauuuucugagccaaguagguuguuuaacacuaaauuguuugauuaaguaacugcuuggcagugagcuguuuucugagcuuuaaauguuaguggguaggguauauuuccuaaauuaauuaugagcaauugaaaugugaccugcagcacccagggccuguccaugcuuugacuccagguaagcuuauuguuaacaaucacagagauucuggcuuaaagauacugaugucauagcuuguuaauucucuuccacuggaucgagacccaagacuuccaagugucggucaggacagccucccuggggccauuuuucugugugggccaguucccugcuuccacauagaauccagaaccguggagugcccaucaccucugcuccccagacccuuacuccucugaagagugucagagcaaaggaagagccaucccaguuccuuucauaugagguugcuaugccagaggaacacaguaaaggauauuugaugagaaguucuuagacuuggcuguuucaggcccacacccuucauuccacauggauuccuagacuacgcugagccuacagcuagacuaguucccaguacagagcaggcacugggcaugagccccugagugaguguugccuuggucucauaggcagaucaucaauaaauuauaugguguuuugcaggagccagagaaugucagcugcuggucauuacagcacugaugugugagacaguauaggguuuuucuucuccaaagaugaugcuaacauugaauaaugaaaacccuaaaagaccuagaacauuaguguccuuggguguucagccagggggacagcggucacauuucuuucccucuguguaucucuuaucuuuucaaaaucacaaugcauuuacauaacaagagaagauucuacaguagagaaaaggggcucaaaaggggccuggacaaggccuccauagcuacccugaccccuucacaaggacacuggaauauucaggacauggugggugcuucuaggugggauguacuaacgggaaaugacaccugccucuaguuugauaaaaggccaagagaaaaugagauacaaaguuuuaucaccguguuuuguuaauguuaugguaaauuuguacaggaguuacuuuguaaccucugcuucuagucucggcuugggggggggggggggaacuguuguuuuguuuuuguuuuuguuuucuuucaaguucuguggugugauucccacguguagucaagguugagaucuggcuccagagucacagugcaguuuguuguuguuuuuguuuaaaaaaaaaaauucaaagacucggaagaugaaugagucucuauuacagaugaguaauugaacucggaaaaacggaacaauagacuuggagucuauagcucuuauaaagccaggcagugucagcuacgguggccuacggugcguggggagguagcaugagaggaagaaguaucugcugaguuaggucuauaccaggacagaagauauauugggaagcccagaaagaaaaugccugcuuguucuaggccauggacaguguucagaaaaggcaggggagugggaggcagagcaaaccaaccaacugagagcaggcccuuguuuaucauggcuugcugucgccuaugguaagagccccugcgaugguugcagcauuaaagauucuaaaguguccucagaucuuugcgucgacauacaggaggguuuugcuguccacaaacaaugacaucuuuaagcaggagcuauccguccacauggccuggugucuccaagccaacauuccagucauagcuccauauucaguggccuucgccuguuagcucauacuggucagcagcagguccugaggguguagggaagccuccugacccccuuucccugucuggauucccauuaguccugacaucaucccaggcuaguggacaucccauggacauauuuugacucaccaggaaagcuggagaacaggagaguauggguuucaggggccucagagucugaguuccuccuugccuggccuccuauggaggaagugggaagaugugggaaagccagggcuauguucgcuagaagagugucugcccugagugaggucucacuaguagucaggggaggcuagcgugagaccagcaggaggaaggccagcacagugagucaacucuucucagccucacguuuuaaacacugggugggcucaaagaacaggugagggccugcaccaguuuauagcauuucucuuuagaguccugugaugggucuucauugucagaauuucagacccacacaaaccuauugucuaagcaacggaaguguaggagacagucguguguguacuugaagccagcugucacuugaggagguggaguuuugucacagaugcauagccaauuaauucuguugcugucucagaucuguuuucaaggcagauugcuaugagaagggcaagcauuuaucagggacagagcagcauguucaaaaggagaaagggcuggaauggagcaguaugcagcgaugcacagggcaggcucugcaucucuucuguuguccucaaguuguuuguguuugaggccaagucugagacuuauuuuaucauuucuguguguaguguucugcagcaaccccucacuucccucagcuaagaacucccaauccccccacuggucucagagaucccacaccggugugcugucuaugcuuccuacuuccugggaccacaggagcuucuguguugugcugucaaaggcaggugucauccuggucaggcugucuguaguuacuaggaaguaccccagccuggagguucuuggccugaugcucagccuucugccuccuucagauccucacgguuacuaucauaagaugaccaucugucaugguuuguauaugcuuggcccagggaguggcacuauuugaagguguggcccuguuggugugggcuuuaagacccucauccuagcugccuagaagucaguuuuccacuaacagccuuccaaugaagauguagaacucucagcuccuccugcaccaugccugccuggaugcugccaugcuccugccuugaugauaauggacuggaccucugaagcucuaagccagccccgauuaaauguuguccuuaugagagcugucuuggucauggugucugcucacagcaguaaaacccuaacuaagacaccaucccugguucucccugcacacuguuacaaacagaacuugucuacaacagguaggacuagcuugcaucucuaucuuccuucugcuuauuucacugaaauauuucauacugaaaauauauauuuuuucgaaugauuagaugggggaaaauugggcaaacugaagauguuuaacaugcagaagagagacuuaauuucuugggaggauuacauauucagcuuugagacagcaagaaauacuucaugaugcagggucugacaguguguguucuaauuuauaauuugaucuuucugacagauggguuaugaaucuaauuggacgauauaaaagagucucgggaucagaaaagauaaccccacgaugggaacaggauuaccaucugcagcccaugggcaagcugggauuguucuaugaguaucuugaaaugaguaaguuuucugugcauuauguugggauauguguuggaguuggaaagcaucugucgcugagccacagaaguauuuagugcaucgaagcgauaugaagagugguguguuugucucuaccaggauaaaauuauaugguagagaaaagucaaagcuuucagauaugauggcugggugugguuuuguuaauguuuauguuguucaaagcuaaggauuuauuacugggcaaugagaugggauuuuccuggaugcguggcuuuacugggaguucucaggguguucacgccguguugucugugacacuuuccugacucagucagcuuaggcucaaguccaugcagacacugugauuggcugggacaugaucacggagccagccugugagagcugcucccucauaacaggagggguuucuacugccuuucauaccuggguccugccagagauggccucuuauuuccuccucgcaaggugguaccaugagaaggagccaggguacuggccuggagugaguuaggacuuggcacagguccugcccuaccuuccugaauguccuguacauuugugaaucacuugcuugggcucuuguuugucauagguuauguguggcuuuaagcucuguugccuuugauagaugcaucucagaacagguuuucuuugaaaacacuaaccuuucuauugugaaugacaugcuaaaucuaaaagauggcuaacuguucauguauuccauaucucugcccuuucaccuaaacuuuacaaagcaucacaauuauuuuuuuuuuuuuaggguagugagaacagaaaaacaggaauaaaaucugacaggccuuacguuuacacauagcaguguuuccugcagauagcggguggguuacuaaaucacauucuauauauaucuuuucaaaaauaugcauaauacacaggaauaucuguuugucugggugaguagacaguccacuuugugucuguuaucagccuggggucagauuugaaauuagcucuuugcuuuuuaucaggaugggguuuuauuaaggcugcagcaucggugugaacuaaaguguaagucagauguauguccuaacuaacugucucucgccagggccauuaucagcaguaauaauagcacucugguauagaacgcuaucuguuugagccucuccccaccaaaaaaaagacuuuaugggaaguuguucuuaccccaaucaauuagcuaaaauguauggcuuuaaggggaaaacuacagagccaugcuuucgggggaaaaaauggacuuuuagaguuucauaggccuauuaaauaguuaugaacuaauuaauuuggucuaauccuacccuacaauauauguaugauauagucugucauaacagacuuugagauuucuuacaaugcuuuauagccaccccuuacagccaccccaacaauucucaaugacuuugauaguuuccugaguuucugagcagagacaaucugucacuaugcaguuaguaacauggugaaaucuguguuuaguguuaagcugggggagauacauucuucaggacccuuagaauuccugucuuauaucccuaaaaauaaauacugucuuugggaguggcaucgcucccacaugaccuucacggugcucuuccacguuuaccagcaccaccacugugcaccuuucuuuaggugccuuuccacgggugugccccucccccucccagcagguagcccugugccuuccaccagccaccacuccuugccucucguuccuucucacuggcucuugagggaccuccguagauccauuuagcucuucacucugcuuugcugcucauggggagcuaggcagccuugauucccauaauccugugcaagcaugaaugccucucccccacccccuaaacucagccugcugcaggcagcuaccaagcccuuagcacgugugcuuggaaucuaguacucccagguacaugcugccuuugacacaaggaugcaacugcuggccaaucccacaguugcgcuacuccgcccauccucggugcccacugaggcuguaugcccuaugguuuuuguucuuguuacugcugcuagugaauuuuuuuaaaaguaaauuuccccauaauuugagauugaguaauucuaggguauuagccaaaguugccuggcagaaucuuagacucuaccucagaaaacuugagaggaacagcuacugauaguaacgucuggaagcugaagaaaccauuucuuuguaccuugggucgaccugucauagacacaggucucuugagaauguggugacgucaucuucagaguugguaggugccauagcagagggcaccgaagcacuggcauuuccauguuugcccuguuaauuggacccaucuccaaagcuaacuuuccaaaaucaugagaagaauggcuauuuuccuuuauuucuuguugcuguguuaaaauaccccgaggaaagccauuuaagggaggagagguucacuuucgcucacaguucaagguacuacaguccaccauggugcagaaguccaggcagggcaggagccugaagcagauggucacaucacauccacagaaacagagaaagaugcaugugugcuaauguuuaccuuucuucaaccauuguauacagcccaggguucccugcccacagcagagucucccuacaucaauaaauggaaucgagauacuccccaacaggcaugccccaaggcccaucucccaggagauucuaggugcugucaaggugacaccaccaaucauuauaguuguaacaguuacuccauagcugcuuacuguugugaauagcucagcucuguaacaucgcccuggcucaccccuuuucucccugugacucaccuaccaaaugggcuguauacucucuagaaaggagaccugcuuucuccuuugccucucuuguguuccuguccccuaccugcacugaagacuuccaguccuuaaaggacuggcuuccugguguggcagacgggucacucccaucucuuccuucacuacccaguguuggguguaccacugugccaagcgcuacacuguuugccagagauagcaagcugagauucggugcaugcucucucggagcuggacacacaggagauuguguaauaaaagccaagcaggacuuggccaagcagaugguguuugugauuuugaaaagugagugcgaguaucaaagguauggugagggaaauggacacgacucagacuaauggcgaacugggcacuucgaaaccacagagcgacucccugguugcuuccgauuaugucgccaaagcauagcugaagcagaggcucgauggcagggauaugagguaaacuagauaugugggauaugaccucugugugcauagcuagggcuugggacucaugaaagaauggggcucuguaggaauauggguaagggagagaauugugugguguuuuauugaaggucagauuauuccaaaagcugagugggagcuauuuuggauggggucuguauuuggugggaggagauaacuagguuacagcagcuagcgcugauaagggggaaagugcauaaacagaggucucggguaugagaauagacauggggagacagguuuggugagcacuggaggggugacucaggugaaagaugaggaauagaauuuccaagacgcuuuccaggagaugggauguacaggguacaagcaggaagggagcugguguuggagauguaggacaucaggauggcagugucaccagggaaagugggugcccaggucaggcacugaggagccgaaggugaggccauggggguggaucaggcuugccuugcaggacuugagaaagacugccggagugucgacgaggcccaggcagaggagggaaacaguggaaacucuagcagggcucucucugcagagaagacuuuugaggaugccagcauuguucgggggagacugaaacauggcagacaggugcauaagacaggagggaaagucaaagcuaaaacccuguagaugcuacaccaguuggaagcggauggagcccugcggguaauaguguuuuagaggcucguauuuaauauauaacuugccuuuuuacguuaaguaaaaacaaaucaaaaaccauccccauggagagggagaugccugguccugucaaaaacuaucugucuaaaugagcaaggucaagagcacuccugggcuuuggcaugggcagccaaauuuggggguggggaacugcaggaguaguuuccuugcagcagugaggguuuaugggaugcagaguucagaagauagggcaacuggcagagaagugcagugccaccaugaagaauguguuagagagcaaugaggguuuucacaacaaguguuuucuaccuugcuaacaucuccucuuauucauuucaaagggugcuuagaaaguuguucucccuauuuuaaaucuuaauccuuuuggggaguaaaagcgaugaaggcccuagcuuuugcagugauuuagccagcuguaggagaacccccugguuagcauacaguaagaccuucuucaaaaaccuccuguuuagccaagaccgugucugcauuguacuagaacccagugccguggugaacuggccauucucuuuugauucuuuagcagagugaucuacguugauugucaguguuauuuuaacuguuuguuuguugaugucucuuuaagugucugaaauagccauaaggaauuacuagguagauuuguauauccccaaauugugucuaccugauuaagaauauauacacccugucauucauuuauucauucauuucucuauaauaaucauuagucuuagcacuuaggauuaauuuguauaguuuuaguuauaaaugguaucauuucucuuuuggacuuuuaaccgucauuucuggccucuccugagcagucaagaucuggcuaugcuacauucuuacucuaacacaaggacuccaaucuguccuuccaguagguuggacacugguuggucagcucugacccauucugcagucucuuacuugccuggcccaagacuggcauggauagcuagcaguuugagagaugcagaggcaggcguggcuccugcugcuaacacagcuugaguccuugccugucugacuuuccugaugcugaccauguccgccuggccuguguggcuuaucuccucucaguucugaaguacuccucugguaggcuggucucucagaccagaagcagcaggcgcagcacagccuugcccuucuccaguagaauggagcacaggccuagaagaguugucaggugacaucuccuccagucuugggcucacucacaccuguguagguaggugucuuccacagcucugcuaguaagguaggaagcaccucagagagguuucucggcuaguucuuuggucuuaauaccauucuucacccucuccauggcagaguguauccauucucuauaccaaguucacacacacuucagauaaagaguaaaggcugaguuacugcuagaaucucuaccuuguggccacacagaccgacaagggugaggauggcugaaugugugccugcaacacacaggugauaaagucucugucagccuggcugcacccccuuguuuucuuguuucuagcaggcuuccaacauccucugaauaucggcuucccaggcacgcauuucugucuucucucugcuuacuagauucguccacuguguucguuuuuaaaccccaagcccugggucugcuucucauagucucuuaacaggaagagugagcagaguucucagguugccuccggcguaugaccggcacgcaaccgugcuuggcuuaaaaaguuuccaacgugucauuucuuuugagugaauacacaugugggagaugagcugucuuuagucaccuuucuuuagauuucauauuuauguuuccuauucguccugccgugagcacuguuuugugauuggccguggcugcugucuccucacuggggugggucauuuguuggccuuuuaaaucucuuuauaaaguagagggaauuuacauuguccucccaucuguccuccccaccaugauguguguccauuccguugacaguuauucaguuuggguucgucacuuuauuuguggccucuuucccacuggcuccccugcuggcucuggugaacaauauuuuggaaauaagaguggacgcguggaagcucacaacccaguuuaggcgcauggugcccgaaaaagcccaggauaucggcgcguggcagcccaucaugcaaggaauagccauccuggccguggugaccaacgugaguagccugggagucucggguagaccacccaguauuaucuuuauagguauggguguuuugccugcgugcauguggaccacaugugugcuuggugaggccaggaaagagaguggaaaccacccccuaucccggaacugaaguuucaggugguuguaacccugccaugugggugcugggaauagaaccuaggucuguuguaagagcagcaaguguucuucuccacugagcuauuucucuagcucugguaauggcaucuaauuguuaugcaacugucuucugcuacauuuuaguugcuuauuguuauuacugacucaccccaccaggacagccggcagaggggucacuguuucucuucugcugaugucuuuaucuaaagaaacauaagagcaauaggaacugaaacuuuuauucaucugugacauaaaaacaucagcaaagaguguucuuaaacacaggcagauacagguucauucugagucagagcauccugaaagcauuucaccaucuauccucacuguauauuccaauguauauauauguauauauauacgucacaucuuaaaacauuaacuaugaugaaggaaaaauugcccauccuaacuauaugcuagucacccucuugucuccagggaaacaagcucuuaugagagguggggcagucccagcugugagagaacaaccuguggagguuguuugcuugggcagaggccaaguggcagcuguucuuaugcagaacagcucaacaccagcccaucagagggucucuugccuacaaagguccucaaaaaacaggguuauuucugcccuacuaaucuugucaggcccagcuucccaaacaaaaugauuuuucaauuuccauuccuuaagccacaauuugcugagucccccaggagcgccugccaaagcagaagagaaaguggucucaggcagugugcuagggaagugcgccgugaagucaggcagaucugaguuccacuucccggcaccacagcuugagcccugugaucuuggcccccccacacacugccaagccccguuuuauauguguuagaugaaugccucugcacucagcauggcuugggaagccacugaguugcagcggcggacacacggagcccggguccuccuucacacaguagccgcuguuugacuucauuaccugacaucauuaacugugguucccugaggacucugacagucaccucaaaaaucagucacccccuugacuggcuacagugaaauaaguucgcugucgccccacccccaccacuuuccugaauugcaggcaaccuauagcuuugagaaacugauagauuaaaucaguuuccucucacccaaagagccccuaccuucaaugcccacuguauuugaaaaugaagacugauguuuagagccauggcagcaaggccuuucaaguuccacagucacgagagcagcaaucugucagauccaauaugccacacaguacauuaggcagggcaggaauacgggcccgggcgcuuuaggaaaacuuuaggcgcgaagguuugagacuaaaagggguuuuguuugaccuucagaaagggaaaauuggucugguucacgcaccugauuccucaagcauuuuggggugauucugucaggccucuucucccacaccaucccuuuauccacaccauggcugugcuccaugaacacagauggaggacuggcuggguuuccaaaguacugacucuguguguguguguguguguguguguguguguuucugcacgccucugugugugcacacaucuaugugugcauucacaaagacacacgcccacugucuaauugugguugcuggcuacguuuuuauuauaauauacucuagcagaggcccuacuagauugugucacugguuaaacuauugacagcccuucagcccauauuguuagcaucugucaccccacuuauauaucaccccccccacgaaguacuguacauaauguccacagccuaaugugcacaaaagaaagaagagaggccacccugguaggugacaccaagcaggagugugccgugaagucacuugagcuaaaagcuggcgguuccauaaauaagcacagcugacauuguugugcugugccagagcaucugcuauugaagagcaauuuuaauuuauuuugauauaaauggaacuugugugcagaacagcauggggaaugaggcaagcuacacuaugcguauuccugcggcauaucucagaguagcucaauucagggggaaaguuaccuugucagaaaaacaaagauuucuccucaugguuggagucuuucuuccucccugaaguauaucucgggugauucuguuaaaagauagcauugaguuaaaugauaccaggaaaauuuaaucuauugaaaucuggcaugagaccaaaucuuauugucuuaccucccggcugacacacacacacacacacacacacacacacacacacacacacacagauucuucacaucacagacauugagagagcuggcucagguagggaaaaagccccgaacuguuuucuugcuuuacccaaaucuuguuuguuaguuuguagucucacugcaacuaaaccgucuauguccagaggacuacuauuaaaaaucacuuugagccaaaacacaugccuguucuugggcuucaguuaaugauuggccuaacguggauacaauuuccccuuugucccugcaagccguuucauauaccagagucaaagccuccaauuaaagcucuuuggggaaggugcauguaguucuaaauaggcuuuugucccaguacacuucugccuggcauagacacgggcucauaacuggcccaucuauuccucuaugcaggaacauacuaagcuguuuucagugauaauuuaugguuucaguacuuuauccagcuaaucuucuagaagcuuggaugcucagauacuagguguuagaaagcuagcuuuguuuccugacugagugaacugaacggacccaaggcaguuuaucaggccauggauugucuaaguaagucuaagauagcgagacagagggagaaguuuggugaccauuauauaaccaggggaucaggagaguguguaagugaucuuuauuuuuuuaagucaguuucauauaaagucuuuauucaacaaaugaguucuauggugcaagauuaucuucauaauacugaccuuaguguuauauuacaaagcguucuaacuguaaaccguccugguucuaugaagaagcgcucugagguuuaaguggauguuguaacuuugaucagcacugauguacacacaggauacacaagccagucccgcucucugcucuuccuggugccccaggauagucauacauuguuucauguauuucagaggcaaccaaugguccuuucaaccuucccuuagguuagaagaccucccaacgugucuucuacuugaaauauguauaauuccaccgagagauacaacuugguggaaaccacaguucugccauacagugagccauagcugccacccuaacaucccucucuuccuuuccccaauguaggccaugaucauugcuuucacaucagacaugaucccccgccugguguauuauuggucuuucucuaucccucccuacggggaccacacuuauuacaccauggacggcuacaucaacaacacucucucugucuucaacaucacggacuucaagaacacagacaaagaaaacccauacauugggcuugguaacuauaccuugugcaggcaaguuuugauucaccuguuuuaaaaauguaccucaucuuauaaaaaaaagcuuucagugugugugauaagauucuaacugguagcguuuaagucugugauaaagaaaugguuuucacggugcuuucauuuuaguaacacucaaaaagauuaaaauuaaugaagagcaaugguagggccuauaaaccagauuggaaagguguucaaaugggcacaucauaacgauggaggagaaagccuggcacaucucagaaauggagagagcuagcugagagauuuacaaauucaggucauucuguuccaagacugccuugugaagcugaggaauacagcucaguugguuguucuuaccaagccaaagcauaaaaccagaagugguggugcauggcuguaaccccagcacuaagggguagauggcuacagguaaauuguuuccagcggaggcuaaccugagauacauaguaagcucaagaccagccugggauacauaguaaaagucuauuucagcaacauaauaauagaagaaagauccggguaggcuguagcucagcaggagaaaacacagccccagguuccauccccaacgguguaaugaagagaaaugagacaauguuauuauucauggaugaccuaaagcuaaugaugacacacuggcaccucaguuagcaaugacauaaaggugcaugcgguaaggggugucgaguacucugcucugguggaugggaaggucaacuguggauagagcgcacuagcucacuuaccaguugguaguuuguugaccacguaggucaugcagauuuauuuucucuauuacaguuucuuuuuuuuuuuuuuuuuuuuuuuuuuuuuuuaaagauuuauuuauuuauuauauguaaguacauuguagcugucuucagacacuccagaagagggaaucagaucucguuacagaugguugugagccaccaugugguugcugggauuugaacucuggaccuucggaagagcagucgggugcucuuacccacugagccaucucaccagcccucuauuacaguuucuuaaucccaaauucacuuaauucaacugcucagagccauucugauuuagauuuccaauaccacaaccaagaagucagauaaggccaagacaacugacugugcagaaugcugaucucagcaauuauguuccuguauguuuaauaccucauggucagggaauuaaaaacaggcugggugaaaacccuaaguuaaccaguagacaguacugggugguaugacccagucagcuccccaagauagcuagcuaaauuguuuuaugucuucucagaaagcagggauaaagccaugggggaaacauaaaaacauugucacuuuguaaagacauguccuguuuuacccagcuggggucugucauuuucugcuuccaugcucaauaagauaguucuggaugauuuucuuccaguauuugauaccacauugaacuugaggugaaaugaaugugaugccugcuuuaaaaauuacugcgucgaagaugacucugguuuuaagucaggcccuuguuuacaauauccaucaaaaagauuugucuuccuaacgugccugguuguguuuccagguaccgugacuuccgaaacccaccugggcacccacaagaguauaaacacaacaucuacuauuggcacgugauugccgccaagcuggccuucaucauugucauggagguaagagaagugggcucugaggcaggcuauggucgugcacauucguaagccaucugugucccuuuaaguauugccaacuuucuucaguguauauuagggcgugaacugaucagauuuggccugaggauagaugguuccuaacacugaaugaaauagcugucugcuuuaaauguuaaaaagcaugaccaugucaagggagacucggccccgcuuaauacaguauucacugagugccuuuguacuuuggggcacacugagaggcauguuggauugugaaaggccucugcccauggagcuaugaugcaucuguguuccaugcagcugcugcauggggcacgccaacuccuuacagugccucucucucuaaaguuagcugagaaaaugacacggcuguagagugucagccgaucuagccaaugucucagaggguguuacuaggaacaaacgagggaaccuaguuguugugcaaagacagacaucagcccucacuuguuuaagcuacccuagguacaucuucuguccuguguaaaauucugaggcuuugcaaucugauucaaaaaaaaaaaaauuaaaaaauagaagacuaagaacaugggggauggaggagaggaacacuuuccaucguagacaaaaggugucagccacgggacagaaaguacagcacacgucauaaaggacaaugcagcucaccggagacgggaggcagagggaagaggccaacagcugacaaagaaaacuaggauuacaaugagggagggcucuccacagaaacugugggagacagaagcaacaguucuagaacuucagccugcuaaccgagagagggaauaacugagguuuuguuuuuuguuuuuuuuuuucccccacaaccaaacacuggugagccauaggcccuuacagagagcaauaauaaacugggaaggguuccuccucuguguucucucaaacuccugggaggcuggaauagccuagaucagugguccucaacugagcacuaaguaccagucaguagcaaaaugacacuuaggaagcagcagcaaaauguauggugaggcaggggcuaagacugccagaaauaguguuuuucaauggucaugacccacagguugagaaccacugucccagauccuaaacucacaaacaaucauaggcacagagaagaaaacugccugacacagaggcgcaucuguaucucagcacgaaggaggcagaggugcuuggccccugugaguuccaggccaaccagaacuacacugggaggagaaggccuaaaaacaaaacaaaaaaaaacaaaaaacaaaaacaaaaaaaaaaaccucuuaacaagaaaaggaaaacuaagacuauucuugcugccucauaaauacagagguccucguagacugcauaaacugaaccuacaggguauuuuuaaaagauggcaucacacccuauuggcuuugcccugugaauguuaccagccucuauacagaugaguuuggaggagaugaaucuuacuuacuuacuuaagaugagucuucuguugcacucucuugcuucgcaacuguugcuacaucugcuguacucaccagccucuguugcucuuccccaacugaggucagggucccuaaaggcauggcaguguuugcuucccacuccccucccacuccucccuccucuccagucauuuccuacuuccuaagucaucuauccugcucugcguauggugaccauaaugucuguccuguggcgaauuccuugagcagcuaucucugcccacauguuacccagcagugaacaccaacagggccagccucucauucuuccuggaagccugcccccuggcuucaggaaaacaauuauuuaguguuuuaaagcaggaaaaaagucuaggaaaguuagaacacuaaaaggguccauucagcaaaaagaaguaacaauuauaaaaaaaaaaguaacaauacaucgccuauaguaucaaaagucuaucagugugcuucaaaggagaagcgggugucagugacagaggaauucaucagcucgccuucagcuguaaacaggucaucucuacccaaaacaaacaaggaacugcgcucuagacaagguggcccccacugaugcccacaggacauugugccugccugggguaaagcacacauuccucuccacaguggagcacccugccagggcccgucacaugggaagcuguaaaacaaaucucagcacacacuuaaaaauuaaaaauuaaaauccuaucuaguggcuuuucugcguauggugcaauuagaugagacauuucagaaagcacacaugugcacagaaauuaaacagcaucuuccagagcaacuggcaaagcaguagagauauuaagagaggauauauaauuuuuuaaaacuuuuuaaacaaaugauaguggaaauaaacaugccagaacauuuggaauacaaugaagacaguauugaaguacauuuuuuaaucuguggucacaucgguuuagcaggaaaaacccaaauagccccaaggaugagaaaaaaacgagugucucuucucagugugagcccagugccaccauagcuuucuguuuguuagcucucuuacguccguguguguucucauacccacucuaggcuggcccggucucucucuguuccacagucuccuccucugugcuaugacaucuucaucuagccaaucucacaggaccuuucccaccccucuuccuuuucucucacccccccacauucaagccuauuggcuuuuucccucaauaguagaccacugaccccuucucagucuugccuagcuuuguauugcaaugcuggcagguucacccuggcugauagucuccauccaugguccccucuuucuuuggaccucuacugagguaguaccccaaaccaggagaaugcuauggcaaggaagcuucucccuucguggcagccauuguguucccuacgagcacacaacaucauagccuaaccuccugcuuaaccccuucccccucaaucgcaucaccagcugggagucagccuucaacacaggacuuuggauaaaccaagguccaccaggccaaagccacugucauuucuugcccggcugggcccuggucucuaccuggaaacaacggaguucugaccuuggaauaaaagccagagucccugucgugguguguccagccuugucuguggcucucacuguggauucuccuuacagccucagcacucgagaucauguucuggaagcuuccccugcucugacucugcccuccugauaccuccaugacucauucccucgccccuuuaacucuuggcuggguugugugugugcagacuacacuggguaaagugucuguacugcguucagcauccuguugcacuccaugaggguugcaccauucuagguucucccaaagcucuaagcagugcuugauacuagguacaaccuauucuucuucuuccucucuucuccucccccacuccucccccucccuccuccuccuccuccuucuucucucccucacuccccacuucucuuuaaguaucuuauggcuauucgucuaucucucuuuuauacaugaaacauacguagccaaaggggcuuuggaacagugacuaacaaaugcuuaagggagaccaaagucaggguccauuugaaauucagaaaucgguaaaagaggaaaagugagaucucaccaagugcugagauggagcacagccaaaacugccccagcugcuggagcaaccuaagcaggugccaccgcuccagaaagaacucggucauccuguagaacugggcauucgauuggccaagcgucucagcagugcccccuauagguuccugcucuuuauaaaccuacggagacuguucgcuacauauucacaacagcacuguuaauaugaaaacugggaaccaacccuaugccuaacaguagcagaacauacguguugcaguguacucacugggaguauuacacacaguaaaaguaaccaauaugaaccagcuauggaauuggcacuaagaacuuuagaaacuaguuuugaauuuuaaaaagguauuuccccaaaggcuaucuagagggguaggagagauggccuggcagucaagaguacuugcuguucuugcagaggaucugcaacagugcccagcccccacauggcagcucacagccaucuguagcuccaguuccaggggcuccgauaucccguucuagcauccaugggugguguacacacaugggacacacacauacauacagggaaaacacauagaaaguaaguaaggcuguuuuugaaauacugucaaguacuauuauaaagcucaaaucaagaguaaauacguauuggugaacacguauauauuuugguuucuucuuuccuuuauaguaacaucgcauauaggagaguaccuuugagaaaggaacagagaauuaggaaauacaacagcacugucaggggucuggguuuuuagcuuaauggacgauuugggggcguucguuuuauuauuuuuuguuucacuacaucauccaaacugacaucagacucggucucccgugugcuggagugguagucuguaguauguggaugagaacacacacagucagguggacuccucgcucaugcuaaaggaacaugguaccgcugaacacggacagaucacucccuuauaucccguugcuuugagacugaagggccacggugucuacccuguccggacacaccaucauaaugacaugaguaaagcucggggacucggccccccucugacacggucuucucucuuccuugcagcacaucaucuacucugugaaguucuucauuuccuacgcaauuccagauguguccaaaaucacgaaaagcaagaucaagagggagaaauaccucacgcagaaguugcuucacgagagucaccucaaagaccugaccaaaaacauggggaucaucgccgagaggauaggaggaacgguugacaacagcgugcggccaaaacucgaaugagcgggagcuuuaggccuggagaagcacuuuaaagagaauuagcugucagacgugugugaagcacuagagaggauggcauuggaacuccuaggcaggcggagucuugcccaugcccauuucugccugugucaucuuccaguuucagcaagcaguguggaaacuggagaacagaaaacugaucaggcagagccuaaaaccaccuaccuggagguccugaacaugcucccucuuuugauaaauuggaauuuuaguaacaggaaaaaaagcccugaggugugcccaaguucuccccgggacuucgcuuuucugaccucacgugugcagagcuccuuuucugugcuuaauuuugcauuuugccaaaucuaucccagaccuauuuuguccggacagcaccaucaccaaagaccaggcagaccucagccuuaaucgccucuguguuaucaacaauagccagcucaggauugaguuuggaugcuguguuaggucccagguaggcucaagaguucacaguauuucagugucuuacuguacacuccaaggaaggagacuccgcugcguaugaaacagcuucuguaucauuucagccuguauuuccaccuccaagaaauacucgucuuagauuggcaugaagauggaggguauugaaugaagaagccugucccuguuacuccacggugacauuugcucucuagcaauacucccagcaugcucugggucugaccaauguugacuggcuuucagaucuuaaggguauauaagaugaaaagguagcagcccuuguugaucugaacgguuaauuuaucucuucuugguagaugauaaucaaaugauuguaacugucucguccucagcaucaugggccgggaagcccauccacuucaugagaacggacuuagcagaugcagaaggguggcacuaccaaucaccaagcgccuucugccuugcucgcugaaaaaggcugguggccugacgacacugggcguagucagagcaacagccagcuacccaaucacuagccauauccugugaucccucuguggcagaugucacucacugggaacccuacugacuucucugcuugccacggugaccagcuuccuugcccagcuccauucguugccugcuaacucguuuguaaucacagcugggcuggagacaagucuaccaagauuguugcccuuugaggaaggaaacccuggguugaauuugagccccaagccuccucucaagccaucaggggguuaugggaaaggcugguuuaucugcugguggcuugcugcgaagccucagcuuccuagugccuugcccucccuguugcuuggcugagcagucucucugcagccugugcuccgcuucuccuccaguccaucuggaggagacauggcgauaccucgcacccuugacugaucacagaggucagugcugggugaagaagggaggaccugccucacacuguuuggggaucgggccgcugcugacuggauggguguggaaugccucggugccuaggaaccaagccaaggaaagugagcgguuuuagagacugccuucucaacacccgugguauuaaaugcccaccacgaaugauuuacuagagaauugagaaucaacaugauuaaucaaagcaguguucugggcuuuugaguagcccagggggucagugugggaguauuuccccuccucccuuguccugggaguccagagcccgccauacagugucuaucugugcugagauaaaaaugacuaccuuccucccugagggaugcucucauugcacagcugaaaccaagugccacuccuugccccuacccccagauugcccuggagugcccugcucccucuguuaccucuuuuccagagccugugcucacuuccuaaggacaggaaaguacucccacuccauaccauagaaagaggaaauuuucccuuccuuucuuuguagacacaaagaaaaaugucaaauaaaaagugcauuucuucaucuauauuccccagccaagaacucccuucacaaaguagaaaguaccacuauggacagaagaaggaggaaaaaaaaaaaaaaaaaaaaaaaaaaaacuuccuuuucugaaaggagcacucauggcaucugaugcuaccagaaugcugaaugacagcaagguugcugugagcuguagguucccaauggcgucagugucauuccuaugaggccugugccaaguuggugauggauaggaacaggggacaccuucgguggcagugagguagaccccaggcccaggaaaaccaagggcaugacuguggccacccaccugucuagcaugagccacuagagaaguuccauccuuuuguaaugccuuugcauuuuaauggauuaaugugguagacccaguacucaggggauuuuuccuuaaaugcuccucggauguuuuagguauuccguuagaaguagaagaccacaauuuuucuugaaauugaaagaggccgucugguaaugaguuugucaagguuuccccuuugcagggcacgugggucuugaguuucauaggacauccguuugugauggggcagagcggggugaguuggucucacaggucuugugugcuccuuguguucguuccuacaaugguugagaaguggagacagugcagagcucagcugaaaagggacucgugaugcuucccauacacuguguccccgguguaauguuuguaacugaugucuguuaauuucuaugcauuuuaauauuuuuuaauuaaugagcauuuuaauaaaaucaguuuuacaaacaaugcuguggccuaacgagguuuaauaagugucuuauuaauguuuuuaaaggaacagguuuccgagguuggccaauuacugguuaaguaucgcuuagaugaugggugugcacgucugucuagaguauaucuauaaugacuuuucauggcccgugguuacauggccuuucagccaugguagaugcuguaaaugcaggugagcugaagaccugcucaccugcucaccagcccagguacccuagagucaccggugagaugacaccccuuugucaauaacccucuuugggucucacuguguagcucaggcuagccgccccucgagcucugagaggacacgugagccacacaccuggcccuuggaugcacuuuagaacaguccuaauaagggacccucucuucuacacacuguaagcaaacgguuagcuacaaguuuacuucuaaggcaaagcaccggcuucccauccgggagcaccucgguacugaccaaaagaugcaaauucuccaacgugguuccagagacuggugcaugugaaaauguaaauguuuuuaaaauaaucuucagaagacaagguggcucuuuuuuuuuucuucacagaaaagccaaaguaacagguguuuaggggacacgggaggugacuggacucuuaaggauugaguaguauggacaugguaucaccuugguuucagaccaggcaagggaaaggaggccugugaauuaucaucucuguaagucagauuaacacacacacacacacacacacacacacacacacacacacacacacgucacuaagccucaacaacaaacuggaucaacagggagaaaauaugugaccccccaaaccaagcuguugaaauaaccuguucaaacaaggaaggaggagagagggaggggggagggaggcagaggggagaggagaaugaaggcauucagagccuuuggaaacaaaccugcauuuucagcauaccauagccccgaccuauuuugaaaagagacaauauccaaauuuggacagauuuaggagucagaccucugcguacccccaugucugggacuccacagauauucuaccacacaggcucaguugaugguugcucugugagccagacuugacuuggagugacugucacaggccaacucuuacggugugaauaucaaauguccccuacagggcuauuuauugaaugcuuggucaccagcuaguggcacuauuuggggagaguguggaaaauguaggagauaggaugucacuggaaauauuagguuacuaggggcaugcccugaugccugguccccagacccuugacuccacucagccaucucugccacaugccccugccaucaugauguaugucaaggcuugccacagucccacacaaauggucaugugcugcaccauuugaaauguauucugccuugauaauguuagcuguguuguguuuuaugaaagagagagagaaagagaaagagaggaagagagaga

SEQ ID NO: 7956 - RNA, 2371 nt, Mus musculus
agccccaccuuuggugcaguuuguauucuagaugugauccgugaaagccaaaugcacgcaagauuaugcucauuuacugaaagucccuuuagugccuugugugugcuagguauggucuucgcucugggaauugaucaguagauaagacauauggccccuacccucagcgcaugggcugccuggcagggugaagcagacguaucaagugggugcagcaaguuauauuucaaggcuguaaaaggagagcaaaccaggauggcacagugagaagagaaucuuggcugugcccaccacucuccagggggagggcuuucacuggggaauggcuggcccugcagcuguucuuuucauaguucuaaaaauacccugaucuuaggggagcauggcuuugaaaagcagggcugggugaagaaggcucaaguguacauuuggcgaacaugugaaacccugccuuugcuuucagguuuccagguccaguugcccuggggaacuagucgggcgcaggcuuuauuuaugaugauauccguggucuuucaugcaccuugcagaggugguucauaguccuaagccccacuauuccuugguguguuuguuggcugcaauagcuacacuggguuagaggcaauaaaauacaguugcaucuucaggucccuucaugauggcuuuauaguucaacuuagcacgaugcucucccuuccguagguuugaaagggaugcuaagaccuuugaagucaucaguuguuaguuuuucuguguugcccaaggaagaggggagacaauggguacugccauucccugcucacaucugugccucucuugaccucaagggcuuggggaccuagagcagaaugacucuucuggacuaagccagcacugaguucucuucucuggcugcucuccugggggcuaugaaucacuucuguggggaagaggcgggacugacuuugcugggagucacaacccagccccugagggcaugaaucagaagucugguggagcaggaaagccccacaggugacugaggcuuggcuccagcuucuccuccugaaacccuugcuggagaaucucucuuuccugucagagcaccuagaguuauauggaaggacgaaaguuaaggcuuguuuuguucucaggucguggggcaggagggcaugagaacaaacucuguucucauugacuguuauaaacaagaguccucucgcuugagauucuguguuagguuguacauccuagaauggcaucucaccuuacuugugguuccuggccaaacgggagucuucuugaugggugaacucgagggagugugagagacugaugcugccuucugccaugcuuuugucugauaggagcccacucuacggaugcucuugauuagauuuuuaaaguucacuucauauagugagugauaugcgauguaaacuguaaagcuuggcagauccugggucugacugccacccacacucagguggaggccacgccccuccacccccaccccuaccccacaucccucauuucuuuucucaguucaggggaacaguuugaagaccucuucuguaaacugagggugccagcuguuggaauugacccaaauagaacaaaguagaguauaauaaucuuuuaugcuugccccuuuucaugucacgugguauuuuuuuggagauuaaucuagugugguuaucuauucccauuaguccaguguauuugaacuacaagaauaucuggaaaagaccuuuuuuuugguuaaaucuuaacaugcuaccuaacgcuaccuuuucauucuauuuaaagucagauuucuuccuuucuuuuuuuuucuuuuuuucucuuucuuacuuuuuuauuuuucuuuuaguuauuuuugugguuguauccaccgcucacacaaugcuuuugcuuauacuaggaaguuaacugacuuuaaguuggggagguggguacaggcaaacuguacucauuuuaauugcuuugcugucugaauccaaacucagagucacuucauacgcugucccugagugcccaggcugcugggugcaacagcaauccauagagaaauacaugcggguuuguuccuuccacacaagaaugucaaguauaauaauuaauuuuuccaaaaggucagcacuugcuggcauuuugacuaaggcauguuucggacagauauucuuagccuucaucugguaacuaaagagcucuaagaacccaaaacuaaaacugaccugcaccaagagaggaggcaggacuuaccguuggccccagauauaauauuccacaguguuuguccaagcccguggguucccaguucucagagaaguuacuuggcgcuggcguugcuuucccugccgcgugacucaugauuucuuaaggcugauua

SEQ ID NO: 7957 - RNA, 20929 nt, Mus musculus
uaauagugagagcucaaaagggagacucgccugggaaacucgggggagauggaaauaaaccaacaaauagcugaagucaggauagaauaaggagagauguaagcaagaagcugagaagacgcaaaggaagaagguuggggacugaggagagguaacuaaccaagugguagacauaaaauagcuuaaguguuaguuaaauaaguuaugagccugucagggaaugagccaagguuuauggccugggcauuuauuaauaauuagucucagagucuucauucugggagcaggacugggaaagaaaaaaauggauuuauuuuuauuacaaagugccuccugcaaagaaaagaugugggagaaacaacccaggcagcaggcuggcaggcagagacuauggcuguccuucaagggaugguaucacugggacgcuccuucgaaugccaucacaggagugagcacuaagcuggaggaagaggugaacuggcugagugaugagcucgggcuaccugaggugaguccauggagggacaugcuuggaaagccuaggaauaaacagauggcgcuguccuuguauuuagagacuauugggugcgaaugagagauguccucuguaggcucguauguuuguacacuugauucccaguugguggcaauguuuggggaaguuauggaauucauuagggguggggggcuugcugagggaaguuuaucacugagggcaggcuuggaggcugcacagccuggcuacacuuccucuuuuccucuuucucugcgucucugugccucucugucucgcuuccucccucucucucucucucucucucucucucucucucccucccucccucccucccucccucccucccuccaggcuggccucucauuccuguugucaugccuuuucugccagaauggaccggaucugaucuggaacuauaagggaaaauaaaccuuuucucccugagauggcuaaucuugguugccaacuuaacuccauguguaauuaacuaaagcccaggauacugggcacucuuugagguauggguauauauauauauaauauguguguguguguauauaauauauauauauauauauacauauauauaauuucaaauaugugugugugugcaugcacucacgugcacgcaagggauuguauuuauuuauuuacauaccagaagagggcaucagaucccauuacagaugguuaugguccaccaugugguugcugggaauugaacuggggaccucuggaagagcucuuaaccacugagccauuucuccagcccgugagggauuuucuuaaucagauuauuugaagcaggaagcccacccugaaucggagcuacacugcugguggcagcccacauaaaggacacaggagaggggaaccuugcucuuugucugcuugcccuugcucuccugggcaagcucaucuauccuguugcugcuggcguucaauccaacuucuuuagguucucagcgcagacugaaagccagcagcucuccagacacuccaggacucaaguacacgaucagaauuacagagaccucuggucuccuggaaugauggcuaccagauuaucagcccuucuaccaagagagucaguguuggacuaccaugacugcaccccauuuuuauauauauauauaucguguagcagguaaggugagcaccagagcggugggaaagcaguaucacgaacaaagcagagacacuucuguuuauguucaucucaaguuuuccccaaaagacguuuggcuaaagccaaacgaaaagcacuugagagcauguuaguauggaaugggguccgcuagaggaggagaacccacaaauguauacuaaauacagguggcucacauaggacagccugaagcgugguccucaaccguucuaaugcugagacccuuuaauacagcuccuuaugcugucuguggugacucccacccauaagauuauuuuuggugcuacuucauaauuuugcuccaguuacgcauuacaguuuaagugccuguguuugucgauagucuuaguugaccccugugacggggucauuguuugagaaccacuggucuaagucacccaguaauccgcugcccucacacgagagaggcugagaacccaggggcuggaagggagaagaaaggacaagcaucuauuaacuagcaggucuggaggcugagaugcgaagauugggaagucuugucuguucagccuccggugggagucccuguggcugugacauacauaacacacgauguagauugcaucaugacaggagagcguaugagagagacuacacaggaagaaagccagaggcugggggaggggcucgucgcacucugagguacuauuagcucaguccucugugaacccauagggggcgccacaagaacugcacuguucugugcccguccucagguaaccccuaaugaccacaccaccuucaccuagagcccagugcaguuuguuuuuuguuuuguuguuguuuguugaggaaggggcugugagcuaggcaaauggugccucaccaguaaacuacauccauaucucuauagagcccaggcuugcccacuaaucuuuccgccucuuccuccugaaugcugagauuuacaagugugcaccgcuauauuagggaccaaacauucagcacaagagcccuuggaggacuaguccuauccaaaccauaucuagaauguguuagaacguguugcauaguacaggaaaccaggggaacaaaguaguguuuuacugacugaugcugguuuguuccgguuaauagacuaugagacuuaaaagcuaauaggcuaagaaaggacuagaaagagaacaguuuuuacaguggaaacaaacggaaguuuagaaagcagagucaugugagugaaagacuuuuuccccccacuuuauccgcuuccuccagcagccugggacagcauucagugcuggacagucuuuccucccacccucuucuccuggcuggcuggcuucugauacagacucugcucucucugggcuuccuggcuuggccgcuuccaaucagcccccauggguuuaauuagcacuuugaugcacacaguucccaaaguggcgucuccagaggugaccucucucuccagucacauuccucauaccuaauucccuguuagcacccugccaugcuacaucaaaaauagaacccauaagccucuccucagacccaccucuguuccuguucaugauaacaccgccacuccuaagcuguguaauuuucagucagaccucccuugucucuuuucauugaguugauuagucaaaccugauucugccuuacgugucuuucuucucuucaggcccaacuccuccccucagcacccccucuccccuccuuccccucccucccagccccccccccccccccccccgccaacacacacaccauuccaucuaggcuacaacuguagucuuucaguuuuucacuugaauccuguuaugguguggcuguuggacgccccccuuuggacugaguguuugaacaccugguucccagcuggcagcuggcuuggaggguuucggaaccuuuagacgguggagccucacgggaggaaguggucccugggguggcaggccuucugggcugcagucuggcccugcuuccagccaguguuuuucucucugcuuccuaacuacugggaucuuguaagcaguagccaguguucguucucucucucucucucucucucucucucucucucucacacacacacacacacacacacacacacacacacacagugaacaacccuucaucacagguccugggagggaugagaaaaauaggaaaaaccagaacucacuccguaacugcaaaaaugucccagaaacgaauucacucguucaguacagagugagcgacguuguauugcccaagcaccugacagugaucugggguacgugacucaggaaugaaugagacaagauccuuacucugcagagaauagugacagacagugaggagucacccaaguaaauacaggugacaaaaaaacaacaaaaaacaaaaaaagcaaaacaaaaaacaaaacaaaaaaacaacaaaaaaaauaaaaaauaaaaaacaaauagccuuuucuggacaaaaaaauaaaaauaaaaauaaaaaauaaaaaaauaaaaaaguaaauacaggugacucguccuggagccugcauguccagcacugaggcggccaacggcugcggaggcgggaugaugagacuguguguagcaagaucccaucucagaaaggaaauacacaaauaaauacaaauaaaucaccuuuggagauugcuuugacaggaugauacuuucaacuuugaguagaguuguaaaaaggauuaaacaacaacaacaacaaugauaguaagcugagaccugacagcgcuaacuaagacuugcuucuuaacaguuaaaaaaaaaauugagaaagguuagaaaguggaagaaaaauaggcagggacagcugagaggcagccuugauggagucuagagagaucaguuuggggccuaaggaaguggcuuccugggcaguguuuaccgagcaagcucaaggaccagaguucagaucccaccccuuaccggcauagaagccugguguaaccacacucaucuguaacccugggacucggagaauagauauaggugggucccaaaggcuuucuggccaccaguagaggcaaagaguaagcugcugguucaaugagagauccuacucuuaaaaggaaaugcugugcuguugagauggcucaggagagaaaaugcuugcugcacaugaaugugagcccuagaguuugagccgaagaagccaugucaagccagaugagguaguacacuucucgaaucuuagcacuccugcggcgagaugggaagucgauacaggcgaacccuuggaagcucucaagcaagcuaacagcacaagagacccugucucaaacauggggucucaaagugaaggcugauaccugaauuuguggugugacccaccacaugcccauuccacauucacacacaugcauguucucacacacaagaacaugcauacacauauacaucauacauaacaacacauauuaagagaguaauauaccuaacucugaccaccugcuauagugaguacauguauaggcgagugcacacacacauauaaaaagaaaugaucagaugggacccaguuuuguuucuuaaaagacguauacagaaacaauaaggaggaaggcuuauaagagacugggauuauaaguugaaucuuaggagccccugcaguuguucaagcaagagaugauggcagugugaacuagagagacaccagcaaaaauguagagaagugguuuggaauguagaaaugagaggcuugauaugagauaggauggagaucaugggugcauccauaguuugguccucauaagccauguaaugagugccuauuaaccaagguuauugucuuagucaggguuucuauuccugcacaaacaucaucaccaagaagcaaguuggggaggaaaggguuuauucggcuuacaauuccauacugcuguucaucacuaaaggaagucaggacuggaacucaggcaggucagaaagcaggagcugaugcagaggccauggagggauguuccuugcuggcuugcuuccccuggcuugcucagccugcucucuuauagaacccaagacuaccagcccagagauggucccacccacaaggggccuuucccccuugaucacuaauugagaaaaugccuuacaguugguucucauagaggcauuuccucaaccgaagcuccuuucucugugauaacuccaggugugucaaguugacacaaaacuagccaguacaguggugaauacuaagaagguugugagcuugcagggcaaugucaggagcaugucaaguuugaggugucucauggaauuuuaugguuggauaacauuuugagcauguuuuuuaaaaaaaaccuuuuaaauuuccaaauuauuucuuugaaaguuuccaaauguauccagaagagcuguaauagaauccuacauacgcggucucaggcgcugcgggagccguggguuaccguguagacauggccaaguccaagaaccacaccacacacaaccagucccgcaaauggcacagaaauggcaucaagaaacccuggucgaaaagauaugagucucuuaagggguuugaccccaaguuccugaggaacaugugcauugccaagaagcacaacaagaaaggccugaagaagaugcaggccaacaacgcaaaggcagugagugcgcgcaugcgcagaggccaucaaggcccugguaaagccucaggccaucaaguccaagaugccaaaaggccccaaacucaagcggccggcuuucaucgcucacccuaagcuugggaagcggauucgaagcuacguggccaacggucagaggcucugccaaccgaagccuaagguccaaaccaaggcaggggccagcuaaggcccaggcuucagcucuagcccaggcucccaaaggugcccaggcccccaaaggugcccaggccccugugaaggccccauagaaaaggcuccuaccagugugaagacagacagacugcugugacacaccuccccacacacuauuugcagaugaccaguguccuaugcuguucuuaugaauaaacucaggcaagaucuguaaaaaaaaaaaaaagaaagaaaagaaaagaaaaagaaucauacauacauacucaccaccaagcuucaguaauucuuaggauuuggcaaucauguuuuguaaggugagguucugauacuaagguccuguuucccuauugguucuugaucugucaguaaagaaagccauggaccaguugcugggcagaagggaccccuggagacaaaggggugcaagaaaggaggacagaguucaccgggcuuuggauaaaggagaacugggaaacuaugugagauuucaaaauggacuggccacacaggcugcuccuauaggcaggugguccgggaaguuuagcaacugaaguuuagggcaggugggagagacuugagauaagagacugauaagggcagcuuuuccaggcaggagauaguaguaccagcaauugugcccagaaggcaaguugaagaggagcagcuguaucugugugucuuuaauccucaaagucaagggaagcuaggagggggaugguaucucagucacuuccuggagcaaaggcacuaggguacaacuacacgcagcaauguuuucucucuguucccacauauacagcuguaccaaccugccaccucaucccacccugauggcaacuucuuaauauugucacguuuuauucauaaguuguuggggauugguuuuaaucuuuugucuuaauuaggcucccaaaaucuuauaggaaucugcauguccagaugcugagggucccuguccccaauuggucuuugauugcucaauaaagagccaauggccaauaucuuggcagggagaaagaagcauaacuuuuaggauucccgggcaagauaugcaagggagaagacgagggauuccaucacgagagggguguaggauggaucaugccaugaaaggggaagcagagagaccagaauuaaaaagccugccaacauguaagagccugggaaaguggccccagaggccacgccccuuauuuggucugggauagcauagaugaaauguagguuuuaaaagguguuaguuaacuaaagaauaccggaggggaguauaggcuagucguggggagguuuggaagugccuagccagugagcuagucaaggcauaacaaaauuaagcugacaugugugugucuuucauucacaaacccagacaacucuaugggauggcuagaaaugugauccccugcugggagggagcucaaagcagauuaacuguuugcuaccacaauaaguaucuuguaucugauaaaguuuuccuuuuauuauauagucauaaaaacauuauuaaacaugguaagaauaccaauuucuccacagcauucaauagucaugauuuugauguuuccagcuguuaaaauaggcagcauaaauaaacccuugcauacacugcaaaaaugauuuugauaaggguaccaagccuacucaauggagaaaagacgaucuuccaccccugcuaccagcgcaccaggagaccuggggcaugccagguaguaacucccgcccauacuguaaaucuaccccuguuaccuuaggaccacauggacugaacaccuuccacagaaagcaccauccaucuaccugcagccugccauuaacaauggcuaauauacaaauggucaguaugcugagaguaagagacuuuaggcuacucagcccuaacaggauguucccauuauaccucuccccucacggcucaggggccuuugaagaagaggcauggaaaaauuguaagagccagaggugauggaugacuucaaggaaacaguauguucuugacacagcagcaguacaguuguaguuagaucuauugucauggcuugcucaagacccacacaaacucaaggccaacaaaaucccagcaccagggcaugcaagguacaaauguagucccucccuuaguuuaggagcuacuggccuuuauuagcugcuugcaggggcagaggcaguuuccuuacggugugaacuuacacugacuacacuccauaauagauucuacagccaagaguagcuggccaacacaaacugacuugacagguuuaagauauaaaaaaaugugaaguuggguggguagggagaugaagcucaaucuaggaguagcuguggggaagggaauguauaugaucagaauacauuguggaauucucaaauaacaaagauauuauuuugaagaaauuaguacucucauagugugcuggcuaguuuuuaugucaacuuaacacagccuggagcuauuuaagaaaaaaaaaaaaacucaacugagauaaugaccccaccacauuggcuaguagguaagccuguuggggcauaauuuuaauugacugauguauguggucccaacccauuauagguagugccauccaugaguccgguuccuggugguaugagaaagcagauugggcaagccauggagaauaauccaguaagcagcacuccuccauggccucagguucaguuccugucuccggguuccugcccugcuugaguuccuccccugacuugcuccuguuauguacuguuaccuggaaguguaaagaugaagcaaacccuuucuccccauguugcuuuugaucaugguuacuuuaucacagcaauaaaaacccuaacuaggacacaaaccaagggagugaaaaacuuguauaaugaagauuuuaagauaauggaaagaaaaaaaggaagcagaagacaguuccugaagauggaacccccuuccauauucacucauguguuggcuagauuaauauugugaaaacgcccacccaaccaaaggcgauuucagugacgacacgauccucaucaaaugucuaauguguuuccgaauaugaauuugaauaauaaucuuaaauauggaaaaacaaaaggcccaggauaggcaaaacaaucuugaauaauaaaaucacugccagaggugucaccacaccugauuucuacagagcuacaguaauuuaaaaaacaaacaaacaccacaguaggguacuagcauaagucuauacacauuuaucaaugauauggaguugaguuuguaaauggaaacccacgccccuauugccaucugauuuuugacaaagacuaaaacuacccauuggagaaaagauagccucaucagcaacuggugcuggucauacuggaagcucuguuagaagaaaguaaauccuuaucaucacucaucccacacaaaacucaacuccagcuagaucauggucuguggggcaguuggaugcgcacagacagccuggucuccagucgagcaaaggucuggaaccccagggaccgauagguggugauuuccaccuacaugggacagaagguguucaaucaugucuccuggcccccuggcuccugucgaaguuacuguucccacagccucugcaggagagguguguggcuaucggucacuuaggagcagcaucaagccuucccacaugcaauuaagguuucccccaaacucucaguccaagacaauaagagguaccugcugucgaacccugugugcaaguacuacuccaucucugagucuuuuguuccaagagcuguaacaggugggaagagaucuucucucccaaagagccaccugagguuccaccgcacuccucacaggauaguuggcuucuuguuggccuagcccgaccccacucagugcagaucgacucuuggaguuacugaaugaccuggaaggcacggcagagacuucaucucucugcccacacuugacacuuggccucccuucacuggaacccucgcaccagaccuggccagagaucuucguggaaaaccucugguacccgggcccacaauggaccagacacccugaaucugccacaugagaaggcagggaauacacuuuaauuuaugggcacagaaaaugacuuuuuuuuaacagguauaacuuuacguuuuugaaaccuuauuuuuaaugauuuuuuuuaaacacuuuaacccacccaccagagguacuggggaaaaaaggauacaggggaaguagaccuguuuagaaagguucuuuggagcaauuccaaucugcguuguauggaaaucagcaguucagcucauagguuagcaggcagcggcagcuccauccacuugcaaauacuucaugaauauaccagcaguccacuuugguagggucagguuagcaacagcagugacaugcccuagcagagacagccaggccucagccucagcucaaguuagcaggagggacgcagaggagugucaggagaaguucuuggcugugccuuucucaggaaagcaaagaucagugaagauaagagacccacaaacauugcacagcuagcuguaccagcaagccaucaaucaucacacgaccuccaccugucuugccucaacacaugagucugucucagcugacaucacucugccaaacagccccaguccacagacgaggcaagaaacuacagcacugcaccagaaguuauggagucccaacaaguaaauggagcucaauuacaguguaaggcagaccaauacaugugugucauuaacaaagaauccuucaucacauguccuuucacgggcuugcuuuagcagaacauccuuucuccugugucuucuucaaagcaguguuccuucacgagucugccuuagucuuucaccuguauccacuucaggaaaacacuccuuuacuuguuugccccggcacacaaguaacaaacacaacuggcuugcccaagaacacucaaguuuccauugcaaacaggacccugguagaauagacauuaggaccaauaauugguaaaugggaucagugaaacuaaaaagugucuguauagugucugaauauaccacuaugugaaugaagagauggcugauagaguaagaaaaaaucuuuaucagcuaaacaucugccucgggguuaauaucuagaauguacaaagaacuaaaacaaagccaaaaaccuaaauccuaaugcaauuaaaguuuggaauguagaacuaagcagaggauuucuaaaagaagaaauacaaauugcugagaaauaauuuuuaaaaucuuuaauaucaauaacaucaguguugaaaugaaaaucaacacuacuuugagauuucauuuaacuccagucaaaaauaacuuaaaaauuuaaagucaauaaauuguggugugacuauggggaaagggaaauacuuaugcccugguugggaucauaaauugguacagcuacauggaaaucaauaugaagguuccucaaaaacauagaaauaauagaucugccauauguugcaccuauaccaagugucuuaggguuuuacugcugugaacagacaccgugaccaaggaaagucuuauaaaaaaacaacauuuaauuggggcuggcuuacagguucagagguucaguccauuaucaucaaggugggagcauggcagaauccaggcaggcauggcacaggaggagcugagaauucuaugucuucauccaaaggcugcuagaggaagacugacuuagagugagaguauuaaucccacacccacacugacacaccuacuccaaccaggucacaccuauuccaacaaagccacaccuccaaauggugccacucccuggcccaagaauauacaaaccaucacagccccuuacaacugacuugaaugcuguggguauuucuuuuuuaauauaaauaucuaaucuaaagagucaaagacagcauccaaguaucagaggaugcucauccuucggcaugcggguuacccgacucacucuagcagguuccaguuccauccauuuagcugcaaauuccauucuucguaagagcaggaugcuauuccauuguauaacuaucccacgcucacucccaucagucaguuaauggacauagaggcugcuuccauuccaucguuaucaugaagagcagccauauggagggucacuaauaccacccuuugaaaaaagugcaugguaaccuguuacuguagaagcuuccuaaaauaggcacauacucaacauacaaaaugaauucagccaggugggguggcaccugccuuuaaccccagcacaaggcagguugaucccugugaguucaagaccaauguggucuacauagugagucuaggccaccuauguagagggagauauccucuucccgagcuguuggacaaugggguaaacuagaaccccaaacacuacacccccuccuccuaaacccagggaucaccauagaagagauuggaaagguugugagagccaguggcagggaguggcuuuagcaaagcaguguauucuagucacagcggggcaguugcacaugugaacuuguagcagcugugacggcaaucguaagaccuacacaugauccagucagacgaaauucaaaugaggagaaggaaaguggcugugaggucauaccacucgcugaggaauauuggugacuaacggcugcugggagagggaguuggcuuucaucaaugaucuaauacuaaaauauugcagaacguuauuaggaauaaucguauugcuaucuucauuuagcagaacaauaguauuggguuuucccccagguccauggccuaauuagugucagauuccuggccaccugagcuguguuuuaucucuuggagcaaaccuuagauccaaucagagagugguugguuacucucacaaaguuugugcuacuacuacacgcgccucucacggaagcaggucaccacuguggauagcagggcuuguagcuggguuggugcuuaccuuucuccgcugguggcaugcugaguaccaggauaccauccaguuccaugaacacuagucaccggggguaaaggcucgaguuaggcaccagcuuaacuuuuccacggucagugagauauguaagauucagaacuucaguaauggggccuugcaucagccugugggcaggaaccaauaaccucugcaaaagccugaacuauuuggagauuuccauggagccccuuuggccaacaauucaauuaguugcaacccauucuuggcacuggagguucuacuuggcggcagagauuucuaauaggggcuuugucucuccuguuaucuugugacuccauuuagauuucuuuucuauguauauuuuagugugguuaguaugugguuauucauacaguuccaugccuaucaaggcuuaaaagcuaacuuccauguauaaaagaaugcauaccguauuuaucuuuuugggucugcguuacuuuacucagggugauuuuuuuuuuuuucuaguuccacccauuccccugagucaggucagguguggccacuggguaucacaggaagagagucugaaguugaauucgugucuagcaccauuacccaaaacuuuuacaaacauaucaaacgcgaaacuuaauaacuauauuagggguaaugcuuauaugcacugggugaagaugugucucuguccuuccuugccugccuaaggcaccuucugauuggucaaaguaaaaagccuauggccuguaggagaggagaggauagaaggugggacgucgggcggagagaggaacucugggaaagggucacuggaaagaugauuugccaccuaugugcggaggaagucgaacagaugaaacugaggagagguggccagccacguggcagaaguuacuauaaagggaauaacugaguuacaagcuagugggaacaagccuaucauacggccuaggcauucauaaaggaagaaaacacgucuccaagucauuauuugggaacugggguguacacagaaagaccgaacaguuacagccacacuaugaaauguuagaaugacaaccuaaacaagaccaauuggacuaaagaauaauuuuugauuuuaugcauaaaacuauuaucaacagaauugccaauuacauauuugauaagggcuuaauguccauaccauauaaugaaccccuaaacucaagaauuaaaagcaaacuugauuuugaaaugggaaaaggacuugaauagucauuuuccuaaagaaacuaugcaaaagacuaauaaacaaauuaguaggugaucaauaucacugaucaaaacuacaauaagauaccgcuuccauuaggacaacaguuaucaagacagaaagggggaaauugaugagauuaaggagaaauggaaauauuuacacauggcugguaaaaaaaaaaaaaacuuaaaucagaacugacacuggaaaacaggauggcaaauuguucaaaagucaaacgcagagcggcucugugacugggcacccucuccugccuggauaugaagcgaaagcagagaguuggauggacaucugcuuacccguauuuacagaagugaaaaaguagacgucaggugcccgugaugaguaaaucagaugcaauacagucauacaaugggauaucaugcaagcuuuagcaauguaggaaagcaaccccggaugacggguaugaacacggaaagugcuaagcaaugggaagccagccaaucguaagagagaaggaagugugggcgugauggaaggucucagaaagaaaagcagugguucucaggggcuggugauuuacaacaguccagaggguaccgaacuucaaucugggagguguuacugcuaauuuaaaaguggcuuuuuuuuuuucucuaacccagcuagcucccaaauaauugagacaaagacucacaagagauuuauuucacaugcuuuaagacauaauaacugagcacauauaaaucuauuccaauccucuaggcuaaucuggcuaccucccagccaaaaacccugagauacuugcauuuuaguauugauccggcucuuucugcuccuuguaaauucucauggugguccucaucuuguggucaugguggagucuuccuccccccgcacccccccaacgucucguccuucuccuccucccccucccccucccccucugcucagucauuggcugaucaaccuuuuauugaccaaucagggaauaacuggggagcaauguuuacacaacauuaagacaggagauucuuagaauaagcaugacaaugccaggucuggacugcaaccagaaguuggggcacagaaaucagcauuugaauucaaggauaaccuuuacucugugcacaagaacauauugucaacagggaagaauaaagaauaguucugagcugaaucacugugacgguugcacaacaauguauuugacaccacugaagugaccauacagcuaagagucaauaccauggugauuuuaauuuuuuaauuuuaauuuacacuacaucucuguauguguuaaugaugaaaaucugcuugcaucauaaaugucuuuauaauugguuugcuagaguagggaugcaaaccaaccccacacauugugcuucccuaauuggucucuuaagucugcuaauugauaauucccauuaccuacauuuuuuuuuucuccugccuuuaauuguuaaagaaacgaagucgcugguaaauucaccucauuuagguuggccaauugccuucuggucgugucuuucagaguggucuacuuuuguguguguguacuggcagcuauaaauguaaagguucuggugugugugcaugugcgugugcgugugcgugugcgugugcgugugcgugcgugugugugucugugugugugugugugugugugugugugugugugugugugugugaugguguuugguuugugagacagggugucacccgguagcccuggcuggucuguaacuccaggagcucugccugccucugccuccaggguuaaagauuugcaguaacaccccaagugaggacugguuucauuugcaugcuuuugaggggggugggggggggggagaauguggaagugauucugggcaugugcuaucaugucacuugagaaagcacuaacaucugguugccaccccuucugguuaagaugacuggguguggcugccugagccaucuugggucuccauccauucuucacccagugacuccagcagccacuagagacccauaacucccuauggcugcaaauuugguugguugguugguuucuaauucuaguauucucagugcccucaacuaaaaauuucuucuguacagauuaacccuuccaccagacgcacuguggcuaguuugcucauggacuuggggaaacaggcuuuguucuuuuucucauuagcuuucaaaacacugaaauggcaucgaacaguuuccaaggguugccaauuaauauuuuuguuucucuaaugagaaugagcuuuuaauauauuuuauauuuuuagaaucuuguguccaugaagcaaccauucagugguuaagagcacucuugcaggggaccuggguucaauucgcagcagccgccuugugguuuauaaccaucgguaacuccaguuccagaggauccuucacccucuucugaccuucacggguaccagacacacagguagugcagaugcacagagggagaaacacauacacaugaaauaaaaauaaauaaaucucuaaaaucuugcaugugugugauauguauguacgugagagacacauguguuauacauguacuucuuuguauguaucauggggagaauaaaagcuaaccucacuagcugguuuucaccuucuaccuuauuucaagcagggucuccuguguuuccacuguguacaugagaauagcugccccaagagcaucuacagauccuuccaucucugccucccgugccccgugcugggauuacaggagugugagcauuugugccuggcuugugcauggguucugagagcuuccacuccaguccucacuacagcacagcaagugauuccccccaugagccaucuucucuguccugcauuugauuuuuuuaauccuuuacagucauuacccuuugggaugcucaaagagucucaucguggcuggagggagaccccucaacuaggcuucuaagccguuuucagaagcaccugcuguuuuagcuguccucuucauuccccaugggaucuuuggagaugguauuuagaggcugagaacuaacugaagauguuuaacuauguuagcuaugacgugauagaaucuaacuccuuucaguguccaaagugagagagugaauuuugcuggguuuuugcuauuguuuuauucuuaggaacaaaaguaucaugaguucauauauuuccagacuccaagauuuuaauuuaacugucauaacuuucuauauguaacucuuuauccugaaaaaaaaaaucuuggugcuaaaugacagugcagaauuacucacuccaggcugggcgugguggcguaugccuuuaaucccagcaauugggaggcagaggcaggcagauuucugaguucgaggccagccuggucuacaaagugagugccgggauagccaggauuacacagagaaacacuuuuucaaaaaaaaaaaaauuuaaucacuccauucaucuauuaccauggcucuaaaacagcaauacccaucuaaacauuaucaacaugccuacuaaaaacaacaugauuuucaggggcuuuuuggucauuaagguauauuguacugugaauaucuaaauuugcauguaccuuaaaguuacaugagguguuccucugugugacugaggcacaauuccacaaauuggaaauauggaguguuuuuuuuuuauuuuguuucuuauuuucauuucucaaaaaccucuucgcuucuuguuuucuucauacuuauccaacacuacuuuaguaucaggugaaaguguuuacugcaucuuuccaaaauuccacuaaguccagaacuauaaugaaacacauccaaagaaucauagaccaccgucuccaucccuguaucccuuguacccuacccucuacccuguaccucacauagccauuuucaguagucugggcuuuucgccaucaacugcuuauaauauaaacaaauaaaauacauaucccuguucccagguaaugaauggcauauuacagauguuuucugcccuugaacuuuccugcauuguguggcuaagcaagaguuuguuuuaaguaggcccucggcauugggcugugggauguuuaccagucugcugucacacacaaauugaauugucuuguuuaugugccguucuguauuucccacccgcuacucuauaagaaagaugucuuacuauggaauuaaugggucaaaauguaaaugcuuguggaacucugauaauggacguguccccuccucugggcuuuuaccucaucaacaauacaugagaaugccaauuucccucuagccuugccagucccauugcuaagcccuuggaguucugccaggcugauagggcagagaugguauuuuaauguaguuucaguucccccaccccucucuuccgaggagcugauuagagcaucuuaucacaucuggagguccauuugcauuucuuuuucuggugagccauguguggauuucccgcucaguuuuacaagaugcuauuugccuuuucaauuuauagacauucauuagcugauagagacuuuaaccuuugguugagaugaggaguuacagguaucucccuagacuccacuggugacuugcuuagauuuuagguugcuugcuucguggcuuacuuuccacacagaacuuuuaaaauauagcuaaaauaauuaaguuucccccaaguuugggggaauuucaugagcuuucaugaaaggaagcacgccaugauuuccuccagcguuuggacuagcauagcagacuagugugugguauacagggugaugucauuucuuacaggaugaugucauuucuaucuuuuccauguggagguucauuuuucccaguaucauuuauaaaaagucuguauuucuccacagauuuuucagaagcagccuucccuggagucucaagacccaugugcaaauaacuuaggguuauuucuggauuuuucuauuuggcuccacugguugucagcuuauucacuugccaaugcaauugucuucuaauuauagagacuuuguaaaugcuuuaacaucuggcucugcgucaccaccgggaugaaucccauacugcuguaggccgaggaguggguugguccaucaugcaaaccaagcacaacugcaaaggaggccuccucuucacccugaccacagacccuauuguccaugugugguacucugcgaauggcaagaggcuaggcaccuacguggagcuguguggagugcggauguugacuggaacacuacucaugucccuccuggcucaguugacaacagcuguugucucugggauugugaaacagggaagcaguugguuccacucaggaccaacucagcuguccgagccuguggcauugacuuucaggggaauauuaucauguucuucacagacacaaagauggccuaccaauguuuugugagcuucuuugaucuaugggaucugagccaaaucaacagcaaugagcccuacaugaagaugcccagcaagauuccaagaucaccgugcuguuuggggaccccuggggacacacaucauugaaagccaugagaguagaaagagcucagccaacacagugccaagucuagagaggucuugguuaauguuaaagagcaccauggcaggucacugucauccaguugucuagaggcaugaccaugugugucaccacauccaaggacagcacagccaagcaacuugacuccauaagucuugacuaucaggagacuuuccaaacacaauguuccaucaacuccacuacucucucucucaucugugaccaugugguacuggaaaggugucaggaagccagagauaaaaccacagccuccaccaggauugacaaguuugaggccagguucucccaguuggcauuugaaggagaguuugaaagccucaagggccacuuuggaccuaucaacaguauugccuugcauccugauggcaagagcuacagccucauggcuaagcuggugauguaugcauccacuauuccgagaugcaucuccacaaacagcagagaggcugcucacagaagguuuuaaacgcugaaaaauaguuugaaaaaaaaaaugcuuuaacaucuggcuuaagacugaguuuguacucauuauuuuuucuuuuuaagguuuucuaagcuauuuauauuuaguuguucaaagugaaauauauaaucaauuuguugaaugucaagcaagaaaaccaauguguauauuuuuaugauaaugaaucuucuuauucaaacucagucugucuuucugucucuauuauuauuuuuacaugcuuuguacccacaaauuuugaucaguucuuauuagauguaugcuuagguauucugugucaaauuaaaaauaaacauuuguaguuucuugguua

SEQ ID NO: 7958 - RNA, 366 nt, Mus musculus
gccauggucccacuccacagacaggaauucuuaggcucuaagaggugccuugagccugcacaggcacaagcaggaccaggggcuugaucucagugaugucaccaggugaaagacuuccucgacugcuuccugucuuucuaaagugcauuuccacuuaaagguaacucugagauuccuauuuuucaugcagagauuuccagcucaaguagaugcaaaggagucauugucuacucuuccuuggagagugaagacggagagagccauggacucuaaugacuacacacccgaccaucucagaaaggcuccuguaauuacugacuugauguuuaguucuugcuucauuccuguaccugaaacuuacacucu

SEQ ID NO: 7959 - RNA, 12346 nt, Mus musculus
cugaggauugauuaaucauguauuuauuuuaguucaguuaaaacaaacauacauuguuucauugaaaccgguguagcauuuacucucugccaacaggccacagaggcauguuggccucuaacaguacagcugggacauuuacacuauauacauacaaggaguccucuuucauugagaucacacuugacauguuaccagauagccaugugguagcuacugcauuuugaaaauuuagaccucauuuaaagcuuuagauuaucugaacuuaaguugauguccaaccaguuuauugcaaauacaauuuaaacaaguuauuuucaauuuuaguauuauacacaaugucaauuucuuaagauugaauucucuguacaaguaauuuggagacauauauaaugugaauucaucaaaaugcaguuaagaaacuuaggggaauauauacacuugaacccaauuccaacaguauauacaaucuauuuacaaauacauauggacaauauauguacaguuuaucauaaauauugaaaaauagguuagcuuuaauggauuaaugcugcucuauaaauaacaguacaguuauugaaacguuccauggaagacagcgaugugaauugaggugacgggacagugguuuuaauacugaagacugcucaaggcugagaauucaguucaggaaccucaaggcggguaaaacagccccaagcuuuggaauuuggccugaaauucauuuggaaccuugcucccucacaggagguuugggaagucucuccacacugaucggcugugaacaggauccugguugucauggcaccucucaggaugccugccucucagcauccccuggcauaugguagccaggacucuuuccaggacuucaagcggaggugcagagucuuugacgagcaggugagguucuggacuugaugacaaguaagcagcaugggggagugucuucucacugccuuugcgucuacacaguccccagggguuucaucuugggacagaacugaccauugguuguacccaauguauguagcacuaccagacgucuuccagucugcaagagucuuuaauggcagacauaccuugccuaugaauucagucacauauacaauacaagacuguaacaaaaaccaugugugucacauuucuucuggccccugccucaaacucaaaacauguaguuucaagagccagauaaccaauugacgauucuacuugcuucccuccaccacuuaauggaauuauguauauuaauuagaccuuagacaauacgcuugaugagcaaaguaccucauuauuuaaaaauauguucaccauacaccguuaacagacaguaaaugugcucuuaaagccaagcuuccaaguaaugucuucacguuuaacuggaauugaaauggaaagguaagcaugcggcuggaccagacaccgaggacaggcagcuugucccgccuccccuagcugaucauuuguucgauguaaacaaauugauucugcaucucauucaaugagaugaugauccaguucgaguuuuuaggaagcuugcugcaugagaaaccuuucugaggagggccugcaguguaccugcauggugcagccuggacugccaacacagcaggagcaccacugagcugcguguugucaaguaaaccacgcuuccaguagaugagccuuuggaaguucugcucucuauuggacaguuuuggccuauugccaucaaacgcccguuuucacuuuuggaagcaagguuuuaaaggaugggcccaaaaagcacgacccagagcugacacuguaacucuggagaccgaugcaacugaauaaacccugucuuacccaauugcacuauuugguaccucaaaaucaguuauuucauuuccuacagaaaucucggcacuguuucccagacuaauugaagacauaaacauuuuaguuguaaugaaccaauuauuuggaggcaaagaaagcgaugaacggaguucaccugacuuggugcagcaacgaccaacuauccuucaaaugaaucugaaugaacaaaaacaaaaccaugcuaauccauggugcaauuuuuuguaacauuuuucccgaaaaugauuuuuggguaaaaaaguauuuggcuuauaaugcccacaaaaaaggcaaauaauuucauaauacuaauauucauuuuuaaauaucaaugaaauuguuugauggaguuuauugacaacugguucugaguaaaguucaaaaaugcaauuucuucaaaguaaaauagugcuucugaggucuuuuaaaguauuuuuugguacaaaaaauaaguguauuuucucaaugcuuauuucaauacuuugcuguaaauuaagaaguguuucucacaucgaaugguuccguuaggcacauucaaguaaaaucauaaaauauccaaguuaaacaaugagacagccaaacauguggcuuugauaaaaaguuaaaaguucguccauucucuggaauggaauaaacuugucacuucccuuaacccaaggcucgugguuuugucguacuauccauucccuaacacacagauagcuucuuaaaaaaaaaaaacaaaaacaaaaacaaaaaaccaaagagaaagaaaaguucacuuauucugaauccagaagaaccagcgaguagacugcacuucaaaaggaagugaccgggacgcaucaggugagacugagcaggcugagucgacucaacacgguaggcaggcggauggaccauccagcgugaggggagcuguuagugcccaccugcagcggaggcaucguggacccaauccagcacaaucaagcccaugcuuccaaucaucaccacuaugccacucaggagaaaacacagagccugcaggaggcagagaagacucaucaguaaggccccaagaguucacaucacaacacuuacaaauacucuaauuucaccugacuguucuuaaagucaucaaaccauuccuguguuucuuguagcacagaaauccuguauugcugaaaccuucugaguucuguaauuuuucauucuuuuuuuuuccccucaagccaaaguucucccuuugaaaguuagacuuuguguguacgcaagcuuucuuucagagcaaauuaagucacaaaaaaaaaaaaucaagcccagguuaaguccuagaguugcagggaccauggaugggcgucaucuuucuucagugguccagacacuccugcaucuguaguuccuuacccacaucacuaaacucacugacggaaggagguaaccuuggguuugcaggugcccccugggcucaacuucgcucauuucugccagauuacuccuaaccucauucugcaaagcagaauagcuguggacagagggcuggcaggcuguuucucaagcaucccuugcuagggaggggguucuaguuccaaagcuuguggcuggugcuaaguguaccuuccacuuugaaacaagaggcuaccaaaccuuagaauaaagacgcacuacugaacccccucagagcagggccccaggguucucacucuauacagaccucaccuuccuggagccuauacauccuugcuaugcauaugugcccauacacagggcuccaacaacuacgucaguacuuucgcacuguucuuuaauaucuuccuugcaguuacaucaucuagcgcacugcgaguucccacuucccccgcccacuccuuuggugaguacuuuauugcuaaagcuuucaggcaccggucaucucacucaccccaaucuuuugcacggaucucauugguuccuucuucacuaacuugauguagaaggcagacgggaggauaaagaucagcauggcagccgccgacgccccuguaaagcgagguugucagucauuugagaacucaacgaaucuguacuuuuaagccuuaaaauauuccgggcacguugaucaaaacucaccaaugaacccgaagaugucccuaauaguggggacaaagaugacgagcaaauuggugaaggacaagauggucacggugaugaugcugugccggagccagcugaacucuuuugugggacacaguaagugagugacggaacuccggaucugaaagaaagucaggaggcguuuauuaguuaacaauccaacgugaaguaacaccaagagcuugcaagacaaugagaagcaucgacggagacaaugauucuuuucuagggaacggauaccccugcuuucugccacaggaugauguggaaucuacaucguacucuauucacccgugcccaaccucuuuaccacacccagcauacccauagcugucgcagaagucaguuagcuacuuacagggaaaauaacuacugggaccgugagggugacagccaccagcacagccaaucggacaacaaggagaagaaugucaguccccacgaucucggaguagguaugcagcaauuccgauuccacguguccuguggggacacagaccagagacagacuuucagugugguuuccucuggggaucaaguggcaaggcuaacuuacagugaaaucugcacuagaauuaggggcuacucacagaaugacuguaaacuaagaggcuaaggagauuaaucuagaauuaugguuagugcaauuaaaguaacauuggaggaaaagaaauuuucuaaacaccgagauuuagccacaugaccuccagugaggucuaacaggggcuaagcggcuagaucccagucuggcugugugugugugugguguguguguguguguguguguguguguguguguaugauauguuaguuacagcugaaguucggagcagagagagccaagaauaucacagaaaacaucacggcacggcucacacccacuucggaaucuggaacccccaggaauggcagauuaaaccagaugggaacuuuuuacaguaagacuacacauauaauaacgucagcguccuuuucaaauuaggcacuacuuaccguaaaaggucagguauccaaagagagcagcgagcaaguacaucagaaacauggcgaagaaggaaaucuuggacacguucaucauccgucuccggcugcggcugaggacccacaacagaaagcacacguguguguuuuagcacgcuccauaccuuacggcuuuagcguaggccaaacaggguuaaaggauaaaagaucaacuaccucuuuagcucuucguagaugggaagaacagcgggauggcagacaaaggaaaacgucaggauggguacugcauacacagucugaaagagacacaacacaccgcugcauuuacaccuguguccacacccuaccaguucacaccaccgguacucacacuggcaauauacccuugucaguucccagcuaaaaaccucugaggaucuccacaccaaacaaacuaaugacuaacucccauccuguaacaguucagcaccuaugaucuaucuguaucugacccucuacccccgagaugugccccgaggcacauuauuuugccugcugccuuugucuaagcuagaacaugaaacuucgcuaguucuccaguuuuuuccccccuaaaacccaccuaucauccagccucaauuugucuugagacauuuuuacaucccugcuacgcaggguauccuuuuauccuccugucaacauuucuuuccagaaaacaggacugccgccaaguuaccugcgaguugaagaugaaauagcguggccugcaagcaucgucugcggugcuauugaaugccaacgccaacgcugccuggguaaaggugccguucacaguuucguuggccaccaaagcagcuuccacggggcaagggaucugaaacuucuugcaaaucaccugaaaacauaguucacacauuugugagcaagacugagcaguuugacaaagcuuuaagauguauuuccuaaaagaaagaaacaaacaaacaaacccacuaccuaccacgaucaggaaaaauaucauacagagcagagagaggccgcugguguaccccaaguauccuggaagggaacaagggccgcuuuaaucaaacagggauggacagagaacacgagacacuagagccauguauggaguguuaacaguugggggcuuuaaacggggugugugugcccugcugccacccccaagagcaggugcugagagccuucggucguuccugggagaaugcuagcagcugcugagggcucacagccgucagaaccaugucugcuuaccuagauuucucagcagugacaauggaagaaugaggacaagggacaccagaaggaccagauagucaccguucagauaccacaaccugaauggggagagagaaaaaagccaagagugaacggacggcacacaccuaacucggccaccacacgcaccgcaugcgaaaaggacagcuuugaugggggaaggaaaaaaaaaaagcaucccuuauuugagacaccaccgauuuugugaccauuugcuucauggagcuucuacgccacucucugcucugggaaggcugccagcugauuccuaacauaaaacacuucuuaaagcuugauacuaggcacagggaacaaagccgcucugugcagcccggagcuuaucuguaggacuuuugagaaacacuggacaccaggcacugccguucuggcuuggaauguccgacaacgagagggagaaggaggaaccccagcaggauucgccggacacuuguuagggagacgccugcuugcucuuaagcauuuccacaaggagauuuucaggcugaagauuaaaauaaaaugcacaggccacuacucuccccuaagugagacugagccgaaccccaacucaagcagaacuuauuucagauuauccuaguaccaccuggacccaacuugacucaaaaaagggugggggugacuucugcguucuaccaccauuucuuuuuucuuccuaagauaccaaggccuauucuugccauagguguugguggcccacacuugcacuuugugucccagagacagaggaaggcagaucucuuugagguccaggccaaccagugagaaccugucuuaaaauaaagccacuccucuaaaaagcaguguuuccaagcuccauuuaacucccugugauuuccacuccacuccugguaauaaugaggaccccacacagaaaagucacccugaaaggcagaagucuucacgguaagucuaaaggcagaguggaaagcugcacgucucugcuuugaggcagcaacugugcaaugugggcagccaaggagcccuggcuauuuacuuuggacccuguuccuccagugggauggaaaacuuugcaaaaguuaaccuuuuuuucuucuuaaauaguaaguacggcuguacauuuucugguuuucuuuaaaaaccauguaagcaugacugguuuuuauaaggaaaagaaguuauuguaaccagcucucuauucagcagccagaacaaacgucacuaccaacgagagaugaauucggacaacagaaaaguuucagguuuguguauuugcuaguccgagcuaagagcagguugcugcaggaguccuccguuugugggacacuccuugucauaaguauucuccacggggauacuccugggaaauucauugguuacuguuuauaauauccaacuuugaccaaaacguuaucugcaaauuguuucuauggauaaccuuacucagcaccuacccauuuguaucuucaauguucauuaaugccuugaucaccaaagguaacucauauuucacuaugaagagguagcuugacauagcuggaggaaaacaaaauuaaaccauuacaagugcaaaauggggucugugacaccgcagucacguugucaccaccuugugcuacuacaugaagucuacccaaagugacccuuuaaaacuuacccccaauguucugcaugguuaucgauccggaggcugcuagcuuuccagccagaccauacgccuuaugucccaacuguucguacaauaaagauccugcauagaagaacacagaggaaucaagcgaccugaaaucucuacccaaauuaggauacacauucaauuacuuggggaaggagagggaagaggaaaaaaaaauccaucaaucagaaagcuacuguaccuccuucguuggcagucuugaggaggagauggacggaguauagcgaaaaaauugacacgaacgucaagagaauucugagaagagggaaaggcacucgguuauuuauaaauaugccgggcugcgcacucacuaacacuuccugucucacacagcuccggugcggcucccucuccuaacucgugacugacacuggcuuguagguuaucaggugagucucaucguuuuagaagcaauguccacccugacaaaauguaggaggagucucaaaacccagaggacgagaaacuaucuauacgccugccacgaguuucuaauaguuucguuuaaaaaccugcuaucaaaccuaguccacgaggccuucaucccacucagcugagaugggucagggaaggccgagaacacauggaugagagaaggaaggcagguagagguggaaauaacagccauuuaguaggacacuauaaaaaaaaaacuguacugaacuggagaagggacagcuguguagacaagacuccgcccccugcagugcaggauacucgacacuagaacaagugaauugucagcuccacccucccccuuggacuggcagagaaaaaugaaauggaauaaggaaggacaaccaaacggaccuaacaccacugucuucccugagagcacagguugcccaucaagucuagaaggcagacaagguaguggcuaaaaagaaaaaaaaaaaucaaaaaacaaaaacagcaaacgugcaaacgagacagccacguaaaucuugaccuuguacgggcaaacuguacaguaugugaggugcuggcaaaaaaacaaaaaccaagaaaaaaaaaucccaucaguacauaaaaagcacgggauaugacguccauccuaagaucagccuuaggacaccugguucuggggugacacugucagccugaccucuuggggaaaaggcuguuuaauuaaaaaaaaaauuaaacaaacaaaacccagagcaaauuaggugccgugucuuacagagacgacaaugccuuuggagagaucacuugcaacccgaagauuaacucucuguaaaaggcuggcuggccauuucagccuguggcuuuuggcccauuuaccauauuuugcgauguuaaguuuggaugaauuaaaaaaaccacacaaucuugguaucauuuagccauuuauuaaaaugguuacuacagcaccagaguaagcuguuagaguggacuccccagagcucaagggugacaccguucaguuuuacuuucaguuacgaaacagaguuaccaaugaccacauugguagaauuucaaaaauuguucccaguuuuucuggcaagagccgggaaaggguuccaaauauuuaacuuugauuccggccguucaaauucccaacaaaaccugaaauuucaggauguucuguaccaaggccacgcacguuuuuuuuugcaaggacccccccaaaucuucaucuugaugcuucuaguuacccaaagccagacuuuaacaucuguguggggucugacaaagcagagcuuuucucucaaacauuuuuuuuuauuaugccgggagaaagucauuugagugcuagauccccaucaacuaaccaaaauuucucaacugucacaaaaagggacagcugucgagugugugcacuucccauuggugcagagguuauggugaagucagaggcgccuccacacaaacugugucagccaugaucuacaggcaguuugaaaaucucaacacagaacuacacacucaaacacauacaugcuuuuguauuuggaaacagccuuuuuucccccccucuuacuacugcucugauggcccggggaaucgaacucagaaaucaaucugcaugccaggcaagccaagcagccuagugcugaccucuagucuaccacucuuccaucauaucaaccacggguaagugacccccaaauggguaacccuccaaaacaugacuucuggagguucagccaacuaacuuaaaaaaaaauuaguagacucuuacuuagaagucaggcaccaauccuauguauccggaaagacuuuuuaaaaagugaauuugcucuuuagcauccagaaaauuaugacucacuugcucuuagacaaauaugaucugggcuagguaaauaccaccacaccuuauacaccuccaaccuucuuuuccuuaugucacagguucuagggcgagaccgucaacuuauaaaacccaucuauuuuacaauuaacaauaccuucuggaaaggcuggccuuaaccggucaguuuuaagcgcuaucccacguucugucuaacuugcuugcacgaggacguacaauaauagcaguaaaacagagauucggauuucccauacuuucaagcuuaaauuauuuuuaacaccgacuacuuugaaccgcaaguugcuuuuuuuuuuuuuuuuuuuuccuggagccaagaauauguuuaucauauuaacugcccugcacggcaggcaccacuuacacauacuuacauaaaaagagcaauuccaguauuagccauggcauaagaaagcccaaggauuccacugcccacaaucgcauugcucagauuaaauacugacauuccaaaggaaguaguaccuggaugcuacacagagggaaacgauaaccaaacauauaacaauaauuaaaaggagaaaaaccagcuucgggcaagucagauuugaaaucuaaaaguaacacuauucuuugacuccauaaagccaagcacauaacaguacuguuaacuuacaaagucuguuucguacuucuucuuccccaaauuugauucaaguaaaaaguucugguuuucgggauccacgucggcauaauggcugcaaacacauaauuuuuuuuuuuuuuaaaaaggccguuguaacccaacugaaagauacgaaaacuauaguuuacaucauguaaagcccuucaguucugcuuaaguuaaugcaugaacuagguguucucgaagguaauaccaucugucaugcaguaacaaccggguaauuuagcaggcuacucucuccggggcugugagccaggggagaccgaggcuucgggugagccuucugguuccugggugugcgcguuagccuguaaccgaugagcaaucccuccagccccgaggcacccgugugugcaagcuggcuuuuuuuuuuuaauuugcaaagcacauuucuuuuucccaccuuuucagagcagccugcuuggugggguaugaguaguugaagucacuguuggagcuguaacugcugcuguccucauccggggagauguugaaccuucccauuucggucuucuucaugcugcucgggagggacggacggugugcggcucgcucgcggcgcgggcuuccuuuuguccuuggcggcgcacuggcccucgaggcugccugcgaagguagaaggcggcgcgucaggacugcggcgcgcgcccgcccgccccccccccguaccacgugacgccgccgagcggcgcagcgcggcugauucaucccccgccaggcgaguggaaaaguaccaggcgagcgaggggcgggggcgcggcgaggggcggaaaaguaccgacggcggggccgcgagaacaaagaugcgcccgccgaggcgccccuccagccgccccggcgcugagcccggucccccugccccagccggggcuuguuuacagggcgcacgccgagccuagccuccggcaagccggggacugccccggguacccggucacccgccccuccucuaccccgggaggaacugaugcaauaccgaggggcgauugauugucaagcccucgcgcgguucgccuugccccacgcccggaccggacgauuauuuucgaggcacaagacccgauugcaagcagccgagcggcccgugcgcgauucccccuucccccuaacgggaggcuguggccggguggccgcaagcccccgcucccgccgccggcgccgcccgcguccccgccgccgccccucccccgccucaccucggugcucucccugcgagcuggcccaccucacggcagcgucucccgugggcugucucggucacacaccagaauuguaaaacgagggaaaaaauguaacagugacggaguccuuuucuuuuauuuuuuuuaauaaaaaauuuuuaaaauuuccccguaauccaacaacaggcagaagagguggauuuuuuuuuccucuuuaauuauuaaagaaaaaugaaaaaaaagagcggggaauggcgaucacgauccuccggcggagauugagggguagcggcgcgggcgacggcguggcgcgguguggagcagcuucccgagcgcga

SEQ ID NO: 7960 - RNA, 463 nt, Mus musculus
uguuuauucuuucauucaaccagcauuucgcucuccucgggggucuuuguucaaccgaaagggaagggcccucgccauuccggcagcaccgaauauucucgucuaggggucccccugagccgcccggcucugcaagaccaaaagcaccaccgagggaucugggcuguagagaaagcuccaggccuacauuccaacgagggcgcucucgcuggaagcccggggagacgcuagcaccagggguggggugguagcaggagggaaaguguccaccaagagggaacagggcgccccugggcggccucggaagaacccagcccgagguucuuuuauuaaaggugugucuggcuugcuggucaaacgcaaacccucccuaguacgcuguggcacgugcaacccaaaagucuaugccgacacgcaacugcgagccgccucucauucaccaccaggcuagcacuggagagug

SEQ ID NO: 7961 - RNA, 3273 nt, Mus musculus
cggcgcccgaggagcgaggacgcggggacccgccucccgcccgcucccgaccccgggcgcacgggauaaaaggcgggcggcgggcgcgggagcccgggcccugcagccugcgagcgccaccggcgggccggcuucccccgccgcccaccccgcucccggcgcggccgagcuccggcgguaccugcagccgagcgagagagccggggagcccgcgccgcugccucgaaacucgccaaaguugagaggcugccgcccaccgggagcuggagggaaggugcgagcgcgcggggcgcaaaccggcaggcggacgcgcggaccuuccgagcgcaccgccgucggcggccucuccgagccgcugcggcuucccagcgcugugaguggucggcuagaccgacggcuggcuaaguauuuccguucaauuguuuaugggaugcgauuguguguuuuugugugugucgguggagggaguuaaggcagaaugcauccuuuagaaacaaaaacacacaaaaaagccugaguuucucaugcugagacugucgcauugagagaagguaccuggaaaucucacugaguuggaguaaucuaggaaaaaugcauauaacagguucuuuauuaaaaagccaccccuguuggagauggaacccauuucaaaaguuaauuggaaugaaagcaauuacggaauaacucuaacggguuaacuaguggcaguuaacuuguacuuuucucccguuuuaaauguuguuaccagauuggugggagacugagcugaugagaagcgacuggcaagagacucagaggcgaccauaaugucguuaagguuccacacacugcccacccugccuagagcugucaaaccggguugcagagagcugcugugucuguuggugaucgcagugauggugagccccagcgccucaggaaugugccccacugcuugcaucugugccaccgacauugucagcugcaccaacaaaaaccuaucuaaggugcccgggaaccuuuucagacugauuaaaagacuggaucugagcuauaacagaaucggacuguuggaugccgacuggaucccggugucguuugucaagcugagcaccuuaauucuucgccacaacaacaucaccagcaucuccacgggcaguuucuccacaaccccaaauuuaaagugucuggacuuaucauccaauaggcugaagucgguaaagagugccacauuccaagagcugaaggcucuggaaguacugcugcuguacaacaaccacauuuccuaucuggaccccgcagcguucggggggcuuucccacuugcagaaacucuaucugagugggaacuuucucacacaguucccuauggauuuguauacugggagguucaagcuggcugaucugacauuuuuagauguuuccuauaaucgaaucccuuccauaccgaugcaccauauaaacuuagugccggggagacagcugagaggcaucuaccuucacgggaacccauuuguaugugacuguucucuguacucguugcugaucuuuugguaccguaggcacuuuagcuccgugauggauuuuaagaaugacuauaccugucgccuguggucugacuccaggcacucccaccagcugcagcugcuccaggagagcuuucugaacuguucuuacagcguuaucaacggcuccuuccacgcacuuggcuuuauccacgaggcucagguuggggagagggcgaucguccacugugacagcaagacuggcaauggaaauacugauuucaucugggucggucccgauaacaggcugcuggagccagauaaagacauggggaacuuucguguguuuuacaacggaagucuggucauagagaacccuggcuuugaggacgccgggguauauucuuguaucgcaaugaacaggcagcggcuguuaaacgagacgguggauaucaugaucaacgugagcaauuucaccauaaacagaucccacgcccacgaggcguuuaacacggccuuuaccacccuggcugccugcguggccaguauaguucuagugcuacuguaucuguaccugacgccgugcccaugcaaaugcaaagccaagagacagaaaaacacgcugagccaaagcagugcccacucguccauucucaguccuggccccacuggcgaugccucugcugacgaucggaaggcagguaaaagagucguguuucuggagccccugaaggacacggcggccggacagaauggcaaagucaagcuuuuccccagugagaccguuauagccgagggcaucuuaaaguccaccagggcaaagucugacucagacucagucaauuccguguucucagacacacccuuuguggcauccacuuagcugggugccuguguucgucuggugucgugauuuaaagucucccugcuuuaacuuugguccgaagaauuaauagcaggacggggugaaaacccuauuuugucuuuugagaugaaaccaaauggugucuuuuuaagaugguugcuaggaagugaggcagagcacacugguugcuucuuggacugggucaggagacgguugaguuugagaguuuugaguaacagcaucuuagccuucagcaucgccgaggauuucaaagcugccuugaaggcaguaggaccagccauuaucucuuuauuugguuaucuugaaggaaaaauggagcuauguguuagcauucuuuaaaaauagacucuuuuugacuuacuagaaccaaaguugagcugagcuuuuuuuuuucuuuuaaagaaaaacauuaguggcuucuuucccuuuuaaaagauauagaaggaagaauuggcuauuuauaaagcauaaaguuagcauagagguuuuucagccaaaaucaucauuucagaccagaaugacaaacuuauaacauccacaggguucugccacaucccauguagugcaaagggacauuuagcuguuuagcugucuucuccguccucgcuguccugaauacccugguacaaaagaucucgcugaaacauuaaagaugucauuauuuguugcaaagaauaugugucaguaccgaaaugucugaguaacucccuaaaccuucaucguagcagacucacggcuguccgucugcuuguguaucuguagaaccuuaaguuaugugaauggcugaguagacccuaaugugcuguguuucaggcauuuaaauccaugcaaauacauacacgugcucugugacuuuaugcuugaguugccuauuuaccgaugcaaccugaaauguugaacguga

SEQ ID NO: 7962 - RNA, 1848 nt, Mus musculus
aucagucccugccuccagguuccugcccugugugagcuuguguccuggcuucccuugaugauggccaacuaugagaacgugugagcggaauaaacucuuuccuccccugcucccuuuagaagcccuaacuaagacaagcuaauaccagcauagugggguuuugcugcggcagaccugcuuuuggaaggacuguagaagucuccuuugggaggggguuuuaugauccuguucuggauuuuaggguccgucucuggagcugauggucuuaucaccuaauuucugggacuuacaguuuguuccuggagcuggugccuuacggccuuuuuuuuuuuuuuucaaaaucaggccuggucuuuaaauguagaggcuuuaagugcauggauugaaugcuuauauccaccucagaucuguacauuaaaaccccagagccucaguguguagcauuuggagauggagccucugggagauggaugaucugucacaaggcuagauugaugagacuagugcucuuaggacaggagaagaggagaggagaggagaggagaggggaggggaggggaggggaggggaggggagaggaggagaggggagaagaggggaggggagaggaggggagaggagaggagaggagagaggagaggagaggagaggagaggagaggagaggggaggaggggagaggagggaagaggagaggagaggagaggagaggaggggagaggggaggaggggaggggaggggagaggagaggagaggggagaggaggggaggggagaggagagaggagaguggaggggaggaggggagaggagaggagaggagaggaggggagaggagaggaggggagaggagaggaggggagaggaggggagaggggaggggaggggaggggaggggaggggagggcagggggaggggaggggaggggaggagaggagaggagaggagagggcuuccucuuccucucuugagcuuacccucucccucuacacugcgggaaugcagcaagaugguugccugcagucagagggaccugcaucaggcauggggucacagcaucugggaccagaggagagggacccuguagucuccccucccccagccugaaaccugcuugcucggggguggagcuuccugcucaaucuuucugccacgcccaccgcuggaaccugccgcuuugcuacuggaccccgagauuauuuggcgggaauugggcccccuuccccugcuucauaacugcgugcagaacaguaaaauugagcuuugaucagaaugccugucuaagcugcauuucuuucucucgccgccuagccccucuucucuuccagguuuccaaaaugccuuuccaggcuagaacccagguugugaucuacuggccagacacaacaggacccucaccaggcaccagauuggagcauuagugaccaauaggaccuucaccaggcacggggucacagcaucuaugaccagagggaccuucaccaaucacggggcccaugguaguaucagugaccagauggaccuuccccaagcaccgcgucuacaguaucacgaucuuuucuuuucagcccccagaacagaaugcuugcuucuaagccgcuuaauuguuuauuauuuuuaaagcaaaccugagcaaaggcgaguggggacuaggaagaaucugcucucugugugguuaugagguuaugcagaaaguggcuuccacagggcagugcuuaguuagauauucacgaaacaagagaacaaugaaggaauccaaaugccguggaauggggucuccagacggagagccuuugaacgugcacaaagcccuugccugaacauuaaagaccuuuucucauuguuaag

SEQ ID NO: 7963 - RNA, 1297 nt, Mus musculus
cagauugggcaacgcagcaggcagggagagggguuaagaaaggguggcugcgggacuggcaacacaccacccugucuccgcacauuccacuguccuccccauaccccaucaucuccacacacccugcagucccaacaggcacucacugggcugccagcuugaugaacuuccugaguagcugagcccgggagccaggaacagggcagagacagagcucuguggccacccaguacugcagcucguugaagcggcgcaugaagcgcuccagguucgcgguggugacaucccgcaggugcugggggcccaguacauaauggaucagcuccaccuggacgggccaaagaccaggucagcaugcuaggccuggugucccgcccacacccuccuccuccugcucuaccuccugcaccugguggauccuguugaagagguuccagucauggucggucagcuggccugccagguccuuggcgcucacuagguccagcaucucagaagaacccagaguggggcccagcugcucaggguguggggucuguaggagaagaaugcucagacacagggaggaccugggacaaaaacucugccugugguggugagagggacagcggacagacagacagggcacugggaaguagagaugcuucucgggucuguggacggugaaaaaugggcucuccugaggggucacuguucugacaguucccucaugcuggaacucuggcuugagacccuggaguuaggguuagcuagccccucuuuccccuuggcaucucuaaaugcuguggcccacccucccuuuucucccagugaagacucaggagcagccagaggcaagcacguuccuccauucucuguggccaccccccagaacccacccugccuccuggucccagaguuccucgggcucuggcagccugccugucccuaccagcucaugcacuuccugugggucgacaacaaagagccgcucguugagccccagggauguggccacaccacgggcaucuggcugcaagccaacgacaucugugaagacagcagaggcugugcugaggggaggugguugggacagaggccagggagcagcuggaggcccugccuagcugaaaguguucuucuucuggagauggcuggggagagacucuaaacgcacgggugcucaugaccacaccucgacacugccuguggcguugacucaggcagcaccugagacuagucacuuauggacgagacauccgccuuccugacccucgauuuccucuucaauaaaccaaagccuguaaggcucacccca

SEQ ID NO: 7964 - RNA, 1297 nt, Mus musculus
uggggugagccuuacaggcuuugguuuauugaagaggaaaucgagggucaggaaggcggaugucucguccauaagugacuagucucaggugcugccugagucaacgccacaggcagugucgagguguggucaugagcacccgugcguuuagagucucuccccagccaucuccagaagaagaacacuuucagcuaggcagggccuccagcugcucccuggccucugucccaaccaccuccccucagcacagccucugcugucuucacagaugucguuggcuugcagccagaugcccgugguguggccacaucccuggggcucaacgagcggcucuuuguugucgacccacaggaagugcaugagcugguagggacaggcaggcugccagagcccgaggaacucugggaccaggaggcaggguggguucugggggguggccacagagaauggaggaacgugcuugccucuggcugcuccugagucuucacugggagaaaagggagggugggccacagcauuuagagaugccaaggggaaagaggggcuagcuaacccuaacuccagggucucaagccagaguuccagcaugagggaacugucagaacagugaccccucaggagagcccauuuuucaccguccacagacccgagaagcaucucuacuucccagugcccugucugucuguccgcugucccucucaccaccacaggcagaguuuuugucccagguccucccugugucugagcauucuucuccuacagaccccacacccugagcagcugggccccacucuggguucuucugagaugcuggaccuagugagcgccaaggaccuggcaggccagcugaccgaccaugacuggaaccucuucaacaggauccaccaggugcaggagguagagcaggaggaggagggugugggcgggacaccaggccuagcaugcugaccuggucuuuggcccguccagguggagcugauccauuauguacugggcccccagcaccugcgggaugucaccaccgcgaaccuggagcgcuucaugcgccgcuucaacgagcugcaguacuggguggccacagagcucugucucugcccuguuccuggcucccgggcucagcuacucaggaaguucaucaagcuggcagcccagugagugccuguugggacugcaggguguguggagaugaugggguauggggaggacaguggaaugugcggagacagggugguguguugccagucccgcagccacccuuucuuaaccccucucccugccugcugcguugcccaaucug

SEQ ID NO: 7965 - RNA, 1215 nt, Mus musculus
gccaggaacaugcuccgucgguguaguuagcagaagaacgucagguaggagagaggacgcaacuccaaccuccaaucugguuuucuugggcuaauccuaaccaguagaguccggcugagcgcccugcaggagaaacucaccugagguuccccauccggcgcgcgcagagaacggcucccugcagcgcgccgcgggcgucggggucccgggucaacucagguacgggugacacaccugggggaggcguuuacagcagauuggguagaaccacggcggcaggggugggugguggcuacaucacggaucaucacaggcagaaacguggauuugcacacacgacaucaucaaauacuguuccacggaaggcagacgccugugcugcacuguggcuggcgguccuggagccccucacaaggcagggccuccaaggcgacagugcagugguugauuccaagucaagaaaguuucagggcuucagaggacugaacuuagugggcgugguugaggggcagggcgguccgggggcggggccuugcgggggcggggccaggugcugagcagucucugcuugucaaaaagcugcugccgagcccuaagcacgggaagcgccgagcuguguguccaccgccagaccaggugcggaucggggugcagggggaaggggguucugggugagugguuagacccggggcaggcgucugggaucuagaggucucagcguucgggugcaagcgcuagaguccaagacucggaaagcaaaguuggcgacugagauccgggcuguggugccaugagguugggacucugagagggcacccaagucugagaaagcugaaguucguacgaggcuggcgaggggacagccaccuccgcgaugcucaggcggcucagcgugggaguccuuagcuaggagggugcucagcgcuggacaacaagaagcguuuguuucuuuccugggacgggcgcuuugacuuggaguggaggaguaagaagggagugauuggcugucgauggugcuaaggucucuggagguggaguguguagagccuguuuauuacuucgcggagccaugugugaucaccagugauaguggaguggaaucuuuuauauggaguuuuuuccuuuugugcuugccuuucuaaaaccgccggugcuuugagaccagugugcuagguuucucuuucaggagagccuguccacagauguccagaggga

SEQ ID NO: 7966 - RNA, 6089 nt, Mus musculus
gcgcucgcccggguccucgggcgggcuugcgguucugcgcgugcgcacgggcggaggcgcgccgaggacucgcuggagcgggcagguggagggaggaguggucccgggaguaacugccagcaguuggugcgccacagguccgggggcgcccgcguucccgagccucggaggccugaacgcguucggaacguggcuuuuuuugugcgggggcgugaccugagcccgccuccucggcugggaguggaggagaauggggaucgcugaggccuuuaauuaaucuggugccuguuguuugugugcccgaggugcagccuguuugccuuuugaguuugcaaacagaggggaggaagcggcgggguggggugggggagcaggaggggagauggggucuuccgggcagagagccuaauccagcgagggccguccuauuccagggggaggggaggccagacacgacacgggacacugcugcaaaaggaaggccgcaguaggaacugccaguguugcgcacacaggcacacacuuagaacaacagccucuugcucaguauuuugcacuuuaugcagaagugauuuuuuuuuaccucuagagcggccccacauggacacuaacacgcgcucaccaccccccuccccauauaggagaugacacauggggucucagcacuccucugcccucacauuuugucagcgaaagaaggaugacaacccggaggacuugcuggcugauagagaucaggaggaagccaucgcucaguuccccuauguggaguucacugggagaaauagcaucaccugucacaccugccaaggagcaggcuacaucccagcaggugagaccaucggccaucacacggaaagcacucuggcaucugcuccagccagcccuccauagucauagcccgcccugaauuguagccagcuccgcugcccugauaaauggacagacuccagguuuuuuguuuuuuguuuuuuuuaaaucuuacacucggaacccuuucucuucuucauuucuacuccuuuauuaaugccuuaguuucuuuucugguugcucugauaaaauacucugacaauggcaauuuaggggaugaagguuuauucugauucacagcuccaggucacagcuccaucacugaggacaaguuauacaacagcagcaauuugaaaucgcuuaugucaccuuauagucacagcaaacagcgagcgaggagugcucguaccugguuuccccuucccuauucauucagagauacagccuaugaaaugggugccacccacauuuagggagggucuucacauuucaguaaacccaguuaagaaaaucacucacagacacgccccgugggccgaccuaaucccgucuguauccacugagacaucuuccuaggccacuccggguucccagccccucucugguuuggaauguuuauuucucugcugugggaucuguugacaaggauguuucucuaucguucuugcucauaaggauggccacagcauugugaaggagauauucuagcagauccuuuacaaacaaaggcaccaugagcaguagccaggggucagcagaauaccaggggguggggagugacagucggcucaggaguggggccuggauuaucuguagcaacagcugccacuaaguugacccuagguguugggggagucacagagauuagagcuuuuaagaaccuuacaaaccacacaaagcuccaagugaaaagugacaauggcuuugagauguuccgagacuucgucaaagacagcgaaggcaagagccccccagccucagugccgcagcccuacggugcugguagaaguuuuacaguuuguggcguucuccuuaggcuaaucuguuucuuccccuccagcuuuucuuauccugucucuacauuuacccguuccuucauccaaccaaaaguguacguuuuagugucuaagcccagcugaaucucagcugugccaguugacggcgaaaugugacaagaagaggaagggccacucauaccugggguuuacagaaugagucuguguuugcugcuuuucuagagcaagucaaugaguugguggcuuugaucccccacagugaccagaggcugcguccucagagaacgugaguuggcuggcucucaucugccaauaccuucuucuguucccaacuccucucuaugaaagaacaccaaguaaucuuugagaaagaugucuguucuuauaucugcccuguuuccuuauuuucuuuauccacuaauuuaugauuauuaccucauuauuuauuuauuuauuuauuuauuuauuuauuuauugugauacuaaggcuugaacccaggcccucucacuuacuagacaagcacucuuccacugaacgauagccuaguccuccccauuuccccuagaacuuuugcuuaagugaaaugucucugucucguguuacagucugggcaaagaaaugugaagcuagaaacaucuuaagggucaacugaaaggaagggguuggggaaagaggccguccugggagaugagcgguguuuaggagauaaaagcaccgguuucucuuuggagggcgaauggugcucagaagggcugaagggccuuuucuugccccauugcucugugcccagucugugcuuccugauucuguucgcuuccuuucacugcaucaguauugugucaaucaggaccauuuaggcucccguaucugguaucugaccgaccacggugacccugugcugucguuugcagaaaacaguauguccuccugucgguccugcugugucuccuggcaucuggccugguguucuucuuucuguuuccacacucgguccucguggacgauaacggcaucaaagugacaaaagucacguuuaaugaacaggacucccuugugguccuugaugucacgguaagaugaacggccucgcuuccuggccugcgcacuugccagccuuagaccgggacacuuaccuggcgcuuccucccuugcccuuccuaggccacccugaagaucaggaacuccaacuucuauccuguggcggucaccaaccuguucagccagguccaguacaugaaggcuguggucggcucguacacaaccacgaaugucucacucauugccccuaggagugagcaccugguaugucguuguugaugggccucugcccacgggcuaaggaagagagcaggugcugugaggaugcugugaggaugcuguggggaugcuguggggaugcuguggggaugcugugaggaugcugugaggaugcugugaggaugcugugaggaugcugugaggaugcugugaggaugcuguggggaugcuguggggaugcuguggggaugcuguggggaugcuguggggaugcugugaggaugcuguggggaugcugugaggaugcugugaggaugcugugaggaugcugugaggaugcuguggggaugcuguggggaugcuguggggaugcuguggggaugcugugaggaugcuguggggaugcugugaggaugcuguggggaugcuguggggaugcuguggggaugcuguggggaugcuguggggauggaugcugagguuccaucccauuccucucuucugcccaccgaagaccuguaaugauggacaguugggaagggacagaauuggcuaacauacuuggacagugaaagaauugaugagagaaagagagucaccaaaucaagaggaggugggacuauagccuaaagccugaggccccuaggggaagggccccaagguuuucauuucaagcuccgaggaugcuuuguaugugauggaagaguggcccagcaccuguggguugaucccauuaaugcuguugugagaagcuugccugucauaggcugacgcgggucuuguuuuauuuucaggugaauuuuaccgugaaggcugaggugggaggaccgucuuccuauguguaguaaggacagaguucucucuaguacacuaucugccuggagagagucagaguccuccuugauugacugugucccuggcucugccgugagccccagauuuggccuguggacucccuagcuuuaucuuccuguggggguuuugagaggagaugucauugucacaugacuaaaguucugagcuuucuaaagaguauuaaccacuagaaacagccucaaaccccagcauguaaacagacaacggcuuugaaaagcaggggcgugguguggagggcugcagaugacaccuuguagggcucugaaccagugguccuuggcagcauuuugguuugaagggcaggcaugggaaagagaaggugccccacauaguuugacaguguaacuccacacugcccucuaagucuccugggagauggcaccuuucuugugcugcugcuccguugucaaucaggugaccgugucccgugucuguguuugcaacccacagcuucuacugcacacucccugccauccggguacacaacauugugaucuucaugagguagguccucugcccucccuccugcuggccuuucucuuugagccugggccgcccgugagcuuuccacacuugcuggagccaccuggcugacaggagacccuugguauucucucgggguggaguccagaaccccugcacaggcugccggauucccacuggagacuuaaacauacuguuuggagagaugguuaagagcgcugguugcuuuucuagaggaccccagcuugauuccuagcauucacgugucagcucacaguugucuguaacuccaguuucaggggaucaauguguucuucuagccucuguggguaccacacauacacaugguguacagacccacaugcagggagaaacaccuaaacacaugaaauagcuauuuucuaaaaaguuaaaagagcuacucuguaugaaauggguucuaguuucacuaaacgagugauccugaguaaggaccagccuagcuuucucacgguguaaguacuaagcauuuacccucaggggucagccauuaguguugcgacugaggcuguucacaguagagaaaucugggauuugagugaggauucucagcuuugucgccugugaguucucugucgucagugacuguggaugcuucagaguggcuccccucaucucugcuugcugcugggagcucucgccucaguuccacucuguugugaugacccaaaggugcccagauggugccagaagccccucugugggcuucugugucguaucaucccuguuuaagaaacaguccagaaggucacuucaugacaagguuuuuggaauaaccagaaagguccucuggccuccagguuacauaaccacaaagauaggagccuggaacccucaacuuguaagacauuuucuggguacuauuuccuguuuuuuaagucucuucauuguuuuguuuuuugcuaggacuucugugaagauuucauacauuggccacauaucccagagcaccuuggagacacagcacuauguggauuguggggugaauuccacagcugcucagagccuguucuugguuccucgggggccacaccuguagaaggaagccuaacaucugucccuauggcuggcccauuuaccacaugguauaaguagaggaggaagaagaaacccgcagaaagcauccucccacacuuaggggaaagccgccccuuccaacgaaaccacuguccagugccuagucugugccuagcaaauaguuagcacucaacuacagguugaagaauuggauucagauauucuggcugcucuugagucauuauaaguugagaugaaccaggguuccagguuuucagaccagaguaacaugaagguagguugcuagugcagcugcagacguaugggugugguguccaggacacccacccgugaggagcccucagcggcugccucugcaucuguucccuaauaccucccccucccgccucaccccacccccgcuuuuuggaaaguuuuuggcguuucuuuuccuuccccauacaaagugauuacaguuucccccgcaagggucuaucgaagggcuugacggaccuuugauccacuggcuggauauagauugggaauuugauagaaaaauaaacccugcuuuugauugaucugcacugucu

SEQ ID NO: 7967 - RNA, 31187 nt, Mus musculus
gacugacagugaagacgaauuuccugaaauuacagagguaaagaagagacugaaaaugucugcaguggagcugggugugauggcgggcaccuucaacccagcacccugcaagcagaggcagguacagcucugccuuugaggccagccuggucaacaccaguguuccagaccagucagagcuaccaagugaaacccugccucaaaacaaaguuagcugagggaaguuucaaauguaagucaguagaggaccugacauuuagauuaauuuagcuauacuuuucauuguauugguauaauuauguaccaguguuuauuuuuaaagguaauuaaaaguuguucauauggcuaugguuggguuuuagcaacuucagugagaagguauguaguaaauuuauauuuuauauuuguuuuuaauacuuuuuuauuucaaaaaaaauuuuuuuuguuguuagguuuggcuugggagauugcauucuguuuugauuguagugaggagacuugagcccaccauuuccuauaugcugacauaggagauaauuugauaguaaauugugagcugagaaguacuauuucuuuuuuuuuguuuugacuuauuuuuuaaugagcauacaaaggaauagauuucauuaugacuuuuuuauuuauacuuuguuuuuauaauguuucuuuuuaagcaauaguaauccauuaugaagaauuugggaaauacuuagaaaucuauguauguuuuaaaaccuguuccuuaauucauaccucuuugaaaaacguuauuggaccugggugcagcuuggugcuagagugcuggcuucaugugugcaggcugugguccuggguccaacgccagcugcucgggagccagugagcagcacagacauggcauagcccuacuaaguuccauuuuuacaccuucaaaaggacgcugccuuuacuccagggugccuuuuguagcuuuuguuucuugggagaccauaagaaccagaaacauaaaacauaaaccucugaaggagcuuggaagauuugagcaaagguugcaucagucuucaggaagugauacaaaaacaaggaucugaauguuguguaaaaggaaaagcagggcaaggugggugggagguaaccuggaagacgacugcaggaagagagacugaccgguggcuacaaguaagcugacagcggggaacuaguaggcaggugacucgugcugaacacagccagggcacugaugagaaaccaguuuuuucugaaacuauuauguuuggucuuuuguuuucuuaggaaauggaaaaagaaauaaagaauguauuucguaacgguaaccaggaugaaguccucagugaggcauuccgcuugaccauuacacgcaaagacauucagacucuaaaccaucuaaacuggcucaaugaugagguaaucuuuugcucccuuuguaugcaaauagcaaaaagggugagaaaacuaaaggaaggcguuaccucacuguucugcagaugaggcucauaggcagccucuguaaacagaauggagcagaggagcuuuggggggaggugggaggcagucgucccucuaugcugugugcugucgagacugcugcuuccaugcucucaugcuucaccacgcuuaaggcaccugcucugcgguuggaauuucugagcagagaguuacugucagagcguacugcugcgugaggggacucuuggguuucuaggcagggaccagguuuccuuccuucucaucugccugccuuagguuacuuacguugggcauggaagcuuucugaaauaaugcuuauuugaaugugguauuuuuaaagcugacaucgagaaaauuaaauugcuuuuauguaguugauauguagcaagggggaaugauuucaccccccaauuucaauuaaauauauuaauuaugccaugauuuuuaaauugaucuauccucauccuaaaccuuaaaaaggcuguuugagccaggcgugguggagaaugccuuuuuucccagcacuugggaggcagagccaggcggauuucugaguucgaggccagccuggucuacagagugaguuccaggacagccagggcuacacagaaaaacccugucucgaaaaaccaaaaaaaaaaaaaaaaaaaaaaaggcuguuugauuugagaaggcuuauuuuuccuuuauuuauugugugcaugugacaacuugaacaucugaaaggcaaacaaagcauagaagacuaagaaacucccaaguucauagagcaaauacaaagcagaccagggcaguggugcugacuguaagccacuugccucagccccucagaacugggucuauuaugggacuagauguauagcacuuaagaccauccagaugcccaagacucugaguuccucuggaccagcugagcugcuccauugucaguagcacuggccaguuuauaagacagacugugcuugcuguuuuuuuccuuagaaugauaagaaacacaugauuugaugucucuguuagaaaccucacucacaucuuuugacuccucggauaauggaacgcuggauuaaaugacaguagagaagagcucacaaaauuaaaagaggaaaacaaaaaccaauaaugaucaaaaguauccuccuaugcauuguuuuugaugugugaucauucaccauuucucuuccccugccaacugcuggagaggagagucagucauuccacaaggaccgcagccuuuguuuguuauaaguuaugcaaaaccuagggggcagcagugagucggacauaggcugaauucuugcccuucacuguggcagauaccucagagaguccguacagaggcagcauuuaucaggacagacuuuccuuugcugcaacccauuagaggccagacugugagcaugcaguuagugggaacuccgugauuagaguagaugcaggggaggcaggauuagacugugagcaugcaguuagugggaacuucgugauuagagcagaugcaggggaggcaggguuccuugucugcugccuacagugcugggcuggggggagugcuuucaaagccacaguaagucacaucuucaagaugauaaugaggacuaguuuaagaagcaccaauuuuagaguauaguauuucuuagguuuaaguagccaacauuugaggaacuauuacagauacuuaaauugugauguuuaauuacaaauacuuaauucuuuuucaucaauuaugaauauucagucuuuuacaagugcucaugugcuuuucaauucuauucuucccucaaauacucuuguaaauacccauuuuuguuuuguggguccugccaguauuauaggauauguuaaaauucucugcaaaauaaaguaacucauaaauuauucuuacuguugacaaacuaauacaggaaaugaaaaaaaucagauacaguuuuuaaagaaaguaaaaucuuccguaguccaaaggaagaggaggaagggaaguaaaagaaagaaagaaagaaagaaagaaagaaagaaagaaagaaagaaagaaagaaagaaagagaaaagaaggaaggaaggaaggaaagaaagaaagaaaauccagggccagcaagguagccaggaggcaaaggguuuacugccaugcugcugaccuguguuugguucucaaaaccacacaguaggagggaaccaacaucuaccaguucuccugugaccuccguucauguccgccauggugcaaccaugucugugcauauauacacauauaaauaaauaagugugcugaugaaaaugaguaaaaucuaaaaacccugaauggggcauacauauaaagccauuaugccacuuuuccccuguggcacccacagagaccagaaagggggucuggaucccgagacuggagcuggagacucuugagagccaccauguggggcagggaacugaacuccgcagccuuggcacaguggccagugcucuuaacugcucagccagcuguccagcccccugaacacugcuuuguagaucauuaaauacauuuagaaauacauggaaguaauuuagguauuuguacagauaaaacugguuuugcuucuauacaaaauguaucaauaucuaaacauaaaaauaucuagacaaaaccauuuucuuacauauuaugaagguaccccaguggucuccgagagaagugagauuguggauguggagauagacaaaagguacaaagaugacaagaccaucagugaggucuaggaugcugucaggcagccuggugcaacugcagucucagaagaaaagcaauccacaaggagggagagauagaaagaagaaagagcgcaaacauaaagaugcacgcgguaguagauuuaacucagccaugucaguagccaaucagagugaucuaguccagcccucugugguagaaauacaauaugaaccacgcauguuacuuuaaauugaguaguagaaccacuuuuagaagggacuggggucuaguucaguggguacaguacuugacuugcauaccugaggcccuggcuuugcccuccagcagcagaaaaaaagaaaaguaaaagaacuaaguaaauuauauguaacauguuuuguuuaacccauuuauauacaaaauaugucauuuuugguuuguaguccauauuaaaauauuaaugaguuguuuuacuuucucuuuaaaauaggauguaaauucuauaucuuaguuggugauaaucgcagcccaagcaccuuaaccuggccuaguugcugcuauauggacaggcguaagugagaacaagcacugagcagaggggcugagacuggaaaggagacugucuguaagcagcacccuucacugcacugcuggggcugagccccagacagaccugggugccuuagacucugugugcuuuguaucgagacacaugacaaccaugcaagaucuuauucugaaagugaggagacagauaggauuauaaacuaaaggaugagaacaguugugucaugcaaacacuaauaaaaaaagugagucuauuaagagucuacaagguuuagucuggagugagcacuguuagcagugauaguaauuucacaguaauagggaaagcuucacagcccaaauaaaauacauuuaaucacacacugaaaacgugugcagugcagcugguggaacuggaaggaggaagacacaaagcugugugcccucagaggcuugagugcucucucccugacgcugguagagcagacaagugccccggugugaagaggcguugggacugcagccuucccugugcucauuuggccuccaagaaccuagucuccacgcauuauuaaggaccaguuacaugggugaacuggagacuggaaacuagccagaagauauggcugccccuuuugggcguguguguguguguguguguguguguguguguuuguguguguguuugcaagcucauacuaauuauuaccaguuguuuuccaaguaaauacugagauauugaaagaugguacuuguaacuucaccugggaaggaaaggccauggccaugggggcaaucacagcaaaugugagaaucguuugcuaaagggggaauuaagguagugcguccauaacggacacguauacagccaagcggcugggcuaccauucggaagcuucaucuuugaagaagaugccuuucagcuuuccaggguugcaguaggcuuguggauucagacagucucgcuacuugauugggugugggaaguaaaguaaggcuguacggaggcacugggccccguggguuuuacagcagacuugagagcuagaacuggagcucaugcugaccugagacacagugcuuagugcaaguccaggcaugguuuuauucagcgguagagcuccugccucccaagcacaaggcucuggccuugacccucaguaccacacacacaguaauggucacagccggucauucucuccaguggacggauccccaugaugcucggcuagagaggccacagcccacaaaacuuuacacugggacuaggagggucuuuauagggaagaagucaucugcaugagagggaagagacuaggaagcagaggggaccuggguaaguggguagguagacugccagcugugauguucccauggcagugagacagaccaucagagugaagcuaauguuuccagggugacgcucaggcuuucuuacacauccucugcaguguucuccaaacucccucugauaagccaggaccuuaugcaaggucauaugggaaagaguaauuauucuccauaaguauagguguugccugccuguccucuuuaaaauacauuagcaguauuucuggguauuuguucuugaaauuacacauaaggagacaaagucauguguacaguggggaagcuguauuuuuaccaugauaagguggucucugagcauaauagucacgugcuucuguuuuguuaucuuccugucucaaugucugcucgggaagucuguuggaacuuuucuuccugagacaagcagugugggucagcguagcuaugggagagcugaagaguuaaacaacacgccguugcuaggaauaggauacuucuggauuugucugcuuuauugggcaagaaaaaaaagagauaccaaugaucauuuaugucaucaugguaacguucauggagaaaaaaccuccucagcuccccaguuucaguuugaaaacacuguagaguuuucuggggccgaagagauggcuccguguuuaagaccacuggauguucuugcagaagacccagguuugccuuucaguauucacauggcagcuuaaaauaguccaucuccaguuucaggggauccacaugcaagugguacacagacagacauucaggcacaacacugauaugcauagguaaauaaauauauauuuuaacuuaaaaacacaacacuagggcuggugagauggcucaguggguaagagcacccgacugcucuuccgaaggucaggaguucaaaucccagcaaccacaugguggcucacaaccaucuguaacaagaucugacucccucuucuggagugucugaagacagcuacaguguacuuacauauaauaaauaaauaaaucuuuaaaauauauauauauauauauauauaaacaaaaaaacaaaaaaacacaacacuagaauuuuucuuuacagagaggcuucuucccagcuucaggcuggcagcucaucaaauagaauagaaaaggagcaaagacacuauaaacaacucccuccucaaacaaggccgcacagacaagcagaugcuugaugcugaccaaggcucuucagggaauaggaaggcaguuucuuaggcacccgcagcccagccgggggcagcugugcucccagaaaaguggcaagcggucugaccuacagugcuugucagauggcuuuagaggcaagacggacagcaagacucugagcugggggacuuuagccgcuuauuucaaaggagaucuaagaccugcuaggcuaagagaaucucuguccgagagcucuugccaguggagaaggaagggaccuuuguuuucaugaacuacaggcaacugcuguggcacugcugcugcccuuucauccugagcacugugaccccgucucucauuucucucuccuugguccccagccuccucagugagguggcacggaggauuccuuuuguagcuuauuuugagcguggcagugucuugcaggaccacggcaguuuucuucacuugaggagagaacgacuugcaucuaaacucagccugcauaucagauuacacaucucagcuaauggaagggggugucagggucaccaaacuccaucuccugggacgagggaagauggaacggggccuagagcaugccguagagcuggcuaguggcucgugggauggagggagacccagcagugagaaaagauucccuguucuccucagucuagcagucuuguguaguuggugcucucugggagggaggaaaacccugacuauguaaaaacuugucuagguuuccuucugaaaacuagaauacuuauguauaacaugucaacccuuccccugucuuuuuaaacuucaagcuagugauuccaaaaguaaugaccacuggacaccugggagagaaaugccugcguggcuuuugugcuugacuauccgucucucucugcccagguucucucugcuuucucuuuagaccucauugcuugauaaaguauauacccuaccugccccugugaaaagauugacuguuuaguuaccugccuauauacuauagcuuuugguacccugaauauauaacuauaauauauauuuauaauauauauaaauauaacauggauaacauaguagacuaaguagauccuauccacuucucugagaggaaacuuacccauuccuuuuugguuaauuuucucucaauagagauuauaguuuacuauauauaaaucuuuguuugccuaggcagauaugccugcauucauaacuguuuucacaaauggagauacaucauuuagggacauuauuguuuggcaguuaaacugaacacuuagauuugaaaacauaccaucugguugcaccuugauuccuuuucguuauuuaaagcuucagggaauauugcacagagaucagagcugcagcagaacggucuucaggccuggcccaucaccuuagagcucuugguuugguuucccugaagcugccugugcgucuguaucuaugggcccuuucucuggucuagaccaggguuggguguauuccuggcaggauucccuguggacaguggcucacugcucuggcauccugguguguaaauauuugucaaaagacgggggcuuuuucccauuccucaaaaaacauucugaaaaaugucccuguuuucauagucauauuuccaagcuguggcucaguuagcccauucauuccuuucaguugacagacacuggcuuggccuuagcuauccacauaaaguaaguaugcuguaauuuuuggccuaauaacuuuuaagcguuaggaccaggacucuggaccuaaaggaaccacagacagcauaguuacuguucuaaaagacauugcuuuguugacuaagaaucgcacaucucuucuaucaaauauuuuaauucaucaugcgcacacuugauacugaagaagugaugcagugaugagaaagcuaaccaccucgcuucgucaugcuaggaccugacgccuggguucccaggggagggugcugugcuauugcaggcauuuccuagcuugucucagggguuucuggucuuagauuugcgcgaaaccgaagcaguuugcugcugcacauggcugagaaggccucagaugcggagcuggguuuucucugugugcaacuguaauaguugaagucuuuaauuccagcacucaggucucagacaggacauguaccacagguucaaggcuagcuugggcuuuauagugaguuuaggacagucugcuacagagugagacccugucucaacccaagcagugagaagaggaaggagagggaaaaugucagggagggagaggaaggagaaaagggcagagggagaauaagaccagagcccaggauccacuugcucagcacagacacucagacagcucccacugcacuccugucuccucucuccgguucucaucuuccuccuccccuccaguuuucugcuagucuggcuagcagcugccuaucugcucugguuuccagcaguuaacuuaguugugugauacuuaagaaguaugauuaauaaagucuuuauauuaaggaaaacuggauauuuaaaaauuaucuguugaagcauucguugaguuggcugccauccauagcauaauacauacgcauauguuaaugacauucugauugugcuaguguuuggacuguucuaauguguaaugucuuccugcagaucaucaauuucuacaugaacaugcuaauggaacgcaguaaagagaagggguuuccaaguguacaugcguuuaauaccuucuucuucacuaagcuaaaaacagcugguuaucaggcagugaaacgcuggacaaagaagguggauguauucuccguugauauucuucuggugcccauucacuugggugugcacuggugucuagcugugaguaacuccuuuauuuuugauggcaugagaaagagaucuacguaggcagcauagccagcccagugggccauaugaucugugucucugcuuugcuauggaggagagguggaauuucauagugaugccucggcuuuagaguaggggaugcuuagguucggaaguuacaggucaucccgccgccgccucaggugaggcaaggaacaagcauguuuguggugccaccagccccagcuuccuaccuagcucugacuugccuugugcauguggggguuuagcauuucugugcucuggaagcaugaagacaucagcuuaauguuaauaagaguuauuguauauucuguuuugaauuacauuucaaagauaucaaucuggggcuggagagauggcucaaagguuaagagcacggacugcucuuccgaagguccugaauucaaaucccagcaaccaccuggugacucacaaccguccauaacaaaaucugacucccucuucuggagagucggaaaacagcuacagugugcacuuacauauuauaaauaaauaaauaaauaaauaaauaaauaaauaaauaucgauccaaaaaaaggaaauaagauaaaaacaaacgcagaaucuugucaccaucuuucuuauacugugggaaugaucuuaugauaguuaauuuucugugaaucaugcauuguugaucauggagaaaguggcaugcaaaaaaagauuuuaagacaguuaauaggccacugguggaucaccccagcaccacccuagguaaacaguccccuugcucuucccaugcuagaauacagcacauucaccauacugcucacagucucacagacagucuggggaaaggucaaggccaagggaggccagcugaugaugcguguguccugacuguuuugucuuguuccagguuguagacuuuagaaggaagaguaucaccuacuaugauucuauggguggaauaaacaacgaggccugcaggauccucuuguaagugcaaauugaggacaaaagaaauguuuguugcuuucugucuuuccagcaaucugagugagaccuucggagaugggauuaguggcauugucacaucaguauaaaugcauauuuuaaauacaauauguauuaaugagggcaguugcugucuuggcacacugaaauauagaguaaccauauacauagaaauacagucagcagaacucauauuuaauucagcuuucugaaauuuuaaacgaaaaagucccacagagaugacuuugcuuuggucuuacuacuuagugguucccuuggaaauuagaaugggaaucucuuacacccauuugcuucucuuuguaaacaccagugccuugcucugcaacugauacauggcaagggggauaaguuccugaacagugcgcauuuccuucuucaaaagagugcucuuggcuagggagaggcucagaggcuaacgggcuugcugcacaagcauaggaaccauaguuaggaucaccagggcucacauaaaugcucuaugugugcaugguucccacucaacuccagccuuggaaagcagagacaaacugacuagcaagacuaguaguaucaaugugcaccaugcacacacucaugcucacgugugcgucaacacaugcacauaccacacacugcacaccacaacauauacacaugaaaauuggggaagaguccucugaauuuguacuguuuuguuuguguuuuugagacagguuuucucuuuguagcucuggcuguccuggaacuuguucuguguaauagacuaagccagccucaaacucagagaucuuccucccucccaaggacugggauuuaaggcuugugccaccacugccuggugugaauuuguacuuguuaaauuuuaaaauacauacccugauacugcuugagacauuuuaaauuuuauauuuauauauauauauauauauauauauauuaauuuaauaauaaguuaugcauuagguugauaauuguaaaaggaccauacaaaccaagaaaaaauaaauauaaaaauauuucuuagaaagaugaguagacugaagaauuuagaaagaauauuaccuaucaggaaucucagaagcagcgguccugucccuccuggcagguggcagaaugggcugcuugugggaccugugaggguugucuucugagggucgccagccccauucuguggguggcagcugccaucaagcugcacacagcucaucucggucucuucugaugucuuuaggcaauaccuaaaacaagaaaguguugacaagaaaaggaaagaguuugacaccaacggcuggcagcucuucagcaagaagagccagguacguuucauguugauaucauagcaaucuuuagagcugggguguuugggggaagaggguucugguugcugucugacuccuauggacugucuaauucaagucuagccugacuucagcuuucucugguuucucaagggagaugaauuauuuguggggaagcucaugauguguuucuugugcaaaacuguuuucuaaaugcugagcuguuugcugagauuuuuacuccguugagaaauacuuguugacuguuuggugcuuagaaggaggaccaguuuguacacccuugggugccaugaaagccugagagaggcuccugugugaccagugugaagcuaacacacaaagguggaaccacagugcugcauccuuaaaccuccuuccccuuaggagacccaagggaaaugguguaaaauugauaaaagaaguuugcaaaaauauuuuguuguuguuguuguuuuaggaaaucccacagcagaugaaugggagugacuguggaauguuugcuugcaaauaugcugacugcauuaccaaagacagaccaaucaacuucacacaggugaggcaggccugugccuguucuguggagccucugcccugaccuuuacauacuucaggcugugucucagaucacugcacaaaaggagaaaauguuggucuacacgccaggcuaccauugucacauauaauagugacugagucuuggguuaagaagaaaagucuuuauugucuguccaucucccccagcccgagacacacacacacacacacacacacacacacacacacacacaccccaccucuaaccuuauaggaaacacaaacugaaaccagaagaagccuucuucacuuccccucaauuuagcauucagguuuuggaauauuuuggaauagacccaaguaaaucucuuuguguccuuuguuacacacccccuucccuggcccguugucagugccacuggucaguuuuaccucaaagguagaaggucauuuuccuagacagcauccugaacccaagaggacugagacuacaaaucccagcugauucugauauguuuucuacuuuugcuucuguuggaaucagcguccugucuagauuuugucugaaccagggcuucguaaauguuuuccucuugaugaggcuugaaagaugcucagugguuuaagaugcuugcugcucuuccagaggacuggguucaauuccuagcgcccacauggccuauacagccuuugguaacuagaguuccaggaaauccaccgcccucuuguggcuuccacagguaccauggaaugcacauggaacccagacacacaugcaaggggcauuuguacauauaaaaaugaaugagucugaaagaaggaacaaaacuuacuauucgucuucauccaaaaaguuuuuacauugcccuagauauauacauauauuaaauagauuagugaaacauauaauaaggcaaagaacuuauuuuaaaacaguccucugguauacauguaauuuuacaguugguuaaagacaaaagcgaguuuguacacagaugaaauggaagguuuuggguuugcauguggccuugaguuuggcugacucuaauguuaacaggauauagcgcguccucguuguuuuccagaguggcugacaguuagguuucacagucagcaaugcugagaaugaaguaguacaggauaggaauagcaugcaugugggagucagacaguuguacgaauuccaagaucuaaacgcaugucaucaagcuugguagaaguuucuauacucacugaguuaugucacuggcccaguucaauaccaagguaggccagagugauaauaggaagguacuaaaauucugguuuccauaauuaagcuuuuuuguuucugucaaagcaaaaaguguuagguauaaguaaaacggcugcuguuuguaacguacaguggucugaaaucugaacugggguguuuccagcaacaauaaauggcguucugugcaucacagaucacacagugcaaagugugcuguguauacucagagucaggccuucacuaaagucaugcaccuuggauucauugaacguuugagccugaauuaguuucuagaccugguauguucagaaaccuaucacaguucucagauucuucagaguguccauauucaguuaaaaauucagaugccugggccagagagguggcccauaguuaagagcacugacugcucuuccagagguccugaguucaauucccagcaaccacaugguggcucacaaccaucuguaauggaauuugauucucuuuuucuggagugcuugaaaacagagcacucauauacauuaaauaaauaaaucuuuuuagaaaacaaauucagaugccaaauucacagcccagaguuuaagaaaacccuuggaaaaacugggugcggugauacacacuuuuaauaccagcacucagaagcaggccuaucucuaugaguuagagggcaucuugguuuacauagaguuucgggccagccaaggauacauagugagagacugucucaaacaaaaauaaacuaaaaauuaagacacugagauuuagagcaaagacauuguuuuaaguucucuuacuucuucuccaauaaaguacuuuucauuuuuuggccuuagucucauuguaaacauaaaaaauuugauagacuccauucucaaaauucuuggagucauugggaauggccuagagauuccagguggugcccaguguaaccuguuaaggguauagagcgaaaauugugguagaaagaagcaauaaaggaaaagucagugugaccaagacaagcagcuugagaggccagaggugucaccaggucugguaguugaaaccuuaaggagaaaggaguauugugcccacacaagugagaacuaagagccuaucuguguccccacagcaacacaugccauauuuccgaaagcgaauggucugggagauccuccaccggaagcucuugugaagauucucagugagcagacacugagcgugugggggaccaaccuuugccaucgacagccggagaccuuggaaagagcugcuccucccuccccuguucuuguacagcccuugacccuggaccaggcccggcgagaugcauucacaagcacaucugccuucccuuuuguagcucagauccuauuuuugcaaagaaacuuuggugcugugaaggggugagggaacaucccuccugaagagacugcuuuucacuucagcucugccgucuucuuuuccaagggcucccgcucacugagucccucacuaggagcccaagagagccucgggaagaaucucgguuuccuguaaacccuuguugcucggccuuaccgagaagcaggaaagagcaugggcagcagguagggguaaaaccaccagcauguaggacacacauccccaagacgcagagucggcaauggagcugcuuaagucccuccuccaggaccuuccuauuuaugugcccuccaugaccgacugcuucuccuccaagcuguuucuucacugguagcgucaucccauccuaagcacacuacacaagcccuggcagacccuaaagucucgagcaguccguuccuuacaagcagggcugcaugugcgagcacgcacgugcugugggagggcccccagaaguacugagcgcagcagccgggccccagcuucagugcugccugcuucugaccaagaagaaggaccuuggcgguuagcaucacacgccagaguaggaugaauacaggucuagguggucuguggcuaguuaguuuaaauaugcuucuagccucagagaguuuuauauacauauaugccuauauguguguauacauacauauauacacacacacacacaaugugaaauauauauuucacagggauauguuuuuaaaaguuaaaaaaaaaaaaaagacugaauguguuuaccauuuagucuguagguuuauuuucaucuuucaaauuccagcacacagugaucccagcaagcccuguguaucgggccuuuguagauuuccuaagaguguuuugagaccuggaugaaucugguuuaggaguaaagguuaucaagguaaaugaugcugucagcugaagauggggugaauuagacagguaaacuugagguuuuuaaacugcucuuuguuguuguuuguagcaccucucccccugcccaucucagagcuccugaggugagauggugaggggacacagugccagugucguuuuguacuuaaguuccacaacagggacguuuuucuacuuuguguaugguggccgguaguuuucuaugcagucuucuccccgauucccugcgcccagcccugccagcacugugcucucucuccuugggcuuauuuggaaauuuuacucuguuuuauaccaaucuuguuuaguacauuuuucuauguuuuaccacaagucacaauuugaaaacaacaacuauuuuuuuuacuacuccauuguuaaaugaauguuaccgucuccacuccagcagccugugccccucuugccucccccugcauguuggggaugagggccacuguccaugugugucuccuucucucgcugccucuccuucccccucuccucccuuucuuuuucucuugguuucccauaggaaauaaauagcuuucuauaugaguugcgggcccuuucacagucucuuuuagaaaacuggcgugcagacucagcacaggacucaaggauguugucugcuucucaguccuuaauguauuuaggugacagcuuacacgguggcagugugacuacuuagucuaaaggcgucccucucaggcuuuucucacuguugucugaggcucaucacaggauacguuucuguguuuauuguuuguuccuuuagacaauaucugcuauaucuuccucagagacuuuuuguauggaccaaagcaacaaauauuuauugccaugaauacaagaauaugagacaugcaacagaagcacuuuguaaaauagguagaauuguugagccagucuggaguuggcucccuucuccaaugcaguuuaaacgucccagguaaaagcuagugauccuaagaccacuguccaccccggagcaagaggauaagucagacugggacgggguggccucaugggaaccaaguacagacuuguagacuguccuuagagucagccaacaggagcaggacaagugucggaaacuucaagagggaacucugaugaccaagacugaagcuguuuuuguauuucauggccaaggguaugcuacagacuaugccuguuguuuuccaucugucucuuuuuccccugacaacaucucccugaugcugauaaucaucucccuccccuguaaaaggaauaugugaaggaugauagcuuagcaguuacagacuuuucaacaaaacccccaguccuccagcagucaucccuggaguguacccagagaaaaugacacugcuucugcccuuuugagaacaugugcuaugauguauggaagcuggcuacauccauuugaucacuugagacccacugugacccccaggaguccuguguaggguucagugugaguacuugaacauagauagccuagagacucgcugucaguucacucuucugugugugaggaguacguccuccuauucuuuagacugcccucagcacugcuuuagcauuuagugguucaaggggacagcagaucaccaccaccugguuuauacacccaugguaugaacaaucauuacuggauggaaagagagagagagagagagagagagaguucguuaaagagcugcuuuuuguuuaaaucuuaaccucugaucuuucugugucauccuccaagcucugaaagaaggucagaguaaaaacggcggacauuguguuucguucugucuucccuugcucuacucucgugcccaaugccagguggagugaggugcucugcguuacugucgaaggucagugucagcaccgccuugguuguagcaucaaggcugcacgagccuugcuaaaugcagcaugccuagaugugcccuggccuugugucugggcuggggaauggcugaugaugauguggugacgcuagagacugccuuccccucgacagagccagcugcuaggaagggcuaaugugggagaaugguccccaagagcacaggcuccauucugcucaggcauucagucuaauccuuguccaaguacccacucagugugugugcacccagggcugauuaaagcucucccuggucacacuaccuuaaaaucucuugucuggacuucuguaguccugaugauagaauggccuaacuucucccuguuugucuugucugccuucucauagggggcacagcauggagaugccaaggccaggaggcuggguuggugcuguuuuucuagccaagagugcaagcgucuauauucucaucugaaaagaacaaggcagggcucguucuaugaaacauuucuuaagaagaauaguguugugagggugugaggagaauugguuauuugucauaacuuccaaacacuguaggcucagagcagccauuccgaccucaaacagggcucuuuaacagaagcaccguccucaucaguaggucauguugccauuuggggcucucgggcuacaccccaagaggcuuaucagaacaucuuuuuaaccccuuagguaguuccuccuccguccuuuuuauugacagggauaucccuugcacauucagaugauggcuuccuuucucuuugucuuguccuguaaaggcacugccuuaccuguaacucacggggaauccucugucugaagacuugauaagugugagaggucaagcccuggacuugggagcccuggagggugagaaagguggguuaacaaaggaaguaaaagccaccuguccucagggucuuacagucuguaaguuuauaguuugccugauuuggaaggcuaagcaaacacagauacaccuugucaagaaagaaugcgggcucauuagcacacaguucagaaugaagcuggaguggaggaaaggacugagguggagaugugucagggaugaucucgccuuuaucuguauaugugacucccuagguuuuuuuuuuuuaauugauuuauuuaaaauaaauucuguggauuuugcuucugugcuuugacugggaacucccuggacucaauacuauauuugugugucucugagacuguccugucuccucguauauaggaggguaugaaauauguauguauguauguauguauguauguauguauguguauauauguguguguauguauauguauguauauauuuucuuaacauagauaguuacucccccccacaaacugucugcugauccaaacuguaccugugauuggaucuucauuauggucuggguuucugaauccaccccuuaaccaagagacugaauacuguucauucauucauuuuauuccacauaccuggaagugaagccuggaacacaaauaacaugcaaaucuguggcuuucugguguuuuuuaaaaacuaaaccugucugcagaggcugccagggagcucucuugaagccaagugcaccagccagacuccaaccgacucugcuaacugcacccuugucucgaugcuuuccugcucccccacccucccuucucgccauauuaccucuccuaagugcuucugguacaucgugcucacaagagugaaacuaagagcguauagcagcucacagccucacaguggagaaacguuugucuguuggguuaggagaguggguuagaagagcccaggaugucucuguacaaauuuuugaacucuguguuuuuuaggcaugauuaagauuuuuuucccccaaaccucuccuaauggcuagagugaggaaagaaaccuuuaaaccauauuauaugguuuauauaaauaguuggcaguugccugaaccuucuccaccugacaccagacaaggagauuguucucagaguaggaccugcauccaguguccauaaaagacauccucuccccagcuacucuagucauggcucugcagacagugccaaagggaaagggaacgggaagggauggcugcuugcucuguaccagauccuccuugggccugggagaagugugugugaccucaucaucuaccauguguaugaccucaucaucuaccaugugugugaccucaucaucuaccaugugugugaccucaucaucuaccauguguaugaccucaucaucuaccaugugugugaccucaucaucugucaaggaaagggauggcugcuugcucuguguaccagauccuucucgggccggggagaagugugugugaccucaucaucuaccaugugugugaccucaucaucuaccauguacaauuucugucagccauugcagacaguucccuaugucugcugugaccuggcagcccuacaguagacucagcaccucucuaacagcucucguccuucuccuccuccuccucucccaggcuccgugguguuaccacccuggccucuugcuccuguuugucuaacaggccgaauauucuuuuaccucacugcuuccuucuauuguuggaauacgcagacccaaagucugcagcuuccucccccacaugucucuccucugggcacaugucucuccucuuacagcaccugggcaugguguuaguuacugaccugugcuaaguccuccaggugucaacaauagaaagacagacuaguugaaggaauggauggauugcucuuacugacgucuccaagcuguguguugacuggauuccugccuccuuggcuucugcagagaaugaggggucugucaccuuccccaggugccacaguuuuguguaauucaggcuggccucaaauuuaagucaccaaggaugauccugucucccaggccuguuucacuacuggccuuuuuuuuuuucuggauucauguuuuauuaugcuuuuuaaaauuugucuugucuauauuuauacacauacaccuguauacauacauacauacauacauacauacauacauacauacauacauacauagauguauguguguguguguauggguauuuugcaugccugugcgugcuugugugucuauugccugcagaagccagaagagggcaccagcuccccuagaucuggagugacaguccccugugagccaccauaugggugcugggaaucuggguucccuggaagaguagcguagcuagucuuuuaacugcugagccaucccuccagccccguggguucguuuuugagauagucucacaguauagccaaggcuuuugauccuucucauucuccggaguguaugcuuugucucuugccuuccaccugagaacuuucacuaugguuaucuuggagaaagggucucacuauguagcucuggcugaucuggaacucaccauguauaccacacuugcuccagccucucugagccucccaagugcugaccuggcccucaucuaagucuucuucauuucugcuuccugucuucuacagagugucuggcuucaaguuuccucuauacuuagcagcuaaagccauuuccuaacaguauugcuaauacccuaacaguuacaguucagguccugcucucacuccuacaugccaaacacuccugugugccuugcucacugguccucacagcugugguaucggggcucgugucaucgcuucagaaaagagaggagagcacagacauggauguccugcccaaagucuuaauucaucuuccaagccaaagcagguaacugcaggcagggcccuaaaagugcuaaggucugccgcuuccacaaagccaucucaugcucaggagagaaccgccugaccaaagaccucuugucgcuagcucuguuaagccgaaacccaggcagagccuuuaaugggguccacucgguccuccccucugggaaacagcucgggucuucacucauguucucaccuuaguuugggagggcaaagggacaggugucccucugccuuuggauucgugccuccuuggcuucugcagagaaugaggguucugucaccuuccccaggugccacuguccucuucucuagaauuuuucuuuggucucaucugaaaaagauaagccuaaggauggaagaugaggaauuagaguugccaggugaccccagcccaucuacacucauggcaagguuugugcuagguagggggacaacaccccucacacacaaaacaaaacaaaacccuggagacauuucuaguagucuuguccugucuuuccaccucugacccacucauuccugucaguguggaguucccucugcccugguuugagaaucccaggaauguggaaccuagggccuucccucuauguuccagccccaccccaccccccacacugaacccccuggcccugugagggaaguuuuauucaaggagggggggaggagguccugagccuccaacugggaaagaaaagcaguauggggcucagcucuuccccacccccaccccccucugccccuccccaaaucuguucugccccuuuucaucacagauggcuggcacccucaccaaaguuucucuugaugguaauugcuccuaauuguuuucccuggcuuacaaggccuuucuuggcugcccuuagcacaugagacucaaggagggaggcaagccccuuuggagcucgaagcccagcuuugcagaugugauuuagagggaaggaaggcucacaucacagagaauaguaaccagaagagaagagcacgguggggggugccccccccccugcuuuccuucucuaggacgcucaguaggucugucagagagggacuggcagccacucuuuaguagagcuggggagcuugaggggugguggauguccagaaaaagggucccauggaaucucauacacugguuagaaaggaguuugggggcgacagccagagagaaggcauagaaauguuuuagugguucaguguuuagugcagagccuguggugugcuaggcuccuguacuagcuuucuguccccugggacaucuugcucuagcgccagcccuaagugucauacccaguuccauggcuucuggcagccugagcuacaacccagggaucuccuacucccuucaccccgacugcagcuucucucagcuguacaggaccuguucuagugggcacagcagccuuuaugagaggaauccaggggaaaagaaguaaggauggagaauggacgaguuuuacacagcugcagacaucuaaggaagccucauaggugugccagaaagggagggucugggcuaagaacauucccuuagauucagggcgggaugauggugccgucucuacugaagccuuucucauguguggugggucaagauaucauauaagacuuuuauaaaaauuucucuauaggcaagggaauauuuuucugucuguauaugcauccauuuaccugucugucuacuaaccucuauucaaccauucacucaauugcuucuuuggguccuacucuguggcaggcucugggguauagggaggauaugguacgguugcuuguccucacaggaacuucaccaguuccuucuucagaagccagaucucccuucugucaugucagggacccgacuccaaccuaggaggucuuccaguggauaacuagaagucucaaaccaggggccauugauaauuagggccagaauaguggcuggaggaaugaggaagguacccagccaggucacugagcccaucacugugguuuggcuaugcugguuuaaaaaaaaaaaaaauuaguaagcuuggacaagugucuuucuguuuccugugcuccaggcuguucucagacaggagucacuccauuaaacaaacuacagccaagggcaacagggccugggcccagagaggucuggaaaugagagugggaacauggagccccagacaagaccugagccugcuuguccauuacagguaaaauugugugagugaagcuggccggcuggaaguaugagcacacaaccugaaggcugaggcugaguuaggagaaaaccacacugggaaucccaagcaccagacagcacacacauuaagugagcucggcauggacuuaggaauagcguucucuugcuggagccuguugaagagaugaacaguaggaauaagaagggauagacaguaacaggacauuggguggggcgccaacacacacacuccucugagcugcagcguaugugacauccucugcagauuuuacuucauucuaaaaucagaaggacugugugcuuugggcuucccaggccucuccccuuucuccauguggcugagguggaguuaaugggaccugcguacacagagccucucacagccuugaggacagaggcccauucauuccaggagcugcaaagcaccucucaggcuggccuguaguccuaguccugugccaccgacgugcaagggagcgacgugcaucucugcacaugcagccuugcccccaggcacacacacaaaagacacacucaagccccuggaccccucccuaccacaugccucuuggcucaggcccuggcugugccucucucggucagucuuuacccauuggaguuagcucugacaaccuucuggaccgcaggcagcccaccugggugguaccugugaaacuuccaggacuugagaggagaaauagcuaaagaacaugaagacauuaccugccucagaguaagggguucaggcgacagcugugucaccagcaagcuuugagaccuuucccaagauacuuaaccucucuggguuucagucuccuuacugugaggugggagagaagacugaguaagagaucuuuauaagcccacugggaugauguacaagacagagccuuugaguacacccccauccccacccuacccccagaaacguaagaaccagggagcugagccuggggagguagcccaguggucaagagccaagagcacuggcuguucuuguagaucgccugccuagaguuugauucccaacacccauaugacaguuaacaucuaacugucuaacuugauuuccagaggacccagcacccuuuucuggcuucugcggguacugcaugcauguggugaacagacauaugaaggcaaaacacucauauauguaaaaaucuuuuuuuaaaaaaauuaguucugggaauugcaagagugagcuucuuuguaaaugaugcaagcauugcuauauucaaccccugcaguccuucagggucagggucaacuucacccaucccauagugucuucauggucuucauugcuaugccucaagcuguggaaacacuccccugccucacugcagugcugucuucugauggaccacuuccuggauuggguccaucucugcagggaccaagggaagguggcagaugcugggaaaaguaguauccugugaccacacuccacaggcccucugugucuggaugucuccuugccccuaauccugccugugcaagagugaacaugaggauguucccaaacaggagccucuaauuuaccugaggaccuucguucccaccccagaacaggcugaauuccuacccugaaaggcccuugugggcuggggguugggcuaugugaugguaggaaauguagacuggaugguccaaagcuagucuggaaacaccuucacacaccagguaaacacaggugcugcauggcagcugggcagugguggcgcacgccuuuaaucccagcacuugggaggcagaggcaggcagauuucuaaguucaagaccagccuggucuacagagugaguuccaggacagccagggcuauacagagaaacccuguauagaaaaaaaaaaaaagaaagaaagaaagaaagaaagaaagaaagaaagaaagaaagaaagaaagaaaggaagaaggaaggaaagaaggaaaagugcuacauagcuaaaauauaaauguuuaacuuaaauguuugguauucuuuaagugucaaaauaagugaucauuauggaaaaaauuggaaauuuagaacucuucaccauuacaacugcuuuuuaaaaauaccaaucuuucaaugauuagcacuuguaaauguuuuaauucaccacuacuaaggguucugcaucguccucaaauaagagaaacaaauuuucccucucccauagcccuuggggcuagaagaacaagccugugcaguagaagaccagagaacucagaggcuuuauuugagcaucagagcuaucaguugcuaacuaaggggacccuggcuugucuucccuguaucccacuugcucaccucagccuguaguauuucuaauucucacccauacggaugacaucaucaguuucagauaugagagcacacugacagaagaggauggaaggagagucagagaguggccaccaggagacucaugaugucaucucucuacaucauggccucaaguccaacucagagauccuuagggaaggagaccuuagacccuccaguuuggggcucacaguuaagugaaggcacucuaaguugcugaaauaaacacaguuuuuucacauggacaacguuuuagauuucauucaaggugcauuucuuaaaggaucauugcucuaccaaccagccacagaaccaggaccaugagaggcauugacucuuuagagaacccccacacguagggcugcacagucccaugguguccaugaggacugcccucuaccgucuucccucuggcuguggcaagaugaagcucaggauaggcugucagacacaugguugugucagcccgugaacugaagguugccucucccuggacaguccccaagggcugcauauuuuuucaacaccucucaccagccccgcagaugaaucuaccuuuucuacgugugccauuuggccguuucuguugcaggagggccacagagucaauggguuccacuguucugccacagagacaaacagccacagcucuguucucucggccagcccuggggccuggaggccugugccugugggaauuccagaauggaagaauguuaaagcuggaugaggccacagcccucgccuaguacugcccagccggcacagggggaaacggaggccugggaggcagacagcuuaaggagcaugcuuuccuuaaugugaaucucagcaugcacuucacaucugcacuggugaugucccaaagcccuggccuguuagcgucagauguucaauaaucggaaagcucuaacuaacacugggcuaaagucagacucccacucccugcaguuucaccuuuguguagucuccagagaccgaugggacugccuucugaauuuacauucgucuuguuuguuuuugcuuucuguuuuucuagaucaaaaucaauuuucucuacauuggagugacacagacaauuccuggccuuucuuagacauccuaugaccaccagacacccuggcucucaugaagaaaaaaaaauccauaguggaauuuaauuuacagaauugagaaugugaaagucaugggaggcucaggacaacuugaucaagcuuaaguuuguuuccaauaauucccuugguucugccugauacaucgacuuccuugcaaacccgaaauacccacacaaguccugcccaugaagacagugaucuuucccucccugccuuuaaaccaagcuuugucccauacuuuguauggaccagcccagaagaaaaguuucugcgccaaagaggcgggucaguguuggagagcaugagcugcucugucagaggacccugggucccuucuccagcaccagugucagguggcucacaagugcuacucgcuccagacccaggagggccuagcacccgaccucugcaaacaccugcacucacauacacuuuaaaauugguugguugguugguugguuuuuuaaaaugcauuucuugugugggucguggaauuagccuaauuggccuaggucaaucaaggccuuuauguacacuaggggauuagagugaacucuaucaaaauagcaguccucugcacaguggugugagugugaccaguacugcgggagccagccacagucucauuuacagagggcauucguaagugcuaagggagauggcauacaggguuucagacagcgccuggcacauaggacauguugccauuuuuuauuaacuuagcauuauugguguccugaacacacaaucagcuuucaguacuucacuaagggccagcuuggggauaugcuugcuguguacgaccuaugugagggguacaauuuaguacauaugcaauauauaaugauuguauaugauuguauauaacuagacaggauucccagcacucuaaacacuuuaaaauuguguacguugagaaucguuggcuucuuuucuaguuguaaaaugucucucgaguuaaggaauuccucuuauuuaagagcuguuuuuauuuuacauguauaaguguuuucccugaagguaugcccguguaccauaaaugugccugcugcucacagaagccagaagagaguguugaauucccuagaaguggaguuacagauguugugagccaccaugugauugcugggaauugaacccagguccucuagauuuaagugcugagccaucucuccaucaucaaggagucccuucaucuuugguacccauuaucucuauccucacucccagucucuugugaccauuauucuacuuucuuuuauaauaauauugacauuuuuggcuuccacaaaugaaugaaaaugugguauuugucuagcugugccuggcuaauuuuaacauauaauuauccucaaguuucauccacauugccacaaaugauaggguguuauucuuuuuaugguagacugacauuccacaugugcguguacaaugcuugcuucauccauucaucuacccguggacacccuggcugguacaagccuaccacagugguuuagaguggcccaagggcuacagucugcguguugcuucucucgugggccccugggaauaaguucagcucuggagcucuacgaucccacgccugaccguggcuucugcagcccuggaucucucucucccagcugcgccagcagcuauuuuaucaagggagucuuguggucacgacauuuuaaguuuuuccuccugaauuccugcucuguuccauccuuugauuuguguucuuccaacaccagucccacaacuugugcaagagaagcaucacccucuucugauaucccauccucccagggacacaaccucucaccuagacagaauguucagggucaucuucaauggccccuucagggguuccuaccaaccccugguucugugggguugaucacaaguuugaaguauugacaccccgugagcaaacgccucacguguaguucacaccacagucuaguccagauagcugcucuauggccucucaguggccuucuuggcacagcaaccacagucaauccuacagcuuucugggcaccaguggugcugguccccaagauucugguggcuugcaggucaguaucagccaacugccuuuaauuggcugugccuagaggaaauuguccaaaggggguucuugcuggcaccagauagcuuaauaagacucugugccucugaucugcucaauggcucaaugacaagggaagcuugucaucuguaauuuacaggcaagaagacuagccuaggaaagguuuagauggcucgcauaggaggagccagguaaccagugggagagugugccaccugcaaguccaguccuuugcuguccugccuggaagagaaccgugaaggucccaucuuguaccuagcccagggccuggucuggcaguuauuugcaaugcuuggucuuuucugucacagucggagccacggggauugggcugagcaacagagcaggcagccagcuuauuuccugcccugccuuugucccucagcgaugaaaagaugguggggggugagaaugggaucaaauucuuagcuacaucuagaaacauggccaccucgucccgcugaguucucaggcucugcagcucucaagagcaccuccagguuuuccugacuucagacucccuguucaccuucugcuccccucugcuggacccgguuuuccuuucuucuaggcucucugucucagcuuuucucucacuaacguccuuuaccuaggccuccuucagagccucuagaccuagcuggccugugagaggccuccaguacugggaagagaggcccccaguccucugugggcccugccccucucaccuuagccgccccuccuugacagugggggcaggggcaggcacagggcugcaguuagagccacuuccucggauacaaaagcuucuuucucccccucagagaugagguuuccaggcagguuauuuuuauagcagaauccuucagagaaaauaaacaaagucacacacaccaguccuucacaccccuccgccccuucucuaaagaggggcccagccuggcagagccgacaugaggacgccccacugccccagaguggcugccauucccagaagcaaggguccaggcuggaagaagggugccugggcaggcauucgaagugauaaaggccucugaugcuucccacaggcagggaucaauuaaaacucuggggucucucagcauaaggccaggugcucuaucugaaucuguagggagagauggagacucagacacaauagaugguuuccuaacugcugaucaauuuccagcuaggcuugcggcucccaacacauuccccacauucuccauucacugcauacaaucagcugaaacuagucagcacucagugcccacugcugugugccagggacuguuagguacucgacagucggaaauaaacaaggcaugggcuccaagagcuuaccagccuggacuagggaccuggauugccacaccacaacaguuugaggugcauauuuuuaca

SEQ ID NO: 7968 - RNA, 2477 nt, Mus musculus
cagcuucucugaggcuacugcagcaucccugccccgcccgucagcccauacaacagagcuucacugcagcuucggaacccuguucucuuucuuccucacuuccucguugccauggagacacacgucauuuacgugccgugcgucgccuuggaaacgggggagcauccgcggcgccgccgggagacccgccccugccucuccagccgcacucgcgggcacugcugguggauggcuggggggagucccgagacugacgcgcugcggguccccgucucgaccccgagcccucugcgagcgccucugugaccugugagcacucuuugucggugauugccgggagggcggcggggacauagguaccacacuggaggcgagcgggcaagccacuuuugcccccuggguaagcccgaagauccuggucccgggacccuagacaggucuucgauccauagacucuucucagcccuccuugaucccgcccguguccucugccuggggccgcucucuucacguaggcuccccgccccucuagggagccuaggugucccugggcuccaccccgucccucccgggaccucucccccuccacacccuucccccacccuggaggcccgcuggacacgacccagagcugccaccgcccgcuucugccacucaauggaggacagucugcuggagaucaugaccaaggacggcggcgacaugccagcgccucuggagguguccacggugcccgccgugggggacgugaucucuggggaguauaacggcgguaugaaggaacugauggagcaccugaaggcccagcugcaggcccuguuugaggacgugagggccaugcgaggggcacuggacgagcaggccucgcacauccagguucugucggacgacgugugcgccaaccagcgggcuauagucuccaugugccagauuaugaccacugcgccccgccagggaggcuugggcguggccggcggcaaggggagcuucccaaguguuccccaugaaccagagacaccuucgccugggaucgaggacagcggcuugcugggucgugauccugaugaagacgaggacgaagaggagaaagagacaccuaaccccgccacacccaccagucacugcgagcucucugagagccccggucuccuuggggaggaugggccacuuguggagccccccgaccuuccugacauuacccugcugcagcuggagggcgaggccucucugugagggagaccccaccagggaaccaacuacccgcgcuggcuuuggguuuccaagugcuuaacccgaggggacugaacagugcggugcaguguucuucacuucaaacgugguccuuauaggucagggagagagacucccucacagaaggauuuguagagucaaggacuuuggaagcaucgcgaauuccacccaagcaggcaucauagcaaacugcagaaaggugagguucccagaaaggacgugcccaucucuggacucucaucuaucccuuuaccuugcccccuuccccucuuccuaggaaacaggaggaccauugaauuauguaaauaaaauucugcuuuuucuauucugaaaaaggagucaucuaggacuuuggcaaauaaucucuauuuaccuagaaauuaaggaguugggguauucuguucuggcaacaggaaauuuacccuuuuccccaaacccaagauauucagugcucugcggaaaccucucccccuuacagaucgcucugcaacugcugauggguaaaggaagcuugaggagggaacugcggcccuaggagucaggguacucggguucccagggccccuaggcugggaggagcuggcucugaugugcaugaagacacaagagcucaagcucuggcacugagcaugcagagccgagccugccccgucgcugacuucaccugggauugcuuggccacucaccugggccuagagaacaaagugcucaggucgcaggcagagacuuaggacugcucagcaacuguccagauuuaaggggacaucugaggaacucuugggggagggggcgcugcagccccaagcugucuuuucuggcuauaccugcuuaacuucaguuccuuuuauuauuuuuuuuuuccugucaauaugucgguacccucugcuuucugguguugccuccauaaugucuuguguuauguguguccacuuguguaguagugugugagcccucaggggcagggcuuguggcucuaguauuagguucagggggcuucagacccgucugcaagccccaggcuaucauggcgcuuucugcucuuuucccuuuuaugccccacuccucaacccagggcacggagcauguggcuguccugaguguccuuaacugaugugcuccuaccuuccgaaguggugacugugugugccccuucccuccucuguguauccuuucuuagugcuuugcuugaugucaaccuuaauaaaaaggcaccaucuccccucuug

SEQ ID NO: 7969 - RNA, 17092 nt, Mus musculus
aagauuuauucauaugaguacacugucccugucuucugacacugcagaagagggcaucggaucccguuagaguugguugugagccaccaugugguugcugggaauugaacucaggaucucuagaagagcagucggugccauuucuccagccaccccaaugucuacucuucugcuguguagggacgguaaagaaguagcugcccgagaagacuggagacuacugccaccagaagacgaacccuucagauggaaaaauauccgaauccggcgacuggcgguggcccgccuuuccgacggcccacucaccggccgaguuucugacagacacuucacuucagccacucccguuguggagucucucacugucccgcccuccacaggcuaguguuaguucugaccaauaggagcacagcacccucagcgcagcaaccaaucagcgucuagggucgcguuccgagcaggcggagcagccagagggcaagcugcgcggugccgcgcggugggggagguaagauggcgccgugccgggcgcuucuccuuugcuguuaggcgcugcucgccuucucugucagcucagcgcggcacgucgucuccugcagcguuggagccucucugguugcuaggcuuucggggagccagguucuccggugccgggagccgugggacaagauggcgcuuguaggacgacggccaaggcgcucgggucggggcugugagcgcugaggcggccagggacaaaggcggcgagccggggcgugggggcggggcgugccgcgccguugcaguggugccgcgugggacaggcgccgcgcuuccggucugcugcugcggagauucggccaacgugguaggggcccgggcggcgggcgggucggugacgggaggcuggagggcggccgcgggagcacgcaaccaggacucguggccgggcuaaggccguuucgaucugucgugugaccgcccuccccgcagguuuuggcaugaacaggauucggauucacgucuugccaacgaaucgggggaggaucaccccagugcccaggucgcaggagccccuuuccuguucguucacucaccgcccgugcucucagccgcggcuggaggggcaggaguucugcauuaagcacauucuugaagacaagaaugcacccuucaaacaauguaguuacgucucgacgaagaauggaaaaaggugccccagugcugccccaaagcccgagaagaaagauggguacguggagaggcguggguuauaugggugccuucgggcuccgagagucguucuuacuuuucaaugcacgccaagcacagguuguaucaccgagccugcuucaacgcccaaaccuccuaccguuagacuuuuauuacauuucgaagcauuuauuucccguugguaguuuguuuugugugguuagggacacguggggaggucagaggccaauuugcuggagucgguuuuaguaccuccugguacggaaggacagacagaagguuaagcuaggcuugcagagucacagacucccccacccccggcuccucuuuugagacagucucgcccuugcuuggaacaguuuuggcaacccuuuaugguuuuuuaaagaacuuucauguguauggguguuugccugcauguguguugguguaccacguucaugcuugaggggagggcguugggucuccuggaacuggagugggagaauguuggugccacaugcuuguccccugccuucaguuuuaaagugcaaaggggaacaugauguguagaguuggucguaucugcggaguuuuaggucguguguuuguaaaaaagguauuaaggauauucacucuuugggaggcaggucaaaacacucaaaugcucagaggugaugaugcuggcagcaguggugcaggccuuuaauccuggcacuugggaguucaggccagccuaguaaaagcauugaauuccagaauugccagggcuaaacagaacccugucucaacccucccaccccaccccgccaauaaugagaacuggaaggccauuugagggagagauauuuaguuaaucgcuugcuggaaaaauuaagguuuugaguucugauuauggucagacugauuuuaacccuuaauucuccugccucggcuucuggaguucugggauugcagcucuaaagucuucuuccuuaaacaucuauuaugaggauucacgugcugccacacacacguggucggaggguagcuuucugcuguguggggggugauggaacucagguggucugucuggccuuggugguaggcccuucuguuugcugagucacugaauuggcacucuaaguuaauucuucaugcuggagcgcugacucacuugccaagccuuguuaaguaaugggcacacuguguguguguuuuggaaggggcaucauaguuuuuuuuuuaaucauauauguauuuaauuugugcaaaaauauggcuuuacuagguaauuuguaaacagcuaguucuagauuugaagcgugugugccuguaguggauugauaguaaaauguguuuccagaaauaauuuugaaaaauaaaagcagcucugauuuucugugagauacugcuaacuuuuuuugugugugugugugugguauuuauuuauuuacuuacuuauguuuuuuugagacaggguuucucuguguagcccaggcuguccaggaacucacuuuguagaccaggcuggccucaaacgcagaaauccgccugccucugccuccucucuagccacccagcaccuuucugggauuaaaggcgugugccaccaccgcccacucuguuggauccuuucuaagagaggaccuauuaaauauuaauguuuugucuccuuagggugucuuucugugccgaacaugcucgaagaaaugcccuagcacuucaugcucaaaugaagaagagcaacccaggcccuaugggugaaacccucuugugccaguugagcucauacgcuaaaacagagcugggcucgcagaccccagagagcagccgcagugaagccagccggauacuggguaaggauccucuccuggggcgagaaaggagggugcuugcgagugaguguggcucacuucaguguuugggaaccgggugagagccagggcggcugguuuuacauuuagaguuuguuuagcuuauuucucccaacccggugaccuuuccuuguguuaaaauuuuaaaaaguuaaaagcuuugaauuuuaagguuucagguugaacucuuaagccaugcagccucagcuguggaguuagagaggugggaagucuuaauggcugcucuucccuuccuugccucagaugaagacagcuggagugauggggaccaggaacccaucacuguggaucagacauggagaggugacccugacagugaagccgauagcauagacagugaucaagaagauccccugaaguaaguuguaacuccacauaaggcuuuugcauacguuauauaguuaguauguagaauguaguguggcaugggguugauuaauacauguggguggguuuaagugucacgguucaacaccauuuugcuccaaggcaagauuucuugauuguuuggcagaagucugacaacugggaacugagucuugcccuuaagaugguuuagggaggaacagccuuugacaaaggaacaagagggagccggaaaggugcuggcuggcuggcuagagaggagaaaguggacuuaaguagguaaucguccgcuccagaucucagaaagaacgagcuaucuauacuuagacgcgugcugcaaaauuccaugguuaugauucuuuaaaugggaaagaaaaguguucaauaguuggcuuugguuucaugccuaauaaaggaaaacugauuuagaaacucaaauuuuaauuauauguuaaguucuacucuaaccccuggucaucuuaagaguuuagaaauagcaaauuauucccuguuccaaaaucucugaccuuuugaagcagggucucauuguguagcucugacugaccuggaacuugguguuugagucaggcugaccaaacucaggcuuuguucucccuuguauuuaguuuuugaaucaucuuagcaguuagauaguguuugucuucaacagugcgugguaaacacaugcacacacuauauguugggaacaaaaaaagggggguccuggggaggcccuaggggaagugggggaagaaaaggguccuagcauccagccagagcucuauacaccgguuuugugagacagaauuucucuguguggcucugguugcuguggaacucacucuguagaccagguuggcuuugaacucagagaucugccugccucugcccaaaguuaaucuuacaaguuuuaauuacuuaacucagaagcgggaaacagucuuuauauuaaccucagaauaaaaacagcccuguuuuuggaguguugaauuaaaggcaugcacuagcaugcccagccaucuacucauuuuaaauguauaaauaauaagauauaucucucuuuguccugucucucuuuuuuuuuuuuuaagauuuacuuauuauaauauuuaaguacacuguagcuaucuucagacaccccggaagagggcgucagaucucauuacggaugguugugagccaccaugugguugcugggacuugaacucaggaccucuggaagagcagucagugcucuuaaccccugagccaucucuccagcccuguccuguuucuucuuacaaagaaucuguucaguuccuaacacccacaugggagcacucacaaaucauuuguaacuccaguuccaggcucucugagaaccgcaucugcacucacaggccgguggcauauacauaaguaagaaaaaaauuguuuuuuguuguaguuguugguuuguuguuagugcugaagaugggaccaagggccuuguuauccaugcuaaguacuugccacugagcuaggcuaugcuuccaagcccucuuuauuucuuuaaaaauaaagaaauaaaaauaauaucuuaguaaaagcugugugaaaauauuccuguguaggauaaugugucaauucagguugacuuuguuaaauacaaauugaggcuauuuucagccuuuuaauguuuuguuguuuuuauuguuuuugagauaggguuuuauaucuagguugacuuugaauuugcuaccuaguccaggcagaccugaacuccugguccuuguguuucgacuucuaauaagugcuggaauuauuggcacacgucaucauguuuaucuucauuacugguuuuuuuuuuuaaugcuuuguugaauuuaucauuuuauuccagacaugcuggugucuauacagcugaagaaguggcucuuauuaugagagaaaagcuaauucguuugcagucuuuguacauugaucaguuuaaaagacuccaacaccugcucaaagagaagaagcgccgcuauuuacacaaccggaaaguggagcacgaggcuuuaggcaaguuagauggagucgaaucugccggucuuacagcuaacaagucucuguuuacuuaaacuggaaaagcauucuugaguucuuuacaaguuacaccuuggcuuuuguagccuuucuaauggugacuguguaauguccuauccaguacuugagaagcugaggcuagggaguuuguugugaacucaaggccagauagacugaaauuguuuaaaaaaacuugauuuuuuuuuuuuuuuuuuuuuuuuuuggugacuuuuuagguaguagucuccugacuggcccugagggacuuuuggccaaagagagagagaauuuaaagcgacuaaaaugucuuaggcgauaccgucaacgcuauggaguagaagccuuacuacacaggcagcugaaggaacgcagaaugcuggccaccgauggggcugcucaacagguaauuugcaaauaugcuggaauuuauuguuuuauucuagaugugcugugagcucugugugugcacauucgauucauugauaagaucaucaaaacaccacagcugguggcagcacacgccucuaaucccagcacuugggaggcagaggcaggcagauuucugaguuccagaccagccuggucuacagagugaguuccaggacagccagggcuacacagaggaacucuugucucggaaaacaaaacaaaacaaaaacaaaaacaaaaaaauaccacgagcaguucuggcuuugaaauccagcuuguacuaaaagcacuuaccuggaugucagcaagacgugaguccaggcuuuguucucugucagucagccugugccugaguaggaagcuuugcagaacucaguauucaaauugaagggcuuagggcauugauuccuaacuucuuuuguuaaggaaguccuuaguuuggaaaaugggcaaaaguuuuacucaugcaguuuggaaagcuuaaaaaaauaccagaagcaaacugggugugguggugcgugcuugucuguaaccucacugcuuugugggaggaugaggcagucaggaagcuugaaaccagcucgcgcuuacacaagggaauaguaaagggcuggagacacggcuuagugguugauagcucuuccagaggacucagguuugaguucaugaacccacacuccacuccagccagcuguaacuccagucccucuucuggcuucucagacugcacacacagagauaaccaugcaggcaaaacacucacacacacagaauuaaguaaagaaagcuggacgugguggcacaccuuuaaucagcauucuggaggcagagacaggaggauggaucuuugaguucuaggccagccagggcucuuacacagggaaauccuguucugaaaaacaaagcagauuaaaugggguggggugggauuaaagauaaauugcaagaauaguagcaguuaaacgucauaguaaggcugacagaauaauuccaugaccguuguuuuuguuguauuuguugaggccuccucaccugugugucaguuguguggcugugaaaagaacugccgguguaaacagcccccggugcagguggugugggcuggguguuagaggcucuagugcaauguggcugagaagguggcagagcaucuugguggcuggcucucuccugauuccaguuuauuuugucugcgccacagugcagggcacaguuggguggguuuuuccuccucagugcuccgacccucacagagcccagaagugcugggcuuggacagcuguaauagcugcaguggugacugaggugguaggucauaaccuuagggcuucuuaagucauuugcguagcaugcuugagguugcagcuaccacuccagaaagcuucauugcuaggagcuaaguuaguugaacuggggauuuagcuugguguuggagcauaugugugugacucaggauuuauucccuaguacuaccaaaacacuugauguuugaaucagguucccacuauguagcccccugguuguccuggaacaugcuguguagaccaggccucucagauuugucucugccuuggcuaagauugauacauugaccacagugccuaguuaaagcaugaguguucauuaaugcugccaagggcuccuccaauuccugugccaucaagaagaaagaugaacuggaguguguggccaagucuaaccacugauuucccagcugcugccuaauaaacuguccuuuggaacaauuccaaaaaaaaaaaaaaaaagcaugagugucuuuccuccuuaccucugagggauagacucuaagguaccugaaggagcccugaaacuuuguagguaucaucaugcagguguuauaugcuuaugaauaagccaguuauggccauauaaaguuaauguaagcuauuuacaauuuagagauaauuccugguuaagggacagacugcucuuuauaucacuguacuguguggagagguaguuuuaggauuaggauuaacuccauucuguauauauaagguuucaugguuacaguauuggugguuggguuuguuaaauguuacauuuuccacuuuguacgaauugacuuuccuuguauaacugaauaauaucauaguuauauguuuuuuugggggguuuauuuguauuuguuuucucaauuuuaggcucacaccacucguuccagucagaggugcuuagccuuuguggaugaugugcgcugcuccaaucagucucucccaaugaccagacacugccuuacccguaucuuuacagcccuguguuuagguucugagccucugguuaagucagggugauuauggucucugucaguuucacucaagauccugguuacuuuggcccuaaaucaaggccagcaguuuucugaagcuguugguuucaagcaggcgccuaaauaaaugucuuucuauggucuguuggccauuucagaaauuugaaaauguaauggucaauucauuagaaagaaacaucugucuggaugugggacccagcuguguaauuguagcacugggaauuugaggcaugccugggcuacagcaaaauccugucugggguagaugaaguaggggcggggagcugaagaaacagcugagucauuggugacggaugugaaggcugaugacagucuuaaugagcucccacaguuuccguauauacuaauaggugacagcuugagcuuuuguucauuaaguuauguguuaaaucuguuaccaagagaaaaggguuacuguggguuuucugccccgaacaugagucucuacugugaguuuuugugcaguauuauuguuagugcccuaacuuguaggcuuuaaacuuacucaaauuagaaacuuugaaaaaaaaccggaguuuuuucuccccaggaacaugaauucucuauucuuucuacuugugaauuugaaccaaugugcacugugcucuggcauagaaccacguguugauggacuacgaaaguugugauguuuauugaauuuuuaugcaaccuguauaguuuuggauuucauuugcauauauuuaaaagucaaaaauauuuuucuaguuuagcuuguugucuuuaauguaauccuacauaguugggagacaggcaggaggauugcuugaguccaggaguggauagaauaguaaagauaguccccuccccucaaaauagugauaggaagagguggggagaacccccucugggucuuugguaggaaaggaaaagguuguuucuguuuuuguuuuccccuauuccauuuaaugaaauauuugaaguuaauuauuauacugaugccugaaugccuugccuuuuuagccucauaauacugggauugcagguguagcuaccacacuuguuuuagaggaacugcuuuuaacauauaaaugcuuauacaaagucuugggcucuaaagaugaagguuaaugugauugggcuggguaaaggccagagaacuacaaagggcccugauguagugggcuggaggggagauuggagacuccuguaacacggaagauauuaaggcggaaagaaugcugugacauggaaacugcaauagaacaggagauacuaaagcagaaauguggaguagggggauaguggaaaccuguugugugucagcuuaauuuaaaaaacacagcacuucagagguagcaguccgaugaucaggccaaguucaggcuuggguuuguagugaguuuuucaugguauuagaaacaaacauuaaaguuuucugcaggcuuauaagcagaaacaaaauuguaucucuugacucuuggaagaggaugguacuugcuucugcaacaagcuguuuguacuaguuucuauaugggguuucucuugucaauguauguuccuugguaaguuguugccacuugacacuuccugucucuaguuuaaauggcuagaguccuggaaaagaguugggagugaauuauaaauuauugauaggguuaaaauuaugugcacaaaauuacacuuacagccguaacuaaaaauaacuccugcaguuggcuuucaguaaaaauguaguaguuuucugcaucgucagacuuguguuugacaucgcagacuccuguacuguguucuuccaauggguccugguuuauuuuccuuaacuguucuguagauaucugucaggauacaaaucagguucucuucaaaugcugccagggaucugaagagguccccugcaacaaaccaguuccuguaagccuuucugaggaucccugcugcccucugcauuuccaguugccuccucagauguauaagcccgagcagguacugucugugccagacgaucuggaagccggccccauggaucuguacuugagugcugccgagcuucagcccacugagaguuuaccacuggaguucagugauguaaguuagagaagcucugcucugauuggcccuugacagaaggcccuguuuacuaguggugagaauaguuagcuguuuucagccuagagggugaugugauucuaacgcauugacugugccuguuuauccaucuaucuacacucugugcucuaccuuucuccuccccagacuuuuuguucugagacaaaaccuaauucuguagccugaguugaacgugaacucgugauccauaucucauaaguguugguguuagagacaugaacccccaugccuggccuccuuuguuucucagggaugggauucguagagcacaacuuggaagugauuuuuuuuuuuuuuaucaagguguuuauaugcagcaccuaucauuacugaggauguugguaccauacuuucuaaugagaugaguaaaaaacaugauuuguauuuguuuuggugguuuuuaaacaucuucugguggauaagcaguuuugcugacccuuuuuaaaaaguuuuauuuuugacagauuuuauuacaaaauuuauugaguuuucagacuuuaugugguucaauucuaauuuaguguuuuugaugcuguuaugaauggggucugagcauuucuuuuuuuaugaguggggucugagcauuuuuuuaugaguggggucugagcauuucuuuuuuuaugaguggggucugagcauuucuuuacuugcuugcuuccugaaacccagcuuguaccacgacuuuaaaaagcuggcauuugaugccuuuuuuucuuuuuuaaaaguuuguuuuauaaauguguguguuuuguuguauguauauauguauguauguauccauguauguauguaugugcacccuaugugugccuggcaucagaggucagaagagguuagaucuccugggacugaaguuauagccaguugugagccaccauguagaugcugggaauugaaccuggauccucugcaggauuaacacguguuucucuccgugagcucuuuugggagguacuugauggagcaaaugauguguacuaugaaucccaucucgagaaacggccugcgcuuaaaaccucuguagucacugcuuccaggggaugaggucccuggaaggcuguguccuguacaaaccuacuuuuccccugcuguuuggagagagaugaugccagucuccuuuugcucugggagucuggcagcuuaggauauagucuguaaaucucuuagcuaugaauuuggaguaauuauuuuaaggccaaacuggccuaacauuuuaagcacuuuccuauauggcuuuagagaguuugacugcucagugauggggaagcuuagcguuagcgucgcccuuuccauagggcagagcuggguauuggggguuucuuuuccaguuuacggugauagugcccagaguggguuuccuaccugcacuuaccucuuuaccuuugcuuuuccuucccacucaaaauagacauuuucuaguugcccaguggacaagauucucuugaccacucaguccuggcauucucacaaauagacguuguuuauauaauguaccuguggguagaaagagcuggcaccaaccccaagcuuuaaaaagaaaaauugcaggaaacaaagugagcacugucuugguggugugcgcgugggcuucugugggccgagagcuguguccaguggacgucuguaguggauagugggcaauguggcugucucuuuccuccugcuugcacugagcaguuuguuuacuugcuguuguuuuuaaaggcauuuuaaagaaaggauacauuacauaucccuugaacucucagagaucugccugccucugccucccuccagagugcuggguuuaaagguaagcauucccaugcuuggcuuuagacuuaauuuuuuuuuuuaaggauucaauuuuauuuuauguguaucaguguuuggccugcacauaugcguaccguguccaugacccggugcccuaagaagucaaaagaggugucggauccccuggaguggaguuaguucuguguagagcgccgugugggugcugggcacugcgccugcguucucuggaaacucuuaacugcugagcuauuuuuccagcccccaauuaaaaauauguuuggcuuuuuauuuauuuguuugauuuauuuuagauaaggucuugcucuguagaccaggcuugcuucaaacucagagagauccaccugccuuuugguuccugagugucaggauuaaaguuuuagauuuuuaaaaacuuauuaaacugugcuaacccuuaauuaugaaaagguuaugauuucuauuccuggugauuagcacaccaagauuuuaugauacauacuaauuauguagaaugguuuccuugugacagccucauauaggcauaugauauacuuugaagucucuuugccugccagccuucugcuuccucgucccuucugcuccccucccuuugccuguucuucugucauggggcaccuuuacuuucuuagcuagagcuuaaaagcauuagccgaauuugucgagauggcuuggaacuuggguugccauaauuuuugaaccacuauagcgaugugggcccuaaaucaguguugguuugaggaaggagccaggagugaugcuuuugaucugcugacuccacagugucucugggaauggcugauucauaugcaaagcguagaguguagaauauaauguccuuuuuuuuucccccuaaacagaauacuugaacuauguuaaguguaagacucagaggcuuagcccggccagguggcacaggccuuuaaucccagcuccugggaggcugaagcagagcauccuaaggucaagucuugccugggccacagggugaguuccaggcuagccuggucaacuuaguaagacccaugucaaaguagagcgugaagaagagggcacugagauguagugcaguauagaaugucugucugccuugagagagagagagagagagagagagagagcaaggccugaccucaggccacauugcucauucuagggauuggaguuaaccacaguauccugucuuugccauucagaaacaucugaguuucuguggucuguccucucuuuaguugcuugcuccgugaauguuggucagucuuguaucaccaguguguuuuccagcaggguuucauguuacuuuguccauaggcugauuguucuuauuggaugccucagucaggagcguagguguugacuguaauuagagagagagagagagagaguguguguguguguguguguguguguguguguagugugagugugugugacaaggcaugcauccgaguucucuccuuccacugggugacuaaauacaagccauuagccuuuacuuacugagccaaucugccagccuuguauuuucucuuuauuuuuccuuuuaaaaguguucuuuuacacuuaauuugugugugugugaacaugcauguguuaugugcacaucagagggcaguuuuaggagucuauucucuccaccauguggauucugggguucaaacucaguucaucucacuuagcgaugccuuuguucacuguaaaacaugugugaugcugggcgugguggcgcacgccuuuaaucccagcacucgggaggcagaggcaggcggguuucugaguuccaggccagccuggucuacacuguuaguuccaggacagccuggguuauacagagaaacccugucuugaaaaacaaaaaacaaacaaacaaaaagaaccugugugauacuuuacaguugauugguauugaucuugaguaguguguuaugcagucauuguuagcaucuuuuuccucccucgguuuaaacagacucugucccuguuaagccucccccuugacucucgguggucgcucuuucacuucaugacuuuccuaguggaaaugagcuaagagaggcucuuacuguuguugaucuuguucacugaucuaagcggggggggggggggggguagaguuaccuugagcuuuggugaacauugucaguuguagcuuauugauguccuagaugcugcugacggacucuucucuuuuccccaggacuuggauguugugggugauggcaugccaugcccgccgucgccauugcucuuugauccuucgcuaacucuugaagaucauucagucacagaaagugccggagacgcaguggguaucuuuaacaaugacugucagcuaggcucccucauguagugaccaggccaggcguuggcuagcaugaauuccagggaguaucgugauucccaaguagagagcaaaagugcccaagaugccauaaaauggaaauacccgcuuuaauaaaacaccacaacccaaagcaacuugaguagaaaaggacuuauuccaccccuuacuucaagccgcaguccgucaccggggaagucagcugggaagcuggaggcaggagcugauagagaggcauaaaacaacuucuuuugcuuuugaaugcuugucgguacuaauuuuccagaugaaccgcagaacuccuaaugguucuuaauccucaagagggggcauccguuuguuugagugaaaggugauagauacauugucucuuuaagggagcguucaucacucgagcuauucuagaaucaagggaugggagguuacccauggcucuuacugaagacuagcaguuauacacuguagcuguugguuucaagcagacgccuagagaacugucuuccagugguuuauuagcuacucuggacuucaguagagaaugacuauuucauuuggaagaaacaacccuuguucucucugguuucacagccucaguaauucugguucuuuggaucagcaguauccuggggaagcaaccagcauguuagcuacuuuaucucucugcucugucagagucaugcgucaggcccauuggagggagucucuaaccaaagugccuuuauuuauuuuaauagggacagaugcaggcggcuggggaugggugcagaucccagggagcucgaaguguagagaaagcagcauucccucagcguggauuggcuacugcgaauggaaaaccagaacccacuucuaucaguugacauucauucugggaauuguuugccuuuggauuugaacuuuccauucuucagacaaguguaucucugaucaucucucccugaacagggacaacucagaccacauugcuuccuuuggggcuuuagagcgcuauagacaaacauaauccaaguuuguguggaaugaauauuuaguauauaaguuuugggauuuuuuuuuuuuucaaggaagaaugugaggugaucccugccuuugggauacaaugcauauuggagacugccugggagagagacauucuguaaugggacuccuaagccacggacagaaccccacauggauguccaggcgggcugugcucgagacggugcucggcaggcguuggcccuuagugucuggcuagcuguaucuaaaggccuguaucuaagccuuuccucugcucuacauaguugggcaauacaaagcccauucguuuccuugugaacuguaacugagaaaagcagcucacaggucugggcucuccuuacuuaguuauucuugcuuuuaacuuauguaaguuccuguggugacuccauguaauauguagugaaauuacuguauauaguuucuauuaaauguuaaaaugcuaucaaaguguaaagugaucuggaucgauuguguucucguuggauuugagaauguucugaugggaaagguguauacuacuucuauucuaagacaggcacucuggagaaacucacgacagagguggugcuugguaccuaguucccagggccagguaaacuugugucacuggaaagcuagggguuaauucacucgagaccuggcacagagccuuaggaccuugguucaaccccagcgaggaugguggaguggcaaagcagacaguguggcggugagguuuguguaaagccgcuuccuaggggagcguuagacagaaaugaugagcaguucccaggaagaagcuaauaaaacugccaaggaaagcggcaaagcuccucccuggggugggcagucauccauuucucccugcaaggaaguagacuagaucauucgcucagcccagaccccuuucggguguuggcuguucucuacucuucuguugcuuaugacuaagauguaagguuccagagggguuauagagcaucauggcaggaucaggaagccgugagcucgcauggggacuacuagcaugugggacagcacacguacaagacacaagguuuaucucaaaguccauccccagugaucacuuccugcagcauuucgguaucaccgagauaucccaaaacugccaccagcugggugccaaguguccaagugccagagacuggcgggcauuucuaauucaaauaaucacaucgggguuggccaguggaaagcacaagagcacgguacuggaccggauugucagaaggggagcugguucaaagagcacugagggcagaccagaguacaucucuuagagccaggccaaacuguaauccccccacugcugcgacacguggaggccccacagugguaccccagagugggaagguuggauggcucaugggaaauacacacuaugaugacuuaggagggauaguggcuccuauguaugcgaagaggagacuacaaccagcaaacugcaaaccaccucucagcaaguuguguagggaacaccaggguuguaacuuuugugaguuaucaccauuuugggggggaugaaccuaucuuucagugaugaaccugucuuugggucauccauauuccuguaaacaagccaauaaacccuacaguucacugaau

SEQ ID NO: 7970 - RNA, 32237 nt, Mus musculus
ggguucuccauggagcugcaacugcgugagcuaaauaauuccaggaagcuugagguaucaaggaucauuacuuuuucuuuuauuuucaagacagaguuucucuauguagccuuagcuaucuugaaacuuguuauauagacuaggauggucucaaacucacagagacccaccaaucucucugccuccugagugcugagacuaaaggugugugccagcacagccgggcuuaucgaguuguuuaauuaauuuacguuacauucaaauugcagugcacacacacacacacuuucucucucucucucucucucucucuuuuuuuuggagacaggguuucucugguuguccaagaauucacucuguagaccagacuggccuuuaacuaagagauccaccugccucugccucccaaguccuggauuaaaagugugagcuaacacugauggccugcaggcucauuaccuuuuauuuuuuguuuuuucuuuuuuugcucauuaccuuuuaaaaaaacugcugucauccuuugagaacuuugugcaauguauuuugaucaucugcauccacccccaccucuuccaucucccccagaugcccuccauuuuguccuuccuaacugcauggccuccuuucccuauucagugacucuaguuagugcugccuagcugcacauggguguggggucaugggcaacuggccaguggucacuuuccccucagcagccaucaccccuguccuguccuugcuggacucuucacuggccugacuggugcagguaagcacagcuguagugagcugcuguguacgguagccagguggcauucccuaucuaucagcauccucccaagcccuccccuuuugagacaggguuuuaccgugucuuggaacucaugaaguagaccaggcugguccucaaacucagagaucugccugccugcaggacagcuagggcuguuacagugaaaauccuaucucaaaaggcuuugagggugugugagauggcucgguugaguaaaggugucugaguugagccugaugacccauguuuaaucuuugguaaacaugguccugugguagaaaggacgcucuagaauuauccucugaugucuagccuuacacugaggcaugugaaagcuauguuguguaugcacagcacauguauauacacucaaguuuuuaaauuaaaaaaacucccugaagaaggaaucuuggagaggggaggcuggggaagacugggaggagaaacugcaguugggguguauaugagaggaaaaaacugaaaaaagagacagugacauacauaaaacaugggaacuucuuuuuuuauauauauaauuuauuuuuuuuggagacaggaucucucuauguaguccuggcucuuguuauguaucccagguaaauaucccgcucagguuggaaagcuggagcggggcugcgacuuaacagaggccuugaacuuagaaaauuuccacauggugcuggugguaacuuuccacaugguagaggcaguuuugauucauccaugagcagauccuaggauacuuuugggcuucuaaacuauuuagccuuggggcacuugaggucgucaggggauaacuggcuagagucaguucuccucgaucuaugaugggggggggggguucucggggauugaauucacaccagaguugacagcagccucuccuaccugcuaagccaccucgaggggacccucauuuaugcagacacauuucccagaggacuucuggcgaaaaaaauagaccccaaaucuucaagauugauugccaauccccuugcuaguggguggauacagugggcucuugguaaacaaaagaucuagaguuugggauugugugaacaucaauaccgaguucaaggcagcgaccgaggcccggggacagagacacccuggugcagccaggaggcugaggcggacaucggccccagcuugcuuuuuacaaccucacaaaguggaccugggagugaggccagagcacaaauuaucucuugaucuccuucuucugauaauccuccccaaugcaggacacaaauuaucuccugaucuccuucgcuugauaaccuuucccuacgggguggguuuccuagaacuacugaccugacgcgcaggggagcuugcauaaccuugggcccucccugacuggauguuuggaaucugagccugcaagcuuaucgccuucacugacaaagagaaaagaaugcaaaagaaaaaaggccuccagaccuaaacgauaaacgaucggugguguccuugagcguggcggggugguggugcaagccuuuaaucccagcacucgggcaaaacccgacgccccucugagcuccagggaugacaaaaauaagaaaggaaagagagaaaaagaccccuuuacccggggcuggagagauggcucagcggguaggggcacugacuacucuuccagagguccugaguucaauucucagcaaccacauggugucucacaaccaucuguaaugggauccgaugcccaauucuguugucuaaagaccacuacagaguacucauauacauaaaugaagauaaauaaaucuuuaaaaaaaggccccuuuaccccccccccccaaacacucaaacgaagcucaguggcguugauuuuauuccuuccagaugauuggccgcagugaaacgggaggaaaggcugcuacaaaauaggagagcgguuuccaaacgcgccggaguucuccaugccggagcuaagaacccaggaaccuuuuaguggcuuucgcguuucugcacggggcagggccacucacugucucguccuuucucgguuuucugagagucucgccuauuuccccugccacuuuuuccguaagcccgguguuacaaaggggccuccaucacgcacguccucggaaacuacccagccaagcgcagcgagcguuaacuagaggcccgccggugaggcccccuuaccgcaguucucgcgcggaaagacgagaccuuuaaagaacgacgucagauagucccgcccaccuggcggucacacgaccggauccugcgucccggccgccgguccguucuuagccgcggacuggcuguggauucgucuacggggugucggaggggucauuccggaagucggcgcuggaaucuucggcuuucugggcggaagugugucacaaccucgguggucgccccuuggaggaaguucgucacgucgcaguagucucggcacggcggaugugugucgccgcuccggugacgcugggaagugcucgcagcccccgccgcugccucuugguugaagcacuauggagggagagaggaagaacaacaacaagcggugguauuuuacucgcgagcagcuggagaacagcccgucgcgucgcuuuggcguggacuccgauaaagaacucucuuaccgccagcaggcggccaaucuccuccaggacaugggacaacgucugaacguguauccuuucggccuaggccaucggccucggagugcguccggccaugcuucgacguccgggccggcgacgcugguggggacagaagcggguggggugguggcaggagcugggcgucuaaguugggagaacccacaauggcgcucgcuggccgagccacuguucgcgcgagggaagugaggcggagucaauuucccgcucgcucaccggugccaccggccgggcugccgacucguaccucuccugucuuuguguuuucgcugcuccuucccagcccccguccucuggauucugcccuguuuuaguggcuuuugagagucuucuuucugcugugaccuaaggcuccguuuaggacguuucgcuaucgacucugccuccccaaaguguauaaaaaggguuucgggaaauucuguacgcaaaggacuuaugaagguggucuggaauugcugccccaguuuugguuccaagcccguuucucucacuagcuggcuaaccugucagauucucguuuaaaacaaaaugucccaaugucugccaccacgcuugauauucaaacguucuaguagcuguuucauggaauuuaagaggaaaaaaagaugucaacuuagguuuggggggaggggauauacaaguugguaugcuuaaaguaguuuucagaauauuaaguccuugcuucuuugggcacuagugauaguuuauucauuagguuucaaaauuuagagguaauguaguuuagugauuuccccccucccaguuuuucuuaugaaaauacagucuuguggcaaaacuaauaguuuuaaaguucuuuccguuguccauauauauauauauuuuuuuucuuuuucuuuuuuuuauuuuacuuccacuuauguagcauuuauuuaagagugaugcugagggcuaggccugguguccugugccuuugaucugagcuuuggagaaguagaagcaggccagaauuuccauguaagacccugucuccaagaaagaaaaaaaagugcagaguuuaggucucuaguguuuuuaagucugaagguuguauguuguauagguguucucuuuauugccaguugucuccuauugaaauccaguuucccaagcauuuggucagugcacgaucaaaccucucugaguuucugucuguguuuacggcaccuuuuaaauguguguuuaagcuugccgccaucauauugucacuucuaugcagacuguugcugaggucugugggaauaaguacucuuacguuuuggggagguuggaaugguacccguacaaaggaaggcagggguuuauuuucaguggaugacuaucaaaugguuucaaagguuuuauacuucagaggucauguaauauuuccugaaggaaucagaacuaagcagggugugguggugcguaccuugaaucccauugcucaggauggggaggugagcagaucucuacuucugaugccagccuggucuacacagcacguuuuaggacagucaaggauucauagaaaaacccugccuugaacacugcccacccaccuccucaccucccccacgcccccccccaaaagaaaguagaacuggaaaacuuaauuauugaaguuuaagaaggugagagagagaaaaguuccaagagccuaguaagggaaggccugguaaauauccuuaaaaaguuauuuuuuguggggcuagagagauggcucagcaguuacaagcacuuacuguuuaggcagggccuauauggcagcccacagucgucuauagcugcaguuguaggguaaucucaugcccucuucugaccucugugggcaccagacaugcccuuggugcacauacauagaaucaggcaaaugcugauacacuuuaaaauuuuaaaguuauucuuggccugacagaauggcccagcggguaaaggcacuucucgucaagccugguagccugaauuccaucccugggacucgggugggaagauaaccgacuccugcaaguugcccucugaccaccauacucaugcuauggccaaaaguaaaugugaugaaguuguccugagcuaaaggaucgucuuugcagaaggcaagugacaggacaggaagccugaggucguaugcagcuuuguuuguacugauuuacaacuugcuacuuguuuuguuuauucagucaguaaguucauauuaaguacccguuagguagagcacauguugucaauuggcaguuaauuucauuagagaaggaaacgaaucugcuguuggguuggaagaguuaaguuuuacuccccugugggaucaucuguuuagcuuggccauuuguuacuuuggggggagauuauauugucugcuucugaaccuuaacucgagcacuucagcucacaacugacgaucaauacugcuauaguauacaugcaccgauucuacaugauucagucuuuuacacaguuucaucgauauguaaguauaauuuucuauggugaaaucccuuuggguuugaguguagcugccuacuuuaugauuggucguuguuauugaacuaugauuuuaauuuuagaauuuagggcucguuauuuuaaaguuagaaaagaaaccaugauuuaaauauagcuuuccgaguaagaagacaaauguaaguuagguuuugcaacauuuuuaaaagucuuuaagaaaacauguuucaaauuuaggauaaaaaaggacuuggcuuuauuuuugccuguguuuggguuagggaaugguaagagugugugagugcccucagaggcuaggugaggacauugaauuccuuggagcuggaguuaccuaggugcugugagccaccuaagugggcacugggaacaaaacuacugagccaucuccagcccagauaauacauuuugaguugucuuguuuugaugcuaacaaacugaagagaaacugugaagcuagauauaauuccuauaauguaggaaauuggcaggcagguucaggagugacagggaacucuugaucuguaguaaagucuccgaauuuugggugauuagauuagucauuuugacuuuuuuuuuuuuuuuuuuuuuuuugcccuuagcucccauaguuccaauuagccuuuauugaggcuauuugauagcacugaaacagaaguaauuaaugaagaaugaaauuaaagaggaguuuccuaguugucuuagaaauuuugaggguuuucuacauucagcucuccuuuuuuuaauccuuuuuccucuuccuccuccuccuuuucuucuuaacuauguacuaauggcugcacuugaacuauauaguucuggcuggcuugaauuuccaaacacuggcauuaugaacuggaggcacaugccugacaaguacuuuuuuuuauuguaauaaagacuugaagucuuaaaucagguuguucagugugcauuuaaguguuagcauauauuucccuauuuaaugaccuacuuucuuauugcuuuuguguuaaucuuggucaagacagacuucugauuauuuccaaaguaccugcaguaaacugguuggauuaaugaccugauaauuauuucuuuacagagacauucuuuugaauaucauauccuuuguuuuuauuugucucuuguucugaaacaaccucacuaugcagcccuggcuggccuggaacucagagauucaccugacucugucuucugagcacugagauuaaaggcaaacacugccauaacuggugucccaaguaguugaucuucuuuagaguauuguuuuuuuaguauauucuggaauuggcacacccucuuuacagaacauuaauagguugaauuuagcugugaucaauuaaaauuagauuuaagagggcuuaaaaccuggugaccuugauguuaggccugugaagccugcucuugcagaugugugugugugcacauauauaguguacaugaugugugugagugcaguucacacaugcuguggugcacauauguaagucagaggacauguuuugguucucuucuuccuccauagggucagguugugaaauuugggcaguugcacaucagauagcugagccauccugcuagccgccguaugacuuuugauuuauuuauuacaaauauaaugaauuugcauaguaaaaaguaacaauagagaaauguguguauugaaagcuccccugugcguguagagguaaucauugaucaauauuugacaugcaguaucccaggccugcuucuguauaugaacuagugugauuaugccucacuauaucccuauuguacaauuuucuggaacauuuucuuuguguuguuucucauaaucuagguggccgaaaggagacagggcauaguaguaaacauucuaacuguuuuuuguuuuucuuuuuuuuggguuuucaagacagggcuucucuguguagcccuggcuguccuggaacucacucuguagaccaggcuggccucaaacucagaaauccgccugccucugccuccugagugcugggauuaaaggcaugcgccaccacugcucggcuagcaacagauuuggauauauuuuacccucauuaguugauuuguaagaaaugaaguuuaggccaggcaugguagugcguggcuuuaauuucagcaccaaggaggcagaggcagguggaucucugaguuccaggccagccaggacucuguuacacagagaaacccugucucacaaaaacagaaauacaaaaauaaauaaauaaaugaguaaauaaaaagaacagugcaguguacuuaaauaaugcagaaugccgggcgugguggcgcacaucuuuaaucccagcacuugggaggcagaggcaggcggauuucugaguuugaggccagccuggucuacaaagugaguuccaggacagccagggcuacacagagaaacccugucuugaaaaacaaaaacaaaaacaaaaaacaaaacaacaaaaaagaauguaugcuggguuagaaguguguggguuugggguuuugcugacuugcuuacuagcgguguggcuugugugagcgaccaugugccucagaucccuguucuuuguguucaguaauaaucaugccuguuuccaaguaaguuuauguuaugguguuuacguuaauuuucacauuucuuguccaaaacaagcaguugguaaauauuagcugugguguuugcuugcuuuguuuuuuuuuuuuuuuuuuuuuugcuuguuuguuuuuuuaugaagaaaauaaauguauaguauaaauugguauaaaaugccucauagaguuaggugcaagugccuguaaucuuguacuagggaggcugaggcuagugcgaugccuuacagugggaagggugcuugcugucaaaccuggcaaccuaauucagucccuggagagggaggggcaggcugacugggucaaacccagggcaagcacucugccaauugauacauucccagugccuuccuuucuuaaucuguucauuggacauuagacugguuccaauuuagcuuuuaagaagagcggaaggauagagaagguugugcaauaucuuugcagcgugccagacuuuaaucuagaaaauuauaauuuaaguaguaguaguguuggaaauacagauuacgauguuucaguuuuuuuuaugguuacucuuugagaucuuuauuuguaaauuggcuugaguuauuuuuuuccccuaaauauuuucuaucuugugacuuuaauauuuuguaguuuuuuuguucuuugguaugugugucccacucccauucuagggcuucucugugcagccuuggcuguccuggagcucacuguauagaccaggcuggccugaacuuagagccugccugugccuccccaguccugggauugaaggugugugauaccaccagguuauuuuuauuguuuuuaggcagucuugugcagcccaggcagaccuugacuucacuauguaaaugaggaugacuaaacuuacagaugccagugcugggacuguaggggugcaccacuauaucugugcucccuccgcccccaaaaccaaagcacacacacuuuucuuauguggagccaggacuuugugaacugagccacauuucuaguaccuguaauuuuuuauuuauuauuauaucuaaguacacuguagcugucuccaggugcaccagaagagggugucagaucucauuacggaugguucugagccaccaugugguugcugggauuugaacucagggccuucagaagagcagucggugcucuuaaccacugagccaucucuccagccccuguaaauuuuuuuuuuaaaagauugguuuauaaguuaaaaagaguuuuuauuuuuugagacaggaucucacuauguaguuucugggacucaccauauggaccaggcuggcuuugaacucugagaucuaaggaguuuugggauuguagauuagggcugccacaccuaacaaaaacauuuuuauuuaguauguguuuuauauacauuuguguuuuugccuguguguagggggcagggucuauagguuaaacaacaagucuuuuauugguaucuuuuuuuuuuuuuuuuuaaauaaggucucacugaauaaggagccugcuauuuuggcuagacuggguggccacugagccccuaggagccaccuaugccuauaccuuaacucugguguuacagauguugcugcuagaguuuuggacauaggucaccacuucaucuccugagcccccaaauuuauucuuaaaaauucuacagggcuggugagauggcuuaguggguaagagcacccaacugcucuuccaaagguccagaguucaaaucccagcaaccacaugguggcucacaaccaucccuaaugaaaucugaugcccucuucuggagcaucugaggacagcuacaguguacuuacauauaauaaauaaauaaaucuaaaaaaaaaauucuacaguucucccuccuccccauagccgucagcaguguuuguuucagaccgugcguguugacugucccccuuuugcagccauuucaauggaaagcagcuaaggucugcagccuucucacaugaaucccugagggcuugcuaaggcugggguuaugauuugacaggugguggaaaguauuaauaagagguacgagguuguggcagagacuuguuugacauuuagcucuuccuagauugauuaucauuuagaaauaaauaacaggugugaccuuuuuuuucuucuaugaaguccauggcuccagcagccuuguuucuagcagcaaaaguagaagaacaaccaaagaaauuggagcaugucaucaagguggcacacacuugccugcacccacaggagucacuuccugacacgaggagugaggugagugaguguuuacacuuuuaacaaccauaacuucaguuuguaacuuugaaucugggcuguucaauuucucaguuuaauuuuuacuuauuuuuauuuuuuagccugagaugggauuccucuguguagccaugacuauagaccagguuagacuugaacccacagaaauccuucaacuguguaccuacaccucccugccaguguuuaauuuugaaaauuaaaaacauacauaucaauuucaucuaaaaguuugucuuaaaauugaaagcugcauaagagcaaaagagaguuauaucaccuggauaaauuucuuuccacccucuagauccaaaauauuuucuuuuucucuacuguuuaaaaaugauuaaaaagugugcagcaccaccaucuggcuguuuuuccagucuuuuauugaugguauaagcauucuuuuuguugguuauuucuuuuccuuucuuccuucauuucucccuuccuccgucccuuccuccugccagagacaggguaucuguguggcucuagcucuccuggaacuuacucuauaccagcuuagcuuugagcuaaagagaccguccagacugccucuaucuccugagugcugggauuaaagguguguuucaucauaccaggcuucuugauguuauaaacauuuuuuguuacuguuuuucaagacaggguuucuugguauagcccugguuguccuagaacuagcucuauagaaaagacugggcuugaacucugagaucagccugcuucugcaucccgaauguaggaucaaaggcaugugcaacuuggcuaggcuaugagcuuuuuuuaaagauuuauuuauuuauuuauuuuauguaugugaguacacuguagcuguacagaugguugugagccaccaugugguuguugggaacugaauuuuuaggacuucuguuugcucuggucaacccugcucuguccagugccccgcuugauccccuugcucagucccugcgugcuccaacccaaagauuuauuuaucauuauacauaaguacacuguagcugucuucagaugcacaagaagagggcaucagaucucauuacagauggcugugagccaccaugugguugcugggauuugaacucgggaccucuggaagagcagucagugcucuuaacugcugagucaucucuccagcccucuaugagcuuuuuuaauuauauguaaguacacuguagcugucuucagacacuccagaagagggagucagaucucauuaugggugguugugagccaccaugugguugcugggauuugaacuuuggaccgucggaaaagcagucgggugcucuuacccacugagccaucucaacagccccugagcuuuuuuuaaaggugaaguuuuguuguggaaaauuuuuuuucaugauaaagggccauacuuaaauaucagucugaaaaugaaccaaaugccuagaaguagcaagauugauguguauuuauuuuauauuugauucuagccaaaaggcugagaaacacauggucauugucagaguucauacuuuuauuucuucaagucaggaguucaaggucuuaaaaaguauuucagaaacgaggaaaauaccuaauaauaaaaaaaaauuaaaaaaaaaaguauuucagacuagaguucaccccuuuuucugugauacgaaugcugcugacugcaguuccauaggugcucugguccuuccuccaguguguaugcgcaguucuucuauuuuugcucaugcuuccuuaguguguguguguguguguguauuuguguauuuguguugacuuuagguguugaaucuaggaccucagaaagugcuaggcaaaaauucuauugcaaagccuuuuccccaagcuggauuggaugccuuuaauccuagcacuuaggaagcagaagcaggugggucuccuugagggucaaacuagucuauauaguaagucugagagcagccagggcuacauacugacagccugugucuuaaaagaagaaaaacacacccauaguuugguuuuuguaaaaaaggaugacuccugauuuucuucacuuauuaaaaaaaaaaagauuauguauuuaauuaaauauguauaugucugugaguguaggugucuauagaggcggagaucuuggauccacugaagcuggagguagaagugguagugagcuggguugaagagcacuaugguucuuaacuacugggccaucucuccaguucugcuuugagaagucagugaucagagauguugagaauucaaacacccauaauugaggaaaaguuacagauuucuuucuuuuuuuuuuuguuuuuuuguuuuuuguuuuucgagauaggguuucucuguguagcccuggcuguccuggaacucaaguuguagaccaggcuggccuugaacucagaaaucugccugccucugccucccgagugcugggauuaaaggugugugccaccacaccuagcucagauuucuguuacuagguuauuuaagucuuuuauggguguaggaaucaugguuugugaagaagauaaauggaauuuuauguauuuuuauuuuuagaaaauuucuuuauucuaauuuaguauaugcuacagaagcaagcauugcuauccacuuuuuaucacugaugaaacaucugaaaaacaaacaaucuaagggaagaagggauuccuuuugguucacaguuucaaugauuucaaccugugguuacuuagcuauauugcuuuuggucccgugccuaugaggcagagcaucauggccaggaaggagcagguggggagagcaacaggagauagccagggacgagaugcacucuuugaagggugugcuucugugaccuacuuccaaggcccaaccuucuggucuccuuuaccucccaacaaugccaucagauuauaacugcgucuggauuaauccacugaggugagagcucucgugauccaauuacuuccugcugaaagccgccacacccuaacuuucucccuuuaucuggguuccugggaucagacucagguucccagccuuguaacaucuucacugcugaaccacucuuuacccugguaccuggacccuuuaacacgugagacuacaggagacauuucauagucaaaucauaacaccuucccccuucuguucuaugagccuuuccuucaaggcccuguuaagucuuucuauaauggcuuguccuguaggacuguaaacuacauccagaauaggcuucaugccaugauguccauaaaacuguuguauuuuaaugggauuauaugucagagcaucaucaguuuuaaucuguaaaggcagauccaagacagccaucaucucugaugaaugugcaaucccagaaucaucccccucagaacgcaggcauaaguccacuagaacucuuaacauguaucaauuguaugauguaucaacguguacauaucucaguugggcaaacuauaaaugaaacacaaucucuuauguggcauuguuuuaagguagcaucaauaagcagaaucuggagucuuaauucaauauauuauauuucuauggguugccauucuaauuucuuaagccccuguggaauguuccaauuuggauuccucugaggguuuccuauuuugauuuaaagauucuuuucuugucuguuuuaugaucuucaauuuaguaucuaguuucucaguuucuucuuucuucaagacuuauucugauuucuccaaaagaagacacacaaaacuguuaucacugaaagaaacagccauuugugugcugaugaacaaagcaagaucauaugcaaucuagacgcaaugugugaggcauuguguuucccuccaucccgaaugcagaaacacuuaaucugaaacuucucccuaagaacuuuauuuucuuauauuuaaauuaaauauuucuuucuaugauuuuuaaaaacauuuaguuucccuuuuauuguuuaagcucaauaccuuaucaguuugggacuuuuuaguuuauuccuuacggugcggaagccucaucccagcuguuagcuagcucaaggcucaugaucuuuugccagcacuggccaggccucuccaccggcugugcuucugcaaggguuuagaccuucccuggacaucuuccaguggucccuggcccaugugcccugccaugcuugguugggcuggugccucuuaccagacacugggcuggggacucagugggcccagauuaggcugcuguuuuuaacucuggaccuuggcaguagccgugcucuccaccaagcagagugcuggcuuuucagagcagcucuuggaagaacugcauccuguauguuguucucagcagaugcagagugcaagcaaagccuuccuggggagcuuuagucuagcuggucccuaagcaguguuugcagggagugugugacucuacccaguauaccugcaaucuaaacuuggagucuaagugaguucuugccccacauugguuugcccauauuuaggacaaccaauuuauuaagcuuaucccugacuagcguaaaaauaaugaggcucaggcuaugauuauuuuauuuagcuuuggcaauuacugguggguuaucccuaaucuacuuucuaacugcuggcuuggcuaccucccuaaaaguguaccccaaauacuuguucuccuccuagccacgugcuagguucaucuccucaugugacauccuccucuccucucguucuucucuuucuacuccccuaaccagguaaccacaaaucuaucuaccucuaauccuuccaguauuuuauuugaccaauaguuuuagauuaaggaacaagguuugcauaaccaaagcuaguaaaugugagaauuuacucuugguggguacagaauuucgcauuacaauacauagcaacauacaggcuggcuucaaacucacagagauccauuucauaugcccagcuccuuugagcuccagaauuuauuuuuagaauuaagagaaaaauugaaugugagucaaauauuuauuaguuagauucuuauagcacuguuaaaagaucugaaagugaaaugugacgauucuuagaggugugauauuucucaugucuagauuaucugacuucuaagauuuaaaauaccugaaaauaaaugcaguugugcuuuugguagccuuccauuaguaaaguguuaucuuuugauguucggggcuuuuccuuucuguccugagugggauagacauaaagacuauauauuccaguucuaacacuaccuuuuaucucccauucuaccacuccuuaagauuuuaaaaguuucugugcauuaguuauuugccuacaugaguguagggcaccaccugcauacgugccugggaaggccagggagugaguguuggauucccaggaacuggaguuacagauggcugugagcuuucugugaguucuugaaagcaaaccuaggucuucugcaacagcagcaaguguucuuaacugcagagccauugcucaggggccucuauccagacuuuugauuguuuuguuuuuaaaguuauuuacauccuuuugcuggauguaacuucuggguuuuuuuuccccuucuuaggcuuaccuacaacaaguucaagaucuggugauuuuagagaguauaauuuugcagaccuuagguaaguuaauuuuccuuuuuaaagcaggaaaaaaauauguaugggauauaaugauuucauguuaaaguuuguuagaugggagaaaaucuugugaaggcuuugggaagugucuguuccuggguaaaaaugucuguggggcucauuaaauggagacagaucauuaacccuggucacuuuucacaguguuagguccuuggugacccuugaaacagcuauuagucaagauuuaaaaaaauuuucucauuguaagguuuaugauuuuuuuaaaaaaaguuuuauuauauauaaguacacuguagcugucuucagacaucccagaagagggugucagaucucauuacagauguuugugagccaccaugugguugcugggaauugaacucaguaccucuggaagagcagucggugcuccuuaauuuuuauuuauuuauuuauuuuuuaagauuuauuuauuauuauauguaagugcacuguagcugucuucagauaccccagaagagggcaucagaucuuauuaaggaugguugugaaccaucgugugguugcugggauuugaacucacaaccuuuggaagagcauuugguucucuuaaccgcugaucaaucucuccaacccuguaagguuuaugauuuaucugauuguucuguuugguuuugauuuguuuggcuuuguuuuucaagagaguuuauauguagagagucauucagaccaggcuagccuugaacucagagauccaccuaccucuaagccuccggagugcugggauuaaaggcaugugccaccaccaccuggcuaguuuggcaguuuuuuaaccugauaaauaaugacaaagguggugggugggggggagacucauucuccuauaaacuguuuugguuugacaauguguuuagguaauagcauuuuguuuguguguacgcaccccccccccccccccccgugcgcguuuuguuguuuuuagaccaguuucaccuuguagccaaguuggcuuuaaaaacucaaaaucuagccuguugugguggcucacgccuuuaaucccagcacucgggaggcagaggcaggcggauuucugaguucgaggccagccuggucuacaaagugaguuccaggacagccagggcuacacagagaaacccugucuugaaaaaauaaaaaaauaaaaauaaaaaaauaaaaaaacccucaaaaucugccaggccuccugagugugccacuauuuguggcugggauuuauauuuaugugcucaaaagaaaauuuacuuaugucaguuuuucaauauacugaguccguugaauaauuuugguaaugacuuuuugaaauaggauaaaacaaccaguacacauuauaaugaagcugaugagaaggaccacagugagguuuaagaugcuauaauccagcucucagguggcagaggcagaagcagaauugccaagaguugcagccagccgcagcuacagagugaaugguugguagaaugcuuagcauucauuaacccuagguuugauaucuaggguccucagcuccaaacugggugagguagugcauucuguauuucagcaucugggagcuggaggcaggggaaucuuaagugcaguaauucucagcaacagagugagcuugaggcgagccuggggcuaugugguaaugugucuuccuacucuuuacuuccccaaaugaaagagacuaagccauagaagccaccaauauuuaugugccugcugcuuucaacccugugcuauauauccuuuuguuccuaaauaggaucaaaacauucuuuuagguucauuccauuuuaaguguaggagugauuuaccugcuuuuuuuuguuguuguuguuuuuuuguuguuuuuuuguuuuccgagacaggguuucucucuguagccuuggcuguccuggaacucaugcuguagaccgggcuggccucgaacucagaaauccaccugcuucugccucccaagcgcugggauuaaaggcgugggucacuaccacccagcuuuaccugcauuuuugucugcagcauguaugcccacagagauccaaagaaaguguccgauccuuugggacuggaguuacagugaaccaucauguggauguugggagucaaacucagcucucugcagcaccuaguacucaaaaccagggaguugucucucuagccuccauaaaaaagauuuuuguguucagagguggucuuguccuuuggguuuugguggguuuuuuuuuuuuuuuuuggauuuauuuauuuuauuacuguauguaaguacacuguagcugucuucagacacaccagaagagggcgucagaucucauuacagaugguugugagccaccgugugguugcugggaauugaacucaggaccuuuggaagagcagccaguguucuuaacuacugagccaucucuccagcccucuccuguggucuuuaggucugacuuguaccuuugcuaagucuguggagaugauagagaagagugugaaggauacguuuagucacuuagucucugcacaguacuuuugagagggaaaagugaacuggccauuaauaauucagacaaaagagagauaaguauguugaauauuuuuagcuuuuuaaccaguuacuuuuuuuuuucuuuuugaaggguuugaacuaacaauugaucacccacauacacaugugguaaagugcacccagcuuguucgagguaaguaacccuaacuuccuggggcuguacccggcucuggccucaggcacaacacagccgccuugucccagauucagacucauccaccugcuuggcuggagucaagcacuugcuucugaccuauuggaaacuguuuuuagaucuuuuaauuuaaccagacagugagguuagcauuaagugucauuugacagaaucacuuagaagacagguccuggauuugcagguggagaauuagguugcuuauguugagguggacggcccuguucccugcuaggaucucagacugaacaguagagaggugaccaagcaucagccagccggcagucagcccucuguuuccugacuccucgaagugugacagcugcuucauguuccugcuguuggggcuucuccacccugguggcuuggacugugagccauacaggaaaaggaacuaagagucaacuuuugucugguugggguacuucacaaagugcaaggacagauuuggaaaagccaccaagucacauauaaguuagcauuuuucagaaaaucuugaaaguugcugguguugggccagcaagugggucaguagccugauaaccugaguuugaacacuggauccuacagugggaggagagaacugauauccaaaaguuguccucugacuuccacacaugccucgguauuccaguguccuaaccccacauccuguauuagcacauagaauuuauucuuuaaacauggauggucuuuuuuugguucaugucuaauuaaaggaaaccccaguggugacauagaauuuguuugaauuuauuucuaccacucacaauccauuggguaggauuuuaaaauuauauucauuuauucuuacuuauuuguauguguacggguguuuugccugacuguauguuugaaugauauguguagcugguaugcuuagaagcuacaugagggagucaggucuacuggaaauggguuauaguuaaucagcagccaccacagaggaacugggacucaaacccugguccucuggaggaaaggccagugcuccuuuaaccuacuucgcuaucgcuccaguccugaucaaaaauuaguucuugccgggcgugguggcgcacaugccuuuaaucccagcacucgggaggcagaggcagguggauuucugaguucgaggccagccuggucuacaaagugaguuccaggacagccagggcuacacagaaaaacccugucucaaaaaacaaaaacaaacaaacaaacaaaaauuaaacaaaaaaaaauuaguucuuaaaugccauacaaauuuucauuuuugagacacagucucacuauguggccuuggcuugacugaaauuugcuaaauaggccaggcuggccuggaguugagaguucugccuccuaagugcuuguaccaccauacccaucccuguuuuuuuuuuuuauuuuuuuuuuauguuugugcuauagaguuuaaacauagggccuuguauauguugggcaagugcucuaccauagaguuauguccuuaacccuuaaggguuccuucuacuuaaguagugcccauaaucucugggugcuaguugugguggcacacacuuacauucccagugcuuaggaagauuauuguaaauucuaagcaagccugggcuauauugugaguucaagaguaagaccuauucaacuauacaaauagcaaacaaaaaaggauuaucugggacugggcguaugcucagugggagagcauuugcuuaauacacacaaagcccuggguuuuacuuuaagaccugaaaagacaaagucugaauaucaucauacgcauaauugucuuuaagaguuuuguuuuuuaaagauuuauuuauuuauuauauguaaguacacuguagcugucuucagacgaaccagaagagggcaucagaucucauuacggaugguugugagccaccaugugguugcugggauuuaaaccucagaccuucggaagagcagucgggugcucuuacccacugagccaucucaccagccccuuuuagaguuuuauaugucaaacugagggcuagccuuauuuuuuauuuuaauauuguuauaugaaaaaugaaauuucagaaaaauucccaguuucugaagcauuuuaaauuaaaaccuaaaaucuuuaguaugugucgugcgugagacaugggggugguauucaugugccacuuggcuuacguagaggaggcuggaggguaaccuugggcgucaguuuucuauugagcucuuggggacugaccuccgguugcuggugagaacuuuuccucacuuccucugccugagaucugugaguucuguauauuaacagcuuuaaagguuuugcauuaggaagcccagggcugaagagacggggauaugugcuucuuucuauaggaagucucugaaauuccaaagaagauaagaauggcuugucugccuugauugguuuuaugaggguguggaaugcuugcuuucucauugugugugaagcagcuguuacuugaugguaaagucaaucacugucuacucaguucuuuaaaaaauaaagaauuccuuucuccaaacaugucauggccuucuggagucugacuuuggagccaaguccuauuggcucaucucuuaucucgcucuuucucagugaucucuugcaucagaaccucuguucuucccuaaauacugagucagacuacauccaucgaggaauugcauuuuaaaugagcugauguucaaaauaaagcuugccucucuagaucuggaagcagcauaauuacuuacauucaaauuagaaaucuugcugggccaugguggcacacgccuuuaaucccagcacuugggaggcagaggcagguggaauuuuugaguucgaggccagccuggucuacagagugaguuccaggacagccaggcuacagagaaacccugucucgagaaaccaaaaaaaaaaaaaaagaagaaagaaaagaaaaagaaagaaaugaguagaccaucugcuuagccugaaagagacccuguguugaguugccagcaucccacuugccccuucuucccagagucgcugauguguuugcuuggguagaauguaugcaccagaugaccaggcacugggucugccuaacuuaccacuguuugcguaccuuacaaauaguacauguuuacugaguauuuguugagaaaaaauggaacuaauaacgucuuuuucuuuuguuuuuguuagcaagcaaggacuuagcacagacaucuuacuucauggcaaccaacagguuuauauuuuuauuuauuuuccucuucuguuuuuggguuuggaauuugguuggguuggacuugucaucucuugagggauuuauaggaucacuuugugaacuagagacaaaagaccauaaaaauaacguuuguuguaauguauuguagacagcacucuggagaaugaauuuuucugcagauuuuacuuuuuuccuuauauuugcuuuauacccuuuaauuaacuaggguuuuguacuuauuuagcauacauaauucuaugcauuaacuuugcuauaaaauguccaagagcacaaccugaacauucauguaauuuuggggggauuguuaauuuucuucuccuuugccaaagcaaugggcacuuagucuacaaggauuugcuaucuaucuaucuaucuaucuaucuaucuaucuaucuaauuuuuaaaaagcuguuaguauguaacuuguucugcccagugaccugcuuguucuugugucugacucccauauuguuuguucggucauccccagucaccaagugugagaaggucagcauuaguaagccagcccugcauacacugugugguggcccagucugagaucccagcacucaggacccaggcaggagaaugagugguucagggucauccucuggaauacagcaaguucaaagccaugcugaacugucuacuaaacacacacagacagacagacagacagacagacagcaaguucaaagccaugcugaacugucuacuaaacagacagacagacagacacacacacacacacacacacacacacgaagaggaaagaugaagcaaauuuaaaguaagagccaagcaccauggugcuccaguacugugauggggagauaggauugcugugaguuugaggcagccagagaacgagauccgccuaaacccagacagaaucuuuaaaagaaaaaaaaaaaucagguauauuuguauuugagagagcaacuuuuuuuauuuuucauuuuuauuuuuacauuuugagacggucucauugcuuaagccagccuugaacuuccacuucccauguuuugggaucaggcuucugauccuccuauguugacuuugauuguuuuuuccuuuuguuuuuguuuugagacagacagggucacauuaaauaacucuggcagucuugaaauuugcuauguagacuaggcuggccucaaacucacagagacccaaaggccagccuuugucucccaagggcuauuaaagggguaugccucaccgaggcugacuacccagcuccuuuuuuuucuuuuauuuuuuuuauuuuuguuuuuuguucacuaguauucuguuuacuaagugugugauacuaggaaauuuagaaguguuguuaaccugugcaguauuuuaauagaaagugauauugaggugcugaggagauuagccuagcacauauagcucuuccagaggaccugaguucagaucccaguaucuguuguggauguacaccaucgccuguaacucacgguguagggggucuaacaccucuggccuccacacccucacugugcuuaccccaccacagacguguccagguacuuagaagucaaucuuagagaaagacgacaggcauguugagugcugagucagcacgggauggucuugcccuucucacucuccucugguuuuuguuuuugguuuuuugguuuuuuuuuuauauaauggagaguuuuaguuuaggguugagaauugagggcucaugacacucucuguuuccuucccuuugaugucagccugcauuugaccacauuuagccugcaguacacaccuccugugguggccugugucugcauccaucuggcuugcaagugguccaacugggagaucccagucucaacugacgggaagcacuggugggaguauguugacgccacugugaccuuggaacuguuagaugguaaguuuuaguguaagggaccuugaaacgcacgucuugauuugucacauaucuggccaaacaugacuugaaaacagugaguuaguugagguuuuucucuuuuuuaugauauucuugucucugagcguuucuuggauguuucauuuguagaauugacacaugaauuucuacagauucuagagaaaacuccaagcaggcugaaacguauucggaauuggaggguaagacuuagugcugauaaacuuauucuuucuuuuaacugcaccagugaauauaccagaauuggauaugugugcuugguuuggaguuuccuucuugcuuaacaguaauugugacuuuauagcauggauaugaacuaagauuuccgucuuuuuuuuuuuuuucuuccugagacaggguuucucuguguagcccuggcuguccuagaacucgugcuguagaccaggauggccucgaacucagaaauccgccugccccugccucccaagugcugggauuaaaggugugggccaccacugcccagcaggauuucagucuuuaggauaaaagacuguagggcaagauauggauggaauuagaaggguugagugugauuuuuacuuuaaaaauguuuuaggggguuuuaggggggucugcuggaaagauagcucagugguuaagagugcugacugcuccuuacaaaggaccugaguucaacucccagcaaccacaugguggcucacaaccaucuguaaugggauacgaugcccucuucugaugugucugaagacagcgacagggacagcccuggugguccuggaacuuacuuuguagaccaggcuggccucaaacucagaaauccgucugccucugccuucgaguggaggcgugcgccaucaugcccggcuccuuuuuucuuuuuaaaaagauuuaucauuacaguugggcauggugcugcaugucuuuaauaccagcacuugggagacagagaccucugagagcuugagaccaccuggggcuacauauauugugaccugggguuuggggagagauuuauuuuuuguguaugaguguuugccuacauuuaugugcauguacuaccuguggaggucagagaugucagcucuucuggaacuggaguuuuaagugguugugagcugcuauaguugcugagaacagaauccagguccucugcaacaguagcaaguuuccuuaacugcugagccaucucuucagcccaggguuuucuucuuaaaugggcuucagucuggaguuguaaugcaaauauuuuagucuugggaguaauagccauucccuuucccaucgcaucagauagaugaaaaguccucaccuugccuaaggcccugcacucaaucaccagcacucagaagaaggaagaaagccuccgcccagcucuuuugagacagucucauguagcuccaccuggccuugagccuugcuguuagagaggcugaccuuggacuucugauccucuugccuuugccucuaccuuuuaagugcugggauugcaagcaugaaccaccauguauagaaauuucccguauuucuuauuaguucagaccaagucuccugagucuggugaauuauagagaauuguugccuccagaagauuugaguuagaaauggacuucaaagcauguacuuaaucucuuauguucauacaaaucucaucaaaguuucuagaauuuaaaaaggcuaacugcagccuccaaguaguuauacugagcugggagugguggcgcacgccuuuagucccagcacuugcgaggcagaggcaggcgaauuucugaguucaaggccagccuggucuacagagugaguucuaagacagccagggcuacacagagaaacccugucucgacaaaccaaaacaaacaaaaaaaguaguuauacugaauguuuaagaauggcuuuauuuucugggugugacgaugaaugucuuuaaguacucaagagguagagacaggaggaucucugaguuugagacaugccuggucuugaacaaaaaccaaaauccccaccuccaguaaacaaaaaggaacacaaagccacccagaaaaguuccccuaauugacguuucccuguacugccgcucaguaaauugcuuggcaugaagguuuaugugcuucguccuaggcguaccaggcugccaugaaaaccaagccagaugaccgaggagcagaugaaaacacgucggagcagacaauccucaauaugauuucucagaccucuucagacacaacuaucgcaggauuaaugagcaugucaacugcgucuacaagugcagugccuucccugccuuccucugaggagucaucgagcagucuaacuaguguggauauguugcagggcgagcgguggcugucuucccaaccuccguuuaaacucgaagcugcccagggucaucggacuagugagaguuuagcacuuauuggcguugaucauuccuugcaacaggaugguuccagugcguuugguucccagaagcaggcgagcaagagugugccaucugcuaagguuucacuuaaggaguaccgugcaaagcacgcggaagaguuggcugcucagaagaggcagcuggagaacauggaggccaaugugaagucacaguaugcguaugcugcccagaaucuccugucucacgacagccauucuucaguuauucucaaaaugcccauugagagcucagaaaacccugaacguccuuuucuggauaaggcugacaaaucagcucugaaaaugagacucccuguggccaguggggauaaagcaguuucuuccaagccagaggagauaaagaugcgcauuaaaguucacucugcaggggauaagcacaauuccauagaagacagugucaccaagagccgcgagcacaaggagaagcagaggacucacccgucuaaccaccaccaccaucacaaccaccacucacacaggcacucucacuuacagcugccagccggccccgugagcaaacgcccaagugauccaaaacacagcagccagacaagcaccuuagcacacaaaaccuacagcuuguccaguacuuugucuucuuccagcucuacucguaaaaggggucccccggaagagacuggggcagcaguauuugaucauccagccaagauugccaagaguacuaaaucuuccuugaauuuccccuuccccccccuuccuacaaugacccaguugccugggcauagcucagacacaaguggccugcccuuuucacagccuagcuguaaaacucgaguuccucauaugaaacuggauaaaggcccuccuggggcuaauggucacaacgcaacucagucaauagauuaucaagacacugugaauaugcuccacucccugcuuagugcccaggggguucagcccacacaggccccugcauuugaauuuguccacucuuauggugaauauaugaaucccagagcuggugccaucuccuccagaucuggcacuacagacaaaccucggccaccaccccucccaucagaacccccuccaccacuuccaccucuuccuaagugaaaaaaagaaaaaaaaaaaaaagaggcaaaaacuucaaaaacaaaaaacacuuuuuuguuuuguuuuuuuguuuugacuacugauauuagacuacgaaaauuacaucccuuaugaaaucugucaccuaaggaguaaauugcuauugagacaagugggcgggugguggagggagggccucaguuauucgaucugcugccucacaucuacaguucgugcugguauuagagaggugggauuaugucgaagcugugaaggaugaagaacacacucuacucuuggccucucuucauccuaacuagguugauuggaguaguuaucuucccucuucuugccagaacuaaaauguggagggcauaucaagcgguuguggaugcuuuugguguuaaacauaucagaagagaggaaguauuuaaacgucaaaucuuuaagagacuuuuaaaaaauaauuuaaagaaaguaaguuauguuuaguuuuuuuuauauaaucgggagggaaagggauuuugcuguguguaugaggaacauagcagugacugguggggggggggugggagggugggaaugugugcagggugggggggaggguaggcucuuggccaagagugaaauaggcucaggccucuugaaguauugagaucuuuaaaagugcgugugugcuuguguguguguguguguggguguaugugugcaugcgugugcgcguguguuuaaaaucauguuacuuuauuccucccauucuuaaccauuuucacaucuccgcauucuacuagagagauaguuggcuuugacaauaagaagagacauguauugacagugugaguccucucuucccuucaccgcaggcuugcgugguagcagcccucucgcuucuaguucugaccugacuccugcgccaguauggaaacuucccuguuacuucuuuuuguguuuucaacgcagcauggaggugggcuugaggaagaagccuauaaagcaaggccggccucucuccuacagaauggggucuuuucauguugggcuuugcgagaaagcucaggucucugaagggaagaaggguaugcuuugcuuguccugucugaaaagaccagaccaugugugcuacuaggacugggagaagccaggggguuaagauacuaaagacaaugaaauugugauuuggaauucugaagacauggugucuaaguuacauuaugaauguaaagaguuuaucuagugggaaacaacugcagugugcagccuguuuggcgucagagcuugaauuucacagcauugguauaaugcaugagcaagcccagccaacagacacuguuguauucagauuauuucuuaguggcuggcuuuugauucuagacagagauucuuaaaguccuuuuaaaaaaguggaucaggaauccuguuaugggccuugauuguuccagacauuagaaguaaauauauuugaugaaggaaaucuugaaaaaauacugacuagauaaaaauuguaagccaagcuuucugacugaaaaaugcuaccuagccacagaucauugcuguuauuugguucauugcaugaguguguauguguguguauauauguauacacauauauauguguguguguguguauguguacacacacauauauguggguuuugggggguauggauaagauggugcuaugaaaauaauuugucucuuguuuuaauuaaugaagcuucugucaugccaaguagucuuuagggagaagucagaaucuuuucauuaaaagucauagggaaacagaaguuguacgggugcugcuugccaaggacagacuagaaaagacacugaggcaguuacuagugcugacacacuggcccaacggagagagaauguaugggaaggaauaugucuuacuuacggugacuuugugguucuuaaucugcauguuugaguugucugcagcgccugccguugcugugcacaacaaggagcuccuugcugauaaaccagugauauuucuugauguguaacuuuugaaguaacauuucuuucuugguauuuccuguguugugcaagauagaugugucaucaugauuacuaacuuuaggcuugguauuuguugagauuuuguuuuccauccugaccuucccaaacggaaaaguaccuuuuaguuugcaucuuugucugugaugauuugauuuggggacguggacuguuuuuuuaaucacucucauuaaugucacguguuuucuaaucacaugcaaucccuuagcacaaagguugucauauuuggugucauagcauuucuucacaguaaaccuguuguuaaguuuccuagaacucuguaguggacuagaaauaacugcuuacuagagucuucuaaagagcuacuucaugcuguagucuggucuucuacuguagcucaacacugaguuugauuaguugagaccuuacuauauuaguuccuucugguacugucuauagauagaugcagugucugcuucuaagucagugcguagguccugaacucccucgugggcucugcaugaacuucugcauugcauuauuuuggcguagcagauauaccugccagcuagcaugcauauuguccaguuucuguauaaauauggcuucuaagccaugugugucuccuaccuucauacuuucaaggggugagaaguaguaguuguauaucuaaagucagccguguaagcauggcucuuuguuuuuucuuuuaaucuaaacugucaagaagaaaugcgagugguaagcaggcuuggagccucaacuucuguaaauuucauuccuaagaguuugcuugacuuuuacguuggcagaaauaaauaccuguggauugucuuuagggcuuuuagcauauaccuguguuauuggcuaaacucuggugaaucauuaaccuaaagccaguguggucuucugaaguauccaguuaugccuuuuggguuagaaaauaccuaaauauuagucuacuuuccucauucaugaaucauuguuuuuguaucugagacucagcaucucuuccuucuuguaaaugauuuuaguguuugcuuuaguguauccuauauaucucuauuauuauuagguucaccaguggugauagaaaaauugaauaucuccaauugcaaacagcaguagauuugauuauugaaacaaaaucaugguaacaucacugcugggguuccugaagccuuugcaacaaaauucaccucucacaccucgcuucuagacaaaggcaauuggagggguccuaucuauccuaguaugguuggaaucuaaauauaugcguuuccauuauuuugggaacuaauuacuuuuuaaagauuuuuuucuuuuguugaugaguuauuuugauacucaugcuaggaaaagggagaaacaaaaccaucuugagauuggaauuccuguuuuauucuccugagaugggagaacuuaagcagucuaugcaacccaucagauggugagaaauagcuuucuaccauuccacugagcucucagugacccucauacguccucaaaugucuuggcauugauugagguuucgaucuugauguuuaggaagcauucucgcugcaccacacugucauuucuuucuuacuccucaguggauggaaacuuggaagaagagugguacugugaugguaccugauggagugguccaaauucccaguuguuuccuaagugggugagcucuccguuuuaguauucuaaagauguuaacgugaacuuggcaauggaaaggggaaggaaaauaauauuuaauaaaaaucagugucuacgcuuucccuuuaugaguguguauuccugguuguaugaagagaaacucauggguuuuguguugccaugugaaugucgagagggaugcuugacagcauguuaauugaagccagagcaaguaugucugccgucagguaaucuggagaugccaguguaugcugagggagugauuagcugauggcuauaaugaagucacuuacaaagcagaaaggcugucuggccggccgaagaacccaaggaaagcagugcagcagccucacucacguaggugugauuuaggguucugaacuggaaacugaucuguauuaccugacuuuccacaacuguccauuuucuuaucagaccaaagaacaaaaagaaaaaaaaaacaugaaaaagcgaaguaacacaccuuuaccgguuuaugucacucagguacaauuucguggggagguuuagguuuguuuuguuuuguuuuguuuugucugauuuuuguacugcucagcauauuauucugcugucgccucuguccuccguggggcaccucaguuuugggugcuacuccugggaucucuacugcuguuaggugaaugaugauaggauggaagugaccauuaucauaagggcucuuuguaaaaaaaaaaaaacuugaaaaacucaaaaaaauuuuaaagaaggauauuguauacauuuuauagucuggcuaucaguuugauaucuugcugucaaguauguuucucaaucuguauuuauccaucccaucaauaaacguuaaugauaaaauaccugau

SEQ ID NO: 7971 - RNA, 3543 nt, Mus musculus
ucggccagcgagcgccauuguggguucucccaacuuagacgcccagcuccugccaccaccccacccgcuucuguccccaccagcgucgccggcccggacgucgaagcauggccggacgcacuccgaggccgauggccuaggccgaaaggauacacguucagacguugucccauguccuggaggagauuggccgccugcuggcgguaagagaguucuuuaucggaguccacgccaaagcgacgcgacgggcuguucuccagcugcucgcgaguaaaauaccaccgcuuguuguuguucuuccucucucccuccauagugcuucaaccaagaggcagcggcgggggcugcgagcacuucccagcgucaccggagcggcgacacacauccgccgugccgagacuacugcgacgugacgaacuuccuccaaggggcgaccaccgagguugugacacacuuccgcccagaaagccgaagauuccagcgccgacuuccggaaugaccccuccgacaccccguagacgaauccacagccaguccgcggcuaagaacggaccggcggccgggacgcaggauccggucgugugaccgccaggugggcgggacuaucugacgucguucuuuaaaggucucgucuuuccgcgcgagaacugcgguaagggggccucaccggcgggccucuaguuaacgcucgcugcgcuuggcuggguaguuuccgaggacgugcgugauggaggccccuuuguaacaccgggcuuacggaaaaaguggcaggggaaauaggcgagacucucagaaaaccgagaaaggacgagacagugaguggcccugccccgugcagaaacgcgaaagccacuaaaagguuccuggguucuuagcuccggcauggagaacuccggcgcguuuggaaaccgcucuccuauuuuguagcagccuuuccucccguuucacugcggccaaucaucuggaaggaauaaaaucaacgccacugagcuucguuugaguguuugggggggggggguaaaggggccuuuuuuuaaagauuuauuuaucuucauuuauguauaugaguacucuguaguggucuuuagacaacagaauugggcaucggaucccauuacagaugguugugagacaccaugugguugcugagaauugaacucaggaccucuggaagaguagucagugccccuacccgcugagccaucucuccagccccggguaaaggggucuuuuucucucuuuccuuucuuauuuuugucaucccuggagcucagaggggcgucggguuuugcccgagugcugggauuaaaggcuugcaccaccaccccgccacgcucaaggacaccaccgaucguuuaucguuuaggucuggaggccuuuuuucuuuugcauucuuuucucuuugucagugaaggcgauaagcuugcaggcucagauuccaaacauccagucagggagggcccaagguuaugcaagcuccccugcgcgucaggucaguaguucuaggaaacccaccccguagggaaagguuaucaagcgaaggagaucaggagauaauuuguguccugcauuggggaggauuaucagaagaaggagaucaagagauaauuugugcucuggccucacucccagguccacuuugugagguuguaaaaagcaagcuggggccgauguccgccucagccuccuggcugcaccagggugucucuguccccgggccucggucgcugccuugaacucgguauugauguucacacaaucccaaacucuagaucuuuuguuuaccaagagcccacuguauccacccacuagcaaggggauuggcaaucaaucuugaagauuuggggucuauuuuuuucgccagaaguccucugggaaaugugucugcauaaaugaggguccccucgagguggcuuagcagguaggagaggcugcugucaacucuggugugaauucaauccccgagaaccccccccccccaucauagaucgaggagaacugacucuagccaguuauccccugacgaccucaagugccccaaggcuaaauaguuuagaagcccaaaaguauccuaggaucugcucauggaugaaucaaaacugccucuaccauguggaaaguuaccaccagcaccauguggaaauuuucuaaguucaaggccucuguuaagucgcagccccgcuccagcuuuccaaccugagcgggauauuuaccugggauacauaacaagagccaggacuacauagagagauccugucuccaaaaaaaauaaauuauauauauaaaaaaagaaguucccauguuuuauguaugucacugucucuuuuuucaguuuuuuccucucauauacaccccaacugcaguuucuccucccagucuuccccagccuccccucuccaagauuccuucuucagggaguuuuuuuaauuuaaaaacuugaguguauauacaugugcugugcauacacaacauagcuuucacaugccucaguguaaggcuagacaucagaggauaauucuagagcguccuuucuaccacaggaccauguuuaccaaagauuaaacaugggucaucaggcucaacucagacaccuuuacucaaccgagccaucucacacacccucaaagccuuuugagauaggauuuucacuguaacagcccuagcuguccugcaggcaggcagaucucugaguuugaggaccagccuggucuacuucaugaguuccaagacacgguaaaacccugucucaaaaggggagggcuugggaggaugcugauagauagggaaugccaccuggcuaccguacacagcagcucacuacagcugugcuuaccugcaccagucaggccagugaagaguccagcaaggacaggacaggggugauggcugcugaggggaaagugaccacuggccaguugcccaugaccccacacccaugugcagcuaggcagcacuaacuagagucacugaauagggaaaggaggccaugcaguuaggaaggacaaaauggagggcaucugggggagauggaagagguggggguggaugcagaugaucaaaauacauugcacaaaguucucaaaggaugacagcaguuuuuuuaaaagguaaugagcaaaaaaagaaaaaacaaaaaauaaaagguaaugagccugcaggccaucaguguuagcucacacuuuuaauccaggacuugggaggcagaggcagguggaucucuuaguuaaaggccagucuggucuacagagugaauucuuggacaaccagagaaacccugucuccaaaaaaaagagagagagagagagagagagagaaagugugugugugugugcacugcaauuugaauguaacguaaauuaauuaaacaacucgauaagcccggcugugcuggcacacaccuuuagucucagcacucaggaggcagagagauuggugggucucugugaguuugagaccauccuagucuauauaacaaguuucaagauagcuaaggcuacauagagaaacucugucuugaaaauaaaagaaaaaguaaugauccuu

SEQ ID NO: 7972 - RNA, 3543 nt, Mus musculus
aaggaucauuacuuuuucuuuuauuuucaagacagaguuucucuauguagccuuagcuaucuugaaacuuguuauauagacuaggauggucucaaacucacagagacccaccaaucucucugccuccugagugcugagacuaaaggugugugccagcacagccgggcuuaucgaguuguuuaauuaauuuacguuacauucaaauugcagugcacacacacacacacuuucucucucucucucucucucucucuuuuuuuuggagacaggguuucucugguuguccaagaauucacucuguagaccagacuggccuuuaacuaagagauccaccugccucugccucccaaguccuggauuaaaagugugagcuaacacugauggccugcaggcucauuaccuuuuauuuuuuguuuuuucuuuuuuugcucauuaccuuuuaaaaaaacugcugucauccuuugagaacuuugugcaauguauuuugaucaucugcauccacccccaccucuuccaucucccccagaugcccuccauuuuguccuuccuaacugcauggccuccuuucccuauucagugacucuaguuagugcugccuagcugcacauggguguggggucaugggcaacuggccaguggucacuuuccccucagcagccaucaccccuguccuguccuugcuggacucuucacuggccugacuggugcagguaagcacagcuguagugagcugcuguguacgguagccagguggcauucccuaucuaucagcauccucccaagcccuccccuuuugagacaggguuuuaccgugucuuggaacucaugaaguagaccaggcugguccucaaacucagagaucugccugccugcaggacagcuagggcuguuacagugaaaauccuaucucaaaaggcuuugagggugugugagauggcucgguugaguaaaggugucugaguugagccugaugacccauguuuaaucuuugguaaacaugguccugugguagaaaggacgcucuagaauuauccucugaugucuagccuuacacugaggcaugugaaagcuauguuguguaugcacagcacauguauauacacucaaguuuuuaaauuaaaaaaacucccugaagaaggaaucuuggagaggggaggcuggggaagacugggaggagaaacugcaguugggguguauaugagaggaaaaaacugaaaaaagagacagugacauacauaaaacaugggaacuucuuuuuuuauauauauaauuuauuuuuuuuggagacaggaucucucuauguaguccuggcucuuguuauguaucccagguaaauaucccgcucagguuggaaagcuggagcggggcugcgacuuaacagaggccuugaacuuagaaaauuuccacauggugcuggugguaacuuuccacaugguagaggcaguuuugauucauccaugagcagauccuaggauacuuuugggcuucuaaacuauuuagccuuggggcacuugaggucgucaggggauaacuggcuagagucaguucuccucgaucuaugaugggggggggggguucucggggauugaauucacaccagaguugacagcagccucuccuaccugcuaagccaccucgaggggacccucauuuaugcagacacauuucccagaggacuucuggcgaaaaaaauagaccccaaaucuucaagauugauugccaauccccuugcuaguggguggauacagugggcucuugguaaacaaaagaucuagaguuugggauugugugaacaucaauaccgaguucaaggcagcgaccgaggcccggggacagagacacccuggugcagccaggaggcugaggcggacaucggccccagcuugcuuuuuacaaccucacaaaguggaccugggagugaggccagagcacaaauuaucucuugaucuccuucuucugauaauccuccccaaugcaggacacaaauuaucuccugaucuccuucgcuugauaaccuuucccuacgggguggguuuccuagaacuacugaccugacgcgcaggggagcuugcauaaccuugggcccucccugacuggauguuuggaaucugagccugcaagcuuaucgccuucacugacaaagagaaaagaaugcaaaagaaaaaaggccuccagaccuaaacgauaaacgaucggugguguccuugagcguggcggggugguggugcaagccuuuaaucccagcacucgggcaaaacccgacgccccucugagcuccagggaugacaaaaauaagaaaggaaagagagaaaaagaccccuuuacccggggcuggagagauggcucagcggguaggggcacugacuacucuuccagagguccugaguucaauucucagcaaccacauggugucucacaaccaucuguaaugggauccgaugcccaauucuguugucuaaagaccacuacagaguacucauauacauaaaugaagauaaauaaaucuuuaaaaaaaggccccuuuaccccccccccccaaacacucaaacgaagcucaguggcguugauuuuauuccuuccagaugauuggccgcagugaaacgggaggaaaggcugcuacaaaauaggagagcgguuuccaaacgcgccggaguucuccaugccggagcuaagaacccaggaaccuuuuaguggcuuucgcguuucugcacggggcagggccacucacugucucguccuuucucgguuuucugagagucucgccuauuuccccugccacuuuuuccguaagcccgguguuacaaaggggccuccaucacgcacguccucggaaacuacccagccaagcgcagcgagcguuaacuagaggcccgccggugaggcccccuuaccgcaguucucgcgcggaaagacgagaccuuuaaagaacgacgucagauagucccgcccaccuggcggucacacgaccggauccugcgucccggccgccgguccguucuuagccgcggacuggcuguggauucgucuacggggugucggaggggucauuccggaagucggcgcuggaaucuucggcuuucugggcggaagugugucacaaccucgguggucgccccuuggaggaaguucgucacgucgcaguagucucggcacggcggaugugugucgccgcuccggugacgcugggaagugcucgcagcccccgccgcugccucuugguugaagcacuauggagggagagaggaagaacaacaacaagcggugguauuuuacucgcgagcagcuggagaacagcccgucgcgucgcuuuggcguggacuccgauaaagaacucucuuaccgccagcaggcggccaaucuccuccaggacaugggacaacgucugaacguguauccuuucggccuaggccaucggccucggagugcguccggccaugcuucgacguccgggccggcgacgcugguggggacagaagcggguggggugguggcaggagcugggcgucuaaguugggagaacccacaauggcgcucgcuggccga

SEQ ID NO: 7973 - RNA, 3217 nt, Mus musculus
cagagcuuugugacaagagaguacuguccuuuccuguguuuguccuucuguggcuugucucuuguucgguuucgggacagggucuuacucuguugcagaggcugacuucccacucucaagccacucgauugggcuuccuaacugcagcaguuacaggugagcaccauugcgcccaauuuuauucuauuccuuuaauuaucuccccaccccaguuuuaauuguauauguguuuugccuacauguuugucugugugcuuugugcccacagaggccagaagggggagucaaauccccuaggacuggauuuacagcagguuaagagccuccaugugggugcugaacaccaaacucaaguccucugggagacugucagcucucucucugucugugugugugugugugugugugugugugugugugugugucugucugucugucugucucaugcuuuauuuguuuuuauuuuaugugaauugguguuuuuccugcgugugucugcgugagggcguuggagcuccugaagcuggagauacagacaguugugagccgccucaugggugcuggagauggaacccagguccucuggaagaacucugaacugcuguucucugaaccgcuaagccaucucuccagacccccucuuuuuuuuuuuuuuuauuuugauggugucuccuguggagcaggcuggccucuagcucccuguacaacugacuggugaugguuuugaccuucggauucuccugccugugucuccagagggcugggguuacaggcacgugccuccaugcuuggauuuuuuagggcugagaauugaacccagggcuucuuguguacuagguaaguguacuuuuggcugagcuacacucucagccccagcccccugccccccgccuuuuuuaguaaaauuauuauuaugugccugugugcuuugccuguguaucacguauacacuugguaccgaaaaaagucaaaagggggcgucacauccccugaaacugaaguugcagacaguugugagcugccauuugggugccaggaaucaaacccagauccucuggaagagcaaacagugcucuuaaccacugagccaucucucugcuuggcccuucuuuccuuuuccuuuaaaacaaaacaaaaccaaaccacuuuuuuuuucuucuuuuuaaaacauacacugguguguuguuugcauguauaucagugugaggguccccuugaaccggaauuacagagaguugugaguugcuacaugggugcuaggaacugaacccagguccucuggaagagcagcagccagugcuccuaaccacugaacuccagcccccuucuuucuauuuuuuuaaagagcaauuucugagacaauaaauacuacacacaaguaguaacucggagagucaggcccucccuccggucuucagacuccaaaugccauccuuccaaaauuuucugggcgaccuuucagaaccccgaugcuuaacuacccacucuccaugccaccccacccuccucccacacacagaguccuguguguagggaggcacuagggccacccucaauguccugucacucagcugcucucaugucauucaaacauccaaacuucugccuuuguaaccccagaggccuauacgaguccaaaccugcaacuuccagcagccacuugggucuuccguuccuaacccccaguccgguucaaagaugagugucagcucucuauccuaagagcagccuccucaccuggacauucucccaccuccuuucuucgcaggaagguucuguccaaaccccacccuccacccccauccaggugagucucuccccaauauccuucccaaggcgacaaagccccucacagcagugagaagccacagagugacaggcaggcagugcuaguccuggcccaggagccagcagcugugagcagcuagcacuacgcccucuucaauaauucaucuuccagcaggcugcaggcaccaugcccucauucugagccagagauggcugccacagcucuguggggucggagagcgaggcugaaaggagcggagaacuggaggaacaagccaccggaggugcccaaccuccaagcccgugugcugcacacggcccgcuaguccuugugaaaaggguuucagucugggcugauacuugggguccagacccggaaggaucucagagagccacugcgcucagcucccugccgagcauauaccaggcucagccucaugcccuggccgagccuccgcaggcuaccuuucuaaugaugcccacagcccucucucuguccccugacacgucucagcuguccccgccucaggaguccugcucuguuggagcucccauuacuuagaaguccccacagcucuucuuggcucugccgguccacccccaucucuucagccccagccucucuggcuaagagcugauguuuauagagcuuggagacuaaacuguggggguggaggaccugagcugaccccguguguggcaagaggagggauucaggaucguuaagugugaggcgcgugcagaacaguucuuugucuauaguguggagggauggcgguaaagucuaagccacaucagggacuuggccuucucagugucccauccuucgggggacagccugaauucaguuucuaugcuagcccuguuccugcuggaauccauucuuuacaacuggcguuagaggggaaacugagaugaaagacuaaagcaaacgcuuacagggcaccuagucugcacccguaccagcagaagccaagaauuucuggcuacucacucuccucuuucaagugaagagggauuccucaaauggucaaagcugucugccucggagugggcaagaaagagcugggucugaaagccauaguugacuccucgcucucucucugggggcccggcuuccggagagaagggugcuaucauucugagcacugucagcaagaaacccuucagacauauuuauagcaaaugcugcaucaggggauggagccugagagagccucaaagcaucaaauaacgcuauaggccaggaagagaguacugauugcagcaggagagacugagguuugaugucagaggaacuucccaaaguaauauuuggaguugacaaugggaauucccugaagaaguuacuuccaaagaauuuccucagaggggaaaaagcaucauguuuuggucuaauaaauacaauaaauaaauaaaauuaaauuua

SEQ ID NO: 7974 - RNA, 3217 nt, Mus musculus
uaaauuuaauuuuauuuauuuauuguauuuauuagaccaaaacaugaugcuuuuuccccucugaggaaauucuuuggaaguaacuucuucagggaauucccauugucaacuccaaauauuacuuugggaaguuccucugacaucaaaccucagucucuccugcugcaaucaguacucucuuccuggccuauagcguuauuugaugcuuugaggcucucucaggcuccauccccugaugcagcauuugcuauaaauaugucugaaggguuucuugcugacagugcucagaaugauagcacccuucucuccggaagccgggcccccagagagagagcgaggagucaacuauggcuuucagacccagcucuuucuugcccacuccgaggcagacagcuuugaccauuugaggaaucccucuucacuugaaagaggagagugaguagccagaaauucuuggcuucugcugguacgggugcagacuaggugcccuguaagcguuugcuuuagucuuucaucucaguuuccccucuaacgccaguuguaaagaauggauuccagcaggaacagggcuagcauagaaacugaauucaggcugucccccgaaggaugggacacugagaaggccaagucccugauguggcuuagacuuuaccgccaucccuccacacuauagacaaagaacuguucugcacgcgccucacacuuaacgauccugaaucccuccucuugccacacacggggucagcucagguccuccacccccacaguuuagucuccaagcucuauaaacaucagcucuuagccagagaggcuggggcugaagagauggggguggaccggcagagccaagaagagcuguggggacuucuaaguaaugggagcuccaacagagcaggacuccugaggcggggacagcugagacgugucaggggacagagagagggcugugggcaucauuagaaagguagccugcggaggcucggccagggcaugaggcugagccugguauaugcucggcagggagcugagcgcaguggcucucugagauccuuccgggucuggaccccaaguaucagcccagacugaaacccuuuucacaaggacuagcgggccgugugcagcacacgggcuuggagguugggcaccuccgguggcuuguuccuccaguucuccgcuccuuucagccucgcucuccgaccccacagagcuguggcagccaucucuggcucagaaugagggcauggugccugcagccugcuggaagaugaauuauugaagagggcguagugcuagcugcucacagcugcuggcuccugggccaggacuagcacugccugccugucacucuguggcuucucacugcugugaggggcuuugucgccuugggaaggauauuggggagagacucaccuggauggggguggagggugggguuuggacagaaccuuccugcgaagaaaggaggugggagaauguccaggugaggaggcugcucuuaggauagagagcugacacucaucuuugaaccggacuggggguuaggaacggaagacccaaguggcugcuggaaguugcagguuuggacucguauaggccucugggguuacaaaggcagaaguuuggauguuugaaugacaugagagcagcugagugacaggacauugaggguggcccuagugccucccuacacacaggacucugugugugggaggagggugggguggcauggagaguggguaguuaagcaucgggguucugaaaggucgcccagaaaauuuuggaaggauggcauuuggagucugaagaccggagggagggccugacucuccgaguuacuacuuguguguaguauuuauugucucagaaauugcucuuuaaaaaaauagaaagaagggggcuggaguucagugguuaggagcacuggcugcugcucuuccagaggaccuggguucaguuccuagcacccauguagcaacucacaacucucuguaauuccgguucaaggggacccucacacugauauacaugcaaacaacacaccaguguauguuuuaaaaagaagaaaaaaaaagugguuugguuuuguuuuguuuuaaaggaaaaggaaagaagggccaagcagagagauggcucagugguuaagagcacuguuugcucuuccagaggaucuggguuugauuccuggcacccaaauggcagcucacaacugucugcaacuucaguuucaggggaugugacgcccccuuuugacuuuuuucgguaccaaguguauacgugauacacaggcaaagcacacaggcacauaauaauaauuuuacuaaaaaaggcggggggcagggggcuggggcugagaguguagcucagccaaaaguacacuuaccuaguacacaagaagcccuggguucaauucucagcccuaaaaaauccaagcauggaggcacgugccuguaaccccagcccucuggagacacaggcaggagaauccgaaggucaaaaccaucaccagucaguuguacagggagcuagaggccagccugcuccacaggagacaccaucaaaauaaaaaaaaaaaaaaagagggggucuggagagauggcuuagcgguucagagaacagcaguucagaguucuuccagaggaccuggguuccaucuccagcacccaugaggcggcucacaacugucuguaucuccagcuucaggagcuccaacgcccucacgcagacacacgcaggaaaaacaccaauucacauaaaauaaaaacaaauaaagcaugagacagacagacagacagacacacacacacacacacacacacacacacacacacacagacagagagagagcugacagucucccagaggacuugaguuugguguucagcacccacauggaggcucuuaaccugcuguaaauccaguccuaggggauuugacucccccuucuggccucugugggcacaaagcacacagacaaacauguaggcaaaacacauauacaauuaaaacugggguggggagauaauuaaaggaauagaauaaaauugggcgcaauggugcucaccuguaacugcugcaguuaggaagcccaaucgaguggcuugagagugggaagucagccucugcaacagaguaagacccugucccgaaaccgaacaagagacaagccacagaaggacaaacacaggaaaggacaguacucucuugucacaaagcucug

SEQ ID NO: 7975 - RNA, 14043 nt, Mus musculus
ccucagucggaggcaggcaggcagggaacccgcgcuagugugcuagugcggacacuugaggcgcgaccuccuccucccugaacccgaguccacgucccuccgaggcugcagccaugaaggagagacgggcaccgcagccagugguggucagguguaagcucguccuggugggagacgugcagugugggaagacggcgauguuacaggugcuagcgaaagacugcuaucccgaggugagcuucccugccgucccggggucgaucccccaccuguccgggacagcgcucuccaccacccgcaggccgccccacccugccuugccuucuggcuggaggacugcccugucuugcuucccuagagaccugacccacuucugccgcccggucggcuccuccucaccucuuuacccaucauauccccucccacuugccuucaucccugagaccuggaggcucccgagagcuugggcuucauucuugacgcaguaccugccugccccuccuauaaggcucugugagggugcccuccccaacccccccccccccccccgcgcaggcuucugcuguuuugccuguucaccugugccaaaggacuagagggcagaagacagagguuaaaacuggcuuguggcucugaaaaaugggacacacauuuagagaugugaggaaaaugcgaauguaugugucucagacuagcuaggauguaggggguuugucccaggcuggggagcgaaggccaauaccucuacaguccccaauggcucccccuccucuggcuucucgccaucugacacuuugguguuucucggcgcauguguagccaacgcuuggugugggguucugagggcaugcugcugccggggugugaguguuuccugucuccucgcagaccuaugugccuaccguguuugagaauuacacagccuguuuggagacagaggaacagagaguggagcuuagucucugggacaccucagguaagaguguacccccaaaugccccauccuaccaccauuggcuagccgcaguugcugcuuuuuuaagggggggggggcugggaauccaccuuugaagauaggugcuugccaggaaagcgaaggaaagaauguaaaaaauucuuugguuggggcuuugaugauuuuagaggauccuggaaggcagugaacaagccugggugccacuugggucucuggucuaguucaccucuggauggugaggugaagggagcccugagaacuccccgggaguaccagacgucuccucugucucugucucucuccucucccuuccucucccuccucucucccucucucucuaguucuccagagcaaaguuaaaugagguaggagggugcugcuggaggcagcuguggcggggcagagagccacccucccgccccgccggcuuuggagggaauaucacucuccugcaucucaagccgaagcugucugcuugccgcaacucagaggcugcggcuuagagacgaugaugaagcgaugcaucaucgaugcuuuuuuuuggggggggggcaguaaauguagggcauguccacacuggguuaguguccaguugagcacaugggggucuaguucuuaucauuucucccugggcuggggugaguuggagaugcccugucuaucuuuuggaaauguagaaagcaaugcuuucccuacucuccgcucccaagcccuuuagagcucagcuuugcuucugagcccuucccacuuucucuaccccagccccucuuuuuaaccgucugucucagacauccuuaaagaguaagugccagccaugugagaaagaaaagaaaaauccaugcuuugccaaaaaggauauuuucuacgugcucagcccgaguuucuggggaagcuggagagcaccaagguucuccugcaugugugguagaugugccacccagcuucugugaaggauccugugcugcuucuccaacuguaaggucugggaagaccggggauaaggaaugggaaaacagaaaacgauagauauuucuuucgcucuccccacaaccaaaauuccucaggcggguccacggucccccguugcaguuccaggaaaggggaggcaggguuucugguuauccuggacugugcugugcuggcuggaucggaccagaaugcagcguggcugcgugauguauggguuuucuccugcuguauccucccaccuuccaauccucccugaaccuugcugcggcucaucucuccucauuaccacccucgaugcccccacccccacccccacaguccuucacucccaacccagauaaaggaaaaccagccaggauggucuuuuuacccuaggucacaccccacccccucauuucaaaaggcuggaaggcaaucaguuagccuuguuuuaaacuaggucccuguaaggacagaggaaaugacuguguaggguggagagccucacuaccuuuggucugggguugaaccuguuucuguuauucacuugcuggccuuaggggagggggauugcuuggagccaaaauggagacccgcuccucucccccucccccaguaccgcagcacuccccugccucagugcugcuguagaucagcccccaccucaccucaguaagagauggggguggcuugcugaaggagcaggcagcuauccaacucccccuuacuucuucuuuuuuaugaccgacacccccaccucagcuuggauucccccccaguuuccauggugauugcaguacagggagaggggcugcuugcuauucuaagcacggauugucuggauuccaaaucugcuacuguuccuuacccaggguggagggggccaggcucagcuccuagcauucaccccauuagacccugggucugaauugccuucuuccccucugccaaggauccuugcucuggccucuaacuccgcagcuauugguguuucugcucuuugagaucaccucccugaggucugaggggugggggccaccauauucccuuugcucuuuuccguguaagcugacuuggguggguaaggaauagaacacuaaauucuggaugcccccccuccccgaaguucugaccccugagguaaagaaucagggcagccaguuauguaacaggcagggcuauuucuucacugggagacccuagagcaggagaaugaagcagagguugggcagcaggcaggcucuggugaagggaaccugagucaaauccuugucuuuccauagguacuggcagcaucuucugggaugcucugguaugaauacaucuuaaacccacuguaggaaacccagacacggucagagugacuccacccucugcucaccccgcuuuuaggaccaagggaaaugguuccuggcagauggucaugucccaagcuucuaugaaauagcucagugcccugauacagagcuggccaugaagggaucaaagauuacaauccccagggaucccugccugggcuuaggccuccagagcagaggagguaacucucagccucacucucagcucuucuccccuuacaacagguucuccuuacuaugacaauguucguccacucugcuacagcgacucagaugcgguauugcugugcuuugacaucagccguccagagaccauggacagugcacucaagaaggugaggcugagccggaggugguggugucugcuaaugagcuuagcuuagcuccuggggguggggaggggugucgaagcaggagggucgcaaguucaaguucacccugggcuguggagccaguccgagaucagagaauuuagugagacccugucuccaaauaaaaaaucagcugggcggugguggugcacaccuuuaaucccagcacuugggaggcagaggcaggcagauuucugaguucgaggccagccuggucuacagagugaguuccaggacagccagggcuacacagagaaacccugucucaaaaaaaaaaaaaaaaaaaaaaaaagaaagaaaaaagaaaaaaaucaaacggagccccggaugacuugcaguuagggagugcuuccuuagcauaagcaaggccuuggguucagcacccaggauugcggguggaguggaggagaggauaaauguauacuuucuaccuagaagaacaagaaggggccuugucccauaauccuccugucccucagccaggaaagacuuguuuugcuugacgccuuaccauuagcuguguggcucuggguugaaccuggguuuccuuccccuuagccuucugccuuucuccuauccuacuaugcuaaaggccagucugugggcgauacugaaggcccagagaaccuucuagugugugcguuuguggaagcacacacacuggaggcaucuucugggacugugaccucaggcccacugagucaggcaggucagagcucaguuagcuggaggaagugcugguuccgaguggcaggaucugcccacacugagacguugcgggaaacgcugugggacuugccuagcuucuuaaggaagagauugucucauucccagcuacagguauucagggcuuguuugccuucugacugggaaagaagacagauccauguccuuucuguguggcagggagagggagacuugcccuguguuccuguuggccacugugcuguugaagggacaggauccuggguuagcacacuggugccaccaaaggccucaugggcaggaagaugauguaauuagugcagcagagaugcugugacucagagggaaggcagggagggaccugauaaucugagcaaugcgcuggccggugccagcuggacuccuggucucugucaggcacugacuuucuuuccucucccccuucgcucccacccucaguggagaacagaaauccuagacuacugucccagcacacguguuuugcuuauuggcugcaagacagaucuucgaacagaccugagcacucuaauggaacugucccaccagaagcaggcacccaucuccuacgagcaggugugugugcaugugugugugugugugugugugugugugugugugugugugugaggggcacgggcaugugugcacaggugggauagaaaaggcuauggcaagauaaaauuaguauuagggggcuaucuauaaauagcaaagugucaccuggguugggguggcaggaacuuguuuacauagaguccugccauagguuaguuagccugcgagccucucccaugugugugccagcauuuuuaagguuuuuuuuuuuuuuaagccauauguaucauacucauuaaagaugcuuguuagaucuggguguaguuuguaauaguuuguaaucccagaacucaggaggcgguggcagaaggauuccaaguuuguggccagccuggcucggucucaaaaaaccaaaacaaaaaacaaaaaaaacaaaaaaaaaaaacaaaaacaaaaacaaaaaacccauaaaaacaaaaaacaaaacuaaauuaaaaugaacaaacagaaagaaguaacuguuaggauuuugaguuccuaguucccugccuguaaaauaacucugggaggaaagacacggaaaucuguauuucuacgacaagaccagaggauacuuuuuaauuacuuguuuaauugugugagugguacaugccgcgugcauguguggucucucaagaguugguucucuccuucugccgcauggguuucugggauugaacucagguugucaagcuugcugggaaaucuuugcuucccucugcugagaugucucaccagcccccggaauaauuuuaaugcacacaggaguauaagaaugcuuguuaauauuucuuauuagaacccccugggggcucuuuuuuuuuuaaaagauuuauuuauugcuauauguaaguucacuguagcugucuucagacacaccagaagagggcaugagaucucauuacagaugguugugagccaccaugugguugcugggauuugaacucaggaccuuuggaagagcaaucaguucucuuaaccgcugagccaucucuccaacccggggguggggguugggggggggacucuuaaacauccugacaugaggggcugguggaauggcuaaaggggagggaaggcacuugccacuaaguugaugaccugagucugaucccugagacccaguggugggaggagcgaacuggcuuccccaaacuguccguagaugaucugcccguggaugcuguggcgugagccacacagacauacagacacucacgugaaagaaauauguuuugguuugguuugguuuuuuuuuuuuuuuuuuuuuuuuuucgagacaggguuucucuguguagcccuggcuauccuggaacucacucuguagaccaggcuggccucgaacucagaaauucgccugccucugccucccaagugcugggauuaaaggcgugcgccaccauugcccggcaucaguacgcuuuuuaaaacguuguaggugauucuaggcugcaguuaguuuucaccuuugugaaugcuggcaggggcugggggaagaccaauaguggggucguggggggacgcauggaacccugauguuuugcucgaacagacacuugagaggacauguaugauauuuggaaagaaugccacacuguuccuuagucaucuuaaggcauugcguucaugaccacaccccucccacagggcugugcgauagccaagcaguugggcgcagaaaucuaccuggagggcucggcuuucacuuccgagacaagcauccacagcauuuuccggacagcauccauggugugucugaacaagucuagcccagugcccccgaagagccccguccgaagccuuuccaagcgacuccuccaccuccccagucgcucugaacucaucucaacuacauucaagaaggaaaaggccaaaagcuguuccaucaugugaagucagagcuggaggcgggggagacagccccccacuuccucccuuggggugcagaggcacggggagagggaggaugagacggcuuaagacaccggaugugacauuuuucagauggccacagaggacuuuagaaggagacaggaauggaacugaagaagaugccaggcuuggcaggagggccugacauuaagcagaaaccaucacaccccaagccuggcacuaggcuguggagggggucguugccccagugucccccuacuccagaggaaggauggguacuggggagauggggacaugcuggccucaccuucgacaucacgccuuuuccauacagcguuuccaggcaggcuuggggugggcgggguccuugaucccuucucuucuccuuaaagaaguggcaauggacuggagaccgugaaaggcuggagacagcucccuucggggcuuaacccagacgcuccaucacugaaaccaggagggcgagggcugaccuaagagggaacccucauuuuugccuaacccaugcaucauggagaggugauauuauacauucacaugcuucuuacugaaguccccagggcccaagggagaagccccagacccccuucucuugcagaaugugggggugguggugcugugggggcaggacugaugggaggggucaccagacuuuccugccccuggggcgguacaguuggcauuuguuuuauagacucuugucuuuggaacuggggguggggugggggaguguuucaaucuguucuauguuccguguuuaaagaagaaaaccuauuuauuaaugaaauauaacauaugaagaaauuggugggguuuuguuguuguuguucuuugguuuuuauggcgaucagggaaaagcugaaaagcugucuuuuuuuuuuuuguuuuguuuuguuuuguuuuguuuuguuuuuuuugagacaggguuucucuguauagcccuggcuguccuagaacucacucuguagaccaggcuggccucuaacucagaaaucugccugccucugcuuccuaagugcugggauuaaaggcauggaccaccacaccccggcggaaaagcugucuuggaucccuuucuaggaguuacaguggcugucuccaggguccccuagcaucuuguucuacuucucugaaucccaccugcauccugcuaagccaagaaagagguccuuggcccuggaguagggcuuccuucucgucaggcugcugauacuguggaagugagaauggugguuuauaaggggcuguccuauguaggguaugaugcccugacaucccgguucuagauaagaguagcauguuucaauugucacagccaaaaaugucucuagauauugcugaguguccucuggauaaaaucacuuccugcugaggacuaggagcagcgcucucaaccuucccgacgccuccacccuuuaaugcaguuccucaugcugagcugacccccaaccaucaaguuauuuuugcugccacuucauaacuuuaauugugcaacuguugugaaucguaauguaaauaccuguuaggcaaacccagaggggucgagacccacagguugaaaaccacuacccggggcuggugagauggcucaguggggggcuggugagauggcucagugguuaagagcaccgacugcucuuccaaagauccugaguucaaaucccagcaaccacaugguggcucauaaccaucugaaauaaaaucugauacucucuucuggagugucugaagacagcuacaguguacuuacauauaauaaauaaauaaauaaauaaauaaauauuuaaaaaaaaaaaaaaaaaaaaaaagaaaaccacuacccuacagagacugaagagagaaagcucgccucaaauagagggucaagcugcuggguaggcgccgcacagacuaguucaaagccuagggguggcuccugggauucccauuuccugaguucagggagaggugacuuuugcugaugguuuuccaauuccaguauccauugaugguagcucaguuuuaacaucucuuccuuagcgacucgcaccucuuguucucaaagguucauagaaguaauagaagguuauuaugggggcugggcagaugguccagaguuuaagagcacuucaaguucuguucccagcauccacacaguggcugacaucuguaacugcagcuccagagaacuuuaugccuuuuucuggccuucauggucaccacaggcaugugggcgcccaugcagacaaaacacccauauauguaaaauuuuaaaaaaaaaucuuaaaaaguuacuacgacuaaguaugauggugugccuuaguuaggauuuuacugcugugaacagacaccaugaccaaagcaagucuuauaaaagacagcauugaacuggggcuggcuuacagguucagagguucaguccauuaucaucaaggcaggaauauggccgcauccaagagaagcugagaguucuacaucuucaucugaaggcugcuggcagaauucugacuucuaggcagcuagggugagggucuuaagcccacgcccacagugacacaccuacuccaaggccacaccuccaaauagugccacucacugggccaagcauauacaaauuaucacauaccuuaugccuggaagcccagcacuuaggagacggaggcaggagccagucuacccuaugauguagcaagaucuugucuccaaaagauaacuuaucaugcaucucuguccuuuaaaaggaucuugcuuuuuuuuuaagaucacuguagcugccuucagaagcaccagaagagggcaucagauuuuguuacggaugguugugagccaccaugugguugcugggauuugaacucaggaccuuuggaagaacaguccguguucuuaaccgcugagccauuucuccaguccccucauuuuauuuuuaauaguguguguaugugcgugcgcgcgcgugugcacaugugugcgcacaugcauguguucaugugaacgcaggcgcccucggggaccggaggcauaagaacuccuggagcuggaguuaacagguuauugugagcuaccuuacuaggugggcacucggaguuggacucagguccucugcaagaacagcaggugcuuucaauugcugaacuacuucuucagcccuguuugaugcaucugcuuuaaauaagcaaacuuaaccucaaaaagaaaacuaguuaauauuuguuuuaguguugccgugugucagagcacuuuauauuaucugugauaaccuuuugagcgauugccuauuucgcuauacaggcaaagaggucuugagagauuauugugcccaagccaugcagccaaauguagaacucuagaacauuuuuggagacagggucuuacuauauauaagcgcaggugaccuagaagucacaaaaaccugccuacuucugccuccugagggcugguaucaaagaugugcacaccacuaugcccagcugcugcagcccaggguggcuucaaguugcaacauaccagaggaauuucuugagccgcucuuccugucucuaccugcuaagugcugggacuccagggcugugccaccaugccuggguaccaagccuagcuuugaaaugcacacuuaaaauuuguuuucuuuucucuuuugucuuuucuccuccuccuuguccaucuugcuuucaaucucgcucucugagcucucucucucugagggagcucccuguugaguuguuacccaggauggacucccacucugggcucaaugguccucucaggccagccuucugaggaguuggcacuugacacuauauuugacaacauaauaugcuuuuuucuuguuuguuuguuguuuauuuuguggagaggguaggaguugagacugggucuuguuuugguuuugguuuguuuucuugguuuuuggagacaagguuucuuuguguaccucccccuggcugcccugguucacucuguagaccagauuggccuugaagucacagagaucugccugccucugcacccgcuccauugcugggauuaaagguaugcacaaccaccaccugggucuuaugcagcuuauauuggucuugaacucacuauguagcaaaggguaacauugaaccaauggcugauauuucuaacaucacaagugcugguaguacaggcaugcaucaagaauauaacuuuuaagugccuuucuagcucauccuguaaggcaaggaguauuauuuuuguuuuauaaaugaugcaaaaaauacuauauacuauauaauaugcauguuauaugguauauguauuaugcgaucacauauaauauaaaauucauauaguauauaauauguuauauaauaauguuauauaauaugcuaacacauauaugcauauacuauauuauauauaguauauaauaugcagaauaucauacugcuagugacugagucaggauucaaaccuagccucacuguuaacuauauuacacgaacccuuuauuuuuagccauguugcuaaauaggaaacuggccuugauccuuacuaaauauaaucuugagggcuagagaguggcucagugguuaaagugcuugccuugcacacaugaguuucugaguucaaaucccugaacccacauaaagcugccuugcuacauguccauaaucgcagcaccuucacagugugauggaagguggaaacaagaugacagacagccaaggacugagacuguggguuaucaugugaucuccauguguguggcaagccugugccuauacacaugaacgcacaauacacauaacacccaacacaaacacagcaacaauagucacaagaauaauuuguaagagagcuagaaaagcaaaaucaaucuugcagauugguaucuuucuuagcuguguccugagaaguacaaaguacuaggagagugccacugugaacucagacaaagcacuaggagagggccacugugaacucagacaaagcacuaggagagggccacugugaacucagacaaagcacuaggagagggccacugugaacucagacaaagcacuaggagagggccacugugaacucagacaaagcacuaggagagggccacugugaacucagacaagccuuuucaacuuucugagucucaauuuacucuuuaaaaaaaaaaaaagauuuauuuauuuauuaaguguaaguacacuguagcugucuucagacacaccagaagagggcgucagaucucauuacagaugguugugagccaccauguggaugcugggacuugaacucaggaccuucagaagagcagucagugcucauaacugcugagccaucuccccggccccucaauuuacucuuuuaaaaaaguguucauuuaggacuuggagagauggcuccguaguuaugagcacuggcugcucuuccagagggucuggguuugauucccagcacccacauggcagcacacaacucucugugacuccaguuacaggggaccugacacccucuucuggcuuccuuauguccgaaacuccauaugguucacauauauacauacagacaaaaaaaaaaaaggaaaaaaaacaacaaaucauacacauacaaccaaaauaaauaaaucuaaauaaucaauaauuguguauguguauacagaauaguauuuugaaauaaggaaagguaaggucucagagaucaagugaaccccugggcuucagauccccuucuguucuucaacuuuguggacuuggaauggagauguagugagcuauacuuuccuuaucacuaaggucaugcgcaguucauaguuuuaugaugacuaacacaagaagccuuagccuaagugucaagccuggagccagacacuuggaagacugucaaacaauaacggaagguuuuaaaaguuccaaccaauccuuggucagucaaguuuuugguuugugugugaauuuuuuucuucuuuuuuuaaaauuuucuuucugccgggcgugguggcgcacgccuuugaucccagcacuagggaggcagaagcaggcagauuucugaguucgaggccagccuggucuacaaagugaguucuaguacagccagggauauacagagaaacccugucucgaaaaaccacaaaaaaaaaaaaaaauucuuucuuuccuuuuuauuuuuuauuuucuuuaaaaggggggguggugguguuaggguuuaauucugagaguggagagcccucuaguguucauuauacccaguagauucagacugaccaaguccucccugcacuagaauuugcaauaucagaggcuacaagagcucuccaaaagucuccuuauaggacauugagccacugucagcguagcugaguuuuuuaguuaggguguauucugagacccuguuugagaacugaaaaaauacccagagugaaaaaccagaccuggggcuagagagauagaugacuccguggauaagagcacugguuuuucuuccagaggacccagguucauauucccggcauccauagggcaguucacaacugucuauaacuucagcuccaggggaucugacacccucacacagacaugcauguagguaaaacaccaaugcagauaaaaauagaauaaauuuaaaguagaaagaccaacaacuaugugggauuaaagcaaacccgaggauggaaaauguaaaaggaggcaguggguacccugguuaaucucaaccauccuaccucgcacaauguuguauucuguuucagcgggugcugacgguacuguuugaacccaagagaaaggaagugggucuacgacuagaagaaaaauucgguggacugauguauggagaaccugaaggaagacaucaacaauaacaaguagcccaagugggcaguuccugaagaccagggaaacgaggaagcaaggucccaugaggaauguugaauaaauaguaagauacuugagggggaaguccuuccagggaaaccucugaaauguuaguuuauuauuuauugggaguagggggacaguggguacccugggguuguucaggcauucauccugccggggccccaagguuacuccugugacuggaguaguucuacugugaaaacuguacuaccuucauugugaaguacuaagcuacuccagugaacuaaucuuuaguucauuaucuuccauucauccacggaggcaauaaucucucucacaauuuuuauaaaaaacacuuuuca

SEQ ID NO: 7976 - RNA, 3835 nt, Mus musculus
uagcgccuugaaaacccgcccauaccagucuggccuggagugagggaacccguccuggucgcgugcacccgaacagccugcccugguauccuggugcucugacccgguccaaucaugacccugagcccuuugcuccuaccacuccagcuguuacugcugcuacuguucaguggggcggugugccgggcugaggcugggccagaaaccgaaaguccuguccggacccuccaaguggagacccuggugaggagacuguggugccacuccccuccccccaccccaugucccgccguuccccuuuacggccagggaucgcggggaagccugggacucuaaaugguccugugagagugaagaggaaagaagcgaaggaacugaguugggggaaaaggugcugggucuccagaggagcuuaggaggagcagccuugacccuuguagucugaucguaggugcagcccccugaaucgugcacggaaucugcugccauuggagacacgcuccacauacacuacacggugaggggcuuggggguccggggcguggccugggaggggcggcgcccggcugaaacacgucagcuuuggcuuggacacguggcaagcuauccuagagaacuugaguccuaggaucagcccgcacgugggggcguccucucgccugcuucucuuucuuccuuguuuucugccgauuccucuccagcgcugagaaaagaaggauagagagagcuccaagaagcgccagccccguggggcuuccuguuccuucuugcccaugguggugguggguggaaggagauggggacaggacacaaguuuguuaaagggguugcuuccuuccggguggucccaaauugugggaagaaugguggguuuagacccaccauuuuuuuuugucuucagggcaguuugguagauggacgcauuauugacacuucucugaccagagauccucuggucauagaacucggccaaaagcaggugauuccagguaugugccccgugccucugaccucucccuagccuaagcccuugcuugcuugccggcuguauugcucuggaacagccgcuagaaugaaaaggaucccaaggcucucccgcuaccucagacuccacuucuaacacucuucuugccccacacaucacugcggcagagagucugagaaguggagcuaagcucauuugaugacggggagccuuugauuuuccucuuggguacuguggggaagauauguagcuucuaguucaguuuugccuucuuccucaaggucuggagcagagccuuuuggacauguguguggggugaguaucugaaggccggggccugacugcuccuuuuuccggguagaagguuucucugucaucccuucuccaguggcaggacguuguagaguaaagggccccugacuucauacuggagaggugcagguuaaugggaaccccccccccagggcaucucuccagcugucaguuuuguugggggaggcugagugcuguggggagauuggugacuuugcugauccaccugucagguggagaauuucauauuuuggugucgcuaucugaggagggggguaaggcacuucagaugggcugaggcugccagcucaccccccuccugccugcaaucccuguuccuucccucagagagaagcgaagagcagucauuccuucucaccuggcuuauggaaagcgaggguacccgccaucuaucccagguaaccuaaccaggccuuucuccugccugucacacacagucccaagaaccucugcucugucucgagcuugaaaaaguccagaucaaaucucaggaaagaauugagcuggggcuccuccuucaaggccacuuuuucuccaggagaggcuauaaagcaccugugaaggccaccugaccuggcuguagacagcuggugacuuuuuggcaccggcuugagccacguggguccugcugccuacacuacuuaucccagagcaccaaaguauagcuggcuacuugaccuugacuccuagaauucaccuucacacgagauucuuacaccaguguugccuguagggggcccuggaagagaguagggaggaccaagcaaagucuuucuguuuuuuuuuuuaauuuauuuauuauuauacauauauauuaugaauauaaguacacuguagcugucuucagaagcaccagaagaggguaucagaucucauuaugggugguugugagccaccaugugguugcuggcauuugaacucaggaccuuuagaagaacagucagugcucuuaccugcugagccaucucgccagccccacaaagucucucuuaacaaguugggagugaggccgggcaguggugguggcgcaugccuuuaaucccagcacuugggaggcagaggcagguggauuucugaguucgaggccagccuggucuacagagugaguuccaggacagccaggacuauauagagaaacccugucucaaaaaacaaaaaacaaaaacaaacaaacaaaaaaaccaaaaaaaccuccaaaacaaaacuaagucaggagugguggugcaccugggaggcagaggcugguccaucucugugaguucaaggccagccuggucuacauagugagucucaggacagccagggccacugacucgagagacccugugucaagaguaaaacagaacagaacucucagaaaaauccugcccuucccacuggaaccucccugccuuggccucccgcuccucugcucccucacgaguaucuuuccuccucuccaaagcccuuauucgaaaaucugccaagaaccaaguugcaugugcucaugguuggugggauuuuuaaggaugucugcuuuuuauucuaguucauuuuagcccuaaauuccauccaccuggcuguuuggagccggggucuauuugguguagaagauucauauacauacagaugcucacuuguggggugagacagauggcugagcaguuaagauaguggcuguuuuugaagacccagguucaauucccagcagccacagggcugcucaccgucacuuuuaacuccagcuccaggaggauccagcauccucuccuuaccaaggauaccaggcuugaguguuggcacagacauacaauaggcaaaacggccauauucaugaaguaaaaaugaacaaaucuuuagagagauuuuuaaaaaaagaaugcuuacuuauaaauauuuguaaauguggggaagccugcauguuuccccguccacacauuccuugugcugucaaagaucugucacugguuccaagccauaugcuuagcuggaguuaaggucaacaugagaauccuuagcccgcuccuuccugcccucugcugccuuuuuugggagggaacccaaccccacauuucacacugccagcaucacgguugucuucuguggcccaugcuccuuguuucaaucccaagucagagcucuggauaaaucagagccauccuaaggcgcaccccgcccugccccgccccgcccccucuccagccgaugcaggggugcauauccuaacucucccgccccgcccccucuccagccgaugcaggggugcauauccuaacucucccgccccgcccccucuccagccgaugcaguggugcaguacgauguggagcugaucgcuuugauucgagccaacuacuggcagaagcugcuaaagagcauuuugccucugguaggcaucgccauggugccggcgcuccuggggcugaucggguaucaccuguacagaaaggccagcagacccaaagucuccaaaaagaagcuaaaagaggagaaacgaaacaagaguaagaagaaauaaauagugguuuuuaacaagac

SEQ ID NO: 7977 - RNA, 26838 nt, Mus musculus
acuucucgcgcgaucguggaggugggaaguagcccgggcuggggguggguguucgccgcacagcuccugucgccgucgcggcuuccggugcuagguggagggcgggcaggagggagccggggagcgggccagcggaccaucuucaccgcggucgggucggcuugcggagcgggaggcagcggccggagagccgggcggaaccugcgggggcggaggcggcgguggcagccgcggcgcagggagcaggaacagguucggagcuggggagggaaggcggguccgggcagggaagaggcuggguccgggugggagcccgaggcccccggccgcgguccggcucgcaccgucugggcgaggugcugguguggggggugauccucgcugagcuuggggaccccagccccacuccuguccccgcagccgaaggacgccgagcuggggugggggcggggggcgcacacggauuuguccuccgccucccccgagggugcgaccugggcugcagaggugagcuugggaggguuggggacgagggggaggcaggcugaccugugggagggggacgcgggggcgguguggcuguuuggcucucuuuuccuuggguuuaaagggcugcgaggaacgcugccuuuucucucucccucccccgcccgagcugugggggaaccaaagaaaagccgugccgugccgugguuauucuccucccucacccagcgcgaggcguggggggccggggcuuaguaucagggccuacugguggggcucggcuggcugcgcacgguccucacggagguggcgcucugcucugggguguugggaagagggcagcagguggggagaggguggagaggaggcuggagacgggggagggggaccugagcuagcucggaggagagagguggggccuuccucccccaggcggagcgggggcggugucaccgaaggagggagcagcuugucacuggcccugaguuugugucuuccaauccgcuuucuuucucuaggaaguaccaggauucccggaacagaaaaugaagccuuugcuuagcaugccaguccuuuuugaaggaaggagggggagguggggaggugaaguucccuguuaaaaccucaggguccuuuaguuaagucguaacucuuuggagagacuuguuuuuuuuuuugggggggggggagagggucucugggccaggaagaauguaguggaggguuauguauguggucaggacuaagaagaaaauagugaggucauuagggagacggguaauguaaaacccgucucugccacuguugcauugggucacccuuggguccauggcaugaaaguuuuauugggaggagaucugcugcaggagucugauugcuugagucauugcaacaggauagaaucuagucucugcauaccuccaucugugaccccaggcagggggauagggaacugucuuugcugccauuuugucuuagaccuguuuggggauaguauccccacugugugcugcaguggccauuggguuggccuuuggcauguuggaccugcgcuugaguacauuguuaaaggccguuuuaagaaaggcccauccacuuacauucagcuuuucacacaaggagucacugaccuuggaggcagcuggaaagggcucccaggugucacacagucacuccugcacaguuuuccuucuuucucuccuuccuuucccccucccuuacuccuuuguuuguuugagaugcagugcccuugcucgccucaaccuaccagcugccugccgcugucucuggagugcugagguugaccugggaaccgaggcagacccuuacuuccuuuuuugagacaggcuggauuugaaucuugcuuuuguaagaacacgggauagcaaugcauagaacugcgcaagguuucuagcuacugcuuaaggaagagguagugcagcgaggggaaggaguucucuacugaugagaaggagaaacuucuuuaaagccaggguuguuaaaguugaggcuguggcugacagaaacugggaucugcuuccucacauagcuuuggaaguagauaccaagaggccugugagucagagcacaccagugcuuuggcuaacggugugcuuagaggcgggaugccgcagugauugaagcuggguuguagagacagacaagauggggccaggcucaccuccugccugugcugucccgagcugucccaugcuguccuguuguauacauuugauaacuuacuuguucgcacuuagguuucauuuuuccuuuugcauaaggagagucaugguagcagcuaccuaguaggcugucgugagaguuaaaugagauaagugaaaaguccugagaacugcauagggcacacagcacaugcugacugcccaccgucauguaguguggcaccaacacucaggcagggcugcuguaaaagagagcuaguuaguagaagagcagggugggccuaugugaagggacaguuguuacagugacuuuacucagugccucgugagugguaacguuuuauucuugucuguaucagcucauagccguagcacguaaugcuucagggagaggugaagcuggagcagggcaggggccgagaacaucuuggaugcaagggcguguggugauccagaguaguguugguuagaaaggccacuggagggcuggcuggcugguucaguggaggaaagcuccugccagcaagcuugaagaccugagucugauuccguacuccugccccagguccacaagguagaaggagaggacagauucuuucaucgucagucucuggcuuccaaacaaaaacgaugugaaaagagaagaaaaagagauucuuuuaagaaaagucauuccauaaccgcgugugacaaguaagacagcaugugauccuaguacuugaaagguggaggccagcagaugccaggagagaccuuguuugaauaacgaaccgucuccccucccaauuggcacagugcuagacucgguuggcucuuguucagaggacuggaguugaguucccagcuccugcuucccgagccacaacaccugcagcucagcuccaggagacccaaccaaaccugcaugcacacacguauaguuuaauuaaaaaaaaaaaaagaaaagaaaaaggaugaagcugaagagauggcucaucaguuaagagcauuuguucuuacagaaggcuccaaguuugcuuugucagcauccaccugugggcuccaaaccaucuuuaguuccagggacccggugucuccuggcuuacugggcaccaggcaggugcaggguacacugacaugaagacaaagcauggaugugcugaaauaaauaaauaaaucuuauaagaagauggugggcuggggcuuaguuggcagagugcuuccuugauaaguacaacccugguguuccauaucuaguagguauggugccgcuacucaugggagaucagagguggggggaucagaaguuaaagauuugagccaggcgugguggcgcacaccuuuaaucccagcacucgggaggcagaggcagguggauuucugaguucgaggccagccuggucuacagagugaguuccaggacagccagggcuacacagagaaacccugucucaaaaaaacaaacaaacaagcaaacaaaaaguuaaagauuggggcuggagagaugguucaguaguuaacaguauagacuguucuucuagaggaccuggacuugaugcccaacauucacauggccucugcacucacccggcacaaagcgggagcacgggcaucucuguaagcaaagcaccagaagccauaaaugcauaauucuuaaaaaaaaaaaagaagucauuuucagcuacacacugaguuugaggccagccugggauaaaugagaccccauguaacaaaacagaaaucucaagagugaaggugacuuggagguggugacuggacauccugauagaauuuagagguucuguuugcugggaacucagggucaccguugacuaacuuuucaguucuguccuuugaaaauguuaagcucugucugucucacacauacgugucaagguccagagauugugcuauccuuaauuuccugucaagccuucuccauggugagaucuguggugauuagguggagagcuaacgaaacucuucuauaauaaaaggaaucugagaacguuaggaaagaguucccagaaaagugagggcuucguggacauggugaccccguuagucccagcacucaggagguagaggccgaucugcggcagcgcucugagcuuaagaccaggcugacuugcacagcgaguuccuagcuuuauuuuacuuaugugcuuuuaaaucaguuuuauucuacgugcauugguguuuugccugcauguaugugagugaaggcgccagauccccuggaacuggaguuacagacaguggugagcugccaugugggugcugggaauugaauugagguccucugaaagagcagccagugcucugaacagcugagcaguuucuuggcacugagacccuauccuuaaaaaccaaccaaacaaacaaacaaaaugaagccuucaggggcagugaagcuuugggcuuaacacagugguucucaaccugugggccaccuaaaucaggaaauaucagauauuuacaacuucuaacaguugcaaaauuucaguuacgcaguagcaacgagauaauuuuauggcugggggucagcacaacaugcagaacuguguuaaagggucacaguguuaggaggguugcgaaccacuggcuuggcuuagguaagggcacuugaagccuagccugaagaccugaguuugaguccuggaacccaggaaagaacuggugcucaaaguuguucuuuaaccuccgugugggacauggcgcacaccugccuccauauaccacauauacacgagauugaaguguaaguaaacuagagagaugguccaguagcugguccuauagcacccauauuggacauuuucugucucuugacuugaggucuaggugacccaaggcacagucucuuguggcgucuaucugcacucauguguacacuccccacucuccaggaguguacccaccuuuaauuccagugcuagagagucagaggcaggcagagaucucugaguucaagaccagccuggucuacagaauuuguuccaggccagccagagcuauauaaugagaccccaucuauggauggauggauggauggauggauggauggauggauggauggucagucuuuuaguauuucuaacuuuccugugucucgguguuuggcugcacaugugccuguguaccacacauguaggacuagaggagcucagaagagcugucagauccccuggaacagaaguuacagauuauuuaaagcugcgucagagcugagaacugauccuguuuccucuggaagagcagccugugcucagucacagagccgucuccagccccuccagcccucccucccaccucugccuccugagugcuggaauuaaaggccugcaccaccacugccagcugcaaacauuugugugcuuuucuuuuuucuucuuuuuuuuuuuuuuuuuaagugaaggguucauauucuaguuugggaaaauauuguccaaggugugaccuuuucuuacagauuuuuuuuuuuuuuuuuuuuuuugguuuuucgagacaggguuucucuguguagcccuggcuguccuggaacucauuuuguagaccaggcuggccucgaacucagaaauccgccugccucugccucccgagugcugggauuaaaggccugcgccaccacugcccggcucuuaacagauuucuagaaaggaucuguuagaaagaaauggcuuaagacuugaagucuaucccccaaaaugugacaggucucucggugccuuuuugcucucccauugcugauagagcccaucauacauacccuuaugugugagcaucaauuauaaauguuuacauuuaaaaugaauuaggaugcaagaggauauuugcuuucuguugaaaaaaaaaugugugugagauagggucuuguguagccuaggcuagccucaaauuagccaugcaguugacgaagucuuugaccuaaugauccuucuaccucuaccucuguggugcugggauugcagguagauguaacuaccccgcuuuaucagugcuggggacugagccuuggccugugcaugccaaccaagcucuccccugaccaagcuacauucccaggccuguuucucuuugaauaaaacguuuagacuucaccuuagguagaaccguaaacuauaguacauaaaacauuuuagugaggaagugggcuguuaugguacuggggacuggggcgagugggggaacauaaugaaaaccuuugcauuuguggucucuucuucccagacugcuugcuuguuugcugcugcugcugcugcuuuccucuuucuucuucaaguauaauucgaccuuuucuugguuauuuaaaaaagacuugccagguggugguggccuguuuuaaucccagcacucaggaggcagaggcagguggauuucugaguucaaggccagccagggcuacacagagaaacccugucuuggaaacaaaguuuauuuuugugugcauacuuugcuuauguguaucuauaugugcacuguguguggugccuuguggagguuggacuggaguuagaguuggcugugagcuaccacaugagugcugagaaccugaccuagguccucuaaagaacagcacaugcucuucacuaaccagcugucucugguuccacuucuaaaaaaauuuauguuuuauuuacuuucacuuaaaaaaaaaguuacagccaggcaugguggcacacgccuuuaaucccagcccuugggaggcagaggcaggcagauuucugaguucgaggccagccugaucuacaaagugaguuccaggacagccagggcuacacagagaaaccuugucucgaaaaacaaacaaacaaacaaaaaacaaaaacaaaaaacguuacuccaugugugugcaugugugagagaguacaugccucuguguguguguguguguguguguguauguauguguguauguguguguguguguguguguguguguauguguguguguauuuguguguguguaugugugugugugugugacaauuguuauuuuucuccuuccaccaugugaauccuggguguuggccucagauuuccaggcuugguaguaagcgcuuuuaccugauaagccaccucgacccuuuuugagagaaguguguaugcauucuagacuguccugaauuuguuaugcagaccacaguggccugguucugccucccaugugcugugauuacaggcacacaccaucccugugucuuggcaggcucucaguccucaggaacacugagucugagaacaugaaaaccgcuuuccuaguugucaaauucaggagagggacugggggccacagguggcuuccuuucugccugacagacaugacaaaugccaugucauccucaguggagccauuugcagagugucaguccuugugccugugcaggaacgggaagcacguggcagccuuugcagaugaagggcagagucagugcugggaucccagcccugcccucuauuacagcauacacaggaagugauccuaggacagcggcuagacaccugagcugauggguggcucugcaggcccagucaccgaaguucugccuaggcacccauggccuuugugauccgugacuccagcuggcauagaacgcaucagaggcauuuugggaagcuuuaccucuggagagugaggcagacaaguugaauggacuacacuuuacuguuucuuuaggcucuuuaaacagaagaaaaauacagcguauggguguuuggcugugugcauaucuguaccauaugccugcagugcaggucagagagugucugaucuccugggaucugguaacacaguuguaagcugccauauuggugucaagaauucaacuuggguccucuugagagcugccagugcucucaaccagugaaccuucuguccagccccgcuuaguuucugcgguagugguugaccuugcccagauucuggcuuucuguucgaccuguucacugugagcuccaucuugaucgguaccagaggucagauuggguuuaaggcuuuccucgcucuacccaaggucacugauacauuuuuaguguuuuuuuucuuuucuuuucuuuuuucuuuuuuaauucucuuauuauaucccagccacaauuucccucccuccacuccuuccaguccuucucccucuccccuccccuccccugauccauuccuccauuucccuuuagaaaagagcaggccucccagggauaucagcugaacacggcugacaagucacacuaagacuagguacaaacccucauaucagggcuggacaaugccguaggaggaaaggauccccagagcaggugaacgagucagagacagccccgacucccacuguuaggagucccacaaaaauacuaagcuaacaaccauaacauagagaaccuggcucagacccaugcaggcgcucuaauuguugcuucagucccuguaagcccccaugagcccugcuuaguuuauucucugggccuuguucucaugguguccggaccucccuggcuccuacaauccuccuuccuggaacucugccuaauguuuggcugaggguuucagcaucugcuccuaucaguggcugggcacugaucuaugaggauagcugaaugucacuaggaaucagcucacuaacuuuuuuuccaguuguguuugguucugauccauccucugguucuuagccauccaggcagugucaggcuugggcucacccugugguguaggccucaagcuggaccaguuguuuagugagggaagcauaucguaggcucuccuaggcagcuggagauaacagcaccacagaacagcuggguuuggagcagguggaagcggcucagauuuuaagaaauagaaaacagagcagggguuggugagauggcuuagcuccaguuccaggguccaccuuccucuucuguccuuugcagguaccagacacccuuauggugcacagucauacauauacacauagcaucauacacauaaaauaaggcaggugccacucuaaccagcuuaaaacagcgcagugaccuuacccacauagcuaucucucuggcucaaagguuuuauggguuuuuguuuguuuguuuugagacaggagucucacuuuguaguccuggcuggcuuggaacuuauuauguggacuaggcuggucuucaaauucacaaaaauccucuugcuuugccuugccuccugaauucugggguuaaagacauaucccaccacacuacacccagcuaggauuuauuuuuuuccagagagaggauuuagcccagggagccuugaacuugguauguagcugaggauguccuugaauuuauuaaaguagcaagagauaugauugaaauaagccagguaucagaaggcagaugcggcucucacaugagguagaauauuaaaguaguaaguacaggaagaggaaagcugucccaguuuaugucaccaggaucaagaccccaacagaaagcaaucugaagagaaaagguuuauuucccucacagcuuguaguuuaucaugaagggaauucaaagcagaaaccuggaggcgggagcuaauacagagaccauggaggaccauguugcuggccugcucccauggcuugcucagccugccuucuguauaacccagguccaccuuccuggaggugaugcugucugcaaugggcuaggaccucuuacaucauuuaucagucaagacagugucuuacagaccugccuacgggccagucugauggaagcauuuuaucaguggaguuacccucuucagagaugauuacagggugugucaagcugacagaccaaucuguauagaaggggacaaugagauugcuuaguguauaaagugcuuaucaccggguccuuggaaccugugugauagaagaaaagaaccaauuauucagacuuguccugugaccuccacacacgccagagaggaguggcagcugccagugcuccauggagggagggggcuccuuccuacugcgcugcaguuggaggcaagugcugcaucuccagcacgcgugcgugaggcuuguuuccuagcugcaggcucacuuuggagaguugagaacgucugcagaugaguaauggugguguuugcacugcgguguaaguguguuaacgucauugaaccaguuaagaugaaaacaguuaagauggcaaguuuuuuuuguuguuguuuuuuugaguuuuucgagacaggguuucucuguauagcccuggcuguccuggaacucacuuuguagaccaggcuggccucgaacucagaaaucuaccugccucugccucccaagugcugggauuaaaggugugugccaccacgcccgguuaagauggcaaguuuuauaugucauuuuuaaacacaaauauacggcuagaacacuuuaaauccacuggcuuguccuuagagggccuauuaucuccuguuucucugcucuaucuaguuuguuuuuguuauuuguugggugggaggcuguugugagccuugcuauguagccuaggcuggccuacaaucugauucaccugccucagccucacagcaacuagagcuuugaugcugcucuguuuucuuggaugagggggaugcuugcccaucauccuguuuuguuuucaggauuuuuauuuuccuguguuuaaguguuuugccuguaugugugugugcagcaugugugccuggugccaaugaagaugagaaggagggcaucucaggcauuuguaagcuaccauguagauacugacuaaacucauguccucugagccacaaguccucuucacugcugaguccucuuucugaccccuaggaguugggguuuuguuuugauuucagauagggucucacuguguguccagcucuuagccucugagccauuguuccagugucccagcuaguguuuuucaauuuuuaaaaauuacauuuggccuggaaagauggcucagugguuaagagcacugacugcuuuucugaagguccugaguucaaaucucaacaaccacaugauggcucacaaccauccuuaaugagaucugaugcccucuucuggugugucugaagacagcuacaguguacuuauauauaauaauaaauaaaucuuugggccagagcaaguggggccggagcaagcagagguucugaguucaauucccagcaaccuuaugguggcucacaaccaucuguacagcuacaguguauucauguacauaaaauaaacaaaucuuuuaaaaaguacacuuauuugugucugugggagaaggcaacugucacagcacacacaucaaggcuagaggguaaccuuuggggucaaacucagguuguuguauuuaguggcaagccuguugaccugcugaaccaucuuucugccucccgcccguuccuuuguacauguggguguggcaugugugugggcaccauucugugugugugugugugugugugcucgagcgcacgcacgcacgcgcugaaggacaacuguggauguccugaagaaugacaucuguugggcuggagagagggcucagccuuuaagauaagcacugauucuuuuuccugagguccugaguucaauucccaacaaccacaugguggcucacaaccaucuguaaugggaucugaugcccucuucuggugugucugaagacagcuauaguguacucauacauaaauaaaaaucuuaaaaaaaaaaaaagagccgggugugguggcgcacgccuuuaaucccaacagaggcaggcagauuucugaguucgaguccagccuggucuacaaaaugaguucuaggauagccagggcuacacagagaaacccugucuugaaaaacaaaaaauaaaaaaaaaaaaaagaagaagaaugacacccgucucuugugagacagguucucuugcccuggagcucacccguuagucuguauagacuggcuggacagugagccucaaagaagcuugucucugcuuucuaaccaugggguuacaaguguguacuaaccaccauagcuggcuguuuuuagaugggcucuggggcucuuacguggguccugugcuuugagggcaagcgcucagcgacugacccguccccugugcugauguuguuucuuugagacagggucucuguggucugggcuguuguuacacucucggcauuccuccagcccgggccucuggagagcugagacugcaggugugagcugccaccccagguuuagcaucucaucuuguaugaagcuggacacgagagcacuaauauccucacuuaaagguggaagaaaccauucuaagaagcucccagggggcuucccacgguucacuggggacgguuuguuucugcaugccccuuagugagccagugagccgggucauuucauucacuaggcugagaaagagucuccccgaaauguacuucacauucugugucuccccaauuguaaacaaaauggggcuuacuuagaagaaagugaagaaaggcugugguagaggcagccaguaauuucugucgucugaggccaucuugcuuuuuuuaagguucaguuauuguuuguguaggugauuuccagauaucacccccccacccccuguccauuggacuuuauauuuuugcacaaaaauagaaauacaaacugcucuugcagaggacccaaacuuagagcaguaaagucacacaacuacagcagcuuguagcuccagcucuggggaucugauggccucuuccagccauugcccugccacuuacaugcacaugccuacgccauagaaagagauuuaacagaaagaaaucugcauuaaguucuaaagcgaauauccucguccuuaccagaugcauuccuggcuuuuguuuuuuuaagguuuguuuacuuaguauacaugaauauacuguagcugucuucagacacaccagaagagggcaucggaucccacuagaugguugugagccaucaugugguugcugggaauuaaacucaggaccuucggaagagcagucagugcucuuaaccauugagccaucucucaccuuuuucugucugaagaauugucauccaguuccaagucgucguugaccuuucuauucuuccucuuaaguuuaguccaucauuagacccugugaguucuacuuuuuucugagacagggucucuguauuugaucuuggcugucuugcugucuagaccaggcuggcuuugaacucaaauccuccaacuucugccuccaagucugugcccagugaguccuaccauaucgauguuucagaucucucuugucuucugcugcuaccucuugcuacuaggaacuuaaaaaaaaagauuuaacuuauuuuccaugaagaugcgaauuugccugcaucuuuguaaguuuagccugugugugcagugccugcgggagugaguugugagucuuucugcuuccaucuuugcagugcugagacuauagcugugugcuacugcacccuguguaugcaguccugggauugagccagcacuuucuauaugcuaggcaagcucuagagcagaggccuugcuugguccccucuuccuuauucaguguacccuuugacgagucagggacagacaaaagaagugcuuucuuggcuuugaaaaucuacaguuuacuaagauaccaacgaguucuuguguucugacauaaguguucuugaaacaagacguaaaauguacagaugucuucagacaugguugguacuucguacuuuuagcuccagcacuugggaagcagaggcaggcagaucucugucuggccagccaggguuauauaguaaaauccugacucuaagagaaaauaaaagaugaagguggaggacacagcagcaacagcuggguguggucacaugcuccaguguucccagagacagaccagaugaucucugugaguugaaggccagccugguccacauagugagcucuaggacauccaggacuauauauagacccugucucaaaaacaaacaaauacagcuaaaaauauauuaaagcuaugacuagccaacaauuaguucaggagacuaaugcagacucacugaguccuaaacuauuggucuugugguuaucaguguuucagauuccauuucuguuagugauagaguccucaauuugaaaaugaccuggacuacgccggggccuagcaaacacauaaguggaugcucacagucagcuauuggauggaucacagggcccccaauggaggagcuagagaaaauacccaagaagcuaaagggauauaagguucuccuauagggagaacaacauuaugaaccaaccaguacccuggagcucuugacucuagcugcauauguaucaaaagauggccuagucggccaucacuggaaagagaggcccauuguacuugcaaacuuuauaugccccaguacaggggaaugccagggccaaaaagugggaguggguggguaggggggugggagggaggguaugggggacuuuugggauagcauuggaaauguaaaugaggaaaauaccuaauuaaacaaaaaagaaaaaaaaaagaaaaugaccugggaacaccauugcucuuacagccaggcagugggggucgaaagguucuucugccuuccucuggacccugaagaggaugguggaacuagauccaacaucuucugaagcauuucaggacacaugcuugguccagcuuugcagucagaugggaggagugugucuagcucaccuggcuaaacacggggcuaaacacguaagccaagauggccgaacagcucgccauuacuguuuauaaagucagaguuucaugcacacuacgaagauaguuuuccaagugcacuaccuggccaguuuagcugcagguuguuguuguuuuaggaaugcauucuggugcagggaugugcauaggguuagagcaauagcucagccuugaaaggccaagacuuacuacagagaugaugaccaucuguauaggcagggauugguguucccagcauugcuaaaagcugccacugcccuagugacaaggacagaguacugugucuuaauaggcagagaggaauagagaaagcagucaagcucuuaauuaugcuaaagggagucauaaacucuggcugcucccggaagcuuaguggcuaccagguaucugugagaucuuugauuuaacaaaggggaaauuccacuguuuuguccuuuuaggauguuccugaacuaguuuuggguucaacugugucuggaaaauggccaggguuugucagcuccuacccaagcuaaauuguaucuggacuuauuaaagauguuuaguaaauagucauaguauuucaggagggacagucaugaacugugcagaauuuuuaaacuucuugugaaguaccaaaauccgaagggcacuauaaauucaagaaacgguaggguuuagauaucaguugguguggugguacaaguguauagaaucucggcucuggggaggaauggagacggggaucacaggucgucccuagcugaucuuccugaaaccaauccaagggcauguuuguuaccuugagcagagaacguuuacaguaaggauugcccuuucuuguuaaguaugugguuaaacauugguaaaccugugugauugcucaggaggugagaugcaaagggcagagcugucagucugaaggcuggaucuuuggaagaggaguccccacccuacacacacacacccuguugcucuuguaagaaaccaccguguuaguugaugucacugcccugcccggaucugauguacauaaaggcaaaagccauuuuuacugggucacagucuaccaggucucuggcuucaaagaauuaagucuguggagaugguguacaucgaagaggauauagaaaugaauuuuuaggggacauugagcuagaucagcaggucagggugcuugccaccaagugugaaggccugagcuugguuccugggauccucguggugaggacggaggaggcucccuuauugucuucuggccuucauggcaugccagaugugcauagacacauaacuuaaugaggaauacacauauuuuugaguguucccacaggacaaagccaaggugauuacugcaugugccaacaucagggaaucuuuuccuugggagccaagcaucaaaacuggcaaacaaaggaguuuucuucuaugucaguccaacuugggagacauucuguuaaugacuuauuucccccaaaacaaugaagcaaccccccuuuuaacauuacguuuacuguguguauuuguguaaguuccuccugcugucacacgugagguggucagagcacaggucuggggagcuguuuccuuugcugugggucguggaacucuaacucggguguuaaggcaacaagugccauuccugggugggugagucaucuugcuggcucacaaagaaacgucugugugcuaauaauauaacuuaaaaguaaaacagauuuccauauuguauaaaaugauaagcgguggcauuucacacugcauagucacaagagauacaguugugaagaaugugcgcacaggucuagagaggugguaguuagagcauguguucuucuuucagaggaccagcauuugguugucauugcccacauggugacuuagaaccaucaguaacuccaguuucaugggauccgauguccucccccagcauccucaggcuguacgaaguguacuuacauaauauagccacgcccacacauacaagucuaagaacuuguacauuucuguugucauguguagcacuugagcucucuaugccuggucuguuugaucccucaguuuucuccaggccuguguccauccucgccguaauccgcguccucgucuuccuucugggugucuuagcuuccuaucuuuuaggacuuuuggaaagaaauuugggcuagcuuuggagaaacagguuuagcagacagcuuuguggcuuuugucuguggcuuacccaucaucuuggauuuauuuccauuaaugcccccccccccacauuuauuauggguauguggugacaaugacaguaggcagugaacauggacauguaguacauguggcuuuggugcaauguucauucuugaugaaucccccaccuccaucccacauuaacccagacugucaucaaacuugauagauaguuguggguagccuugaacuucugaucuccuugccuccaggucuuaaguguugggaucacagauguaugugucaccaugcccagcuuuacagcacauugaucaacuguaguccauagauagcaauccuacugggcagaagaaaugacacagggauaucucugguugaagcucaugucaguaugcaggauggaucauccauagugauuuaagucaugagugugaagacagcacuugggaggcaggcggauuucugaguucgaggccagccugaucuacaaagugaguuccgggacagccaggacuaccaaagaaacccugucucggaaaacaaacaaacaaacaaacaaacaagauaggcccaaggaaacaaaggauacagaccuugcagaggggguuacauuuuaauuagggagaugacuauguacccauuaauaaaaaagcaagucacaggguaaugugugcuucaugagaaguucacaucuuucagggacuuugcaggacagaugugcagccagcuucucuuucucuccaggccuuccuccuuccaccucacagugcugcacuagagcccgugucucuguugucagguuacggucaacuuugaauuguaacuucagcaugacaguugagcagagaaguggaggguuaucuagagguuccgagccagggcuauuggcugcuggucuuguuuuucagcagcuggucucacuaugaucauauaaucagugauagcguggucauggaggacagacagggagaagugugugauauaaguaaaaucccugccagagccuaaaaacagcucuucagcucucucugcuccaucccaggaaacauggagaaaguuuuccuuguggaggucaugguaccagaaacccaacuacuauagguugcugagguugggaugaccugauuuuaguagcuggacaagugucccugucacuccuccucccccccccccuuccugcccucaccuuaggaauguguaagggccuuagaucugacuggaugaguugaggcuggaaggacggcggggcuggcaggugggcagcauggcugagauugaguccugaaguccaacaagcccuguugcuggggugugagcugggaggccugggagaaccacaccuggcuccuuagucuggggaugucugaagaugaaacgcuucugcacucaguucuuuuuuuauuuuuagacagccuaguacuucagucccuaggggcucuugaucugaguucuaugcacuagucuggaauuugcuacagaggaauaggggaaacaaaacaagaaaaacaaaacaagccugaagaaguucuccaaaaaagugacuaaacucccagcagacuucccugauucaccuuguaacuaggauucuucgcugcccaccucucacauuccuggguuuagaugcgcucuguccugaccuguuccuucgccuucuggguuuggggugugugugucgcugguuuccagacucuggagagugccagcagcuggcauaugaugaucacugaacaagcugcccgcugacacaugccuucugaggcacagagagcugccuggcuugagugcucugaacccccauugcaugacuguuucagaggugcguuuuuagaccaaguaugcagugcacaccuguaauccuagcacuuagguugagguaagaagagcauaaguucaaguuuauccuugguuacagagugaauuugggaccagccugggcaauagggaccauagcucaaaacauuuuuguuggauggagagaugacuccgggcaagagugcuuguucuuguagagacccgagucaguucucagcagucacauagcagucacaguggcucacagcggcucacagcugucccacauccucacagugccucacagcugucccacauccucacaguggcucacagcugucccacauccucacagugcuucacagcugucccacauccucacaguggcucacagcugucccacaucuucacagugcuucacagcugucccacauccucacaguggcucacagcugucccacauccucacaguggcucacagcugucccacauccucacaguggcucacaguggcucacagcugucccacauccucacagugccucacagcuguccuacauccucacagugccucacagcuguccuacauccucacagugccucacagcuguccuacauccucacagugccucacagcuguccucacccguuuagcaggggugucggguguugcugugaaccacuggugaaggaacagucagucugcuugagcuguaggugaggucgauagagaucuucagaguuaauuggacuguugaacugcaccaagcauucguagguuucaggaacacagugcugcagggccucuugguuuuacuaaagggagcuugaagcaaccaaagguuuugaacugaagaaccaaagggccugguuuggccuuuaaagucacuuugccuguuuuguggagaacaggcuaaaaggcuagggaagacagagggacaaacugauuaccugcuugcaggugaccuuaugggacagcucucccugggugagccauggaaagcuccccaccaucccagcucuggauguagcuguaucgacaggggaaguaacagcagcucaggguguaaaugagcagugucuucuagaaguccugcuugcagcuuuucuuccucaguuagacugguguggaaggagcacucucugacuagagcagccuguaaaccucaggagccuugucagcaguuacagggccacuccucauuccgcucugcucuccgccgccucagaaagcucagggcaagguuggcggaggagaggcaaguggguuugcagugcucugggguguaacagagaacguuggaauugaaaugacuuuagaaaucuccgacuagaaccuucuugauuuuuaggugcagcucugcaaagaugaaguaaacagccuuccuagucauugcaguagauugcuggcauagcaagggcccuacaugccuccugcuugccucugcucucagacauucagucugggugugagugggccuugguauucauagucccuucugguguuuacccaguagugagugaacuccagccuugacuuuggcaaauuccacgaauaugaagucuuuacaaacaguugaugguaaggaguuuguguuuccuuugucuagggucaaguccuccauaccaaggaccaggcuaaaaccagauuacacugccccucccugggcccuauugacuuaaagcagccacuguaaucaugggcaauaucuuugggaaccuucugaagagccuaaucggcaagaaggagaugcgcauccugauggugggccuggaugcugccgggaagaccaccauccucuacaagcugaaacucggggagauugucaccaccaucccgaccauugguaagggcaagcugaggggaggcaggcaaggccuucccuucccaggcagguucauacaccucucgggcuucagagagagugucuguuuaacuuuggcaggugcuggagcugccguuugcccaccugcccuggcccucugaugggggaacuuccuuccgccugcagccuggcacucagcagugcccucaggcauuaggcuugguuuguucucuguguuguuuggaaagcaggugaagggcuuugauguuccugccagaggccuggaauugcuuugguuuagaucuucaguagggagaacauuugcuaaaaacauggggcuguggguccuccuccucagcuggggcuccucucucaggcuucccauugccucucacuccacuuuuuuuuuuuguuuuuugagacaggguuucucuguguagcccuggcuguccuggaacucacuuuguagaccaggcuggccucgaacucagaaaucugccugccucugccuccugagugcugggauuaaaggcaugcgcugcaaacccccaccccccacccccggcucucacgccacaucuuagcguagauauauuuuauugaucaagggacagaacagaguccuuccuuuguagaauggaggaccagagucugagugacaggagagcggcggcucuuauacuauccaggcagcugugcgcccucugaucagagaucacccuuguagacuucuucaauuuuccuuccuaaaaaauacauaccucauaauauauaauagaacacacacuuuuaaguguguuuauguuuugcauguaugaauguauguauguauguauguaccacaggcaugcauguguagugaacauggaggcccagacaggcccucagaccucguggaacuggaguuauggaugguugugagccacuguguggguacugggacuugaaccuuggccuuugggagaacaagugcucuuaaccacugagccacaucuccagcccuuuuaaguuuccuucuaggcuccccaggucaaggaccucaaggucccaguaucccuuuagccuucugcuauuggugucccggguaaagcugaggagagauggcgugagcucaucagguuauuacugguagaccugguauuugaggccaguggccauugacuucuuuaccucccaaaggguuuaauguggagacaguggaauauaagaauaucagcuucacagucugggacguagguggccaggacaagauucggccccucuggagacacuacuuccagaacacccaagguaugacagacagagcuccugggguugccauugcugggcuugugcagagcauggcuguucucuuaguuauggguggccauggccagcccuugcccugaugcagcucuuggaaguggagaaggggaccgugcgucuggaggguguggugugggauaggaaaggggacacugucgucgucugugugucccacgcucucucugcucuccaggcuugauauuugugguugacagcaaugaucgggagcgagugaacgaggcccgggaagagcugaugaggaugcuggcggaggaugagcuccgggaugcugugcuccuuguguuugcaaacaaacaggugagcuuucccccuuuuucugcaucugggagagcauccuggcugugggagucaaggggccuugggcucgugggugaaaggccuggaacuacugcugacggguuggaagugugaggaggagacgcacuuggcuucuucaugcucuucuccuuguuccccagcccagcugugucagcagcauuuaaguccucagggucgaugugguagcaugucuguucaggaucuuuauccucccuguacucuguguacuguaguagagcgagccuugcuccugcugcugaaucacacacacuuagaacccugcucuucccuaucuaauucccuggcccugcaguucuggaacuacugggccuggagcaguuccuucagaucuugaucuggguuuccugagauaacgagaagguggccauauaugcgccucugacagaugggugcgcuuuguagagccuugacagaugcugagguaucucucuguguguguuccuuugugcugcaggauuugccgaaugcuaugaaugcugcugagaucacagacaagcuggggcugcacucccugcgucaccgcaauugguacauucaggccaccugugcuaccagcggggacgggcuguaugaaggcuuggacuggcuggccaaucagcucaaaaacaagaagugagagccaggcagcccucucugacuaccccacccacuccugacacacaccugcugucuccuuaccccaauuuucccuucuuccucuugaaaguggccaagguccuggguaucauguccacaugcccagcaagcgccuugccuuccuccuccuccuccuccucccuccucccuccucccucccuguacacugacacggucagcccccaacugcuguccugaugaugaaucauuccaauuuacuggauuuaaaacagaaugaagcuguuacgguuucguggggugguccccauugguuucaggaggaagagugggguguucucuguuugcuguuuggcacugguugcugugcucuuggcaucugagucccuucccugugucccuggccacucuccucccugucuuccuuuccuucugaacccucuccuauucuacauggacauugcacgggccucucugugugugcgugcaugugugcgccuguauauauguguauagagagauauauauguagggucaggggagggagcacagcgcagcucagggcuuacagccgggacacugcgcacuggaaccuguccccugcccuucuguguuggugagauaaggggaugugggugggucccguuguuuuccucucugcagguggcauuccuggauguugggauacaugaugggcgccuucggccaucugucuuaccuuuccuucuccacuaugaugagcacacgaaguggcauuggucucugggugacuguuccuaaggagcugccgugcuacucugccucauuaguagcccacucacgcuaucagucuagaguguuguauugauccucccccaccguccucagaucugcuccucaggaacucagagggagguggguuagugggaccugcauguagagguggacaguggucggggaaggccuaguuuuccaucuuacugucauaaggaggagaagguaaggcauggagcaguccuguuccugccuucuggucugucagagaucuuuccccuuaguaguucugcuggccugaugaggacugaccaaguggaguaacgagaagccauggacuggggguaacauagccgaccucaguaucaacucccuguucuucaguucucugucuaguucaggaccaggaaagaugaguuucuguuguccucgauguccugucccccuccuuccuggcagcuuuccccaguccucacccuguccugaauaggucugugggguuggaguagaugccguaggacccugcauggcugagccuggaacugugaucuucagggcccucccucccuccauccucugcuuguucagcugcugcugcaggucuguagagggcgccuauuccagaagaucugaccuggguccugacuugucacugcacugaagcuguggcuguucugugggcuccugugugugcuggcugcgcccugagcuccaaaacagcugcccauaaccucucugcuaaggucaggacccugggcucucugcagcuuggccaagggacucuucccagaggccuguucugaguuccuccacucaguggccagguuucuugccaccuuugucuauagcaggcagauagguuccccagccuaccgucagcugagcugugcgagguuccaggaugucucucagugcaaguagugcugugauaccccagacaccaugugagcgugugcucuagaccuggugugugugaguguguguguguguguguguguguguguaagugugagugugugugagugugugugugugugagugugagugugaguguguguguguguguaugugugugugugugugugugugugugugugugagugugugugugugugugugugugugugaguguguguguguguucucuacaugggggugccagggauucuguuccauuuuaaauggguuccuuccauucccugcauuccucucuuuacuguuccugcgucccccucugucgaccucacucucucugccguuucuaagccccuacccccuccuuucuguugcugcugugagcgccuguuugccuucuccguucacucaccacuuugccuguuugguuuugguuuugucuucuguuugauuuucugcucuaucuuugcuuugagauuggugaggacuuugccuuuugcucugccacacuuucugaccuuccugcuuagaugcuaguuccagauagguuuuguacauugcagacaugaguccacuccugcaccccuuaccagagcuuauuuuucuccaccuccugggaccaaccugaggcugagcaggcuaaagcagccuugaauguugccuuggugcaugcugcuccagacacauccagcagggagcaguagcaccuugguaacaucccuggcuuuguggggaggugggggugcuuucuacauucccuaauccaucuuuaggguuggguguuucaucccauuucugugaacucccucucuugcuuuucucaagcugguuuuauuuuuuaucuuguucuaccuuucuuucuggggacuuccccuucccuccaccuccagaguuugugguguuacagugguaucugcaguucugaaguggguuuuuuucuuuuugcuuucucuggaauguagacuguacauguuuaauaacuugccuucucuauccuugcucaaaaaugugggauaaugcaaugacugugcccugguuggaaauuaaacuuguuuuacgcagcucuggcgcagcccuuuguccuugagcaacacugcggcaguagggagcugugugguccuuuccacaccguuccuuuucucugcagaggugggaagacacaccucagcgcguggagucauggcggaacgcagguuuauugggacugcgguuaugguuccuucuucccucacacccugaaggaagucuaaacgaaucaagugcuagcaugugggggcucuaugacugaccaacuccuaaagagcucuguccucaauuuaccuguauuuaccaccuguugacagacuuucagggcagcgguucucaacuuguggguugugaccccuuugagggucacauaucagauauccugcauaucaaacauuuacaucaugauucauaacaguagcaaaguuacaguaagcacaggguaaacaucugggcagcauagaaaaugguaaauaucugggcaguauaguuuuguuuuuuguuuuuuuggguuuuuuucuagacaggguuucucuguauagccucgaacucagaaauccgccugccucugccucccaagugcuggaauuaaaacgcgugcgccaccacgcugacucaucugggcaggacaguaaacaugggguaaacaucugggcaggacaguaaacacgggguaaacaucugggcaggacaguaaacacgggguaaacaucuggacaggacaguaaacuggaugccuuccucagcauaaagcagccaggugcacgaggcuguguggauccuguugccaggcagcuaacucgaagggaugucuugggugcaucuuuaguaaagcuuacauucccguuccuguuccauugcucuggugucuccggcugucacugaagacaccguuccacacagaggaaaggcguggugccgcccucaguaagcagggaaaccucuccuucccuugcugcagagcuugagucccacauccugccauggacuguuuaaucugcacucacugccccuccuuucucccgggacagguuuccuuuuccuccaguuaccgucacccucucaggaaccauugcuuuuuguccauuucucugacuucugaaccucaacccaucaccaaccccgugucuucaacauuacuuucccugaaagucuggcucuuugccuccuccuggcuccuccaggcuucuccugcuaauaaguuaggaguaucuuucucuggugcuuuguuuauuuguuaauaaauagaucacuuucugagcuguau

SEQ ID NO: 7978 - RNA, 481 nt, Mus musculus
caccccuuaccagagcuuauuuuucuccaccuccugggaccaaccugaggcugagcaggcuaaagcagccuugaauguugccuuggugcaugcugcuccagacacauccagcagggagcaguagcaccuugguaacaucccuggcuuuguggggaggugggggugcuuucuacauucccuaauccaucuuuaggguuggguguuucaucccauuucugugaacucccucucuugcuuuucucaagcugguuuuauuuuuuaucuuguucuaccuuucuuucuggggacuuccccuucccuccaccuccagaguuugugguguuacagugguaucugcaguucugaaguggguuuuuuucuuuuugcuuucucuggaauguagacuguacauguuuaauaacuugccuucucuauccuugcucaaaaaugugggauaaugcaaugacugugcccugguuggaaauuaaacuuguuuuacgca

SEQ ID NO: 7979 - RNA, 3995 nt, Mus musculus
gucguugauaaaaauagauauuuuauuccucagaggaagauacuacauuggugggggcgaggagccacuaauagcuacaguggaaggaaauacugauccggugggcaagggcgccuaugagaagcuggguaaaagagaaaaaaggucggauaacaaaaggacuggcgagcagaacagaggagcagugagguggggugaggguggucucugcaacccaggcuggaacccagcacaauaaauaguuuuauuuacauaaccgaacgcguggcucugcggccacauuucggugcaaauuauuuacacagugaugaggaggcaggacaggaaggggugggaggaggcugagggaggcaugguucacagcuguucaauggcuccgaggcagagacaaggagaauguaggguuuugcugcuggguccagcaaccuccuuucccacuuagcuuuccgugcccuuucaacucggaaacucuucagcuacaggugggaggggaaaggccuugaagcccagaggugcugguuagagaacucaagggaccuauagggacccgagagacaaggaaaggugauaauacccaaagaggucacagcgcaaaauacaucaggaaccgcaacaccuucaagaguugaccuccccacccccaccccagaagaagaaucuuucucucacccucuggccaaauuggggggcagugcaaaaggagucucccucaaagagggagggagguaggcugggucagggcccucaggauggcaaaaggguucgagccgacucaggcaagugguuucaggaguccccagguaggaggugggagagauggaucgcuaugaacccugggacuguggcuggacgcgguagggugggcaaacaucaggaccagcgagugugucugagaacuggaagagagcguucccguucccggaggcgcggcaccucauagacacucgugcagaacgcgcgugugcgugcaguugcggcagcugacguggcagcaccaguggaaggugcaguugcagcgcuccgugacgcgcugcgugcgcgugcgguggccucggccacagcacagcagcucacagccguccagcgcgggagacgagcuguugcaagcucguccagcugugccagcugugcccaggcggccacuguacgugcagaaguugggcgauuucucgaaguagacgaggucgugaggggagggaggcuugugcgcggggucuucgggcuccaggcgcagcagcuccgcccgcgaggcgcgguugcugccucgguugccguaaaggacgcgggaggcgccgucgaagcggucgcgcagcacgucgcccacagcgcgcagcgugggcagccgcauccaacacgugcgcaccgugcaggagccggacaucccguggcauuugcacucuuggcgcaucucagagaacacggucugggggaggaggggacgaggggaggagggaagaaaaggucaaagccaacaucccacgaaccaccacccauacuuccccacccccaccccacccgggucacgucgaugcuguggaaacuucagccaagguccaggugugacuaagcucgggagagaggaagugcaaaauggcccgcugagauagggacauucggccagacucugcuccacgccagcaagucacuuuuaucuuucaaaagugugccauggagccaucucaauacaucccacguguugauagccugcuaaucucuucuguucugucaucagcucaggaaccucuuugcccucaaccaccaccucuucucugucuucccuccuagagucccacucucucgggaagccccuucccugugccucuguccccgugcaccugucuuacaucuccccugccauugguuccggacacaccgacguaccguucgcccugccucguuguugugaagguucaugaggaagcguaggucccgccccuucuccccggaguccacgaacucucggccaaagaggcgaccaaaaucgauguugucacugcagcccccccagugccagucggggcccccagggccgcgccgccgguagucgcaggugcaggacucgauggagccuucggagcaggagcgcgccacggaaugugugaccccggcggaggugauugcgaagaugaacgcuguuucucggcagccugugggugaagcgaccccgcaucaguugagagaaggcguggggccaacucagcacccuguuuggaagacuugguacccuacaguccaacauccuuggagucaugugugcgaagcauggaaugcccuccucucuaagcuuuacugagacuccagagccuuagcagagcagcuccaaggggagauucccaaguagaacaaaucugcauagccaagaucgcuacuaguauuggcagugcaaacuuugcugggugcgaagcacaacccuagcuagcccucagagaucagcuucccagguaccuuugaggaaggcuagggaaaaacagcugucgcccagcgcccacgauccggaauucccuuucugugggccaguggcucagcaacguuaaagaucaugcucacaacgcaaggcuagaaagaaucuggugcugaccuacgguaacugccggcaccaggcgauucucaguuugaucacauauaacccugggaugucuucccugccuucgcccgccuaugcccuggagaugacccugcuuuucccuuaaucccggaagcgucgcuuuccugggcacccaccucgguugacgaucuugccgaagagguggggccccggagcaguggggcaguuccagcggcgguuucggaauugccauuugcacucucgcacagcgcucuggagcccuccacucacgcugugcaggauccccggguucugucggaucagucgccgcugcuugcggcucagcagcugcagacugggcucgagcaccagcugcagacucuuggaauccgucaacagguucguggaggaggcuauguucacgaugccccuggcgggaugcauaaggguucaguccaggggaggggaccugcauccuaaccauacaggcuguaccacccuauccuugccuggcccugagcuccagagucuagugaguggacagaaaaggcauggcuaccuuagcucuuccuuucuucaagucagcccccgaggagaaaccccaccugcagccuugcccaccuugaaaaacuuaggaauuccacucccucaccucaaagcuaauaucugguuuuuuuuuuuuuuuuuuuuuuuuuuuugguucaagaccuaagggacaccugagcacccaccacagcgagguugggaccuguugcucagcagaaacggggucguauuaaaugggaauggucucugagccugguguaucugggcuucugcaugccaaugaugugcccccacuucagcagagcuaguucuaggugugagcacccuggaugugaagucacaaugcacgaggggggucuguagguuggugauccccacagcgugggagcuggguaaggcccgugccuggcucuuugccccaggacaaguggcggaccccguacuagcucacuuaccaccaucggccacuacuguuggcagccagggcugcgggcagagcggucagugccaguagcaacguaguagaaacccagcugggcagcagcgcccagagccccauggccugccuggccuugcugguucugugcugcgguucugacgacugugguugcuguccgcgacggugggacuggacacagcggugagggcagugaugcgaguucccaggcuggcucuaauaagucuggaggcgggccgcaggcagcaugguucgcuguccuggcugcugggcugaagcagccacugcgggaggcaccgccucuuauaggccucuuauaguugcggcgcugacugcagugagaagaggcugccccuccgggcccgggcggcacuaaaagcaccagggcgcacuggucagggccacagacaaugaguggcgagcgaagcuguggcucuugccggucug

SEQ ID NO: 7980 - RNA, 9299 nt, Mus musculus
ccuuuuucucucggucuccuuggccucccgcuccugcgacgccgccuuucuuuucucuuguucccgggcucggaccucggcgggggggcccgcccgccaguugguugccuccugcagcacccuggaggcccagggucggcgggguggcggcucaggggaucccgggcgcagccuacaccugggacaaugagcaggaacccaggugagcaguuugcggggacagagagccgagguccggggagcugggagcacuggagaccacuuggggcagccaugugggaggguucgugugagugucugagcgagugcacgugcguauauguuagggcuaaagucgaaaugagacuccucgccaucucuccaugcacacuuuaacagcgacugcccccaucucaccgccugccacuaguacuccugucccccuaaacagcgcucaaugauucaggccccaguccucgacgaguggggggagggaggcgcgggaaagagaagggaacagcagcaauugcuggugccagcggggaggucuggaccccacuucccgccccaccacuugcugccccucaccccuccuucacucacgugcggcucuggggcccacgggcccaguagcuggccuggauguccauggacugucgagaaggagcgcgacgacuauaaugacaggaaauagucuucacuucaaucaccaacagcuuggacuucugcacccagaggcagcugccggacuccucauccuggagcucccgggggcugucgggccccucggagaauaacgggccauccagcauccugccccaccccaccccggccccccacccucccacccgccccgugagcccccucccaacccagggagccggcgcccacugcagagcggcaggcccagggacuggcaacuauauauacccgggcacacgugugugccugucugugcgugugugagugugugcuagcgcgcgagcgcgcgcgcaugugacacgccgccguggacggcuccgcgcugcuuccucccccaugugcacggccgcccccuggggccugggauuggacgccccuucccacucacugcucaggucccccaagccuaaugggaccugcgagugggcggggagagacuucugauucuugccaagcuuacggugcccucuccuccagcccccauuucuucauccuucccgaaguuuuaacccuuugcuuuccugcuugucagguugccugaccaccagugcucucucuauuccugccugcucgcccagacuccuuucuccgacagggaguggugagaacagaacucaaggucucugccugccacucgcugcugguuuccaugggguuggggugcaagagaggcuggcccacagcuggggggagcgggcuauuuuuagugucgguggcauucgggugcagcugagaugaguaaccaguuccuaagcaguacagagaagaggugccgcuuucaggaagcuuuugugcgacucugggggagagcugcucccccaagaccucagaaaggugcaccuguaugccucagcuuucucugcugaggcggaacuccaucuauccuggccaccaaacagcaggacgacuccuacucuaaauauggguguccuugggcacccacagagccuucccugagcagcaggcuagcuccccuaacccagaagccaggauucuaggguuacacaguuccgugcccacacagcucuuccaagccuuauguggggugcagauagagugcuuaaauacauuuguacccuaacagagggggauggacuagagugcuccuguggcacagccaaauccccuagcaacagaaaagauaaaaguggccuuucuuuccuaggucggggcucuaguucacuugacuggcaugguguggugcagcucaccuuuuggacucacucgauucugggggguugcugcuugcauccucgggaucccucccccuaugccuguaccagguguccccugauucaccaugguaauguuaguggcagcacagcccacgccaaccuuccaugcagagacuuagcaaccaugccuggcaaccauagcagcagcucaggggaggggagaaguguagggagcgggaugagaggguggcaauggcuccugaggaagaagggaccauuugcugcuccugacuuuaggaacagaagccugugggcuugcaaagugugucuauccccauuuuccucagcugcuucccaggagcugagacuuggugggguaaaugggagagacaaaaguugguuuuucauagaaguacaaggagcauuuggauacagagccuucuuuuuaaggggacagggaccaaagaauuguuauaggucacacucauugagaaacagcaaaguagaaccugaccuguucugcugucccuccccugccacuccucaacccccaccccaugccaugauuccaccuaccuccuggcugcccugaggauggcuugcaggcacugccagggcccaacagaaucccacagcuuuuaaagucuugccuccucccuggacaaguccuccuugaugaaggaaugugacacaaggagacauuuguccuuuccacccucuccacacacacaaacaugcucuaauuauaaucauuuggaggccucccucccccaagcuugggaaugugcugagagcaaagauguggauggagagggggcccaagcacugagagcugaccucuaacaagcgcccugauguguucccuguguuccaucagaaagcccgcuuugugaaaacuagcguggcccagguucuucugaaggcuuggcaggagaagggaaagccagggaauuacucaggaccugcuccuggcuuggaugcuaaccccuaucggcaaagcugcuguagaagggaacagagccugcagguccuccguccgucagguguuggguaucacucucagcacagaugauaggucugguggguugaccccagcucugcuguuccuccaugauguacccucuaccuuagaggaaaggcaagggaauuguggguucaaaaagacuaccggcccagcauuauccaaacaacucaaccuccacucagaaacgccgaugacauuagcaucucucugcccaaagauucuccuccguuugccacuuuccagagaccugacauguuagggaaauuugcaugggccuuagcuaacuaugguccaaauagagaaaguaagggagcguaacugugggaagugaggugggaacaagucagcagagaugagagaggacaggagucuggugugaagguaggaagacaugaaaccagaaccagacgguuucaguuuaaaugcuaguuuguuuuuguuuuuuuuuuuuaauuauuauuauuauauguaaguacacuguagcugucuucagacacuccagaagagggcgccagaucucguuacggauaggugugagccaccaugugguugcugggaauugaacucaggaccuuuggaagagcagucagugcucuuaaccgcugagccaucucuccagcccuaaaugcuaguuuuaauuuuuuuuuuuuuuuuuuugguuuuuccaagacuggguuucucuguguaguccuggcuagccuugaacuccaccugagauccaccugugucugccuccagaguggugggguuaaaggugugggccaccacugccuggcuuucuuuucuuuuuuuuuuuuaaauagacaugauuucacuauguaguugcucuguauuuagaccaggcuagccugaaacuccagagcucucucccucccucucugccucuaccucccaaaugcuggaacaaaaggaauaucccuccaugcuuggcugccagcuuggccuuaaaacaucauauuuauguguaugcaugaugucgucgucaucaucauagucgucauauguguguguuggugcacaugccauguugugcacacggaggaggucagaggacucugguaacuaagcuggugagugacuuuaccaguguggcacugggccacacugagucucugugcugcaguuuaaaaaauucuccucaaacuggaaaagguguuguggagauggcucaguucguaaaacaugucuugaaagcuugaggaaccagguccaagccucagaaccuacauaaaaagccaccggugguguuuuaaucccauggaucuuuggggccugcugaccagccaaccuugucuauguggcagaaaccccaucccccaccccaaggggcccugguucccuccugagaaccacugccugagguuguuuuccaacuuacacacgguugugaauggggugagggcuggcuuaagagcacugguugccuuuccaaaggaucuaggcucaguucucuugcucauaugacaguugacaacaguggagacaccgggccuaguuauccaaugcauccaugggcaccaggcacacacacauaagugcaaacaaaacaucucaacacgcaauuuaaaaaaaauuaauuucagaucuugugaaauggcacaaauguuaggagcauguauuguucucucagaggauccuagcucaaucucagcagccaugacucgaaauugccuauaacuccuugcuucagaucuggugccucuggccuccucaggcaacuauacucacguucacacacauggauacuuaaaaauaaaccugccagacggugguggcgcacgccuuuaaucccagcacuugggaggcagaggcaggcuaaucucugagaugaaggccagccuggucuacagagugaguuccaggacagucagggcuacacagagaaacccugucuugagaaaccaaaaagaaaaauaaaaaaauaaauaaaccuaaaaaauccauaggcugagugugguggcacacgucauuaaucccagcacuuaugugaaagaggcauagugaucucugaauuugagguuagccuggucuacauagcaagcuucagccagccagaguuacauacaagacugucucaaaaaaauugucuagccaagaaguggugguaaucccagcacucggggguuggggguagggguagaucucugaguucaaggucagccuggucuauagagcaaguuucaggacagccagggcuacacagaagagcccugucuugaaaaagaaaaaaaagaaaaacaaaaucuugccucaaacaaggcagaaguugaauauuguuugucaccucaagguuuguccucuagccuacauaugcuuacacauacacauacacacacacacacacacacaaaauauauauauauauauuuuuuuuuuuuuuuuuuuuaauuuuuaaaaaaauaaagucugacccuggaugagcacaugacuaaaauccuaguacuuuggaagcugaggcaggaggauugcugcaaaucugaggccagccugaucuauacaugguacaaagucuuguuucaaaaaaaacaaucaagccgggcgugguggcgcaugccuuuaaucccagcacucgggaggcagaagcaggcggauuucugaguucgaggccauccuggucuacagagugaguucgaggacagccagggcuacacagagaaacccugucucaaaaaaucauuaaaaaaaaaaucauaaauucuccccaaacuauaacacuuagaaccccauacaucuuggcugaaggaugcaugucuguguaggugaguggugagaauaucuggugugucucuguguauuaucacugcuguuauuaaugaguggaaacagcuuuauaaguauaagguagggaaguuggcgaaauagugccuaucaaaugcagaaaucaaacacugcaguaccaugaugaaaccuugucauuuaauuagauucgccacaaaaagcauuaaucuuggcuaccuacccaccgcccuccuccacauagccaucugccuucgucugcacagcacaagaacccggacgcgccucccuagacucaugggaaggacugacagcaaaugggcccagccuccuccacacagugaaacaagacgaauaaaaauauuuuaccgagacuugugcagagcuauuaucuuagguggaguaagggcaggggcagagcaggguguggugaggucuagggaucucguagagaucagaaucuacccgaggagcacaaagcccguggcucacccagaagggggcugcggcaggcgcgggccuggacuggcugggcugacguucucuccaguguaacaggacggucagggaggcugacaguccuccuccuuuccccuucucuagcucuagacagugggcguggagcuccugagagaagacucaguucucccaggauuccaucugauucccagagcuuccagcaggcaggcagugagggggccaccuccccaggcaccgccuguucuuccccaugcucagggcuucuucucuccacccgugagcaccagagccuguaagaugucagacagcgaaacgaugcccuugaccacgucguguucauccaccaccaccagacggugaaccuggcccagaggaacagcaaguaacgucagugccagcuccaguucggguaacugccucgaccugacccucucagggccacuccccgcuggcugcuugaggguggccagcauccuaccucugccuccaccagccuauugaugaugguuuccagagucucaugcagguagcauuugagaacacccucaaaguagugggaccgaugcugcagggcuuuugucacagacacaucuagguuguuguaggucuuuucggcugccaaauucuggaaagguggggguuuggggggcgggacuugaaagggggucaggucccaaaccuuggaccaacccagccucacuagagggagugagugagggcgcuccuuagcucugcucacaagcccacaguucugucagccacuuguucagguaagauucaaagccaagaagcacccaaggcagagaagacccccuucugcacauccccccucuccacauccaacaccccuccccucccucccucccagccccgcccccgccacucacgaucacaucaaacuuggaguagauguccaccacacgcccuagggagacagaggcagcagcucaguaaaauaacacagugugguagccaaagcucucaggccccaugggauucccuuccagguugggcugcugggacagcgacgcgacccaagcagccucccucuucuugcccagucgcucaccuuucucauccacuacagguaaggcggagacucggugcuguacaaagaugcccagagccacguagacaggcgugguaguacggaccauggcaauauuggcauaggugccaaucugcagcucuuggagagacuuagacaugaauuccggcuuggggaacucggugaucugaggaagggggcauuggcuugcaggugcuuuccggauagagcaggaggugcuacgcucaaucaucaacaccaacaccgcuccucuguccccaaaccgcucugugugugucugcaguucagcacguaaucggaugauggccugagguuacuuacaaacaacuugaggaacuugaggauccgcuugugaguaaggauguacaagguguugccugacucugggucgauaacugggagccuguggaucuuauuucgaauuaaugaagagacagcaucaaacaagcugcgaaaaaguagaagaucauaguuagguuccacggggcuaacgccaggcuguacaaccccuuggaauguguuuacagucagaaaaaacccacagucagcgcuguguguggcugggcaugaacugguaacuccugcacuggggcaaacagaagagucuaaguucacgacagccucaacucuacaguaagagcaaggccagucucggcugugugagacuuuuuuuuuuuucucaaacacacacagcauggcagugugcaugaggagggguccuucuucucuccucucucaugccccugagguaaacacaaacacacacagcauggcagugugcaugaggagggguccuucuucucuccucucucaugccccugagguaaacacaaacacacacagcauggcagugugcaugaggagggguccuucuucucuccucucucaugccccugagguaaacacaaacacacacagcauggcagugugcaugaggagggucuuucuucucuccucucucaugccccugagauaaacacaaaaccaguacuuaccuggcauuuggagagaugcagacaaguggcuuaaaggaguccugcagguacaccucugaagagaacaaaacacugccacgugagugucgcccaggacaccuccaucccucaucugccacccccacccauaccucuccacgucucuaucuugugcuccuccaguucguagaucugcaccuagaagcagaagcagcagcucugaaccucaugcuccccucgucauuaacucacggagcuuugcucgcaggggaaaaccaggcacaauggaccccaggcagggccgugguuuuggcugggagacucaggcuccuuaccagggcugacuuauaguaucggugcaaaauguugaugaagucggugauggucagcaugccuagacaagagccaagaagagggccucagcucagccuguccgaggcuuuuccccucgcccggcaacacaugccaguaaccguaucccagaaacuccugcuuacccacaaaacucugcuucuuacugucccacaaaggggcggcacgaacaccauuggucaccagggcaaaaaaggcuuucuuuaccuauggccaagagaguaaccuccuaaggagauccauagagggcacagcuucgaggaagagcaggguugguguguggggaaauaugacgaaugcugacaggccuuggaccagcgcaggaggaagggcucuacccaccuguagcgaagugucaaauaccaccaacuuggaacuugugggaauuaggucauagcagcgaugagacuucaugaaggaaguauacacacuauuguuugauuccggggucucugcacagagugaaaaaguugguguguuucuuuuauguaagaagucaccaucagaagagacagaaaccaaaaauggcuuuuguuuuguucuuacugccucuugucuuuuuuuuuuucuuccuuccuuuuuuuucguuuguuuguuuuuguuuuucgagacaccacguccagcuuccuuccuuucuuucuaagaauuacuuagcugggcaguggugacauaugccuuuaaucccagcacuugggagguagaauuucugaguuugaggucagccuggucuacagagugaguuccaggacagccagggcuacacagagaaacccugucucaaaaaacca

SEQ ID NO: 7981 - RNA, 9299 nt, Mus musculus
ugguuuuuugagacaggguuucucuguguagcccuggcuguccuggaacucacucuguagaccaggcugaccucaaacucagaaauucuaccucccaagugcugggauuaaaggcauaugucaccacugcccagcuaaguaauucuuagaaagaaaggaaggaagcuggacguggugucucgaaaaacaaaaacaaacaaacgaaaaaaaaggaaggaagaaaaaaaaaaagacaagaggcaguaagaacaaaacaaaagccauuuuugguuucugucucuucugauggugacuucuuacauaaaagaaacacaccaacuuuuucacucugugcagagaccccggaaucaaacaauaguguguauacuuccuucaugaagucucaucgcugcuaugaccuaauucccacaaguuccaaguuggugguauuugacacuucgcuacagguggguagagcccuuccuccugcgcugguccaaggccugucagcauucgucauauuuccccacacaccaacccugcucuuccucgaagcugugcccucuauggaucuccuuaggagguuacucucuuggccauagguaaagaaagccuuuuuugcccuggugaccaaugguguucgugccgccccuuugugggacaguaagaagcagaguuuuguggguaagcaggaguuucugggauacgguuacuggcauguguugccgggcgaggggaaaagccucggacaggcugagcugaggcccucuucuuggcucuugucuaggcaugcugaccaucaccgacuucaucaacauuuugcaccgauacuauaagucagcccugguaaggagccugagucucccagccaaaaccacggcccugccugggguccauugugccugguuuuccccugcgagcaaagcuccgugaguuaaugacgaggggagcaugagguucagagcugcugcuucugcuucuaggugcagaucuacgaacuggaggagcacaagauagagacguggagagguauggguggggguggcagaugagggauggagguguccugggcgacacucacguggcaguguuuuguucucuucagagguguaccugcaggacuccuuuaagccacuugucugcaucucuccaaaugccagguaaguacugguuuuguguuuaucucaggggcaugagagaggagagaagaaagacccuccucaugcacacugccaugcuguguguguuuguguuuaccucaggggcaugagagaggagagaagaaggaccccuccucaugcacacugccaugcuguguguguuuguguuuaccucaggggcaugagagaggagagaagaaggaccccuccucaugcacacugccaugcuguguguguuuguguuuaccucaggggcaugagagaggagagaagaaggaccccuccucaugcacacugccaugcuguguguguuugagaaaaaaaaaaaagucucacacagccgagacuggccuugcucuuacuguagaguugaggcugucgugaacuuagacucuucuguuugccccagugcaggaguuaccaguucaugcccagccacacacagcgcugacuguggguuuuuucugacuguaaacacauuccaagggguuguacagccuggcguuagccccguggaaccuaacuaugaucuucuacuuuuucgcagcuuguuugaugcugucucuucauuaauucgaaauaagauccacaggcucccaguuaucgacccagagucaggcaacaccuuguacauccuuacucacaagcggauccucaaguuccucaaguuguuuguaaguaaccucaggccaucauccgauuacgugcugaacugcagacacacacagagcgguuuggggacagaggagcgguguugguguugaugauugagcguagcaccuccugcucuauccggaaagcaccugcaagccaaugcccccuuccucagaucaccgaguuccccaagccggaauucaugucuaagucucuccaagagcugcagauuggcaccuaugccaauauugccaugguccguacuaccacgccugucuacguggcucugggcaucuuuguacagcaccgagucuccgccuuaccuguaguggaugagaaaggugagcgacugggcaagaagagggaggcugcuugggucgcgucgcugucccagcagcccaaccuggaagggaaucccauggggccugagagcuuuggcuaccacacuguguuauuuuacugagcugcugccucugucucccuagggcgugugguggacaucuacuccaaguuugaugugaucgugaguggcgggggcggggcugggagggagggaggggagggguguuggauguggagaggggggaugugcagaagggggucuucucugccuugggugcuucuuggcuuugaaucuuaccugaacaaguggcugacagaacugugggcuugugagcagagcuaaggagcgcccucacucacucccucuagugaggcuggguugguccaagguuugggaccugacccccuuucaagucccgccccccaaacccccaccuuuccagaauuuggcagccgaaaagaccuacaacaaccuagaugugucugugacaaaagcccugcagcaucggucccacuacuuugaggguguucucaaaugcuaccugcaugagacucuggaaaccaucaucaauaggcugguggaggcagagguaggaugcuggccacccucaagcagccagcggggaguggcccugagagggucaggucgaggcaguuacccgaacuggagcuggcacugacguuacuugcuguuccucugggccagguucaccgucugguggugguggaugaacacgacguggucaagggcaucguuucgcugucugacaucuuacaggcucuggugcucacggguggagagaagaagcccugagcauggggaagaacaggcggugccuggggagguggcccccucacugccugccugcuggaagcucugggaaucagauggaauccugggagaacugagucuucucucaggagcuccacgcccacugucuagagcuagagaaggggaaaggaggaggacugucagccucccugaccguccuguuacacuggagagaacgucagcccagccaguccaggcccgcgccugccgcagcccccuucugggugagccacgggcuuugugcuccucggguagauucugaucucuacgagaucccuagaccucaccacacccugcucugccccugcccuuacuccaccuaagauaauagcucugcacaagucucgguaaaauauuuuuauucgucuuguuucacuguguggaggaggcugggcccauuugcugucaguccuucccaugagucuagggaggcgcguccggguucuugugcugugcagacgaaggcagauggcuauguggaggagggcgguggguagguagccaagauuaaugcuuuuuguggcgaaucuaauuaaaugacaagguuucaucaugguacugcaguguuugauuucugcauuugauaggcacuauuucgccaacuucccuaccuuauacuuauaaagcuguuuccacucauuaauaacagcagugauaauacacagagacacaccagauauucucaccacucaccuacacagacaugcauccuucagccaagauguaugggguucuaaguguuauaguuuggggagaauuuaugauuuuuuuuuuaaugauuuuuugagacaggguuucucuguguagcccuggcuguccucgaacucacucuguagaccaggauggccucgaacucagaaauccgccugcuucugccucccgagugcugggauuaaaggcaugcgccaccacgcccggcuugauuguuuuuuuugaaacaagacuuuguaccauguauagaucaggcuggccucagauuugcagcaauccuccugccucagcuuccaaaguacuaggauuuuagucaugugcucauccagggucagacuuuauuuuuuuaaaaauuaaaaaaaaaaaaaaaaaaaauauauauauauauauuuuguguguguguguguguguguauguguauguguaagcauauguaggcuagaggacaaaccuugaggugacaaacaauauucaacuucugccuuguuugaggcaagauuuuguuuuucuuuuuuuucuuuuucaagacagggcucuucuguguagcccuggcuguccugaaacuugcucuauagaccaggcugaccuugaacucagagaucuaccccuacccccaacccccgagugcugggauuaccaccacuucuuggcuagacaauuuuuuugagacagucuuguauguaacucuggcuggcugaagcuugcuauguagaccaggcuaaccucaaauucagagaucacuaugccucuuucacauaagugcugggauuaaugacgugugccaccacacucagccuauggauuuuuuagguuuauuuauuuuuuuauuuuucuuuuugguuucucaagacaggguuucucuguguagcccugacuguccuggaacucacucuguagaccaggcuggccuucaucucagagauuagccugccucugccucccaagugcugggauuaaaggcgugcgccaccaccgucuggcagguuuauuuuuaaguauccaugugugugaacgugaguauaguugccugaggaggccagaggcaccagaucugaagcaaggaguuauaggcaauuucgagucauggcugcugagauugagcuaggauccucugagagaacaauacaugcuccuaacauuugugccauuucacaagaucugaaauuaauuuuuuuuaaauugcguguugagauguuuuguuugcacuuaugugugugugccuggugcccauggaugcauuggauaacuaggcccggugucuccacuguugucaacugucauaugagcaagagaacugagccuagauccuuuggaaaggcaaccagugcucuuaagccagcccucaccccauucacaaccguguguaaguuggaaaacaaccucaggcagugguucucaggagggaaccagggccccuuggggugggggaugggguuucugccacauagacaagguuggcuggucagcaggccccaaagauccaugggauuaaaacaccaccgguggcuuuuuauguagguucugaggcuuggaccugguuccucaagcuuucaagacauguuuuacgaacugagccaucuccacaacaccuuuuccaguuugaggagaauuuuuuaaacugcagcacagagacucaguguggcccagugccacacugguaaagucacucaccagcuuaguuaccagaguccucugaccuccuccgugugcacaacauggcaugugcaccaacacacacauaugacgacuaugaugaugacgacgacaucaugcauacacauaaauaugauguuuuaaggccaagcuggcagccaagcauggagggauauuccuuuuguuccagcauuugggagguagaggcagagagggagggagagagcucuggaguuucaggcuagccuggucuaaauacagagcaacuacauagugaaaucaugucuauuuaaaaaaaaaaaagaaaagaaagccaggcagugguggcccacaccuuuaaccccaccacucuggaggcagacacagguggaucucagguggaguucaaggcuagccaggacuacacagagaaacccagucuuggaaaaaccaaaaaaaaaaaaaaaaaaauuaaaacuagcauuuagggcuggagagauggcucagcgguuaagagcacugacugcucuuccaaagguccugaguucaauucccagcaaccacaugguggcucacaccuauccguaacgagaucuggcgcccucuucuggagugucugaagacagcuacaguguacuuacauauaauaauaauaauuaaaaaaaaaaaacaaaaacaaacuagcauuuaaacugaaaccgucugguucugguuucaugucuuccuaccuucacaccagacuccuguccucucucaucucugcugacuuguucccaccucacuucccacaguuacgcucccuuacuuucucuauuuggaccauaguuagcuaaggcccaugcaaauuucccuaacaugucaggucucuggaaaguggcaaacggaggagaaucuuugggcagagagaugcuaaugucaucggcguuucugaguggagguugaguuguuuggauaaugcugggccgguagucuuuuugaacccacaauucccuugccuuuccucuaagguagaggguacaucauggaggaacagcagagcuggggucaacccaccagaccuaucaucugugcugagagugauacccaacaccugacggacggaggaccugcaggcucuguucccuucuacagcagcuuugccgauagggguuagcauccaagccaggagcagguccugaguaauucccuggcuuucccuucuccugccaagccuucagaagaaccugggccacgcuaguuuucacaaagcgggcuuucugauggaacacagggaacacaucagggcgcuuguuagaggucagcucucagugcuugggcccccucuccauccacaucuuugcucucagcacauucccaagcuugggggagggaggccuccaaaugauuauaauuagagcauguuuguguguguggagaggguggaaaggacaaaugucuccuugugucacauuccuucaucaaggaggacuuguccagggaggaggcaagacuuuaaaagcugugggauucuguugggcccuggcagugccugcaagccauccucagggcagccaggagguagguggaaucauggcaugggguggggguugaggaguggcaggggagggacagcagaacaggucagguucuacuuugcuguuucucaaugagugugaccuauaacaauucuuuggucccuguccccuuaaaaagaaggcucuguauccaaaugcuccuuguacuucuaugaaaaaccaacuuuugucucucccauuuaccccaccaagucucagcuccugggaagcagcugaggaaaauggggauagacacacuuugcaagcccacaggcuucuguuccuaaagucaggagcagcaaauggucccuucuuccucaggagccauugccacccucucaucccgcucccuacacuucuccccuccccugagcugcugcuaugguugccaggcaugguugcuaagucucugcauggaagguuggcgugggcugugcugccacuaacauuaccauggugaaucaggggacaccugguacaggcauagggggagggaucccgaggaugcaagcagcaaccccccagaaucgagugaguccaaaaggugagcugcaccacaccaugccagucaagugaacuagagccccgaccuaggaaagaaaggccacuuuuaucuuuucuguugcuaggggauuuggcugugccacaggagcacucuaguccaucccccucuguuaggguacaaauguauuuaagcacucuaucugcaccccacauaaggcuuggaagagcugugugggcacggaacuguguaacccuagaauccuggcuucuggguuaggggagcuagccugcugcucagggaaggcucugugggugcccaaggacacccauauuuagaguaggagucguccugcuguuugguggccaggauagauggaguuccgccucagcagagaaagcugaggcauacaggugcaccuuucugaggucuugggggagcagcucucccccagagucgcacaaaagcuuccugaaagcggcaccucuucucuguacugcuuaggaacugguuacucaucucagcugcacccgaaugccaccgacacuaaaaauagcccgcuccccccagcugugggccagccucucuugcaccccaaccccauggaaaccagcagcgaguggcaggcagagaccuugaguucuguucucaccacucccugucggagaaaggagucugggcgagcaggcaggaauagagagagcacugguggucaggcaaccugacaagcaggaaagcaaaggguuaaaacuucgggaaggaugaagaaaugggggcuggaggagagggcaccguaagcuuggcaagaaucagaagucucuccccgcccacucgcaggucccauuaggcuugggggaccugagcagugagugggaaggggcguccaaucccaggccccagggggcggccgugcacaugggggaggaagcagcgcggagccguccacggcggcgugucacaugcgcgcgcgcucgcgcgcuagcacacacucacacacgcacagacaggcacacacgugugcccggguauauauaguugccagucccugggccugccgcucugcagugggcgccggcucccuggguugggagggggcucacggggcgggugggaggguggggggccggggugggguggggcaggaugcuggauggcccguuauucuccgaggggcccgacagcccccgggagcuccaggaugaggaguccggcagcugccucugggugcagaaguccaagcuguuggugauugaagugaagacuauuuccugucauuauagucgucgcgcuccuucucgacaguccauggacauccaggccagcuacugggcccgugggccccagagccgcacgugagugaaggaggggugaggggcagcaagugguggggcgggaagugggguccagaccuccccgcuggcaccagcaauugcugcuguucccuucucuuucccgcgccucccuccccccacucgucgaggacuggggccugaaucauugagcgcuguuuagggggacaggaguacuaguggcaggcggugagaugggggcagucgcuguuaaagugugcauggagagauggcgaggagucucauuucgacuuuagcccuaacauauacgcacgugcacucgcucagacacucacacgaacccucccacauggcugccccaaguggucuccagugcucccagcuccccggaccucggcucucuguccccgcaaacugcucaccuggguuccugcucauugucccagguguaggcugcgcccgggauccccugagccgccaccccgccgacccugggccuccagggugcugcaggaggcaaccaacuggcgggcgggcccccccgccgagguccgagcccgggaacaagagaaaagaaaggcggcgucgcaggagcgggaggccaaggagaccgagagaaaaagg

SEQ ID NO: 7982 - RNA, 1776 nt, Mus musculus
cgugcccauacccagugaggccgggugugguccagagcucucacuugcccucagucaccaaacugcugcuggucuggugggaauggguggugauguggggguggggagcuuagugucagcgcggggagggugggggguauuuaucuauuuauacaugggauuguacauagucuuguggggcaugggggagccggccggaggugagagcccuccccucucccccuacccccggggagagcaaauguaaaacuacuaauuuuugugcuuuauauauucuauauaaauauaucuauuuucuuuuuacaaaaccaguuuauaaaugguagggggguguggggcggacacauggagcuccccuugugggggggcccccuccauuacccaaccuaccgcccuuuccucccccccccuccccacccccuggcugugacugcuguaagguggggguauagagagaagcugggugauucuuacccggguuguauaguuggacuauguuauaacgcacaaagugagcuggccccagggggagccagagggugauggugcccuuaucuuccuuucccuuccuuuccccccccaagcuugugcugcagacgaaccucuuccugcggguagcgguaggguagagggugugugaggccucagaccccucucugguggagcgaggggaugaaaugacgcuucuaugcaguucucuccuaggggcugugggcagagggcauuuuguaauuacuauuuucaagaaucagauuaucuggauuguagagaugggcuggaugguggcaaaugggcaggccugcuggagggguagggcgguugcuguugugauuuuagguuuuuguuuuguuuuaaauuugggggauuguggauugauggggguagggagauuuuuggguuuuuuuuuuuuuuuuuuuuuuuuuucuggccuuuuuuuuuucuuuucuuuucuuuuuuuuuuuuuuaaagcugcuuccucaacuguuucaagcugcaaauguuugagaauaacaacucccccacacucccacggaaaccauuguaauuagacuagacagugggaaccugggcuugcuguccccaaagccacagagcugaacggucuaggcauuaggugggggagauggucuccugugagucaggcucugguugggguuugggcccuagaacugggaaaggagaaggggcagacuuuguaagcauaugcuagguauccgauaguccuguagaauuuagugaagaaaccuuauacaguuuuuaauuuuuauauaaacuauaacucagacccacgcuacaagguuggaauuuugguuguuguugguuuuuuuuuuuuuuuuaaaguacccugccuguauaauugcaucagaaucccacccccaaccccgcccccuguguuuguauuuuggguugguuuacacuugcacucaauuuucaguuucucccuuuuuaccuucuaccuucaccuccaggacccucccccuuuaaaaaaaaauaaaucgcugacaagugugaacccgugaagaacuuucuuuuguguuguguguauccuguacagcaagguugguccuucgugacaacggaugaaaugguucccuuuuuuaaagcgcucucucuuccuccacccccagcgccccuguccuuggcauguuuuguaucagcgaucauucugaacuguacauaauuuauguugcgagaggcaaagggcaaguuuuggauuuugcuucuucaaaguuuguuuuuaaacgauaaauaaaaaaagaacauuuuaaauacaag

SEQ ID NO: 7983 - RNA, 3647 nt, Mus musculus
cucucuccagacacaaacgucaacaaaagauuucucaguuuauuuggaaauauacauuguuaccccagcagacaguucuacuucagaacugccaaggaaccaaacacccuuacccaaccaacacccaaaaccuacccaggaggguggguccuggguaaucaaugcacaagacucauaucccuacuguacagacuguaaaaauugguuuagaaaaccaaggaguuagaagccagggucccugagacaucuugccccuuuguaaacauuaacauccaggcuaccagaaccugggaugagugugcaaaaauaagagugccauacugugugcccagaggacaggggacauaguuggcaaccauagcaguuauauccugagggucugccccacugcugcggguuagacaaugucugcggcagaaacagggcaguuauuccaugccaagaguucacauaagauagcaucggcggucuugucguccauaagaauucuccacccgggcaaucuccuggaugacuuugaugaagacaucuugaguuagcuauaaggaauaagaucagcagucaaucaguugggucagagccgauacuauccagccccaaggcaaacagcgcuuccuaacuauccccaccaccaaucagcauguaggaaaacacgguuagccuugccccuggguccaaucuuuaaguucagcaccugauuaucccgagcagacgacuccauaaacaucgcaccccaggacucugcuagcuucuucccuucaacugccugcaccucucuggaagcagauuuggaacacaccaagauggaaagcagauagcaacgucggcaaguucucugaaaaaucucuaggguuuagauuccuucugaugauucacaaccccucccccaagguuugaggaggugaagaaagagaaaauauacguaaacaaaagcaugauauguaaaugcaaaacugaaauauaaauuaugauaggauuauccuuaagugaccuucaaaguuaggaugaaaagcucggggaccagcuaggcacggugacccaccacuacauucucagcgagcacuauuuggaaagcuagaggaccuggaguuaaaggacagccugggcuauguggugaagaucccgucucgaaaaaccaaucaagauguaaaauugcuucagucaagcaucagagcugggaaggacuacagcucgauugaucccugauacaagucacuuuccauugccugagcagcggagucuuacccaccucucaggagagagaucugccuuguuccccacaagcagcaccgacagccugggaugacaaagcaguugcuacaguuaugcuuguaagauccccuuccccauccuccauggaccccagcuacuccaacuccaucaaggccagaugauucccaaacaagccaacugugaucuaggucuagccuccuugaagaguucacucacccuuucgcuuccuuccacacccucaggucucuauguccuaaagccacuuaccggguuuuaccguggccuucguguagcuuuugguacagguucuuaacgaucugaaagcuucaaacauaagaaacagagcuaggguuuuaguucuaggauaacugcccagucuugacaagcccccacucaaaaaccuccgugcguaccugcgcagagaguuaaccgaguauacaagaacguaaccauggaccccgaugaugagcgaguagggcagaaugcuguacucauccuagcagcaaacaaaaacgugaguauguacacccaugccuucaaacggcguaagccaguggcauagcacacgagugacccucccgggacauuccucgcuccggucucuuccaucaaacaaauuuuuaugaaguagcuccacugagcccugcacacugcuaacagcucaaugccuuucuuuucauacuacaucccacaugaacccccccccccccacacacacacacacuaccagacuuuauaauuuagggcugaacuauaacauuuggacacccuaccgcaacugguaccugcccugcuguguccaccagauguaggugaaacucaucuuugccaagagucacugucuugcuguaagcuggaaaaacaaacaaagaagaaagcuucuugacugugaggugcuuuguggucccagugauguguguuccgauacaguccugaccccaggagugacacacugacuuacugucuucagccacaccugugguucucaaccuuccuaaugcuugauccucaaccauaaaauuauuuuuguugcuacuucauagcuaugauuucgcuaucgucgugaaccgcaauguacauauuuuuggagguacaggguugcaaauggggucucaacucagagacugagaaccucuugaucuauacuauccuggucuagaacggcacaaacgccacgcucuagacacuagaaugggacucccagagcugauuaguggacccuauaaacaaaccauccucuuugcaacaaagaaaucucaaauuauggaguuugagagggcacccagucuaucuagguuccauccccuucacacuaaagaaaauuacucaugccaggugguaguggcgcacgccuuuaauccuaguauuccagaggcagaggcaggaggaucucugaauucgaagccaaucuggucuacaaagcuaguucuagcagccaaggauacacaaagaaaccuugucucaaaacaaaaaacaaaguggugggggguguugggggggggaugcaacuacuuacuauucuccacuguaggaucguagccuuccaggaacucgccuuccacaaauugaugugccaaagaugucuucccuuuaaggaccaaagauuguuguaauauagucauccauccauauuuacaccuuuuguccuuucggacuguggccaggaccaaagggcaccucacaucagcaucccagauugugggagcucccaagcaaugcuuacccuuugucuuuuauuaccaucauccuaacaaguagauuuccgcgacguuuuggugauucgaugcauucagugacgcuucaggaagcccuuuccugccccaccccaucucacccuuugaaaaagauuccccgggaucuagugcaccaggccaaggacacuugcaagugucuagccggcagagaucuccaccacaccuucaaauacugaucccacccccgcucccagagagagcaacgcggggacgacuggugcaaccacagcccgguacacuuuaacccuugcgcgcuccucuuccagcaucccuccacccuuccaucuccuggcagcaaaaccgacuucuucccaggccacauuggguccucgugucacaucuccgcgacagcgcgccucuucuggccacaaagcaaccgugcucucgggagggcggggacuuaccuacggagcgguacccuaggauggccaccuuccuguagcgcaccagcggcaugacaggacgccgccccgcggggcucguaggagugcgggccgagggaacccgaagaucagccgaggugcaggccgagguggacucugggaagaagaguagcucgcugaagcuacgcccggcaagccaaggaaaaccaaaacaagccgcgcgcccggggcagcccacgugaucacaacacagcggcuguacgcaagggagcugggc

SEQ ID NO: 7984 - RNA, 3647 nt, Mus musculus
gcccagcucccuugcguacagccgcuguguugugaucacgugggcugccccgggcgcgcggcuuguuuugguuuuccuuggcuugccgggcguagcuucagcgagcuacucuucuucccagaguccaccucggccugcaccucggcugaucuucggguucccucggcccgcacuccuacgagccccgcggggcggcguccugucaugccgcuggugcgcuacaggaagguggccauccuaggguaccgcuccguagguaaguccccgcccucccgagagcacgguugcuuuguggccagaagaggcgcgcugucgcggagaugugacacgaggacccaauguggccugggaagaagucgguuuugcugccaggagauggaaggguggagggaugcuggaagaggagcgcgcaaggguuaaaguguaccgggcugugguugcaccagucguccccgcguugcucucucugggagcgggggugggaucaguauuugaaggugugguggagaucucugccggcuagacacuugcaaguguccuuggccuggugcacuagaucccggggaaucuuuuucaaagggugagaugggguggggcaggaaagggcuuccugaagcgucacugaaugcaucgaaucaccaaaacgucgcggaaaucuacuuguuaggaugaugguaauaaaagacaaaggguaagcauugcuugggagcucccacaaucugggaugcugaugugaggugcccuuugguccuggccacaguccgaaaggacaaaagguguaaauauggauggaugacuauauuacaacaaucuuugguccuuaaagggaagacaucuuuggcacaucaauuuguggaaggcgaguuccuggaaggcuacgauccuacaguggagaauaguaaguaguugcaucccccccccaacaccccccaccacuuuguuuuuuguuuugagacaagguuucuuuguguauccuuggcugcuagaacuagcuuuguagaccagauuggcuucgaauucagagauccuccugccucugccucuggaauacuaggauuaaaggcgugcgccacuaccaccuggcaugaguaauuuucuuuagugugaaggggauggaaccuagauagacugggugcccucucaaacuccauaauuugagauuucuuuguugcaaagaggaugguuuguuuauaggguccacuaaucagcucugggagucccauucuagugucuagagcguggcguuugugccguucuagaccaggauaguauagaucaagagguucucagucucugaguugagaccccauuugcaacccuguaccuccaaaaauauguacauugcgguucacgacgauagcgaaaucauagcuaugaaguagcaacaaaaauaauuuuaugguugaggaucaagcauuaggaagguugagaaccacagguguggcugaagacaguaagucagugugucacuccuggggucaggacuguaucggaacacacaucacugggaccacaaagcaccucacagucaagaagcuuucuucuuuguuuguuuuuccagcuuacagcaagacagugacucuuggcaaagaugaguuucaccuacaucugguggacacagcagggcagguaccaguugcgguaggguguccaaauguuauaguucagcccuaaauuauaaagucugguaguguguguguguguggggggggggggguucaugugggauguaguaugaaaagaaaggcauugagcuguuagcagugugcagggcucaguggagcuacuucauaaaaauuuguuugauggaagagaccggagcgaggaaugucccgggagggucacucgugugcuaugccacuggcuuacgccguuugaaggcauggguguacauacucacguuuuuguuugcugcuaggaugaguacagcauucugcccuacucgcucaucaucgggguccaugguuacguucuuguauacucgguuaacucucugcgcagguacgcacggagguuuuugagugggggcuugucaagacugggcaguuauccuagaacuaaaacccuagcucuguuucuuauguuugaagcuuucagaucguuaagaaccuguaccaaaagcuacacgaaggccacgguaaaacccgguaaguggcuuuaggacauagagaccugaggguguggaaggaagcgaaagggugagugaacucuucaaggaggcuagaccuagaucacaguuggcuuguuugggaaucaucuggccuugauggaguuggaguagcugggguccauggaggauggggaaggggaucuuacaagcauaacuguagcaacugcuuugucaucccaggcugucggugcugcuuguggggaacaaggcagaucucucuccugagagguggguaagacuccgcugcucaggcaauggaaagugacuuguaucagggaucaaucgagcuguaguccuucccagcucugaugcuugacugaagcaauuuuacaucuugauugguuuuucgagacgggaucuucaccacauagcccaggcuguccuuuaacuccagguccucuagcuuuccaaauagugcucgcugagaauguaguggugggucaccgugccuagcugguccccgagcuuuucauccuaacuuugaaggucacuuaaggauaauccuaucauaauuuauauuucaguuuugcauuuacauaucaugcuuuuguuuacguauauuuucucuuucuucaccuccucaaaccuugggggagggguugugaaucaucagaaggaaucuaaacccuagagauuuuucagagaacuugccgacguugcuaucugcuuuccaucuugguguguuccaaaucugcuuccagagaggugcaggcaguugaagggaagaagcuagcagaguccuggggugcgauguuuauggagucgucugcucgggauaaucaggugcugaacuuaaagauuggacccaggggcaaggcuaaccguguuuuccuacaugcugauuggugguggggauaguuaggaagcgcuguuugccuuggggcuggauaguaucggcucugacccaacugauugacugcugaucuuauuccuuauagcuaacucaagaugucuucaucaaagucauccaggagauugcccggguggagaauucuuauggacgacaagaccgccgaugcuaucuuaugugaacucuuggcauggaauaacugcccuguuucugccgcagacauugucuaacccgcagcaguggggcagacccucaggauauaacugcuaugguugccaacuauguccccuguccucugggcacacaguauggcacucuuauuuuugcacacucaucccagguucugguagccuggauguuaauguuuacaaaggggcaagaugucucagggacccuggcuucuaacuccuugguuuucuaaaccaauuuuuacagucuguacaguagggauaugagucuugugcauugauuacccaggacccacccuccuggguagguuuuggguguugguuggguaaggguguuugguuccuuggcaguucugaaguagaacugucugcugggguaacaauguauauuuccaaauaaacugagaaaucuuuuguugacguuugugucuggagagag

SEQ ID NO: 7985 - RNA, 7416 nt, Mus musculus
uaaggcggagucagggcguuucugggagcacgggagccgggcagcagagacuggcugggcuggcacucacccucgacccaccugcucuguaaaugguagucuaucaguaguagguuccagguuccccagggcauguaggcagaguuagcggcugccaaguguucagagccacagcgcuccagguacucugggaccuucucuaucugcggugcucuuuagcuccugcggagaugcccaauugacaggagagccagugaggacaagaacgcucccuuccgacccaaguccacggcacccauggcucugccggccagucuguugccccugugcugcuuggcacucuuggcacuaucugcccagagcugcgggccgggccgaggaccgguuggccggcggcguuaugugcgcaagcaacuugugccucugcuauacaagcaguuugugcccaguaugcccgagcggacccugggcgcgagugggccagcggaggggaggguaacaagggggucggagcgcuuccgggaccucguacccaacuacaaccccgacauaaucuucaaggaugaggagaacagcggcgcagaccgccugaugacagagguaaggagaguuucuccccaccugcucuaccacaccaccagcuccucaauuuuccuacaacaacccuggaggaugaacuguuccuucauccccagagacccuaaacuaaaauaaaauaaagugagaucuccuucaucacacccuucaggaaagcaaauaaccugguggcuggauagugguucggagguauccaaauggggagagagucugcgauggggagggggaggaggaacugcccagugagagugaaucugggagaggcuggagcgagggcggggaaaggaggauggcggcaggcgagacgggaaauggcugaggcguggaccgggggucagucaccgagccaggcaggaagggcuggggugagcugggggccaggagcuggcuaugauagguagacugcauaaggcuuuacacuuagccuggcucuuggccugauguccaaaagcucugugagccaaaagaagggggcuggaaaagagaugggcaagagucagguuaccagaccagaccaucuaccuggggaugggguggccauuguccuuggcacgggaaagguagccuauacuagggucuaaacaacagacuuuggggugggggugaccaaaaaacaguccucagaacagacagacacaccugagaaucaaggguuucugggccaucuaaacucaccuuagcuugaggacucugcuuugaauaucagcuagcauucugggguacaugcuacagaggggcacugaaccaagccgacucagugggccauggcuuggaagggaagggcccagagccccuauggccagugcuguagagugucugacaggaaacucagaagacguguuucuccaucccaccccaccccucauuuuauaucugagagcugggcugcaggagaggaaaagcaacuuaaucaaagccucacagccaaauuguagcauugcugagagcagguucaggacuccugguucucaguccuaucuacuuuccauuacaccaccuaauugugugugcaaggggcaggcaggguagugugugugugugugugugugugugugguguacggauuuccucugacuaacugcauaguuuuccagguuaugugguuaggaaaaccuguacaggggagaaagaauuucuuuccucucccuuccuuuucucucucucucucucucucucucucucucucucucucucucucucucucucucuucuuuccuuacuuaucuauugagacacuacauagcccugacagaucuaaaauuugcuagguagcacucauagaaauccuccugccucuaccuccugauugcugggauggaaggugagaaccaauuacuccgagccaagaauccccucuugucccagugaugaagccauccucuuuccaguaaacugggaaggcccuucccuuccucaccuuggcccugggacauuacaguccuugccucuggcugaaaccugcaguagagggauagaacaagcgacaggcuuaggaggccuccaggggccugggaaaccccccuaacacacacacccaguccugcuuaucucccacacccugacugcaaaaggacuccauugaguuggcucuguacugggcuacugcccccgcaggucagggccuucuuaggggacaaaacgacacaaaguuagaaagagcuaccacuuguccagugccucugcagaggugaaguugacuagaaagaaggguagggggcaaaugucccucuagcaaacacuuccaguccaaguucgaggugagagacaaagaaaaaaguuguucucggccgguccuccugcgcuccugcuccugccuuguccccggcucuggcgcgccaaggucuccaacucccagaccggagcagccaagauaacuguggccucccucccccgggggugcaggcccgcggcuguggcuccuguugcuccacucccacccugagcagggaagugggggcagcuccacgccagggcagcuccauucucaggugcuucugcucccacgccuuucagggaugauucuggaacagagacgggcgagaugggggcucucaggacugacacaguggcagucuggccacgcugggggaggggaccuggcgggcgggagcggggauguagggcgcggcgcucugcccuuuccucucccugagccggggcggcugaaaagcgucuuuguagcuguagcugcugaguccgcuucucccgacgcguucccggccucggcccgagauucucgcuuaguuaagucaucccggagaauagccauugugcuucgugcagcccccgccacccaacccuuuuuccagcagccuugaucccacgcggcuccucuugggcaccucuguaggggcgcacccagaccaccaauggguuaacgcuagaggcugaaaggaggaggaggaaggaaggaaggaaggaaggaagcaaugcccagugccagggaaggcaaccaaacaaaagaugaaucagacggagggagggcagcuggggcccggggcggaggucaagcucaaauagggcucgauuggggagccaggcccucucuagccaaacuuccauucucccucucuacuacgguucucucugauugugaugaggucauggaacaaauaggggugaggggcgagcccuguuaaugugggaauaacuagguauguacacccccucucaacaucagaccgguucgguucuccaagcaugcccaggcaagggaguacagacuggugacugcaccuauucacauccucucuugcccacgacucccaaacgcugggagagggagugaaauggauccagagaauaaagaugcuuuaauguuccuucugccucgcccuucuucaccuugccuggugauggugggaagugggaaacccgcuucuuuauuccccccauuagcguugcaaagagcgggugaacgcucuagccaucgcggugaugaacauguggcccggaguacgccuacgugugacugaaggcugggacgaggacggccaccacgcacaggauucacuccacuacgaaggccgugccuuggacaucaccacgucugaccgugaccguaauaaguaugguuuguuggcgcgccuagcuguggaagccggauucgacugggucuacuacgagucccgcaaccacauccacguaucggucaaagcugguacaguagaggccagaugaugguccauccaaagggggcucuaccauagcuuucuugcuacccuaagggagaccaaccaggcuaaugcuuguaaaaacacucuuccauucccacuccugguggggcuagaucccugggaaauuaagcugucccggggcuggugaggucuacguugggcuugacccacaucuucgagacuguacuugcacuggcugauccggacuuaauccuuuuuauaauuguggcuugcagauaacucacuggcgguccgagccggaggcugcuuuccgggaaaugccacggugcgcuugcggagcggcgaacggaaggggcugagggaacuacaucguggugacuggguacuggccgcugaugcagcgggccgagugguacccacgccagugcugcucuuccuggaccgggaucugcagcgccgcgccucguucguggcuguggagaccgagcggccuccgcgcaaacuguugcucacacccuggcaucugguguucgcugcucgcgggccagcgccugcuccaggugacuuugcaccgguguucgcgcgccgcuuacgugcuggcgacucggugcuggcucccggcggggacgcgcuccagccggcgcgcguagcccgcguggcgcgcgaggaagccgugggcguguucgcaccgcucacugcgcacgggacgcugcuggucaacgacguccucgccuccugcuacgcgguucuagagagucaccagugggcccaccgcgccuucgccccuuugcggcugcugcacgcgcucggggcucugcucccugggggugcaguccagccgacuggcaugcauugguacucucgccuccuuuaccgcuuggccgaggaguuaaugggcugagcuuccaaggacagaaguccuccaagcuucauacgaaaucgaaaccgaagccccaagaccugcuggcugagaucuggggaugugagccgcaggugaugcugauaggggagggggugagaaaagagagagagagagaaaggugggcuguacuaggaacuucuugguuuaggcaacuuuuacccgagaagaguggugucugguccuugguaaccggguuugcugguaggcacucuuuaacgaggacuuuuuugcgucuuccccagucgcaccggauaauuuuauuuucuauuuauaauuuguaauaugaugaccugcuugcccagcccaccaaggugagggccuggagcuuggcuuuaacacagucugacccagcuagccagccaaccugacggcucacacccucacuuuucccugcaggugaguuaauaaagggaaggcuuuauuggaaaccaccuucacucaccuccaaagaggaggagaacccggacuaauccgaguccacaccuuacuuccaauuugcccuucuuccucagcacgaucuuccaaacccucuugcugcaaagggugucccaaccugucagcaauagaccagcaauguccugccccuuuuaagguacugguuccaccccuagucaggaccagaacuucacuugugaggaugcauaccaacugugagugggguggggcuaaccaaggcagcaggaggagcacuuggaguccucuauuguuagcuauucuggccuaucccuguaggcuguccauugaucaucagccuagaggucauccugccugcuaaaacggucugauuauuuucugggauuuugguaggccaacuggcgaaccauggguguuccuuacaauccgccacacauuuguggccaaaauaaagauucuagagugauccagaaugguggucaaauuccaggaguacaugcuuguaaucccaacacuuuggagauggcgaaggauagaacagaaagauaaugaguucaaggcuaacuugggcuguauaguagaacacgcgcuugcgcgcacacacacacacacacacacacacacacacagacagagacagauacggagacacagagaugcuggagggaaaauuuucucaugaccugaauaauuucucaaaaccuguuccagguuuuggcuuggguguaucuguggucaaguucuaguguggcauugugaguuuccuccuucgguccagugguuguuucuguugguuccccaucuaccguucuuucccggucucguuacaggcugggcuucucuaguuucucuggguguuuuggggggaauuuuuggacuccaacaucgcagaccacuggaaugcagguagauugaugucucugagcuagggaugggcauguaggacugcccuggaaguggauauuaccaucugagggauaguuaaggugggugguacuuccagggacugggcccaauccugcuacaauuguugcaaggaagauuggcucugcucugagcuuccaagccaaccaaguccaugcuguagauacguugcccucugguggcauuggagagaauucuaagcuuggggacaugugcuucccuuugguucccucuguaccaaagggaaauguacugcaugcugcaccagacuuacucauaggaacugacccagagggcagaacuaauguauguggcuugcguuaacuuuuagcaugguucgggauucucucucaauucuuggauuuuuuuuuuuuuucuuuuuuuacagcccuugugccuaguucagcucugaggcucugggaagcuugaaguguagauaauggugcagagugucccucacucuggugacccucaaguccuguggucagagauaauaguaaauagagcgucgaacaguuccugauaaagguccucuauucaccaaugcccaagucuacagaccaaauacccguugccacccugccuucuccuugccucagagacacaucucaaacaacagccuuuccuacuuucuuacccuacucuuagcugcaccucuuagauucugguaccuuucguuuuaucacccagguguugcugggcaaucuguuuacuaccuccccuaagcuaaguacuacugugucuaaacugcugaaacuaaagucuuuaaccagaaaaccaucauggcugacugggaauauacucaaguaguacagcauuagccuagugugcccagagcuccaauuucaauccgcaguaccacucaaauggcuaugcaaaauauuuggggagaaaaauucauuggcguucauuaaaucacauccuauagguuacuuucaggguuugaggcucaccucucucuccaacuuugucccuugaggccccuccccucauucuguccccuugaggcuccuccccucauucuguucccuugaggccccucccuuuaucuuuguccuccugaagccccucccagcuauguaaaaaacacgcgcuucaccugcaagcagguaaacgcaccacgugcuugcugcagguggucccacuaacuuggccgccgagcaccuuccaaccgcagcaacucuuuucaacccaggaacugagcagacgucgccgcgccgcguaggcuuugcauuccugucucagcugucuacuucauuucuacuacuccgcuaaaaggcuugccagcgcgugcauuucagggaugaguuuuguuugguuuuucaagcugggggcgcagagaggaggauugucuugaguucaagggcagccugggauacuuaguaaggcccggccacaaauaaaucuuauuauuuaaaauca

SEQ ID NO: 7986 - RNA, 6534 nt, Mus musculus
cggaauugugggaaagauuggccaucgagaccacuguugaccacacucugaacguagugcacggccggguuuugggaaccaugggcacuucuugcaggagauaggagccuaaugggugagagggcuggagguaccugaacuguuggagcccaacgagaacgaggagccaagaaauccuguguccacucggaccucacacccuggugggauguggucaggcccaggguggcuggagcucuguuaaucagaauugaagggcuccuccuggguggggagaucucugcaucuucagguuuccuuccaccggucuggaugagagggcucaccugcuccuuacuggcaggcaacugugaggcugccagaugauggagaugggggugggcaaugucucaccccaccccaccugagaguggccucaaacucgcagcuuccugcuucaggaagcucggauugcacacucccugcauaguuuaaagggugcugaccagcaagccaggaacauaggcgugcuuccggaucuccccuuccauaugccacuucuuuucacaccuacggauuuuauaccuuugagcaucuauucagcuguuuagccagaugaaacagagcacacagagacagucagcuugguuuuauuuuauuuuuuuaaaagauuuauuuauuauuauucauuaguacacuguagcugucuucagaugcaccagaagagggcgucagaucucauuacggaugguugugagccaccaugugguugcugggauuugaacucaggacguuuggaagagcagucagugcucuuaaccgcugagccaucucgccagcccucagcuugguuuuaaaagcgauugucuuccaaauaauuuccuugcccaaccccuugagucguuuuauuuuaaauauauaugcuuuuaguuaaacaauuuauuuuuauuauauguaaguacacuguagcugucuucagacacuccagaagagggagucagaucucauuaaggaugguugugagccaccaugugguugcugggauuugaacucaggaccuucggaagagcagucggugcucuuaaccucugagccaucucugcagucccccaacauuuuuuuuaaaaagauuuauuuauuuuaaguaugugaguacacugucacugucuucaggcacaccagaagacgacauuguauccuguuacaggugguccugagccacgaugugguugcugggaauugaacucaggaccucuggaagagcagccaccauucuuuuuuuuuuuuuuuuuuuuuccgagccaggguuucucuguguagcccuggcuguccuggaacucacuuuguagaccaggcuagccuugaacucagaaauucgccugccucugccucccgagugcugggauuaaagguguggaccaccgcgccccgcuagcagccaccauuuuuaaccacccucuccccagcccugaaacauaaaccagagcucauaaaagcacaaaguuggaaaccauaauauacaagcaaaagaccaguaagacaaacaaugcccaaacaaagccguaugagacaagaagucuaccaaacacaccacugaguuagucugauguuggcuaucuaccacugggcauggggcccaccccuaagugugguuagcacauccagugagauuccacuggggaagacuaacuuccuuugcaagcaguugucaauuggagguagcuucuugguuagggauggaagcuuguggcuucuguccccugccucucagccugggacccagucuggcuugagccugugcaggccccguguguccugccacagucucugugagcucacaugugcaucaguccugcugugucuggaagacuauguucuuuuagagccauccauccccuuuggcuguuaacaucuuuucugccuucucuucugaauaguuccuugagcccucaggggaguucccaacccguucugucuacaugaauccguuucuucuggagaaaauuuccaaaauguugugccuuaguuaucugcacacuaaaccuagcauucugcggcaugccgcucugcccacuugcucucugccuucugcgagggagaauucuugacaagaagcuguguccacaaugacugguuaaaucuucagugacugggggcuaaagagauggcucagcaguuaagagcacuggcuuuucuucuagagcaccgggguucaaugcccagcacccauauggcagcucacaacuguagcuccccuuccaggagaucugacucccucacacagacaggcaaaacaccaauguacauaaaauaaaaauaauaaauaaauaaaaaagcuucagugacugaaggagauggaaugguacaguuaagaaacagugagaggcuggagagauggcucagugguuaagagcacuggcugcuugcucuuccagagguccugaguucaauucccagcaaccaaaugguggcucacaacuuucucuccuagugucugcugcccucuucugggaugcagguguacauacauacagagcacucauuuacauaaaauaaaucuuuaaaaaagaaaagaaaccaacuacaauuuaccuugggccaucuuuaguucccgcccauucuuugccuaccucuauacagguggaaacuuuauggauuauauuaacaaaauccaguuuuccacccaucaaagggcuagaaaugcucucauccaucugaggccuguagcugagauucccucacaaggggcucuuucugauguuaacuccaguguguuuuuauuuuauuucuguguguuuugccugugugugcacaugcaugugugugugugugugugugugugugugugugugugugugugccccacaugcaugucugaaugucugaagccuauagaggucaggagaugacaucagauccccuggagcuggaguugaauaauugugcgccaucaugugguuucugggaaucaagccuagcuccuuuggaaacacaaaaguguucuuuuuuuucuuuuuucuuuuuguuuuuagagacaggguuucucuguguggcccuggcuauccuggaacucacucuguagaccaggcuggccucaaacucagaaaucugccugccucugccucccaagugcugagauuaaaggugugcuccaccacugccuggcacaauaaguguucuuaaucccugagccaucucuccaauccccaccaaagcauuuuuaaaauguccugagggcaggaggucgggaugcacaccuucaaucuuagcacacuggaugcugagaccugcaagucccugugcauuugaggccagccuuguccacauaagaaauuccaggccagccaaggcuaaauaauaaaacccugucucaaaauaaaauaaaaugccuugauuuauaacucucuguuauuuagccaucaaaacacccugcuucuaccuccagacagugaaauuugggaugaccuaaguccagauucugggucauagucucuaggauuuggaaccagaauaaacgaccucuucucucugaguugagaccuguguuucauugacacuucuaacuucaugaccucaccugaguucucagaucuguccuguucccucuaugccucuggcugcuguccauguugcugucuaucuguccaucuguccaucauuacuuccucagacaggcucuccuagagcccuucuguacacacacacacacacacauacacacacacucagucugggaacgauaccuccgucagcuauucccaccuucuggcuaacucuggcuaugugcucugagugguguuuauuuacucagagccgagcagugguggcgcaugccuuuaaucccagcacucaggaaacagaggcaggcagauuucuuuuuuuuuuuuuuuaaagauguauuuauuuauuauauguaaguacauuguagcugucuucagacacuccagaagagggagucagaucucguuucggaugguugugagccaccaugugguugcugggauuugaacucuggaccuucggaagagcagucgggugcucuuacccacugagccaucucagcagcccggcaggcagauuucugaguuugaagccagccuggucuacaaagugaguuccaggacagccacggcuguacagagaaaccuugucuugaaaaaaccaaaaaauaaaaaauaaaauaucuacucagaguauggagcucagcugggaauuauauauucaucaauaagaauacaaugauuauuuaccucugccuuuucugauagaaggugcugagaugaccccucuaucucagugguucucacccuuccuaaugcugcgacccuuuaauacaguuccucguguuguggugagccccaaccauaacauuauuucauugauacuuaauaacuaauuuugcuacuguuguuaaucauaauguaaauacuugacauacaggaaauuugaugcgcugccccaaauggguuacggcccacagguugagaacugcuacucuuucaucugccuccauauuuucaguggcuugaagugagcacuuacacagagaccgaaaucugugcugaaugagacuguaaauggcugaacaaauccaugaggcaagauuggaagugagagcccagcuccuggaaggcaaaagcauagcaucgucuguuagaggccagggcgccacagaguaaguaagaccuugucgcuaaaaugaggagggguugagagauggcucagucagggaagugcuugccacacaagcaugagggccagaguucuacccucaggacccacuccaaaagcugggugugguggcucaugcuuauaaucccggugcugaggaggcauagaaagggcaaugucugggccuccguggucugcugcaguaaaucuccaaccccaauaaguccaugcaaaaaccacacaacucaguuacaauauuuauaagcugcacgaacacccagacugggcagaucuaccacuacacuacucuaauccccagcugugaggucccuugcugcuuguggcuucuccagaccaugugguucugcuccaucuuccuuccaccuccucuucuagcaucuuuuccagcucgugucuccaaccuccauuuucuggagcaaaggagguagcucaaaacuacaugcuacaacggucagccagcuucaccuaaucauuaagaccuaaguucuagugagaauguuucaaaucagcaaacacagccuggagacaugucucaacaguuccuagcucacgcugugcuuccagagaaccugcguuugguucucagcccccaaagucucuguucacaucuaucgauaacucuagcuacaagggaucugacaccuucuuaaggccucuaugggucuuaaacacgugacaugagcucagacauacacacauauacacauaaauacaaauuuaaagaaagcaagcugaagaccaacacuggagguugacaucuggccuccacagguguaugcacauguguguaccugcguacagauacauacuugaagggacucuagacagccccagaauggcaaacacagcccugguagaccucaccucuccugucugccuagcuaaaaaccauuagauuccauuccugaagcuagcccccaagguccauucccuuauuuggccacuuccuucucuugaggcugacuaccaagguccagcuaucaaaguauugaagaccagcaaucuaaagcccacuuuggcuguccuaaucaaccuguccaaucaaaaugagacacuucauccuaacaugcaguuucuuuccccuuucuuaaccuuuaaaaccugacauuuuccuauggaucaccucugucucuauucagaggcaguccuuuguuccuggccccaccccaggacaaauacccuuuccccuucuccuuuguucccuuacccuucucccucauccucuaucuuagugucuucagacacaccagaagaaagcaucagaucccauuauagauaguugugagccaccauguaguuacugggaauugaacucaggaccucugaaagagcaaucagugcucuuaaccauugagccaucucuccagcccccuaucuuuguccucccugggcaaauacaucuccuuugugcugagcacuuggucuugaagugucugagcaaauacaguugucuuacacagacacaggcacacagacacacagacacacagacacacacacacacagacacacacacacacacacacacacacacacacacuggagcaaaugccagugcucagguggguuguauagagagagaccagaccuaucaacaucuagucaguuucccuuuuaauuuuuccuccccccuucccuuccuuuucuuuuagugcuauggauuaagccagugcucugucugcaugcacaccugcaugccagaagagagcauuggaucccauuacagaugguugugagaccccaugugguugcugggaaaugaacucaggaucucugggagagcagccggugcucuuaaccacugggccaucuauccagcaccucauuaugcauauaaagugaaaaaauaaaauaaauaaauga

SEQ ID NO: 7987 - RNA, 9147 nt, Mus musculus
uucgcaacccggaaguagaugugucucacggaagccggcuuuggcccugcggcuccugccgucgccgcggagaaauuguuggagcuggcagccuaggaauggugagaccccgcgacucgucuccuaguguucugaguagaccuggagggugaaguggaguuucccaacgugccucggggcacaaccccacaacaagauuuggggccccgccccgguaucgccccgaaaaaucugcgcaugcguaaguccgaucaggccaggcucuggccugcgguguuacgcaugcgcacagguggcaugcuugaggugggaugagaauugucugggaguugguccugguucgcuaccaccggccugugggccucagagccagauggcgagaucgaugcaguaguauggagccgaagaguugacuaaauuaccacugcuccccagagucccugaaacagaccugcacugaucccucaccuugggggugcccugucgggaggagggaagggaaggagggcaagcacuuugccuuaguugcucgugggacuggacaccugcaccccccuucugugguacccacggagcuggucguggagcguccuuaaaggcagagccagaacuuugcucuacgagacgccggagucaggaggggcggggcugccaaagcgcuggguauucauacaguucccaaaccacguuugaaucguccgaaggaaccacccgcuuuaguaaaagcugcaaauggaagggaaagcaaaaggguagcgagauagugggauuccaucuaccuucccaggcuguggccugggggcaggcuggugcugcugauuugaguagacaggcaaaggaaaacaaaugagucaggaaucccuugacccuuucugguuaacguuccaaaugcuuaauuuaggauucacugguaaaauuaagagagaucucugagccuaauacguuuuuucccacaucuuuuuaucauucacacaaaggccucagugacucccacauagcuacuuauauuuuuuguuuuuauuguuuggagcagaggcucaccauuauauagauagcccuggcuugcucuguagacgaggcuggccuuaaagucaacagagauccaccugccucuaccucuaccucuaccucuaccucuaccucuaccucuaccucuaccucuaccucuaccuccgccuccacaugcugggauuaacugucagagccaucagaccagguaauagcuacuaaugguuaggugcaauugagaguagagcucuuuugccucuucccacuaccucagacagggugcacgagugcacgaggauaagggauuggucagucaguagguuuggccuguuggaaacccgagccugagggagccuuaccucuccuucccagacucucuucucagcauccaagcucgcuuggucagaacccuuggaugagccugugggacccuuccuccuagcccugugguuuggagccggaggcuuugggacugugagaggauggacaaagguagugugaggcccggccaucuccccaagcucucgggcgccaggcagccucugacucuaccccuugccuugcacgagugucucucggucuuggcccggcaaugccaccuaccaccccccuccccugggccagcaccacccaugugccucucggcagagccacaauugccucaguugcuguggagcuucugcucuuuggcacaaugcauuuugauagccaagggagcaguuaugcucagagcccaccccgugugucggccucaucagccugaccugagcaccugugcugcaccccaugacccguggcaccaggaggucugagcccggaugggaucuggauggccaaggaggaaugccugccucaaagaccaagccucagggaggccgggcaagggcugaggggcugacacaaggguccgugcacagaggucacccuuucucuuuccuagauucucaggggcugcuagacucgucccugauggcgucaggcacagccagccgcuccgaggaugaggagucacuggcagggcagaagcgagcauccucccaggcccugggcacuauccccaaacgcagaagcuccuccagguagccugggcucagagcgccuggaaggggaggcauguggggcuaggcacgcccuugcuagccuugguuugaaauggccuucugagccugccuggguucugagccugccugggguccaagcaaagccuugugcuuuuccuuuaccuccucugccgguguguccggauggcaccgaggauggagagugagggguuccaucucuguugaaagguugccuguuaccucagaggacuagaacuuggcuuuuccauguccacugagccagacacugcuggaaagugaaggcaguuaguucccaaggggagccugcaccuuggaagccgugcgugggugugguaccaguaguuaacccugcaggaccuuccacagguucaucaaaaggaagaaauucgaugaugaacugguagagagcagccuggccaaauccuccacccgggugaagggggccggcgggguggagucaggccgcugcucagggagcgagcccuccucuagugagaagaagaagguaaggggcugggcagcugggugaggccugccagggacugcacugcccagcccccaucccagaccccuccguccugucucuccugcucccucccuugcugcgucccucgccagugcauccuggaucgcauuccgugugggaggcagggagcucguaucuauucugggagcagacagcuuguucccagcauugcaggguguaaaaauaacccccagguggcauugcucuggccccagacagugcagcagcaagaguaguuuccuggcauccccccaccugcccuccuuucuggggcugagggcgccacaagcagagagaggaccccacccagucaagaaagauacacaaggacuugggcgggggugggcauuagaaagcuccgcucucagcuuggcucccugguguugucagagccugcggcugucacaguaugugaugcaguagguccgaagccccagcucuucugacaccagcucugaguucacuguggucccguccuguacccagguauccaaggcucccaguacuccuguaccucccagcccugccccaaccccugggcugaccaagcgugugaagaaaagcaaacagccacuucaggugaccaaggaucugggccgauggaagccugcagaugaccuccuccucaucaaugcugugcugcagguacccaccaugggccuggggcuccaucccuccuguccuccaauuuccaguccccauacuagcuuagcagaacccuguggcuuccaagggaaggauuuuucccagugcugagcuagagcaaaccguucuggggucuugcagacuaacgaccugacaucuguccaccugggugugaaguucagcugccgcuucacccuucgggaaguucaggagcgcugguacgcccugcucuacgacccugucaucuccaagugagugggcuggcuucagcagaggggaggacuggggcuccccaauuuuggaacuugguauaggagggccagauucaaccaggacccaaaggagggucuugggaggcagggccauggggcuuuguagccucuggguuaaccuggggaccuacugggcauucuggagugucuccuuucuuuaaccucugcuagucccagauggaggucagcguccuggcaugggacauaaaugccuacaaaugccaggagccucaguuccaccagugugugccuugggccacuucugaacuguccacacuggccugucacagguccugauaagaagagggaucuggccuucccguacucaggaggcagaggcauuggcugaguuggaggccagccugcucuacagagugacuucuaggacagccacgacuacagagagaaacucucucuaaaacaaaugcgagagagacagaaacagagacagacagagacagacacugagagagacacugacauaaaagcccaagacccgucuaguguuagcaaaguuucaaguaagcucuugcacauacauaccauacuccuccucaguuucuuaauucaguguccucagagcuugguuugaaucugaacacccaucuucuacuccuccacagcccuaccaccuacucaagcuguagccauagucccgagagaccagaaaauggcuuggccucagcuuggaaaaaggaggccgugggcaguggguaaugaggaagggcugggaagagaguugcagaugaucccagggugucucagaagccggccucuugucugcuugcuuugagcuggggucucuguauggguggcugauggugagagcuuacucuguagaccagacuggccuugaaccuugagcagccgcagguucccgggcuccuucacuggaccuugcccugguuauuucuaccacaggccucuaggcucaggaucucuauauuccaaagacuuauagguuuugcggggaguaggaaccccagauuacuugacgccuuccuuuucaguuuucccuuccuuucuuucuucccaugugcaggcuggcuugccaggccaugaggcaguuacacccagaagccauugcagccauucagagcaaggcccuguucagcaaggcugaggagcagcugcugagcaaagugggaucaguaagugggcaggccacgcgcugggccgauggaaaccggcaguguagggaguccuguugucccggauggggucugcauacaucugcaggggucuugauggaaaccaugccuggccucuggugacuguugcuuuuuccaguuccuuggccuggggacagggaugggguaggaaugaagaaacccaggcaugaagagaauguuucugaucuccagagcagccagcccaccuuggagaccuuccaggacuugcugcauacacacccugaugccuucuaccuggcucguacugccaaggcucugcaggcccacuggcagcucaugaaacaguauuaccuacucgaggaucagacagguaacggacaccccaggagcugucgggagcagucagguguucaggugugggaacaugugccaagugcugcaggugcaguugccugccagcguccugugagagaguucucagcagccccguguguguccuccucaccuccaucugccaaaacagcagcaacagaaccugcugccuuguagugcuggcagggccuuuggcaucauggaauggggaaccagcuugccugcuauccugagccaaaaguccaaauaguaguuaguauuacuacuucuuguuuagguuuuuuguuguuguuuuguuucuugacauauuuggccaucacaugaacaguauguuuaguguauuauuuauggggagccugaaaacuagagcaaacugggcaugucgucucuagucacuuccccccacaagauucucacccuggcuuucuuuccagccugcauccuccuuccauugccuugcuccuggaccagggagucuguguggucaggugguuuagcccuaaaauccccagcagggcuucauauuuaggccccguccauccucuucccuaagggcugggaggccuucugccaccucucaccgccaagcuaggaaagccaccggguuggacuguaggaggccugcagggggacuggugacccagguucugguucguaggguucaggcccacuccucguggcaaaauccacugccugcugcacugugcaccgccauagcucuuccugcugccugggaguaaagccuuccuugcccuagcaugcuccugcagcucagguucggaaagauggccacggccggaugguaggacauguguccccucgugauaguguuccgggggcuugccgucuuacccaucauguaauccucacaggacguuuggcagacagcauuuauuuuuacuguuuuaaagccagcuugcucccucuuuuuguuguugccguuuuggguuuuuuuuuuuucgguuuuguuuuguuuguuuuguuuugagucuugguuuucuacagcucaggcugaccucuugccuccgucucccaaaaacuggaacuauagguuugcagcaccacauccugcugcuuuugucaugauucuggaaauuguucuguucccugaaagucguguguguaaaauaaucuucccccaagaguuucaguuucucauuuguugcuuagagcuggguguccccaggaucaggcaguuuucuuggcuuagcuagcagguuagucacacauuuagaguccuggaugucaagaagaccugguggaaggcggcuuggugggaguggacaaccuaguccucuguccgcacagacugacagggcagagcugugcugccuguccauaccccaccccacccucagcugaagcugccggcugcccagcagagcagcuccgcaggggggacaccucuagccaagcucuaauauccugggcacccuguccucuuccauucuagccagagacaguugaaaacuuugacgaaacaacauacuugauagguucuaauauuaauuauccugcuuuauuucaucccuugaaaacaauaaagcugccgggcggugguggugcacaccuuuaaucccagcacuugggaggcagaggcaggcggauuucugaguucgaggccagccuggucuacagagugaguuccaggacagccagggcuauuauacagagaaacccugucucgaaaaacaaaaacaacaacaaaaaaagaaaacaauaaagcuaauugcagggcccauaaggaggucauucucuauagacugagguagcagcagcucucagucagugccuuccaguggaacgugucucuugguuggccagaaggcuggggacaguuuggucguggcugugcccugacuugggucagaguuuagucugccucuguuacucuccucacuuguacaagggagcugagcagcccucccgcuuaguuuaagacuugacaagugagccugccguguagcagaagcccauguaggucagcuguaguuuugucuugacccaccucugucccaaguuaaguggcaggaugcguugugucaagucagagugucggcugcuugggacugugaucccucuguggcucuggcugcagcagggcuguguccuucccccuggcugcuccgcucgccuggcuguggggcagcuggggcuggaggaggaaccuccacauuuauacgccuuuguugucuauucagugcagccacugccuaagggggaccaagugcucaacuucucagaugcagaggaccugauugacgacaguaagcucaagugaguuccuggagaggguugacuccacauugucgggcacaccaggcugcccagcaggcgcuucaguugcagcugcugggcuuagccacccugcugcacccucuccugugggggccgcuucagcucacugccuucccuuucccuccaccguagucccagggcuaggccaaggcuugaacaacuuucugagccucuuggcugagaagccuggggugcuguggugggccagguagcaggggccugcuagugacaaguccuuuuugauacucagggacaugcgagaugaaguccuggaacaugguaagucugcccugcugaggacggggugggaacggaagcucuuacuggaacagaggggaccaguucaaggugcugguggcaccagagucucuucuuucacuucaccucagagcugacaguggcugaccggcgccagaaacgagagauccggcagcuggaacaggaacugcauaaguggcaggugcuaguggacagcaucacaggugaggcgucucggggacagugcucccuggcaccgcugucccauggagcccaucccgugccuggcuggcuggcuguugacuagggccacgcccugcugcccugccccagccuuacguggucuuugcuccucucgcaggcaugggcucuccagacuucgacaaccagacccuggccgugcugcggggccgcauggugcgguaccuaaugcgcucucgugaggugagacaggcugucacuguccccacccugccuaggcacccacccucucuaucgucccuuucucugcccgguccuugauuucuugucuuucccuggccuguguggggcuucuuuuccucauuccuugacugagcccucaccuccaucauuuucccagauaacccugggcagagcaaccaaggacaaccagauugacguggaccugucucuggaggguccggcuuggaagaucucccgaaagcaaggugugcccacucugccgguccccaggagcaggagggagcuccucugagcccuaagccauggagccuagagaauccuuaggacuuagugaugaaggccaaaggaguuggcgcuuugagaucucuaccuugggaccucaagugcuugcacgccuucauacccaggaagcagagggacacuuggcugucuccuguuugucacugucuugucauuucuuuuacuuucugccucuacaggugucaucaaguugaaaaacaauggugacuucuucauugccaacgagggccggcggcccaucuauaucgaugggcgaccagugcugugcggcuccaaguggcgccuuagcaacaacucugugguagaggugagucgggugaggacgugucucaccugcugccugaggcugggccguggguguggcucugucccuccagacucagccaucuuucucuccugcacagaucgccagccugcgauucgucuuccucaucaaccaggaccucauugcccucauccgggcugaggcugccaagaucaccccacagugaggcgguagcagaaaccagggcauucuccagccucaguuucccugucauuccagcucccuugagcugggaacucaggcuccuggaaaacccuuguacccagaguggggaguggaggcccgacugcuggcccauugauugagccuuugaggcaagguggggucaccauggggaagccaggagaggcugggaccccugugccuccccagagccagagccccaccaucgccaccauugucacuccugugucuccagugagucagcuuuagacuccuuuuuguuuuuguuuuuguaaauaaaaaguacugaguuccaaaguag

SEQ ID NO: 7988 - RNA, 1098 nt, Mus musculus
guuuuuguuuuauuuuuauuuuauuuauauauuuauugugauaggcuuuguuuggucgguugguuuuuguuuucugagacacauuuuuaccucauaucacaagcuggccugaaacuauggcaguccuccugcuuuagccuccugaaggccagcgaggauguuagccacugugccccacugaguuuuggcuaaacuuggucugaaccaugucuucuccaucauauuccugggaaccagaauuuggggauuucacuucugcauaguagagauuguuucucugagacuuuuugcgcauucagguguguaaagaacugcaucgguuugagaagcucauggaguauuuccgaaaugaggacagcaacauugacuucauggugaggaccugggucugggccagaugcaugccaugucuacugaagcauugcugcugaggccagggccgcacuguguucugaggcugccucucuuccccagguggccugcaugcaguucaucaacauuguggugcacucgguagaggacaugaacuuccggguccaccugcaauaugaguuuaccaaguuggggcuggaggaauuccuccagguaagcugaguaugaccuuggaaaggugaaguguuucaggguacagucagcuuagacacauaacuaaguacaaguaagaauauaguccuagauggaucugaaaccuuccuguuuuuggccugggaccuggguccuucugccaaugucuggaagacacugcucugggaagagcugugaagcagggacggggcacugaggguuuccaggaggccugugcugacuccguacaugcugcucuucacuuuuccacagaagucgaggcacacggagagcgagaaguugcaggugcagauucaagcguaccuggacaauguguuugacguggggggcuuguuggaagaugcagaaaccaagaauguagcccuggaaaagguggaagaacuggaggagcaugugucccauguaaguguccuuugcuugccagagccacuguggaaggcugggcacagcugggcucuagaaaugcaggagcugaccuaccugccuccaguggagccacagggaacccugaga

SEQ ID NO: 7989 - RNA, 2176 nt, Mus musculus
uccccuccccccugcggagaaacacucuuccucaggccggagcugaccugcaaagccuucgcggugcucccggugcuccuggugcuggggaucgggaugccaggcccggccgagugggacuggagccggggcauuuagaacagagaaaacuaaguagguuugcgcgggcccacgggcaugcgcgucugcuuccgugggucugggcgugcacguguaugugguugagagcguguuuguaauuugcugcauacguguuaggugcaaaucuacaggaagaggcuugagugucuccuuggccugaaaugcacccgccucucuuuuccaucucuaggucggggaccucccagaaaucuggaaacuggaagcgaggaacaggcacauguguagaaagcagugcugguuuaagaagcaaggcagacccaggcgugguugcucaugagaaauccucgcacuugugaggcagaggcagguagaucuguagugcagaaaaaagagacugugguugguuuuuagcuacuuucugucagggaagaagaaaguacaguccagucacuucacuaaccgggaggaaacaagcuaacucuugcaggccuuugcaacuuaagagcucaguacgguuguccuuggucuguuuguuguuacugauugguugagacaggaucucuaacucuggcuagccaggaacucaugauauaggccuggcugaccuugaacuugucaugauccuauagcuucugucuccauuuugguccuuaaacacuuccuugcccuucgguggauaccuuauaauccucagcuauaugcacuguauuaacuggccuggaugcgcacacaggggaauucagagguaucuuuggacacuuuguauauuuuauuaauauugcuucucucuuagguguacaaaugagacuuaaagcaaaauuaguccaguaaaagaacgggugcccuacaagaauguaggguggucagguuggcugggaugcauuuaagggguccucucugaagaaggcauuuuagagugggagucuaaagauggagaacuugaguaggacccaggcaggaauaaagacaagugauuggcaagaagcuaauuaccagagugggauagcaagcaaauccucuuuuguaggggggggggggcaaugcaagagguuuuaucuggaaaacagaaugagcauuuauauaagggagucauuuuggauuaaacaacaacaacagaagaagaagaagaagaagaagaacaacaacaacaacaacaacaacaacaacaacaacaacaaccaccaccaccaccaccaccuccggucucgcugugcaauucaggcagacuuccaacgcucugccccccagugucaggacacaggugucauguacugggugucaggaccgcaggugugccaccaggccuagagcaugcaugcacacaccaagcaugcacucuggugccgagccaaauccacagccuuccacucccucuucaucuuguuucuugauguucuuugagggugccuuuggacacuacaggacugauuaauccuuggccagucaucccguauuuacggaauagggauuaaugugcugaccccggggggauaacaauaauuagacacaaucuccccucaaaggguuuugaagcccaacacaaaugauguaucugcgguucuugcgucuugggauggaaaucuuaaguccgucagguauuucuaacuauuuuaaauguuuugcaggugacugaauuuuuggaagcaaaugacaucuagauugguuggguuuuuguuuuguuuuguuuuguuuguuuguuugguugguugguugaucgagacugaguguacuggaauucucucuagaccaugcuggccucgaacucagagaucuaccugccuuugccucucuccugagugcugggauugaaggugcgcgccauugcccggcuuagaguguuuguuuuauguuuuguuuugucucuuucaugugcucacccuuauuuaguaggcacagacagagcauuuguccauggccuugcccuccuggcuggcccuggagcacuugcuauuuugauaggcuucaggcuucagcugugaagcuguagcagcgcuccacgguuauuuucuugggugaggcuugcuacguuuugacucgguuuuacuaaucaauuuauuaaaagucugaagcccca

SEQ ID NO: 7990 - RNA, 4476 nt, Mus musculus
ugagcaugagugagggugugacaucgcaagugggagaugugacuggccacugucccaagaggcuuuuggagggagaugaaggcacaauaugaagauuggugguuuauugggaaacgcccaacccgaauaccagcagcgucccccccauccuccgccccaucuuaaccagaaauaaauaagauggcacucgacgaaccaucuaucucucuccugaagagcucucaggcaauguccccucugucuaccugggggaaggcuuuggcacaugagauacuggguuggagagauaaacagggcuaucaccccuuucugggaugguccugaacugcugugagcuuggcacugccuucacaaucucugaggucugagcuguggcagucguucugccuaauuccaaagaggcccugucccuggcccacacccaagugucccaucaugggcuucugcucccaucccauccccgugugcggcauggggauccaaugcugccucuccagcugagaggaugcuagggagaggugcuccaaacucuucgucuuccuuuucuccagugguccaggggcugagggacuggccccugcccggugccggucagugugccgucagcucgauggucuucuuccgcuccucucuaugaucuucccaguccuccucuggcucauaugugccuuugaccacagccacacggucguggaggcucagcgaggaggggaaaagcaaguagaaguagaggauugcagccaggacggcccccacgaucgguccuacccagaagaccugugaagacagaguuagaucagaggaggagccucagggcucagggaccaugaucuuccccaccagagcacagaccccauggacccugaaaggaaauggacgcauagaucuccaggccuccagaaggaacggugucuuucaucuccggggcugauuacugugaaccaguccuuacugacaaggucauggaccacagacccucuaaggaggcaggcagagcccaggagagacaggauucccaaucccaccccaaagagaggcaagugaguuuucuaaggagacagacagagccuccaaaacaugugucuuccaaaaugcagggcccagcaaggcucuaccauccuuuuuggagcuucaagcuuggcuagcacauggagacacuguccagggguacagucccagaagaacaagccccaauaucuccauagggacaaauaaauacagcaucagaggacagauacacagaggggcagacaaaguccucagauuaacacagacccccugauguagcuucaagcuuggcuaacacauggagacgcugucaagggguacagucccagaagaacaagccccaauaucuucauagggacaaauaaauacagcaucagaggacagauacacagaggggcagacaaaguccucagauuaacacagaccccacccccacucccauguacuucuaaagacauucucuguccaacccccaagaucugguccgacaacacccagaauguccagucaauucuggauuuucaguucaguacgcugccguguuuucaggagccgggggaaggcccgcacucacccagugagaggggcugaaccgauucaugaccaccgcagggccgaaagaucgggcuggguucauggaacagccggugaaguagaucuggguagauaggggggucacggugaggagggugccaucccuuccacucccacagaauucugacucucucucagggucacacagugugggaaccagccacaccucaaauccagguuucucagucccuaggaugcugacugcccacgcagcccagcugcccaccaaaccacauuucuuaagcaccugcucuggcuugagucucugugcucgcccucccuuccacuuacucagcuucucaguccauggagggucuuggggggggaugggcaacaucaaaccuagaguccaguaaggcuacagcuuagauacccaagaccagaucuuaaacucuaucgggucuuaucuaucuggaggagcuggcauucugggguuccacuguucaucuccaugacaccccgguuugugccagcacuacucacccccacaagauggcccagugugaccgacaagccaauggauaaggcuggggagcccaccgggcuggugcggcgggaguccguggaggagaagaugcagagggccagcuggaaagucaagauuaacuccaccaccacggccuugccugguguuguguuguugcugagcugcaaggaagagcuggguuaggacccugcuagcagccuucaggcucggugacaggcuagacaaguaagguucuggucuucaaggacaccuagagccugagcucuuggaagucaaguccccugcaugauccagacaggcgauuuguuggagaaacugcacuucagugugcgcaagcuugaagcucaggccuguagccagaggguagggugucagcaaguuuuccugggugccaucgugucaacggcucugcccaauccccagcccccaugagcuggcauuuacccucccuccugugggcagcugcccaguuugccuacugcaaacagccccuggccuccuauccaugccugacccgcugccggugccaacuucaaacccgucucuccagugugucugacucacagcuugacaauggccgagaaaauccuccucuguguuugauuaaugagcccaguucacaugggacagggggcugaaucuagggcugcaaagauggagagacagcaggggggcaggagcagggguuacaaaagggggagccagcacugggggugcaucacaucauggcuucuaaguguaauccccagggcacuggcugugcucugaucaccuccaugucauggguaguaaacuggaagcccagggagaucacgguugcuccagaccuccauccaucacuauccauggcuccuuggugggucccuuaaaacuacaccaccaaggggggucacaagaaagaagucacaggugagauuagagauggaagggauguuuuggcggcccuggggaguuaggccagggaaugcagcauaggagagggagggguagaugagggagaaugugaagagaagccaggacccgggagcacugagguuggccaggagguuggucagccugcucuuacuggcuaaguuaugcccugguguuuugguuguacccauucucaagauggaggagcauggaaggucuggucugaaauguccccagggucccugcccaucccuccacagucugguggacacucaccgcauugacggccagguuaccccgggcauugccuggcgccaaccaguacaggaugccugcuccagcaauggcacccaccagcugggcugccacguagaagauggcucggagcagagagaucugguugccuauuaagagggccagaguaauggccggauugauguggccaccacucacaggucccagggcuugggccaagguaccuauggccaggccaaaggcuauggagaucugcagaauggugggcagcgccgagggccacuugagugccgagcccaggccaaagaagacgaagaugaggguggccaggaacucugcgaacacggccuugaagaaggcaacugaacacaccuccuucuucaugguggccuugggggcccgguggcagcggcugcgucgcggggcggccgucggggcggcgcuggcagcggcgggcgucugucugcggggcucugcgcgacgugcggugcccacuccguggcaggcggccuggcgcggaccgggcaggggcgcgcuauauagagggcgcgcgccccgcggcgggcagagcgcgggggggccgggggcggcucccgcgcccagaggccagcgcagcgcgcagggagcgagccuggcgggcgcgcgcucgcagccccccgccccgcgcacccccggccccccggccgcacagcggcggacccgcccgggccacgugacccacgcggcaguguagacuggcccggcggucugggucgcgcgcaucgugcgcucagcgcugcucccgcgcccuccuggucgacgugcgugcugggcucuccuggcggcugagcgcggucccggcucuccucucgcaccgagcucuggaagucccucuccggccggccuuuaccggcguccggggccggccggcagccuuccccuuuucuccuccuugggcucgcgcgaccggagcaucuugacccggucggucucacccacggacgggucagagugaugagagucucugaggacagcgccucuuagcuccuuauccgcccguggcgggggcgguucggcgaucgugggccucuccccgguccagcccggcaggagcgggggcguuggaucgggaguacagugccagccugcucugcgcucggcaauccucgacgccgcguguggcggugccucuaggcagcgggcucuaggaggcguucucagugguagcccuuggggacccu

SEQ ID NO: 7991 - RNA, 4089 nt, Mus musculus
uacaguaacugcaacaacaaucaucauuuauuggaguguucuaccagcauuuaauuccccaaagcauucucaucguugccacagcaccccggagggagggagaaguaugcccauucuacaguggauaagcugaaauccagagaggauaccccaccaccccacgacccccuuugauuagccgaguagaugugcaguggccuucaauguguagcaaaaacaauucaacucccagggucuuuuagaggcacuaagccuguagucucuacuuucugggccacucuauagccucacuauuuaacagggaccaagguguugaaaaucagaccuuagaggcuucuggcccaggguauagaccgaguguggcaugggggugggguggggacgugggcuuccucuguaucaccuugucccagguagagaucuuccugagcauuugggaacagagagaccuuuuggaagagcgaccuuuguccucaggaaaccccaaaccacaccuaggacagagaaaucuuucaagaagcucaggcaaucccuaaaacugguauugccccaucuuagugggcucugaagcuccuucaucagaguccaagcagaauggauauuugggacccaauuccccuuucuccaagacagggauccagcggcccaggaugcccacugggguccugcugugugguuucugccucccugugcucuugccguuaagaaacagaaaagggucaggaaacuagaaccuugaccaugggagcaggaagaaggcacaugggagaggcugagaggacgagggagaggggcugggaggacugggguagauugagggggcuagggagaggggaccagggguacugggguuaucuggggggaugagggagaggggcuggggggacugggguagauugagggggcuagggagaggggaccagggguacugggguagucuggggggaccagggagaggggacuggaguagauugagggaacuaaggagaggggacugggguagacuggauaacuagggagaggacuggacaggggagacuggggaggcugggggaagagggcaacagaaaacaggaaacaugaaagcaacauuacagcagaaguggagggccuugggaggguaaggugaggaccagcaggaaguggccaggagguacugggaggggagccagggaggggaucagcaaaggccaagcgugaaugaaaaugaccggacagccuccucacacggagaagucaaacacugaaagaaagaagaaaacagggaaggcaaguuggaaaauuaacuggauggauuuaccuccagauucuuucugucuaugaaugcagaagcuggucguggugguaucccuaagucccgucuauuucacaggccaagcggauggggguggaggggcugggaggcauugggaauggaaggucagccugcacaauguaugucaagagaggaaacguggaaaggaaacaacuguuugcuuauggacagagauugguuccuacuuuuagaacaggaggcuaaaucuccugaucacccacacaccagggccaccucaaacccaaggccugcccuggaggcccaaggggccagaggcugucacacgcucacuucuguguccucagaguuugucugugauucuuucuucuggggcuccaggucuaccacuuucuccaccuuuguggugcccacaaggauggccaaucgcugggcuacagucuuggugucagggaacaagauaaaguuguagaucagcgaagccaggacagccccugugagcgguccuacccagaagaucugaggacagagacguaguugugagcgcaagguaguuucagaaaccugccugcuucccuagcacugagugguguccccagcuccagccccagagacucaccaaacgccuacaaggcaugagcccaagggugaggggaccuugccuuucccuggaguggggccuuggaggaugcgaccaaagcuaaaacugggcucaagucuccucacccacuccugcgucuuccucucaccucuccuguuuuagcucugacuauugcuguuucugucugugcuucuguguggucuauuucuguuugucuuuucuuuauucaaguuugaaauuugguccagcuggagaaggcgaagaaggaaacggccggaacaggaaaccugggccaaggcugcaguuucugcccuggcccauuuugugugagucccuggauacugcaggauauuggagcugaaagucaaugcaagccgggacacucaccuuggcuuuuugaauguagggaaagcugcacuccugggugguuuaaauagccugggagggcaggagcugguuuauucaacucuauauggauuuccuaauagcaaaaccugcuaucucuauuccuucugccuaaccccaccaccacacacccucaaggcuaccaguggaggaccucacccaauggacugcgaacuucccaacaaugacggcagggccgaaggagcgggcuggguucauggaacagccagugaaguagaucugguagggcaaagaaugaggguuugaggcagccuggaggaggacguuuccccacuguccuagcucagaauauuagagggcauuccuucagccacaagagaggaggggcuuagggagaacauuuccuggccuuuuaugguccuguagccuuuagggccuuaggguucuucagggagaguucccguaugugcacaugcaugguguccuccuuugucucuuaccccaaugagguggcccagugccacagagguuccaaucauggcagcuggggacgccaaggucugccggccauccauggaagcaaagacacagagcaccagcugcagcgucagaaccagcuccacggccaccgccuggccaguugaugugcuguuguggaccuuagcagagaggauugcacuggaguggacuugggcucugagcacaggacagugagacucccuaguccuuccuacucuccccggcugagggcugaugcaggacccuaaggaggucuguggggucugugcagccggcucgcauugcauccggaugccugcuccccgugcaagugccugacacgucucccacucucccauugagugaggcccgcgguucaacggugccucagaaguuaaggagugaugaaaaagcuugagggaagaauggaggggcugcggguagagguggaagcagauggagcaaagaugaugagaggagugaagcaggccucggaaacagagaaaccagcaggauacacagagagaguacaaggccaguuagguagggcucucccucucccucucccucucccucucccucucccucucccucucccucucccucucccucuccuucucucucucuccucucccucucccucucccucucccucucccucucccucucccucucccucucccucucccucucaagcccagcuuggcuccucgcugacagcucuuagcugccccugauucccuccccuucguauugucucggugucccaucuguuuaucacaccauguugccauuucugucuggccuaggugaaugcuuaaaugggagaggaacccggggcagcucagaauagcuacauuguuuccuccugucuggccucccaccgugaccaucugacucccucaggugcccuaucaucugccacaugacugggccucuuugcaccuaccacguugaccccaagggucucucgaauaccuccuggaguuaccccguaaagaagagcagccccagcuguggccccagccagcugcgcagcgauauaggccauagcccgaggcagagagauaugggaucccacgagguaggccagggucacagcaggguuggcgugggccccgcuggucuuccaggagaucugcacggcuguggcuguggccagauugaaggugauggcgaucuggagcacagagggaagcgccacaggccagggcagaacagagcccacaccaaagaaaacguacagccccguggccaggaacucagcaaaaagcgccuugcugauggcgguccaaagcccgccaaccagaagguaagcccugcuacacagcccuggcuccaugucuuguca

SEQ ID NO: 7992 - RNA, 31167 nt, Mus musculus
cgugauuuugaaccggaucuggcggcgcgguuuuacacugccguuagugaggcgcgucgcugguagacagcagcccuccuggggcgcggcggccggagagugagcgccgcgggccggacgggguugcgugugcgcggggccgggagccucgguaagccggucgaggucgcgagcgagcgagcgagcgggcggcggggaggcgggcgaggggagggggcggcgggacccggcugcucucggcguggcgcuccuugcaaagucggggcguccuuuugaggcguggccggccgggugcgggugugguucccucaagguggucuuggcgagccccagugccgggcgugggaauggcggggagagcccccucauacccuuuuccgaggaacagucucuuuugagggagaaaucagguguuuggggaacccggcggccugacguggagagccucuaccuucuaggcugucucccacaaggcucauuagaacaucccuaguuguggagaguuggaauguugcaaauucggagccuaucucgggugauuuuuuuuuuccaggccccccccccuuuuaauaauuuauugcccaccucugucacugaccuaccuacuguucugugauuugcaugugaaacccuuugggguguauuaauuuauaugaacagcuuccaccaacagaaaagcuaagacuuguucuuaacuauaaaacguagugagaaugguuauaucacaacguaguauuuugguauucuggauucauguucacuagccagggucacuuauauuuggcucacucauuucccuuggaaugagagcuuuguuuuugugccucagaaagagaggaagaaagagaggaagagggggagagacugacugcaguacucccaauaguguaucggaagguuauuggauuuacuguuuaccuuuuaaaguucuaucacuccuaaauaaacuggacuccguguaugugugguagugucuuauguagcccaggcuggccucuuguagccaaggauaaccuuggacuucugagccuccuguccuuggagugcugggauuacaggcauuacaggauaacuuggagauuacaugugugaucugccauucucaguauuugcuguguugaggacagaaaccaggggcuugucaugcuagagagacaugguaucagcugagcuacaggccagcacaauuguacauguaauuucacguaagacugucuucuacuaaccuuuaaaaccucuguggacugaugaggcugcaugucaggcugccagggugcaguaaagauagggacucuuaugcuguguuagacuucagugcugucugcuggucaacuuggcuuuuggguugaugaaagguagguguguguuuguuucuguuuuuauuucuauucugagacaggguuuugcuguguguaacagcucuguauguccuggaacucuguagaccaggcuggccuggaacucacagagaucugccuaccucuaugucuccuaagcacugggauucaaggugugugcugccauucuccgggugaaagguaauucaggccaaaauuucaucugauagucacaaggaggugucugguguguuaguggagcuaaagaucacucagauaauuuggcugcagaucugagacauucuaucaaacucuccacaaauacagacccuccaaucuuagccuuauacuuuuuugguucuguuugguuuuuguuuuuugagauagcuuuauagaauuauaacauugacuuuuaccccuggguuuccccccauauaagguuuuuauaccaugcuacauuaauaaaaaaccuguugcaccaagccuugggcacuguucuagauaccaguggcucugcaaaguccuugcuuuccagacaguaaacuaagugaacauaucagguggagacaagugcucuggagcagaagcaaccaggaguuauggaaaauaguguggcuggaagagacuucacugagaaguaaacucccaggggugggguggauggggacuggaugagauggggggacuguccaugcuagagauggcagcagagaguaaccggaaaccggaguccaaagagaaugacuagaucagugguagcccaacucuucagugcuugcucaguggagacaagaugcuaacaaucaaacacagugugugcccugcuauggagcucugauggaauaugcugggcaaagggcuggcugaggguaaugaggucuguguugugcucuuuaaaggucauucuuuuccccucccccagcauauauucacauugugagaucugucugucugaguugcagucacuaggaaaagugauugcugagacagacucugggugggccucacaggaagcagucagugugcugaacuuacccaucacacccaguucucccccccucccccccucuggucuucacucauggugagcugggaacauuuuguuuacucuuucugcaauugauuugcucauagggacgauuggucucacgauggcauuucuucugucaguuggauggagccucugacacagagcagaagccggacacuuagggagaugaauuguucucgagugcuuuugaaugaaagcaacuuagucugagcuugucuuuaguaggaguaugucuguggcagugggaaaccuacacuguuaaugucuugggaaucuccagaacagcaauguguauaauaauguuuuucauuaaaauacuuugcuggaaaacaaaaucaagcaaucugccguugcuuugucuuaugcaauguaacacucgaugcagcuaaaaaaaaaaaaaaaaaaaaaaacccugauauauaguuuuuuuuuuuaauaauguuauuuguaggacgaguauagaugccuuucccaggauacccugcaguaagaucuguaauagucuguuguucugaaggacugucugucucuuuccugggugauugaaauuaaauugggggcucaaagcaaucauagcaagcugagagucuuucuccugguguugccaaauugcucccuuagggauacucacagauagggaguguaacacagugacuucuuuaccucuggggcucccaucaauagcagcugagauucugggcaccuuuuguuuaaagugcucacaggggccuuugcaguguugucaaaaggcagcagccucugcuuugcaagugacagcugcuccacagcugagagcagcgcucugcagcucgacugcuucugccuccucucacauuacugcaucuccuagccaugcugcuaaauaauaaaggggggggggaugaaaauguggccgagcaggaaaauuaaagccauucucaacugacacugaaaaggccgagugaguuuuaccucuccacauuaugauuugagagucaguagucaugcagaggggugggguuugucaucuauaaauaauuccugagagucacuucuguagaugguuaguaagacuauaugagccccagcacauaaaaagaaguauauuuuacuaaaccaaguuuugauucccaaaccuauauuugcugagcaaaccucuauuagaggagggaaaacgagcucucuucagaagcaggagcuucaucaaggacagcuugugagacaggccagaaguuugcagucuuucugcucuggguucuagcugacaccuguguuuauacacauggcugugcuuugcgugacuguucugcuuuauaauauuuuaguguguuaggguggaaagaaaacagacaccugggugucacugggggcucagcguuuagucauuucagguuucugagccuuuaaguugucugugaaauggcagcuuaguuaauuagauucacaugaaggaaaaaugugaaaugucaaguuuaguacucaauucacagcaaaggcauauauuaaauauuauguaguacuauuuuaaaaaauagucugugcuucugaauucaguggagccucauguggagacagucuagacaacuuaggggaaauuacuagaguugugaaucacucuuccagaaucuaauuaacagcuaucagacccggaaccacacaaagacccaggcuuguuuucauuagcuguacuuucgauaggguucgguuuauguguuacagcauucucaccugcauuugcauucuccugugaggcgggugguguccuuuccacucuguagauggccucaggaguuacugaccaaaagugaagccgucugcguggguaggguccuagcgucacuguccugccucuacucacaaugaugcugagguggcgugacaaguacugugucuauuucaugucuagacaccauguuaagcacugugugcuuguguguuuuaauaccguagcaggucacgcaagauuucuguccucaguaaaguuaaacuagugugucugaauagcaacugaugagagugucgggguaugggcuggaagacaggguuggaggcagaaagucagucugacugagcugugacaguuguuagggaugaggaggcugugacccaucugugagaaaaaucugcagaaaagggaaaaaccaacaauauuucugaaauuuggaacugaacaugaaaauaggaagauaaaaauugguagucagagccaggccugguguuguacaccuucaauccuaccacucaggaggcagaggcaggccugguggugcacaccuucaauccuaccacucaggaggcagaggcaguuguaucuugaguucaaggccagccuggucuauagcacgaguuccaagcuagcauaggcuacauggugagacccugucucaagaauuaacaguaacaccugggagucaguaggacagcugauguauaugaaggagaggagagacugggauuucaggaaguucacguagagucaccuugagaacuacagcacuugaguugacagacuguagagagaagucgguguggccaacuaucagagccugggugguggcuggaguagaguaguuagaugaauucagagaauuugaggaguuaauuuagguaauguuugucacuaggaaggauaccugcacugcugguaagccuggaggaacugacagagcuaaaaauugccucucugcuuacaauagagcauuaggauuuuaaauaguuaccuccgagguacagagacaucaaagagaccagugugacacuguaucugacagcuacuguggugcaguguaucauguaagucugugguuuuggaaucagguuuguuuuugagaccccugcuuucuuuagcuugacagaguggcucaugccuuacaauaucagcaguugggaggcugauaguaggagugcuauggguucaaagccagccugagcugucucaaaacaacccuuuccucaaaaccacaguaaaccaaccuccaagccuuacuuacucccuggaauaaacacaggggaagaguaacaaacgaaagaagcuggaggauucuguuuuuaucucuacugcugucacagaauacuuacacuggguaauuugugaagaauagauacuuugugugugugcacagggaccaggucagccuccagcgguguucuucggggagcuguccaugugggcuuuggcuuuguuuauuugagauagggucuuacuaugugugaccuuaacucgcagagaccuuggcugcuucugccuucccagugcugggauuaaaugauggagagaaaggcuugcggcugcucucugaggauccuucuauugcuuccccaggucaccugcuccgcuuagagucuguuccucucuuucauuuugugugggguaguguuguguauguggcauggcaucccggugcuggcuucguguuugguugugggauugcgcugcgguuguugagccggugcaggagggcccuuauccccugagccgugggugcugaggaucagacuuggguccucaugcuggugcagcagguucaucauggugagcucucuaccucucccacccccagacaggcauuuauuucuuagcgguuagaaaguccaagaugaaagugccagcagacggcuuggucaggauuucccauuuccacgccgccgccuuuuuaugaucuccuguggcagaagagcaauagugccuucaggaaccuuuccaaggacaccccaguuccuugacauccuaguucugcugcauagggaauucaguuucagcuugcauuguggagaggcacaagcagagagcgucaggccaggucaggccuuacugucauuuaagacacauuuuugaugguuauuuugagaugaggucuugucauguaccccccuggccuggagcuugugaccauccugccuuuaucucuaguacugagcuuuuaguguacaguaccacgccugcuugaaaauaguuuuugccugcuguaguggugcacaccuuuaauuccagugacaggcagaucucuggguuccagaacaggucuuaaaaacaagaaaagccacuccucccauuuucaacaucaugguugccacagaaacugcucguccgagucccuuagcagaagguuucuuguucugaauugcagggcacacuuaugaugcugagguagaagcaggguucacuuaggauucugagguagaagagaucaaugucccguguuaaagcugcuggcuaguggccuccguguuuacuggagccagaggagaugaucgugugagucgaugcugaguguucugcucugcagcaccugcuuguggguuuguuaagucuguggaccucaugccuuccacgugucuucugcuggccucacugucugaugcgggguuagucugucugguugcuuagcagcuuaccauggcuaguugccuggaaccgggucugucuccaguugaagagcauggcucagcccaguucagguuaaacugcagacaagcuuggagcugcuagaauuuauuucauuuuauuuacuauuauagcagcuguuuuauaacuacaaaugaauauuucugcaguguuuaauacaaaauauuuuuaugcucacacauuccuuuguucuuugugggguuuggguuuuuuguuuguuucuuuuccuuuguccauuucuuagugucauagcuugcaguacaaucuuacauuuacaaaaauugcuagaaaaucaaaauagaguucugaaacuauuuuucagauagaguggucacuuagagcaucggggguaaggaaagcaugagaaccucuaauggguucugagaguguuuuauucuugagugaaauuuggcuauuuucuuuacuuuauaauuucugucacauucaguaaauguccuucuugaccacuaaaugaacuuauuuuucuaauccauuccuggcugaagacuguuuggaacagagcugccuggaaggccugaguuuuuaauguacuguuuagcaggucuuugggagaaaacacaaagccugacauucccucuacagagcacgcuacaaaugguuuuccuuugcccuugucacugugaaggugguguauugucucucugacgccugugguauaacauaauccuccgccuauacuuaggauaaauuuauuagacacagucccugcaugcaguccaauagagagccccgcacuacagaaauaauucuugugcugcugagcuggcaguuucccuacuuaaucacugugugaugucaccugggccauuggugagaaaugugcugaccacguccugccuuuuaagagacaguugugacaggauguuagccaaaagugaaauuaaaaauaaacauucuaaguuacauuauagguuuucaaagucugaaagauuaaaguaacaaaaauguuaaguuagagccgggagggcgugguggcacacgccuuugaucccagcacucgggaggcagaggcaggcguauuucugaguucgagaccagccuggucuacaaagugaguuccaggacagccagggcuauacagagagaaacccugucucgaaaaacaaaacaaacacaaaguuaaguuagguuugaagaagcacauuuugugguguuauuuacaauccauugacaugcucauuccuacugaaggcaguuagcaccagcgucuuugugaggaguaagggacucgcauagacuaggcagggaaggcaagcguccucagugguccuagugcuuucuaguuuguaaguccaucuuugguuuuguuuuuaucuuuuuuuuuuuuuuuuuccgagacaggguuucucuguguagcccuggcuguccuggaacucacucuguagaccaggacccaaacccaagagaucugcuugcuuuugcaccucaagacuaaaucuaaaggugugcaccgcuacagccuggcuuuauaagugagucuuuuauugcaacuucgaucuggcacaugcuuguaaucucagcauuuggaaggcuggggcaggaagauugugaguucaaggccagccugaguaacacagugagagauugucuuaaaauauaaacaagcagccuggucggaugauguaugccuuuaauccuagcauagacagaucucuuaaaucaacggggggggggggggggggggaggagggagaaacaaaaaaagaaacaaaaggaaagacguuuuaauauaacuuaagaucacgaagaauugucggcgugagauucuuacgauguggcugcagagaggagagcccaggugucggccacugguggauuuacuagguugaugcaggaucuuuugugagggggagaaagcagcuuccuccuaauguauauuugauuucuuggcagaaagauggauacuacaauggugaauuuguggacucuguuugagcagcuugugcgccggauggagauuaucaaugaaggaaaugaaagcaguaagucauccugagccgggcuggggaggguggggagcaagcaugggggacaaagucagaaggcagcccagcagaccugcuucucuauaacgccuaagcguguugcaguccaaaagcugguguacuuucagguucccuaaaaaauaacagauggcugcuuauggccaaaggcaaaagucgguugcauuguguucuguguuggggaccccaugggagccagaggagggcaagggagccucuggagcugcagguaccagaugucgugagccucccgggaugggugcaggaagcuaacucagguccucccuacccccagccgcuguuuuuacgggaacuuuauguaguuagcuaacuuucuugcuuucucucucucucucuccuucuuucuuuccuuccuucuuucuuucucaaagauuuaucuauuuauuuuauguaugugaguacacuguagcuguacagaugguugugagccaucaugugguuuuuggcaauugaauuuuuaggaccucugcuugcucaggcccaaagauuuauuuauuauuauaccuaaguacacuggagcugucuucagacacaccaggagaucucauuacgucacacauucugccagccuugcuuuuuuacuuucuucuuccuugggugucuuuucauagaguagugaguauuaauugccauuuucuuauuccaugaagugggaaaagucuggauuucucagcauguugcuuuuuuucccuuuuuaaagaggguuggucuugggcuggugagauggcuccauaguuaagagcacugacugcucuucugacgguccugaguucaaaucccagcaaccacaugguggcucacaaccaucuguaaugagaucugacacccucuucuggugugucugaagacugcuacaguguacuuacauacaauaauaaauaaaucuuugggcuggauugaguugggccggaguaagcagaggaccugaguucaauucccggcaaccacaugauggcucacaaccaucuguacagcuacaguguaucauauacauaaaauaaauaaaaauaaaucucuaaaaaaaaaaaaaagaagguuggucucauacuguggcccagacaguugaagucauggcaguccucuugccucagccuccuuacuacaugcacaaagccaccucaugcagcucuguuccuccugcucccacauaggccggccuccaguucacugaguaguccaggcuggucuaaaagcucuguuuuuccugcaugucugugugaagguauugcauccccugcagcuggaguuauagacaguugugagcugccauaugggugcugggaauugaaccuaggucucuggaagagcagccagugcucucauucacugagccaucucuucagcccuaauuuuugaugcuugauauuuacuuugccuaagauaacuuucauacuaucuuauuuugcuaaauuagucugcugcuaauagaaguucccuuaugacccacuuauaccuuccuucucucccucccuuuuuuuccuccuuccuuccugguuucuggagacaggguuucucuguguagcccuggcuguccuguaacucacucuauagaccaggcuggcuucaaacucacagagcucugccugccucugccuccugagugcugggauuaaaaguguguaccaccauggaccuggcucaauuucucucuuuucuuucucucuuucuuucugucugucugucugucugucucucuuuucgggacaggguuucccuguguagcccuggcuguccuggaacucacuuuguagacugggcuggccuugaacucagaaaucugccugccucugccucccaagugcuggaauuaaagaugugcaucaccacuguccagcuucaauuucucuugaaugaguuuguauacuaaauuggaagacuagacacauuaaaauugcuuguauguuguauauuucuguacagguuuaaauuuguauagcaaaaauacccuaccuaaaacucccauaaaucugguugcuucaugugacuguggcuuaguuuuacccuguaggauguugguggaggagacugaugcuuagagauaggcugagguuaacucgggccuuguaaggcaguugcacuuaggacagucuuucccaacagcaggagauaaaaugaaugcugccaggugucuugcuuugaggugcuugcuuugaggugcuucaugcugcuuaagaguguugucuuugcagacguuuggacagucuccacucugccaccagugacuuuccaagagccaguguggccguuucugcucuuacccugugguguuugcuuacccuucagggccagcacuguuaaacuggcucuugauuuucuuuuuccuuuucuuuuuuuuuuuuuuuuuuuugguuuuucgagacaggguuucucuguguagcccuggcuguccuggaacucacucuguaaaccuggcuggccucgaacucagaaauccgccugccucugccucccgagugcugggauuaaaggugugcaccaccaugcccugcggcucuugacuuucuaaucauauuuguauaauuaauuauuacugaauaggauuaucggucuucgauaucuaucauauuuauccacaucuacuagagcauauuguagcaguuauaccugaauuugcuguuuaacucuggcucagcaauaugugacugugaaggagguuguuuuuauuuuaugugacuguccuggugugugacagcuaccccaaagguaucccucuuugauugccuucuguucaggagcuuucagcauuggugacaucuggagccaggugacuaaugcgucacauacuccauagcagaugcccugguuaggccaaaagugcaugaccuauugaaucaggcauugcuuuccacuaagcugcuguccgcagugaacaacaggguuuguuccuggucauuuucagauguguuugaccauauaguccagcaagacuuuauauuugggaugaagcuaacuauaggaccuauuuauuugagcagcuauaucuuugcuauuuggauuauugaaguuuuuaccuguccucaguugaauucauccagguugugaaggacuucgaggacuuccgaaagaaguaucaaagaaccaaccaggagcuggagaaauucaaagaccuauuguugaaagcagagacugggcggagcgcccuggacgugaagcugaagcaugcccguaaucaaguggacguggagaucaagcggaggcagcgcgcugaggcagagugugcaaagcuggugugcauugcuuugcuuaucaaacuggugauggggugggaagacgugguuuggugagguuucugcugaacaugcagacccaguuucucuucuacaugaagagcucacuugacaucuggcaugugauuagagaugaaacugaagccugugacuucaguuucauagauugaaacuuucagucuuuucguuugaaaauuuauuuucuccuuuaggcuugaaacaguuuuucacuagacagguuucaaaugagaguuuaaagaauuaaaacaaagcagccaaagauguaaaguuggugaaaugugugccuggcaugcacagagccuuggacuccagaacaagaagagaauucuagaauacuuaucuaauacaauuuauuugcuauucuuggacugcagagauggcucagugguuaagagcgcugacugcucuuccgaagguccugagcucaauucccagcaaccacaugguggcucacaaccauccauaaugagaucugacgcucucuucaggugugucugaagacagcuacaguauacuuaaauauacuaauaaauaauuuuuuuuuguuuuguuuuuugagacaggguuucucuguauagcccuggcuguccuggaacucacuuuguagaccaggcuggccucgaacugagaaaucugccugccucugccucccaagugcugggauuaaaggugugugccaccacugcgcggcuauaaauaaaucuuuuuuuuuuaaaagaacaaaaagaaagaaaagaaacacuguacucuauuaaaaaaaaaaacaauuuauuugcuauucuguaggugugggugugugucuuuugagacagggugcuacuauauaaucccugauggccuuaaacucaggagugauccuccuuccucugcuucaugaauaauggguuuagugaugcaugccaccaugccuggccuauauuguuuauuauaaauucaaagaacgggcuggugagacggcucaguggguaagagcacccgacugcucuuccgaaggucacgaguucaaaucccagcaaccacauggugggucauagacauccauagcgagaucugacucucucuucuggagugucuaaggacagcuacaguguacuuacauauaauaaauaaauagauaaauaaauaaauacauaaauacauaaauaaaucuuaaaaaaaguucaaggucaaaaaaaauuaauucaaagaacauugcccuccuuuuaugaauugguggcacuggcccuuugucaucacggcuguauagcacaggguaaagggcuggaugcagucauagucaagcagugugguuggaaggcaguguguugucuugguugucagggugggucaggguacaguggaggacguuagucaaggggacuaguccaucguagcucaguguagaugccucggggugcccaggcugcauuacagcuuugugucuauuuuaagguauuuuguuccaacauguagagaaauaugcgacuuccuucuuugauccauaaaagaagccaguaauuguucugauaaagacaacacuuuaaauauuccugcucugugagaucuauucuggggcucucauucuagagcucucuccuuggcuuagcaguuuaaucuaaaggucucaggggggaucuugcuguucuagaugggguuguucuuacucaucagaagccggccacagucugggcuugaugugaauuaauauucuauuguuguaaugccuuccugaaggcccauuugcauaauguauuuuaaugucuugugccuauccauaaauuugaggugaagcuuuuuucucuggcuuguugugauguuccacucugcuuuggucuguaggaacaacagauucagcugauucgagacauacucaugugugacacaucuggcaguauucagcugagcgaggaacaaaaaucagcucucgcuuuccucaaccgaggccaagcauccaguggccacgccggcaacaauaggugggggacugcaucuguuguuaucugaucacugcugcacagcugucugucaggaguccacugcuucuuuccgggaugugugcugaacgcagcagaaggagccucgggggcgggcggcuggggaaggugaggggggggagaggccaaaaacccacccuccauuugcuuucauugucuuuuaagcuuugcuuaggguguugucucacuguggguacaguuuuaauguugguguuaaauuacacaucaauaacuacuccuguacaauaacuaaggacugagaaggugaaaagggcuguucagcaauacuuucgcgcuguuuguucucuggagagcucuuguggcugcugggagcuaagaccagacgaucauuuugguuccgcagucacuggaacaguugcagccaggcuuuggauguaacacagcaaauaggaagaggcuuaugccguccgaguugcuuguuuuguaggcugguugguccgaggggaaucuuacuuuguucgguguggugagauagggccuuagggaguagccugccuuucucuuccucccgaaugcugggguuagagcuucgaugccgcugcccagcucacauggaaucuguaacuaggaaaaauacaugauucucauuuuuuuaagauuaaaaauaugaguauuuaugggugaggguaagccauauguguagggagcccaugaaaaccagaagaagguacugagucucuggcaugagagcuauagaagauuaaagcugccaggaacugaacuccauucaauucuggaagaauagaaugugcucuuaaucacugagcaucucagccccacccccaacccagucuguauuuugaggcggggucuuucauaucucaggcuggcuuugaacuucugaucuucugccuguacaucgaaaaugcugcaauuaccugcaugaaccccuaucuccagcuugggcuuaaugucuucaaaagccagugcuggggcuggggguaggcccagauaacagagucccagaaccuugaaaacugggccuggagcuacacauuugugaucccagcgcuagggaagcugaaaaucaucuccugggauaaaagaaguucaugggcagccugggcuggaggccuugucagaagcccagugcuggguaguacuugcuuguaggcagcagcagccuugcuuggauucagauugaaccuuagccugcauccuuguaguacacacucagcaagaaaagccccaugggccuggcugcaguacucugagcuggucugcacucacgcugccccguggagcccaccgagagaggcucccugcagcucaggcuucagcugugcccucugggagcucgcucgcucuuguuaccugaccggugggacuuugaggugcugauggcuuuuaugucuuauggugcucugugucuaacacuguuacuguuuuuaauccagacugucaacgauugaugaaucugguuccauuuuaucagauaucagcuuugacaagacugaugaaucacugguaauaaacauuugauuucuagaguuaucuacuuuuguuaaccuacuccugcagcagcaucucuggcccugucccuggccauccuuuacgacgguuguauuaguugauuuguuacagacucugagcuaguaauuuaaaauauaaauccacaagcuauaagauacugacuuaaauauuuaguuucuggaguaagaaugugaaauauaggauuugcuuugagguugaugaucucugaaggguuucugagaggaaccuguaguaguugguuaugucuugacuuguuaaagcucuagaaguuagugagacugaccaggcaagguguuuuacuuuacguuuuugggauaaggucucguguaguaggugugucuguccuggagcuuacuauguagacacagggaaagcuucuuugcugcugcugaggugaauagauuuaucuuauguccaaauuagucugguucuugaggaagccuuagccauccuucacauuauuaaaaggaaaccaaagcccuuaacgucaucuagaugggugugauuuaaauuacugggcagcauauuaagcaauuaagcaaugguuugcuauguuuaaacauguuaccuuuugugggcagcagaccugguggaguuuccauauaaaagguaauauuucauauaccugcugaaauuuuagucuuuaauguugaggagacuggcaguccacugguaauuuaucauuucuguggaaggcugaaacccugcaaacaaaauaaaguacaggaaauuguuaguaugugauuuuuuuuaaaaauauuuauuuauuuauuauauaucaguacacuguaguugucuucagccacaccagaagagggcaucagauuucauuacagaugguugugagccaccaugugguugcugggaauugaacucaggaccucuggaagagcagucagugcucuuaaccgcugagccaucucuccagcccaguaugugauuuuuugauggaaaagcagauagcagguacuuaucacaugccuaguaguguuuuuacuuguucaaccagagaagcagaugucaauuuuaagguuauaaauauugggcaaccaccuucugaaaaacagaaugaugcaggacaggucuuagguauauaaucaaacaucaggugaguuccgaggaaagccucugcuguguuagcuguuaaaauuggagcugaucaacccauagcgagauuacuugaccgugaauuggggaagugcaguccugucaagucacuguuuguuguucuugcuguuuccaggaacuguguuuuuagggcuaaccaggaguaggggaaucauggguagauacuaaacugaaggccagugauuacaauaacggaggugaaaccagaccgugguaaaaagcauucaaggguaaacuugcucuuaggaccacggaagagggacuccgaggguuauauaaguuaagcuaacuuuuuaagugacacaguugacgguaacaaucacuugaggaaagagucacaucucacauggucaguacaaugucuucuauucucuaaguucuaaaacuaauuagagaaguaaugagcaguaaagacccaggcuccugagguggucacgacgggagcugacucucugaccuccccugucucuguggcauugcuuccugagucugucaccgcugcuucaauauuugaaggaaguccauuaacugcagcuuuggaacaaaugccagagaccuucuucauuccucucccggggcucuaaguucgcuagucugacuuguuuacugaaaauuuauuugcguaggauuuaugcgugaccucaccaaaggaagagauuaacauagucuaauugccaacaggacugggauucuucuuuggugaagaauuucaaaaugaagaaacgagagaagaggguauguauguucuuguucccccgccccaguggggcuugaaugcacggcagguacacucacuguaucuccucaccaagugcuagguuguccuuagcuccuguguaaccaagcuuugauugugacccuucugccucagucugccaggugacuggaauauaagccuuugccaucaggcucagaaguuuagauguuuuacauuuuauaaaauaaagagguuuuuguguuuguuuguuucuuuuuucuuuucuuuucuuuuuuuuuuuuuuuuuuuuuuuuugccugacaucaugucccacacugugauccuaacacuaagaaaacugagucagaaagaucauaauuugaggccucuaauuaauauggacaagguugaacuacauuucuauauccuauuuaaaaaaaguacaacaggccugagagauugcuugcaugcaguuagaagcacuugauguucuuguagaggaccucgauggaguuccuucauggugacucacaaaugucugacaccccaguuucagaggaucuaacgccuuuagugguagccuccaugggcuauagccaugagugugguauguacacaugaauguaggcuaauacuaaugcacauacuaucaacauaaacaugaagagaaaaaccaaccagcaaaaauccccauugguaaguuuuucuuuuugggaaauucggauacaaaacugacacaucucuagacauuauuaaacaaaagcacaaaauguaggucagcugugguggugccugcuuuuauuccaggcagaggcagguggauuuaacacagccuagucuuuguauuuauuacuauugugugugugauguggccaugugagugcaaguacaagcacacuuaccucagugugugugggugcuccucuccaagccccuguggguucugggaauugaacgcagguccucaggcuugcacagugagcaugaguccuguaggggccauagugauacugcuuaaagugugacucagggcaagauucuacuuuauuuuaugggucugggcuauaucuucauauaguaagaaagaauauauuugaguuuguuuugaguugucaugugaauuuuuuauacaaacauuuugugcucuaauguaugcuucagaagcagugugugcauaaugggauauggagagcuaucugugcugacgugcuuagcguauuugauguguuuccaaagacuucauguccuuagauaggauuacaguucuacuuuuucugauucuguaucaaaagcuugucucuuuuuuucuauagcucugaaagcauuuuuguguuuguuuaacaaaugggccaugagaaagagcacauuguuacuuauuguagcccugguucuuggagcuugcauguaguugucugauaggauuacuguguuuucuggguuucaguucuacuugacacugaaguuugaucuuauucccucuccagcgcuccaacaguagacaguucaucgacggcccuccugggccugugaagaaaacuuguuccauuggcucuacaguagaccagguaagagggguuggggccagagaacugggguccuaaacacaccuggagucaguggcucugcacagugugguagcagucgguauuacuacaguguuauuugaggaaguuagagaguuguucuguauaguaagauugcccaugugaggggacuuugaguaagaccugucagcuaagccgggcaugaugugauggcgcacgccuuuaauccccgcacuuuggagaccgacgcagguagaucucugugagucugaggccagcuuggucuaacaucguuccaggacagccagagcuacaaagcaggaaucugucucaagacaaacaagaaaaauagaacugucuaggucugauggucuuuuguugugucuguacgccugcaguguauaagauuucagccuaaggacuuagggcuggaauguaaaucuuacucgggauuuggggauuuuuaccuacuggaaaauaccuguauagaaacaaaguuagucuguuuaucuuucuuucauuauggguuuucuuucaggcaaaugaaucaauaguugcaaaaacuacagugacuguucccagugaugggggacccauugaagcugugucuacuauugagacauugccguccuggaccaggagucgcgggaagucaggucugaugaacuuagagcuacauugccuccuuaccgcugcagagcugccugugguggcaucucuauaagcugagauggggaacugggaauuaguggguagccuaggcuucauacugacuucaagaccaguccuugcauacauggugagaccaaaaaccagcugcucuuauagaaggaagacauagguuuaguuccuagcacccagaggguggcuuacagucaucuguaacuccagaccuaaggaaccugaugcacccuucuggucaccuuagguacugcaccauacuugugguauacagauucauucagacaagcacucacacacauaaugagucucaaaaaauaaaauaaaaagaagggaaaaaagaaaagccagcugugacaucuuguaccugaaagugaguugagccaccuaggugcugagacaggcaaaacaaucauguuugaggcuagccuuggcuaccaaaaccaaacauaaauaaaacacugguuaaaauugagaguugguuucugagaagccucuugagacaggaugugcuggggugggagguucuugcugccugcccgaugcugccaagggguggugugcucacugcccucacugccugcccgaugcugccgagagggggagguucucacugccuacugagagguuccucugcugcucuuuacuucuagggucuggccaggaugagugugcacuacuaguggaguauuguagcuuuucuuggaaacucugugugugugugugugugugugugugugugugcuuuugcuacuaucaguuauauuaaaagaaguuaaaaagagaaaaugggauuaaauuuggucuuuuucuaggaccuuuacaaccugugaacagugacuccgcucugaacagcaggccacuggagccaagaacugacacagacaauuugggcacaccucagaauacuggaggcaugcgcuugcacgacuucgucucaaagacgguaagucugacauggcuucauuucuucugaggcaauuagugugauuuuggagacagauucauucuuuguagcccagguuggccuccagcucuguuguaccuucugcuuuggccuccagcaugcugggauuguagcaccuucucaccucuccuguuugguuaucuuuuuauuuagggggcuggggacauuguuucuuuuuguuuagcuuguuuuguuuuuuucaagacaggauuucucuguguagccccaaugcuauuggaauuccaucugugucaggcuggccaugaauuugagauuuaccugccucugccucccaagugcugggauuaaaagggugaacaucuacacgagacuuuauugggcugauuuuauauacacucacauaugcuaauuuuauucaaagaaaaugacuguuuucuuucuuuuuuuaauauauuuuuaauuuuguuuauuuauuauacauaaguacacuguagcugucuucagacaccccaaaagagggcaucagaucucauuacaggugguugugagccaccaugugguugcuuggauuugaacacagaaccuccggaagagcagucagugcucuuucuuaccugcugagccaucucgccagcccagaaaugacaauuuuccaugucccugcugagugggggcgugcacaugccauggcugguucucccuccaccauaagcauccuggggauugaacccaggccauucggcuugguggcagugccuuuacccacaggacuuuugguagagcaguugaugcucuuaacugcugaaccaucucuucagcaacccccccuuuaauuucuuuaaaauuaccuucaugauauugcugaucuuaguguagggugucaggucauuuggagugggaacuauaggcaauugugagcugcccaaugagugcugggaauuggauugugugcuuugcaagaauaauaaguucucuuaggcucugaguugucuuuguagcuccauuggccucugccaugcuggaauuauaggugugagccaccguugccuggcuuugcucauccauuuaaauguacaaccugcugacauucagcguagucauauaauuggguaucugucaacaguagcaauuuuagaacaguuuuacccccaaaagugaaauccuaaaccuaauagaauuucccccacuguccuaugccacaccaacauccaguagccauuggcugccaccauagacaccacucuugucucuaugggcugucuauuguaagacauuuccuauacacgaggcauauaguaugugugccuuugugucuggccucucucagucagucaccccuucucuagccuguuuguuuuguuucucuuuauuaauuugaugaaugaugucaccuauauggaaagcauaugccgcauauccauccaucaguggacagagcuugaggguuuucuaucuucaucugcuacauaugugcacaaaugucucguagacguuuuuguuccuguuggauaugcgucucuagaagugguguugcugggucguuuuguagcuaugcuuaucuuucugagguucuccuagaccuucccucagguggcuacuguauuuuauuuuacauugcugaguaguguaugacuuucagcuucucuagauuuugucaacacuuacuaaacguaugacaagcucuguucuuugagaauuucagacaugcauguaguguguggagaccccguucucuggcccucuaaaacaucucaacacgcugccgcacucagcaucauguccucuuuuuauuuuuuaguaauuaauugcgucucauuagugcugccguguaugcauagguaugaggauucaugcacuggagcacgagaaacgucucugcagccuccagagaacagccacuccuacguucugcagcacgggucggggaagggcuccuaaggauccaccccuaacugaggagggauuggcaguuggccuuuugucuuuuuuucuucaucuuccuccucuucuuuuuuuugagacagggcuucauuuuguagcccggguugguuuugagcucacagagauccaguugccuuugucuccuagguacuugaauuaaagcaugucaccauguucaccagagcacugcuaugauuaaaaugaagaaaacaagaccuauuuuacaguuuuuguuguugcuauuguuguugugguggugggaauuauuauauuagcaugugugaugggccuaaaauguuguuucauacacacugugcgcuugaugcaugugguugacaauaacuguuauucauauuauucuaugcuucugcccuguuguaucuucagguuauuaagccugaaucuuguguuccguguggaaagcggaucaaguuuggcaagcugucucugaagugucgagacugucguuuggucucccauccagaaugucgggaccgauguccccuucccugcauccccccccugguggggacaccgguuaagauuggagagguaaguaucauggcagccaaccaccauuugucuguaaaaggcauagugucagguuuuuauuuuaaaauuauugaucuuaaaaaaaaaaaaaaaaaaaaaaaaaaaaaagccaggcaugguggcacacgccuuuaaucccagcauuuaggaggcagaggcaggcggauuucugaguucgaggcuggccuggucuacagagugaguuccaggacagccagggcuauacagagaaacccugucucgaaagaaaaccaaaaaaaauaaaauaauaauaauaauaaauauauauauaaaauuauugaucucaaauaaaauuucccuccaugaaaaaugaauagaaauaguaaaaugucagaauguuguuuggaccuuucuacagcaggucgucgucgucgucgucgucguccccccccccccccccccgcuccuaggaagaucucacacaugcacaguagccauucuuauagccuaccccuggcuccuaccauuuaacuuuacagucgugaacucaaagcuguucuuguccucgaucuuaccuggugaauucuuucuuauucucuuucuucuuauuauuguuauuaauauuuugauuuuuuucaagacaggguuucuuuguguuucccuggcuguccuggaauuugcucuguagaccaggcuggccuuaaacuuggagauccaccugccucugccuccugagugcugggauuaaaggccucugccacgaugccuguuuuauuuuauaaaaauuaucaguuuauuuaggucuagucaaaaaacucaaagacugauuuaauuacuauuauguaugugugugugugugugcaugugcauaccagagccucucuagcuguaguuacaggugguugugaggcaugggacaugguccuuagcacuagaaagaaggugugaaacucuggcagugucaaagcuguuguguacuaagguacaacuuguguauuguguguaauaagugccuugacuguacuguuauuccaaauguaaguccaucaucuucucagcuguggagcuucuccaggcugcuuuucccugccagaccauaucacagagcagcccugacgcuccuguacggggcuuuagaugccagcacgaaacugaguagugguuacuucuuguugagugcagagcuaauguaggccuagccaagacucgagagggaagagauuguuaccuucaguaggcaagggguauacugggaucauccgcucucaaagaucuccagcucaggauccagacucagagaucugcuucccucugugccaccacacccagcuuaggcugugagcuccucggggcuggcuuucucuugucccgaguagaagaaaaggacuuuucuugcucacaaaaguguagccgggcaugguggcgcacgccuuuaaucccagcacuugggaggcagaggcagguggauuucugaguucgaggccagccuggucuacagagugaguuccaggacagccagggcuacacagagagaaacccugucucgaaaaaccaaaaccaaaaaacaaacaaacaaaaaaaaagugugugugguuauauagaccacagcaugaagacagaagugacuaaaggcucuauguagauggccucaaacucugcuccuccugccucuaucuccagugugcugggauacacgcaucgcccaccacaggaccucaugccugucaggcguaugcucaugucaggccuugagcugcaccuuacuccuccaagacucuucagaaauguuauuauuuaaacuauguaugaguaggguauauacacaggaguuuaggugccucuggaggccagagaugucagaguccccuggagcuggaguuacaggugguugugaacccccugaugugggugcugggaagugaacccagguccucuggcgaacagcacaggcuuucagcugccggccaccucucaguccccgagucuguuuuagcacguacuuguagaauagaaguucagacgcugacacacuuugcuaguguuuagugacagcucugugcaugagcccuucucucucggucucggcaguguaaauaacaaagccccuucuuccagggcaugcuggccgacuucgugucgcaggcuucucccaugaucccugccauugucgucagcugugucaaugagaucgagcagcgaggccugacugaggugaggagcuugagcccggugaguuuguggucugcgauggugauuuggaaguuccuaaguaagugucaucucuauaacaggcaggcuuguacaggaucucaggcugugaccgcacagugaaagaacugaaagaaaaauuccuuaaggugaaaacugugccccuccucagcaaaguggacgauauccacgucaucugcagccuccugaaggacuuccugcgcaaccucaaagagccccuccugaccuucuggcugagcaaagccuucauggaggcagcaggugaaggcagaacuugacuguggcgucagccgauccagggcugagcuguguuuacaguuuacuaauuuuuccaccaccugugcagugucugaaguguccuagguacccagacuguugggugggugagugacuguccucgccucccaucaugccguuucuucccugaacuagagaggcuaagagaugcucugugguugagcacuggcuucucuuccagagggucugguuuugauucguagcuucugcaagggugggucacacuauuuggaaccccagaccggaaggaucugcuguacucuucugcccccucaggcaccacauaaaugcuggcaacguauguguacacauaaaauaaagggaagaauuaaacuaacuuagacuucguaggacucacugugggucuugauucuuggucagguuuuagguugucccuuugaaaauagaaccagcuuugauuccuuucuuuuccaccacagaccuuguuagcagccuguaaauacacuuuaaauuugguauuugucacgaguccugguacucagcuguccucagaauauguugagaaccugcuaacagauugucgaguuucugcuugugccccuacaugauagcaucuguguggugcuggugugguccuuuuacacucagaguuacugguggcccuuuugucucuguccaccauuguuuuguuuuguuuuguuuuuugagauaagguuucauuguguaguucuggcuguccuggaacucacuuuguagcccaggcuggccucauacucaaagaucuacgugccucugccuccaagugcuaggauuaaagucaugugccaccauggacuggcuuguccaucauuuuuagacuaacuccagucuuuaacaugguugaagagaccugcagacuuggcuccuggucauugucugcaacaccauuuucuuuaugccccuccuuccucuuuucuaauccuggagucuuggauuucuuuuuauuuuauguguauauuuuauguauauguuaagagccagugagugcucuuaacugccgagccaucucuccagcccagagucuuggauuuguagcacacacccaccucacguccuucccauuugcugcagucuuaucccuagcagcuuccccugacaucucuguacuguguuacuucucucuccccgguuucucuucacacauuuuguccuuagaaacacguuuccuaagccaggugcaugacgugguaguccagcgcuugggaaggauggcaggagggccggauguuugagaccagcuuuggcuacauagugaguugagacuggaguaagcuaccuggaacccaguuuuuaaaacuaaccacaaaacccgccuuuauggccaucuugugagaagcaggcccuguuacuuuagcauuccacgugcucauuuucuuuuuuccugaauacugcuugacauguguuuuguuuuuugcauuuccugaccagcucuuugauuagaguauuuauuccauuaaacaaggccucuuuucguuucguuauccucacauuuaaaaauagcacgugguacauaguaggcccucaaguguccuaugauuguugaugguuuaucacugcacuugugugucuucccagcaaauggguugccagcugcuuucucuuaacugaguuuuaggaaguucugacuucucauugaacuguuggccaguguccugccuguuaaugaaacuagagucuggugcugucaugaaccgcaucagaaguuucagaagcuccguguauaggugggccuuuguggucgauagccuugaagcugcuguccagggaagagccuggaccuuuaaugcuuucuugucaucacagagauaacagaugaagacaacagcacagccgccauguaccaggcugucagugagcugccccaggccaacagggacacgcuagccuuccuuaugauccaccuacagagguuaguacagcggaugcuuagucugagagcuagggaaucuuccaaggagaagaguguguggacagugaguuguuuuuucuagaauguauauuuugguguauauuuaagaggaauaauauguuucuuuuuuccccccaccuccccugaauaauguuucuuaauauaaucuuuuauucagagugucucagaguccagacacuaagauggauauugccaaucuagcuaaagucuuuggcccuacaauaguugcccauacugugcccaauccagauccagugacaauguuccaggacaucaaacgucagcucaagguaggguucauggugugcacacacagaugcagaaggucugaucuuugcaaugcacuaacguggcacaaugacagaaauaagccuugcguggugggugagcacaugcaguggccggcugugcugggaggaucuccccagccuggucuacaaguucuaggcaagccugggcugcagagagacugagaaacacaccaacaacagaaccugcaguaaggcuggcucugugcccuuuaggugguggagcgccuacucucucuccccuuggaguacuggaaucaguucaugaugguggaccaagagaacauagacagccagcgaggcaauggaaacucaacaccacgcacaccagacguuaaaggucaguucugcccgaccgaguuugugcuucuucaggagcuuggccguggggccauuucccugagcuuccagcucuuuguaauaucugggcuaggugugguaauagagggccagaggcaaagaguuggucacccucaucugcacacugaauucagugccauucuggguuacaugaggcccucucuuaacuccuaaucagcccccaccaacuugaaaauuccgucaguuuuucuuuuuuuugggggggggggggguuuccaagacaggguuucucuguguagcccuggcuguccuggaacucacuuuguagaccuggcuggccucgaacucagaaauccaccugccucugccucccaagugcugggauuaaaggugugugccaccaccgccugccaucaguuuucauaguuacagagucccauccaaugccauggcauuucuuuucuuuuuuuuuuuuuuuuaagauuuauuuauuauauguagguacacuguagcugucuucaaacacaccagaagagggcaucagaucucauuauggaugguugugagccaccaugugguugcugggauuugaacucaggaccuuuggaagagcagucagugcucuuacccgaugagccaucucuccagcacugcgaugguauuucugggguuaagucucacuuuagguuuguuagcauguuuuauugauuugguuucauuuuugaaaauuguuacuacauuuuauuuauuuuaugugugggugcauaugccaugugcauuugugguggucaaaggacaacuugaggaaauugguuuucccuucccaugaugugggucccagggaucgauugugccuuugcccuggagccgucggcuugcuagccuuccaucugguucuuaugugacguugccauuucugcugccaugaguagaaugcuuuuauucccaucacauagacauauuaaaagcuucuuuuuaagaauggugucuuuuuuuuauaguauauguaaaagucaaaaguucagauguuagaugugugaaguuuggagauugggaauugucugaaugaggaagugaaugucagcuguuuguugaguaguuggauaguucagaagauucaagagcaaguuacaaaacaagggcagaaaugaccuguuaacugcugcaugucugaccgucagaggcgggucaguguaaaccauccaucuucaagaggacuuuuuuucccauucacuuaaaaauaugucucguuuuuauuugaagugagcuuacuggggccugugaccacuccugaauuccagcuugucaagacuccuuuaucaaguucccugucacagagguuguacaaccucuccaagagcacacccagguaugcaggggugaggugugaguguguguguguguguguguguguguguguguguguguguguaugcgcaugcgcaugcgcacucgcgcacgcucgugugcaugugccucuauuuucucucucucucccucucccugugagugugcgugugccugugugccugugauugagucgcagcagaaugcugaggucagugcagaccuguaggaaucaacucuuuccuacuucuccuacugucuucagguucaaggacaguaguuuauugaagcuauauugauguaucugccuguagucccaacaguuuaagcaauugggagacaggagaaucgccaugaguccauggccaguuagagccuuaucuaaaaaguaaaugaaaagaacugaacaagaaguggguacugucacaugaaggucucugcagugacccugugaccuguccugcugggucagcagcaccuuacagaacagcucccuagacaguucccauguuuaguucucuaugucaaguaacaguauaauugucuauucaguauuuuucauagaauauguuuuuuaaagaauucaugugcguguauaauguguguguaccagggcacccacuuggagaacuugcaguucuuuccuuccaccuccaugugggcucucagggauggcucucaggucgucaggugcauauaguaauugccuuucuucuggugucacucaccagccuguagaacacuuuucugauucauuuucucuaauuuauuucuagauuugggaacaagagcaagucugccaccaacuuaggucaacagggcaaauuuuucccugcuccguaccucaaguaaagcugugucugccuguguuuacugcacgagacaccccugucugcucuucagccuccuguguaaugacuacuuuuagcauuuuccagacuuuaaauaaaguugaacgcguaugagaguuugaguguugcauagcucccucccaccuggacacuuagcaccuuuacuaguugucgggagcuuuaaaauaggagaucuuuaccagggccgaaggggaaauggguauaaguuggggcucuuagggggaggggagaggagaucccuuuggcuuaaagccaaauacugcucaugaaaugacuuugcuguggugucacuuagacaaugacagaaacuguaccucuuagguaacgucuuaguuaucucaggacaggauaaagagcugcgcagcggccccuucucagaacacaggccucuuccuccuucggggacugacaagaagcuuggagcccucagcgggaugggccgggccacugaucugaggaugcuucacuucugucuggguuaagcugagaaagugccacaggcucugaucucacacagcgugcuguuucuagccagccucugccuggauuuugcagucaaagucagguugaucugaagccgaauucguucugaugccugacccccuuguuuguccaguggagcccauuuaaaaagucagcuagcaguucagaagacaauuuucauauagcaagaaaguuagcugcuucugucuuuggugaaguuuuucugugaaacagaucuauauaugugaacauuggcuuuuuugguuagcauuuuccaguguucaaaauggcuuccuucccugggauguuuucugacccauacuaacccuuaccuguaacauguaucuggaauauuauguggaaaaaauaaauagcuuuuucaaagugaaagugau

SEQ ID NO: 7993 - RNA, 2753 nt, Mus musculus
ugagcgacacguggagccucuucuaauggcugcaaauugcuucaaucaccugggauguuaccgagggagcagggagcagcguggguggagggaaggaaggugaugaggugagguggcggcaggcgaggacugauugaggccaaugaacagccgcaggaguaguccggggaaagauaaaaggcaugaaucagguauccaggcuccaagaacaggaccugaccccaccacgcaauaccaccggcaggacccuuggccaguccaagcuucaguuucuucauccuuaugaugaagguuguauuuauuucaccuuguuuuucaaugauuaugugaaucacugauggaaaaugcauaguucauugaucuguguuuguaaauccccaguaacaaauguuacuggcacucugauuuagaucuggaagaaaaaaaaauagccauaucagccauaucaggacagacuucgagaugguagcuccuaauucggggaguuggguaaguuuuucuuuuucuuuuuuuguuuuguuuugguuuuucuuucuuuuuuuuuuaagauuuauuuauuuauuacauguaaguacacuguagcugucuucagacacuccagaagagggagucagaucuccuuacagaugguugugagccaccaugugguugcugggauuugaacuccggaccucuggaagagcagucgggugcucuuacccacugagccaucucaccagccccuguuuugguuuuucgagacaggguuucuuuguauagcccuggcuguccuggaacucacuuuguagaccaggcuggccucgaacucagaaauccgccugucucugccucccaauggaguuuaauuuagaucaaguaaaccucaaacucaguggguggagcucagaucuccaaacuuuuuguuuuguuuugagacagucuuacuguggcacccuggcuggucuagaacuuacuggguagacuacgcaggccucaaacucaaagagaucugcuugccucugucuccugagugcuggguaaaagguauaagccaccaugccugccuggguggccaaacuuuuuuuuuuuaaguuauuauuucuuuuauguauaugguuguuuugcuuguguauaugucuguguaucacaugaaugccuggugccuguagaaaccagaagagggcacuagaucuccugaacuggaguuguguauaguuguaauauguuaauaugugggugcugagaauugagccugaauccucuggcaaagcagccaaggcuuuuagcuauggggcccuucuacagcuccaccguaaguucuuaaaacuccuaagucuccucagaaccagucugucugaaucaagacuucauuacaacaaccccuagccucuggagcuugguuuuuacaccuaaauuccucgcucugucgucugaggggagaucagcccucaugggugccacucucuuccagcccucuccacugcagcaaacaucuccuacagcuuucccugugucagaggcaagggcaguccuugccucaagaccucucagcaucaaagcggaguuuguugaugacugauucuagaacaaaggucaguugugaaaggcacgguggugggggagugcugcagagaggcaguuauccuauagcaagggagucgguggugccaaggccuugguuagaagaugcugggggaggggaggggguggagagguggcucagcaguuaagagcacugacugcucuuccagagguccugaguucaaaucccagcaaccacaugauggcucaaccaucugugaugaaaucugaugcccuccucuggagugucuaaagacagcuacaguguacguacauauaauaaauaaaucugaagcagcagcagcagcagcuugaggauuugaggauuccaggggcugagauuaaagcccuuuggcuuccuucugcuucccugggccuauccacccaggguuuggaugucuugcugaccugauccucaguccuacuguguggugauccuggacaggaaauguagucuaccugggucccgcuuuucuccauaaacuauacaacgcaacuaaugccuaggcugauaagacagcaugugcuuggcaaacgguaggcacucgcuccaucagcaaugccuagcgagcauccuugaaaggcugaugggggcagauuccccauggacacucuccuugcauauggccccaucugcuguauguauagaagcacccuccagccucucagagauggguggggaagaggggagggcacaggggggacgaggcccccccugggacucugaggcagcucuucucgcucccccgugcgugaaaucacgaacgccccaaucugucuacauccacuuccuuugccagcucagcaaaugcagaggcgauuaagaaguuaauuagcaggcagcagggaaggggcuggggacccaucccugcaccccuucaccccucugugucccacccaugaccaucccuucucccccugcugucgaucuucugauccagaugcuccuuuccuccaugucugauaccucccugccaccuucacccuuucucacucacccucugcucacuucugaccccauuccucuccucugcucauucaagucaccgccuucuuuguugucaagguucacucguccuccucccaucuccucuccuuccucucucaccuuaccaguuccuguccugcuugacuuuggaucugaugagugggcuccacaucugccucaggagccagcagcuucauggucgucu

SEQ ID NO: 7994 - RNA, 30820 nt, Mus musculus
acacacgcgcacacacacacaagccacagggccucgcaagcagagagcggagccggcuccgggauccgaacgaggcagcucugcugagagcggcgggaggaggcgagccagcggggggagcccucgguuccgcucccgggccgggggccccccgcgcacaccggcccagagacacccucgcagacacucguaggcgcgcacgcgcacccuuuccccuccuccuccccucccgccgccucccggccggacgauggaucccugcagaucccggggcugagagcaccgcgcagcgccagcgcgccgagccccgggcggaccaagccgagcgagcaagcgcgcgcgggcggcggaccgagcugagccgagcuggccgagcgggccgcucccugcagggcucuacgcgggugccgcggcagccggcggcucgggcuccgggccaugagccccuccgccgcgcggcgcugagcccacggaccgccucgcgccccaggaccugcagcggcggccggcuuuccccagcccccucagguggguuuccgaccccgcugccuugggccccgggcuuccuggugccccaaagccgagacucuccuccacuguagcuuucuccagcuucuggggaggcucggcggauggggagggggcggggggccgagccgggaauaugacugcgacgagaagcuggacuggagggggugcguucggggcggggauaacuggcugucauagggaaccgcgccccccccccccauuccuacauccaccucaggcagccuaccauccucucccaaacacacacacacacacacacacacacacacacacacacauacacacacagccugcgccuaugccugugcuuguuugagaacuggagacacagaaggugaggauacaggcagggccccuccccagaugugcccaccuccggagagguggcccugguuuagcuccugaggugacagccuguuccuggggauacccuugaucaagagaagagccccugaccccugguucagcccauuauggggaguuugaucuuggcugggguagauauuccugucccagagugaccucacaucuggagggaacucccaugccugccugugggugcaucagggacuucccuccuucacucuaguggcuguaucuggggucccccauagucugggaagcuugcagaccauucucucgacccgagcugaccccccccuccaagccucuauguuuuaaugacugucaucuuggauggucccucguucaagccaccuuuggagccugcaugucagggaagucuucccuuggacaagcagugaccuccgguuaaggauuuugaauggacauaauuggaggggcccuauaugcgccuucaucucaggacaaugacagagucuugucuccucuuuccucccucuaggauccccuuggcaagcauggaacugaagaccgaggaggaggaggugggugguguccagccggugagcauccaggcuuuugccagcagcuccacgcugcacggucuugcccacaucuucuccuaugagcggcugucucugaagcgggcacugugggcccuguguuuccuggguucgcuggccguccugcugugugugugcacugagcgugugcaguacuacuucugcuaccaccacgucaccaagcucgacgagguggcugccucccagcucaccuucccugccgucacucucugcaaccucaaugaguuucgcuuuagccaagucuccaagaaugaccuguaccaugcuggggaacugcuggcccugcucaacaacaggugggcagcucccauccaccccuccgcaugacuuguggaguaacaccguccuuagcccaccaaaagucaaacagcucugcccucuagcauuccuuuaaaccugccgcucaaggcggaggggcugagaucaugccaguaccaguuaccuacacacaaucucugauuccagcuuaggucaaaacagcucuguccccacccagccugagcuaggagauguuagcucuuuccccagagagcaucaccuaccuccugguacuauccuccuugccucacuuagggaaugggacggaccaccuuuuuuuuuuuuuuuuuuuuuuuuccuuuuuuuuuuugagacaggguuucucuguauagcccuggcuguccuggaacucacuuuguagaccaggcuugccucaaacucagaaaucugcugccucugccucccgaaugcugggauuaaaggcgugcgccacuaccccuggcuaggacggaccaccuuuuaagggucaagacuguaccauccaaggcuccugcccuacagagccuuugucuucuuguauuccaugugucaggcucuccuggcauacucagcuuuccaucucugccuaucuauguccagaucugauccuccaggggcucugagugcugcccccaccccaccccaaguagggcauggguacuagcgaucauguugacccaugugccacucaccccugggcuccagguaugagauaccggacacacagauggcugaugaaaagcagcuggagauauugcaggacaaggccaacuuccguagcuucaagcccaagcccuucaacaugcgugaguucuacgacagagcagggcaugacauucgagacaugcuucucucgugccacuuccgaggggaggccugcagcgcugaagacuucaaaguggugagugaggccccgguauggagccccccaucacccuggucucuagaggggugggggagaugaggagcaugguuuauguuugcuuuucugggaggggaagcugguguuguuugcuucuggccgacggggacuuuccucagcacguggugucuuuguacugcaugaagacuugggccuuugcauccgugauagcaggcgagaaaggucgugguauagacuauuacaaaccacccaggcagauguucacauacacguggacacacuuuacccagggguggcccuaaucccuccaagcuuacauucugggccacagaggucagagucagcagugguagguacgcuacagccuugcuacccaaaaguaggccugcaaacugucaucugagagcuuggaagaaaugacugccaccccacauuccuaacccgaucgaagcugaaucugcgucagauaagauccuagggcaauauagcugcauucuaagagcuuguguagcacagggagucaggaagcuuccucaggaacagccacccucaccacagaaggcaggcaggcauacaugcaugugugcacgcaugcacgugugcacacacacucaugcucacagggcaggauagguuuccccuugccguagucccacaucuagagccggaggaggcucaagaugcaacacaauuacagcugaacuggaggcucccucugcuucugaagauggagaucccucccugccauucauauaacacccuaucaauauagcgcccuccggcucacaccccaggcucuggggaacugacuuuggaaacugauauccuagguguucuugggaaaaaucacagagauuccucagggcuaaaaaucacucaaagcuacgugugggguauauacacauagcuggcugucagcuacacacacauagcuggcugucagcuacacacacauagcuggcuguaggguacacacacauagcuugcugugggguacacauauagcuggguaugagauacacacauagcuugcugugggguacacacacacacauacagcugguugucagguacacacacauagcuggcugugggguacacaacugcaauuccaucccuuggaaugcugagccugauugggacuuuugaaucaaauagcuagaccccgucucaaacaaaccaaaacuguaccuagacacauugcguugacacauuggcucagcuaggagucugagguaggaugagcagucgagccuggggguuugagaccagccuaggcgacaaaauaagauucuuuccaaaauuaaacaaacaaacaaaauccuggacacaaacacacaggccugucuguaauccuagcacucgugaaacugaggcaagaggauuuugaguucaaggcauacagcuugggcuauagggaggaccuaucucacaauucaaagaagaaacacaacacacacacacacacacacacacacacacacacagaggcaagaaaaacccuaaggaucugaagucuagacucucucaauccuuuggcuaaguaaccacauuauuuuacaaaugcacggcuggagacaggaagcgcggaauagccugccuuagcucacuggcuagcuggcugaugaaugacagauccaggauuagaacccacgucuccuuagguaccgauguacuguguucuuaucaccaguauugcugacccugaagucccuaugucauuuccauuguugggauugcuccucagaaccuccuuccuaacucuccgcucucaguaccucucuugccccacugaccacuuucucuucaacuugcuugcuuccucuucaccuuaggcagcaggaacccacuuguuuguguagagagguuagagcccuggggauauuuaacauuuccugccaagguuacaggagaauucccaaucucuuuaagcucugccucgcagacccauuuuucggcauugucaaugcuucggcaaagguuacaggaccaugcuccuugcugagccuggccaucaccccagugcacagcaggaaaguccuggauuccccagaccuugagcccagagggcucccuggcucacaaacuguuuccaaaaggaaaagaacuguaggugaagggugugugugugugugugugugugugugugugugugagagagagagagagagagagagagagagagaagagaaagagaagcugccccugucucagcauacugaauauacaagcagaagggaguaauuccgagcaaggagaagacugcuugauuggcauagcuuguuuguaauguugaauguagcagggaagagcauggcucaaaacaggaaggugcuaagguauauaauaugcauguauuaagcccauggaaguuuaguugggugcugguaacauugcucagugguuagaggugcuuucugccaagcccgacgacgaccugaguccaacuccugauauccacaugguggaagagaaguuccucccacaauugucuccugaccucugcaugagugcuguggugcuugugugugcgugcgcgcgcgugcgcgcgcacgcgcacacacacacacacacgcacacacacacacacacacacacacacacacacacaaguaaugaaaugugauuggccuguacuguuugagggagaauucuaagcuaucagauggagaugcguuagguuugcagaggucuggcgccaucuggguccuuuuuaaaagaguauuuuguuauuuuaauguguauguguguuuucacauaugugcaugaucacgaguaugugagcacccucagaggcuaggggaagggcgcuggguccucaggaucaggaguuacagacgguggugggcaucugaugugaguguuggcuccucugaaagagcagcgaaugcucuuaaccaccgagccauuucuccagccccaaugugaguucucgcucagaggacagacacacaggccaacauccuggagacccaacaguggcacuucuugguucuauagugucaggaaaggcuaauuguucuguuuguaaugucuaaugccugaccccgaauccagcuggauccauacucuuuggccuuugcccacugccggcagguuggccucucggucaggcuccuucuucaucaugagcagcaccauauaugccuguaggggucuuagagugacagcucguggggacagaagggccuggcugucauucuccuuuggcucuuuaguucuaagagggcucacacuugguuccucuccucuucuuggucucauaauuaacaucugucucccggacuuacgauucucugcugugccuggaguacaugucagggauguggaucuagacucugagccaauguagcacuaacacaaagcaauugcccucagggucagggccaagaggagacuauccugguaucccucaauaccaaggugccuuuauuuauuuauuuauuuauuuauuuauuuauuuaucuaucuaucuaugagaucuugucuuacuuuguagaccaggcuggccucaaauccuuccuuagcgccccccaccccccagagcuaggaucauaagugugugugucucggcagucugcggagcagggagucuuaauggagggccaagccuuugcucuguguuuguggauacugugugcaugggcauauguggaccucuuuguguguuuuccaaaggcaggcuucacaugaacagcaaaugcucuguucaugaggacuguucaggaaggcacacagcgcaaggcuacucuugugcccaaagagcccagcucccccauaagccucccccccccccccagcaaguggauugcuggucacaaugugaggccugggaggauaggggcagaguagggccugaaccaaguugggagaaauuauuuugaaaaucauuugggauugagaaagucccaaauagcacuaggggcuaucccuaggcaauccaguuggguagauaucaguagcucccuucugagcagccaagaaagcaaggaaggcccaagacaaggccaucuucuuuccuggccggcucccuuccuucccaguggggugcucgguugccagagcaacaaagucugaagcucccaucuccuuccccaccuuaagggcagccaggccaaggcagggcaggggguuccguguggguggggggcugggggacucagcugcugcuagucccugggcgggggcuggggagugagcacagucacagcugguggcagccuccagcugcaccuuauccaucccuggcagugggagcaggauguggcuggaaugcugagcggcaccgacgggaggagggagggggccugcagaugguugcccaauccgcccaaugccagccccuccagcugagacccggagccuuugccuagggagaaagaagcagggauucaugugugggccuugggagagaaagaagaaacagacaguggguguccuagagguagggaugagguaggggugcgguaggagcgguaaucuuaaauagggcuagacacacagggcaggaaucuguggagugcccacaagaucacucuagauccugaagcagggacaacccucuaauaaaggggaggagugaaggagguaggccuagaaggggacaggccuuccucaggguucugaagggagacaagaauauucuggaacaccgaggggagggaggugcuaaucuaagaggaggugagaucccagagcucagacuggggacaaagaggucauccaaagccaccagaggccuaguggcggcauagcagagugauggaacacuugguuggcaagagggagguauuagguccagcgacaaaaagcauacauuuuaaaaauaaguaaaucacgauuuaauaaguaaaaauuuuaaaacggggcuggagagauggcucagugguuaagagcacugacuguucuuccaaagguucugaguucaauucccagcaacuacaugguggcucacaaccaucuguaaugagaucugacgcccucuucuggugugugugaagacagcuacaguguacuuagguauaauaauaaauaaaucuuuaaaaaauaaaauaaaacaaguaauaagagcccgggaacgccaauucuuggaccucggacacuccucauucucacugcaccccacagaagcucagaaacguccuuaggggacaugauccaagugguuuucucucucucucugugaguacgcugucgcugucuucagacucaccagaagagggcgcgccagaucucauuacagaugguugugagcuaccaugugguugcuuggaauugaacucaggaccucuguaagagcaaccgguacugcugagccaacucuccaguccccaaguagauuuauucccuucaacuagagugggaguggugaggagaaggagagagagagaaagagagagagagagagagagagagagagagagagauccugaugaccccacccaaaggagugugggcaggauaaacaagcacacuuuaaaagaguaaaggaauccggacacgccccauccugcucucuucccuggcaaguacgggagccaagaugcagggugggggaggagcuaggcagagccaaucaggaacccagagacccuggggacgggucucuugcugugccuucccccucuuuucccugcauagaucuuuggguaacuuagcucucucccucucucaccccucccccacccuggcuacuccucccagacugcuaucagcuaagaggcuacucuaagcuaauugaucucucugcucuugccuaaaguaauagggaauugauguaaguaacuaagugccucugggggcagagucggaaguaagggcucugaggaguggaugucuaucuaaugcccagcugcagccgguggacagcuugcugggugaugggugcuacaccccacuguguucuggaggcagaaugcuaacagacugguuggggacauucuguuauagguacaggucacuccugcauggcuucaacuuuguggagagcaauugugauuauggaggggagggguggggauaucgccauauuccuccgguggacaaccggagauugggggugaggaagagggugacaaguuccgccauucacuccccucagacagucacuuccaaaugccagcuccugcccugcggcuaagguguggcagcugaaucuagacuucacuccuagccuuaggggaccuagcgagaucaggguagaauccucccacccaccuccucagcuggcuacuccaaaacccccaggguuacagaaugcuugcucccaccgcccccaggcacagaugacaguucucuggagccuuuagccauuagccagccaaacugagugguuuugcucugagcugugacagccaaggcuugcuaccuucugguugagaccauauccucuugggugggcaaucugaaaggcagggcagggaaggccacagcagggcagggaaggccacagcagggcagggaaggccaccgcagggcagggaaggccacagcagggcagggaaggccaccgcaagguguaccuagcagggcuggagggcuacaugugagguagauuuccaccagacuccuuuccccguuucuagucccaguuacugugaggagauggguggugcugaaguguugucaaggggcaacuuuauccccugcuccugggauaaaaagccacugagauacuucagccaaggcuaggucuguauuuaacccaugugcagacguggacauccuuuguuuuguuuuugguguuuuuguuuguuuguuuguuuuuguuuuuguuuuuuuuaagauagugugucuuagucaggguuucuauuccugaacaaacauccugaccaagaagcaaguuggugaggaaaagguuuauucagcuuacauuuccacauugcuguucaucaccaaaggaagucagggcuggaacucaagcaggucaggaagcaggagcugaugcagaggccauggagggauguuacuuacuggcuugcuuccccuggcuugcucagccugcucucuuauagaaccaagacuaccagcccagagauggucccacccacaauggaccucccacuaauugagaaaaugccuuacagcuggaucucauagagguauuuccucaacugaagcuccuuucucugugauaacuccagcugugucaaguugacacacaaaacuagccaguacacaggguuucucuguguagcccugguuguucuagaacuugcucuguagaccaggcuggccucaaacucagguaacugccugccucuccucagugcugggauuagaggacuaggcugccaugccuagcccugagggauacuuuuaaguuauagugaaacuauugaauucucuuaagaaguuguaagaccuagggcugcuggcuggagauguaacugagugguaugcuugcuggucauuaacagagcccugggagaugagagagauaagagagggaggggaagagaagaggagagagagagagagaagaucccauuagagauggcugugagccaccaugugguugcugggaauugaacucaggaccucuggaagagcagucagugcucuuaaccguugagccaucccuccagccccaguuaagaccuuuuaagauccuaugaguucuaagaaagaaaacuuuuucccacccccaccauccaucaacugacugucucauuggaccgggagguuagguuuugcuguucaguauggugucucucuaauuggugugccccucagcaugccaggcaaagaacaucccuaaaggagauguuggcugcaguggccugggcuguagccaacccagacuucucgugguacacccaaugcaugugugccucuccaucccaugucuggaggagaauucggauguaguguguggaauggacaugugugguugugcacggggcgcacacagcugugugugugugcugugagaggagcuucuguguggacacacuuguuguugcaugaggaaggaguccauggcagugaauuucagucuugcuuugagauuauaaaauccccuuuaucugugcucauucaagcuucaauuaugugucugaaggaagcuuaauaaauaucaccacuggaaagaccaggacaccgagggucgggauguuacguaguuugccugagaucaugacggucuaaggcuuugacuuuggaucuuccacgcccagccucuucaggcuuugggcacaggaccguguguggcagaccaagcugcucugggcucugggacuacaugugcucugaggagaagcaauguggugagguagggaggggaaggaaagggugcagaagugaccccaggaaucccaucccucucgagugagcucaaucucuagauggcuguuuuuaguuauucuauuucuuacuguuguuaugggaagagcuaagaggguuuccucgaguagcucuaacuggcuggaacuugcucugugaccaggcuggccuggaacucacaagauccgccugcuucugccucccaaauauugagaccaaaggcauaugcuauucacacccagcaacaccucugcuuuuuuuuuggggggggggggucgagacaggguuucucuguguagcccuggcuguccuggaacucacucuguagaccaggcuggccucgaacucagaaaccugccugccucugccuccaaagugcugggauuaaaggcgugagccaccacuggccagcucaccccugcuuuuuaaaauuucaccaucuuuucaaucccuacaacugguccccugacuccccucccccaccgcagggauuagucccagacagucucacuguaccagagaaagucacacccagagcagcguggcaucaaguccauccccauugcauucuuuuuuuuuuuuuuucccagagcugaggacugaacccaggguccaaccccacauucauuuuuuaaaaauuuauuuauuauuuaauaguaacacuguauauuuauguauuauuuaauaagacacuguagcugucuucaggcacaccagaagagggugucagaccccauuacagaugguugugagccaccaugugguugcugggauuugaacucaggaccuucggaagagcaguccauacucuuacccacugagccaucucgccagccugccccuccccuccccauugcauucaugauuaacauccuuaaguuggccugcagugcuaugugggaaucacccucgucauccuggccaaccgauccaccuccuccgugguuccugcaagcuuccugccucugccuuuccuagcucuauucaccccuccucccaacagaugaccuugcuccuccacgcgacccccaccccccaccccuguaccaacaccuggaaggggacauucacuuuaucuagaauagucucaaugcacucugacccccucuaccugcguuaggaguuguaaucugggguugucucucuacuccucgaguagagcuguccugcugacacugaaacauucaggaugcuccacacuuaaaacgcacacgccugagccaggcucugugguccaucugugguaaccaucuacuuagguggcugaggccaagaugaguacuucagccuuggaguugggaaccagccuggauaucacaguaagaccccaaauaaauaaacacgugaccagagucaaauaaaaacacauucacugagugcuuccuuuguauaaaaaaaacaaaacaaaacauacaccuuucaccuccacaguacccccauguuuuuucuuuucauuuuaaauuuuuuucuuuuuuggauuuauuugguuuuuuuuggggggggguuguuuuguuuuuuguuugguuuuuuuuguuguuguuuuucgagacaggguuucucuguauagcccuggcuaucccaggcuggccuggaacucagaaaccugccugccucugccucccgagugcugggauuaaaggcuugcgccaccacgccuggcugauuuauuuguauuuuaucuguauggguguuuugcugccuccauguauggccgcaccauaugcaugcaguacccaaggaggccagaagagggcauuauauucccuggaacugaaguuacugauggugguuagcagccauguauguggugggugcuggaacucaaacccaggucucuggaagagcgcugcuuacccacugagccaucucuccagcccccuccacucuauggggauucccucugcgauguuauuaacagcaauguguaugguucucaauacgaauuuccucaacuccaucuuacccaagcuugccuugucccugaucugaauggcuuuaaucaaagacccucauguugucaaauccagcaaacauguuuuauucuugaucuucaauagcuuucaaaacuggugagccaagccauguguggugguccaggcacucagaccaagcuacucaagaaacugaggcaagagaaucccaagguccaggccagccuaggcuacccaaugagaucaugccuuaaaaagccaaggggaggggcugcagagauggcucagcaguuaagagcacugacugcucuuccagaggucccagcaaccacaugguagcucacaaccaucuguaauggggauccagugcccucuucuggugugucugaaguacucacauacauguaauuaauaaaucuuuaaaaagaaaaaagauuuauuuagaaaggggaguuugacaauggccucuauaagcucgauauuugaauacuugguccccaguuguuaggacuguuugagaaggaguaggaaggcuucuuaaaagaggugccacugggggcaggcucugagguuucaaagcccacacuauucccagugaacuuucucugccucuugucuguaucuuguagaucaagacaugaacacucagcucuuucuccagugcccggacugccugccugccugccuaccugcugcugcugccgccaugauggucauggacucuaaccuucuagaacuaugagucccauauuagacgcuuucuuuuauaaguugccuuggucauguugucuuaucacagcacuagaaaaauaacuaagacagaaguuggcaccagaaacagugucuccucugugauuuacuauaggggggcugcuaaaggcuccaaacaccagucuuauuuacuacuggcaccucaaguaccacugggucuucuggaucauaugguccaagugguagagcagccuguacagcagccugggccugaugaagagccuucugguguucuaggccccacucaaaguuagcagcuuuccgagucacuugguguauggauuggaguaacacacccaagggaggaauguccuguguccuggcuccaaaucagcccccuaagcguugagcugcuuucuugguggugggagaggccaggcgcaguaacuugcccuucaccuuagaaagaaaaucgcuacauaccccacaccacuggauuccuaggaauuucauggagguagaagguccuugaauuuugguuggauuuauuucccgcccucugaugugcauaugugucuugucaccaaugaguccaaagugguugcuguguccaacugacaugauugguuucuuuuuuauuaccaaaauaagacaacuugaccaggcagcuuaucaaagaaaucauuuaacuuagggcuuaugauuccagaggguuagaguucaugaccaucaaaauggggaacauggcagcaggcaagcagacacgguacuggagaaggagcuaagagcucacaucuugauccacaaauaggaggcaaugacagcuaauugggggcacuuuugaaauuucaaagccugugacaaggccacacauccuaaucccuccccaaaaguuccaccaacuggagaccaaauauuugaauacaugagccuacaguggggcgggggugggggcgggggugggggcggggguggggagcauucucauucaaaccaccacagggaaggagggcagguagccuagugguuugcaugaagaccaggguccucucuccaucccugcacagcaggguauggcgacuuguucuauaaucccaguguuuuggauguggaagccugaguaucacuaguccaagcucacccuccccuacacaauuaguucagagccagcugggauacaagugacacccugacucaaaguguggggguggaaaggugggaaugcaggcacauucucauaaucccagcuccugggagauggaagcaggaagaucaagacuucaaggacauccucaagagaaucaggagaucaaugcuguccucaacuacuuggcaaguucgagacuagucugaguuccagaaaacgcugucuuuaaaaacugaaacaccaaaggauacaagauaaagaaacaaaccaacggcuaagagacuggggcaaagcuccaugcuaaagagcuugucuccaagcagaaggcuccggcuuugauccccagagcugcaacaaacagcaacaaauuguuuucaucguuuuuuaaaccauuagcuuuccugacuguagcaucacggcuuagccaguauguccagccacuucuguuccuuuaccaguucagucucucuacuuggcuaguguguacuguccacacucaggacccaaacuggcguuuuauucuucaagucauaaggauauaauuuaaaggccuagcucgaagaauuuugcccuggacuaccuuacacugcaauaguauguacuacauuguuaaauauuuucauggacacaaaacauuucuggcacuaggugguuccuucaggugagugccaccccacagggggagucugcccuaguucuagcaguaaggguaaguuucacuucucuuaaacaucccacaguugugcuccccaccacuccuccacccccccccacccccacgucucagggugaccuacuuuugcuggugaucaccugggagagucagucauguugccauccuuguuucuuuuucaaugcugugugcuaucucauuauauucauagaaugcaacuuauuuagauguucuacuaaugcuagacauuuggguugucaccaguuuggggcuguuauaaauagagugacugugaacauucuucuuccuggcuuuuugguugacaccuguacucauuccucuuggguauggagggagaagcgguguuuaagucauaagguaggauucuauuuagcuucaguggauaacgccaaaucaggccucuuuuucauucuuucuuuuuuuuucuucguauucuauucuugggcaaucacaccuucgcucuugacuuugaauaccaucuacaugcugccugccugcuccaggucucaggcuggcucuuuucucaugacuucaacuccaauggcuaaauuuccauuagcgccuuuacucagguggccuugaagcuccuaaaagccaucaggugcagaaccacccucauaucgacuuacuucucaaacaaguccucuuccugagugucuguucuggagagcaccccaccaguuacacaggcccucucugacaccccaucucgcucaccugccuugacagacccuuccaaggccugcugagagcugcagcuucaucugcaauuucuccuucucucucccucucuuucuguucuguuuguuguuuuugugagguggggucucguguagcccagguuagccugaaacucacuguggagccaaggauggcuuugaacugauccuccugccucagccucccaaguacugaauuauagguauauauaccacacccagccaaaaccuagcuuugauuuuuuucugauccuucaacaggaagcacacauuacuauuggaccaggagucuuacaaggccaggucgcuugguuucccuuucuuccuuucuagccacaucugacucuguucagucccucagucuccuguuuaaagcauacaugggccagggccagggggaugacagacagacagacagacaggagaagucgggagcagcacacagagaggcagaagcagagagauuacuucuacugcaauucaaaccucgcuuccucgggaaaccuuacugauuccccaguccgcgugagguuucccguccucugccccaggaguauucucauaacauuccucauaguuugauucguaaauguuuuaaaucacaagacugcuccccaagggcaggauccagcccacucucugcuccccaccauguuaauggguaagguagagagaaggcguuuagagccagaugaccucgguuuaauugacccagacaucuguuugcuuguuugcuggcuugcuuuugagguauuucuugaacuauuuacucuggcuguccuagaacuuacucuguagaccaggcuggccuagagcucacagagauccgccugccucugccuuuuaagguguguacuaucacaucuaacucuaaucuuaguacuugcucauuaggagacuggaauugguuuuuguggcucagcccuguguguguguguguguguguuaugcaugaauguggguaagcacacucgcucaugcgugccuguguagugcugggugucuucucccaucucuagaaagggcuagaauaaauuauucuauuauuauuauucuauuauucuauuuuggggccaaacagagcgaggccuggagcaagagggagagggaagagggaaaaauuauucuauuuuauuauauguauuuguauuuuacauguauaucugugcaccauggaaggggauacaagauccccagcaguugugagugggugcuaggaauugaacccaggucuucuagaagagcauccagggcucuugcuugcugagucccuucauuuaucuuuuugggagcagacucucucaccgaaccuggagcucacgaauuagcuaggacccagcuagucacugagcuccaaagacuccaccugucuccaccuccccagugcugggauuacaggcaguuauccaauuucugcguggguacuggaacccagauccucaugcuccaagcaugucacccauugcgccgucuccugagcucgcgguucaagcucuugcuugucaaaugaugaugaggucgcucuggcgagggcccuguaaagaacccaugaguuaguugaaaaccaccaaaccuugcccaauguggaaggaggugagguucagaagggaugcagagaaaguaaggagccacccaggugccacacagcugguggggaaggaagacagucguccuuggcuggaaagcccugacucguuauucacugacuuauuuuacuuuaauguaagguggauguucauagacgaggucacccaaccucugacguccauacaaggacacauggacaagagugcauacacauaugcacauauauaugacuguagaacccuggugagccuagaacguguguuauguagaccaggcuagccucagacucacagaucugcaagccccgccucucgcgcccccccccccaaguguugggauuaaaggugggucugcguucaugugcaccuggucaucuccucaggggccucuguguguguccauagucucuguguguguccauaguguguguguguccacaguaucucuauguguauccacagucucucuguguguauccacagucugugugugugcccacaggguguaugugugugugugugugugugugugugugugugcacagugugugcaccgucugugugugcaugcauacgauacgaguacaugcacaugcauguaccuguauacauguacauccacaucaguguaugugugugccuguauguguguccaugccugugugacgauguauaggagugcaagguugucuugguguaggugugaggggaguuauaucagcucaguguccucggaagcuccugucucucuucacagccuccucaauccacccugaagcucccucugccuuaguuucugcuugugaauccaggucgucugaaggagagagacagugcccucuagugggaaagaggcagaugggcagcuaggucaaccccagccagcaccgcuuaagccaaggccucugcaacuguccugaggaagggcagcacagcaagcccugcccccugagaacuaaggccuggcaggcaggagaaagcuguccauggagcagcagacagaaagggcaucuaugcauucgcauucguacaggagagaauaacaguugaagguggcugaucucuccucagacccagccucucugugggcuuuccuuuuauaccacaucucucuauguaguuuguguaggagugugcacuugggagguuagaggacaacguguggaagucaguccucuccuccagccacgugaguucugggggucaaaccuuggugcucaggcuugucggcaagcuccuaccuuuacugcggccaucuugcccauucaccuuuaauuuaguuuaucuuacuucuuuuuccucgauguagccucuccaucucgaccacucccucucaaaggcucugugcucgcucgagaggaguggauugccucacaucugcaauguuuugaguaaguuacugacccugaggcaggcacugugcccuguggaaucaucagagaagauaugaauaggguauugaaaaagauccagggaguugggcgcaguggugugcgccugcagacccagcugcuugggaggugagacagaaagaugauuggagcccagggguuagagacagcaacacaguaagacccugucucuuagaaggaucagaggggcugggaccaaagagauggcucagcacugaagagcacugcugcucuuccagggacugccuggccccuucccagcacccauguagcagcucucaaccagcuuccagugguuugagacucugguuccaagggaucugacacccucuucugaccuucuuauuuugacacacacuguggcacauagucacacacgcagaaaaaacacccacagacauaaaauaaaauaauaaaagaauuuuuuuuuuuuucaagacaggguuucucuguauagcccuggccguccuggaacucacucuguagaccaggcuggccucgaacucagaaauccuccugccucugccucccaagugcugggauuaaaggugugagccaccacuacccggcaauaauaaaauuuuaaaagugaucagagggaccagacaggguggugugccuuuaaucuuagcaugugggaggcagagacagcuguaucucuguuagcuccaggcuagccugauugacaugauaaaugucaggccagccugggcuauagaaugagaccaugauaacaacaacaacuacuacaacuacaacuacaacaucagcaucagagggccagcaaguugacucagcaggcaaaagcagggacccaagccacuaugcccacccagcuccaggcuugaauuugguucugagagcccaacguggaaaagaaaaccaauuucugaaagauguuuucugaccaccaacucacaugcaugguaaugauacauaaaauaaaagagaugagaaaaagaaaugagcaagaaguccuaggcugugggugagcccggugagccucggaagguucuggaugcugggcugggcuggggugggggugggggcggcagugucaguaaugagggugccgagagugagcuugaccaugauacacugaggaguuuuaagcggagaaaugggcaggauggcauaacugaacugaaggcacggaccuggggagucauucagaggggauuaaaaaaauuugagaugcgucuaaggggaguggagggcuggagaggggucagaccuccuggcuuucuccucuucugaggcuccaugucucuagagguagagcugagugaggcugaaagcugcccugcugucagcucuucuagaaccagcaccugccccucaucccaacacaccccaagcucucucccuugcaaugcaaaagggacggaaggcccugcuagacuucuucagccuagaccuacuccuggcccugcugagaaaggguuaaucugcuuugcuccccacccccccucucucucucccucccucccacccucccuucccucuccuaggucaccuucuuggcccuagagacuuggcugcuggcucaaguuccaaguuccucauccaguggcccugggugaccagagcacacagaagggccaggggccuggggguagggcuuggucuaaggagggcagaggcagccucaauaccagagcugagaggcaggugagaggcgcuagagcucgaggggagcucucagguugguucccagcccuguucagcugcuccaggacguuccgucuccacacuggucacaguuccuuccacccucugaaggaaaagccucucacauuccccuucuaaaaugguuuuguuguuuugcuuuuuuuuuuuuuuuuuuuuuuuuuuaggggagaaggcaagcuggggacuguggagggcaugguaguguucugucagcaagcuuucagcuucaagagucccucccccagugcugggaacuggucagaaaugagucuguggucagugaaaaauaccugcuaauggaacccgggcugccccacaagccacaaaaaauggggggggggggaggaggaaacgagaccuaaaugugcugcgcuugggggagggaugcggaccuaaaauagagcuguagguuaggggagagugggagauagagaccagcggugggucaggaauggcaaggguauuguagauucagggaguaacgagguaaauccgggugggugaugggaagguaacuaaguaucaaagaaauaauagcgaauagaggcugggagauggggaggggugucaaugaguggcuauggguggagaggaguuagagagaaugccugcagaggacaggaggcuuggagagcucagaaccagagcuagaugaaaugagaauaaaaggagcccacagaacugggguggggacaccgaggagcaugugggggagccguggaggacaagaguauuguguguguguccuggaagagggcagcaacugaggucauccuggcagugagaggagugggcgucaccucaccugaggagaggguaccaagagcccaaaacccucacccugccgaagccagugucagacaaagguuuucagcucuccccaucccuggcaaggcccccgcuucucagcagcucaucaucaauuauucaucaucggcacaggccacgcccucucuagcagagcugucugguccucuuccucaugcccugccccagcucagccacacugccacagaggcucuggugagaaaggacaaacagccgggccagcggaggccuggccgaaggguuagguagcuggcccugcuggaccacaccugaaguccgaucuccauccccucuggcaccuucuuccugucuccuggagaagaugcccauccagaucuuuugcucugugucauucuccucuggagaggaggccccaggauccaugggagauaucugggguccccaccaccaccaccggcagcagcaggacagcucagaaucggaagaagaagaagagaaggaaaaggagucagggauggagcuggaugagggugacucaccuagggacuugguggccuuugccaacaguuguacccuccacggugccagccaugucuuuguggaagggggcccagggccacggcaggcccuaugggcgguggccuuugucauagcacugggugccuuccugugccagguaggggaccgaguugcuuauuaccucagcuacccgcacgugacuuugcuagaugaaguggccaccacagagcuggucuucccagcugucaccuucuguaacaccaaugccgugcgguugucccagcucagcuacccugacuugcucuaccuggcccccaugcucggguuggaugagagugacgauccuggggugccccuugcuccaccugggccagaggcuuucucgggcgagcccuuuaaucuccaucguuucuacaaccgcucuugccaccgccuggaggacaugcugcucuauugcuccuacugugggggccccugugguccccacaacuucucaguggugagugggacccaugcuuaccacaacaccccaagaguauaugccauggcucucucuggccaucagaucggcuccugaggcuggggcugguaacugcugaacccuaccuaaccugggcgaaacucaccuaggaucccagcgucugcagauagauuaaggggcccccaggugcauagcuuuuccuaguugugucuugaaauaugucgccaacaguaauuagcugcuguucugaugccuggaguagccuuuagucucaucugcucuuuuccagaccucuccauggccccaaaccuuguucuagcuaugaggucaaccuuugaccugcugggggcugccugugacuggccaguuguugacuaucacccuggagugauaguuguggggaggagccaccauuuaucuagaagugcagaauggugucauagauggagagggcaggccucccuuuacccccaacaccuugucaacagauucacaacagggacuucauugcauccuuacuuugucuucugugcucuuuccuaugggaguccagccccuaccagugcucucucucucucucucucucucucucucuugcucucucucgggguguguguguguguguguguguguguguguguguuugugugugugauccaucuguuggugaaguugggaaaccucuaaaucaaacccuugcucuuagcaccuucacauucagagguaaagggacuuucuagauauggaaccagcugucaucccccgaucucccuagauuagcucauagucuggucuagccugaugccccucuagcccguguagauuucagaugccuggccuucccuuccauacccaucccucuaugcccuaccauguaggaguacaugggugucauuccagucccugaagcgauuuuaacucgguguuuugggccacugggccucaguaagggcagaggcuacagcaucuucuaacaaggaaaguaucuuccuugaggcccucugugugccucacccaagcauccaagugugccaugccuugguauucaguccugauuccugggagaagagguguuaugcuggaguaaguuugguucuugguguggcaacuggggcugcucucugguucuacugacaaugggacaaugguggacccgagagagguugagagagggaagagacugaaaggcuuagcuuugaggggcuuagguguggaggaaggccuuggaaggauuucuaacucaggggugaaaucccaaagcaaacaucuaaagaucuguuucagaaggccucagagguuuagcaguuauaggaucauggugacagccgcacacguuagggucccagcaagauugucucuugauaguuccauugaaaagacuuuaacaaaggggcuauuugcgaagcccugagcaggauuaaggaagccaguaagggagggcgauggagccagccuuaguggggaauuguaucacuccuaggcugaaagaguccuccuggcaagaguuacaauguuacaaugacgaggggcuaagccacugccguuauagagacgcagagaggagaucagcacuccacucucugucugccucuguccaaucccuuguaguucucacugguuaaacgggaccagaagcucgucuggcuggcaggacccucauguucucuacucugcccuccaccaggucuucacgcgguaugggaagugcuacacauucaacucgggccaagaugggcggccacggcugaagaccaugaaaggugggacuggcaacggccuggagaucaugcuggacauucagcaagaugaauacuugccuguguggggagagacugguauguuagccugcuuaggaccacccucccuggguuucucugagucccucuggcccuagacucaaguagggcucuacuguguggcucuaacaccaaauucagauucauccccuuucucccaagaucucaccguguuugccuuugcccuuaugugacuuccacacucucgauucccuggcuccuccuuccugguuuaguuacucuccaagguaaccaggcauccucuuccaucaguggccgccacucacucuauaaauaacucccucucuucuuggacugccuggcugucuggucucaggggacuugggggcagagagauggggagaaaagagaaggggaugaggagagauggagaggggccgagacagcgacaguccaggagaaauaaucugaaacagcaagaugcauugccgaugccagguaagagagguguguaggauccggaggucacuggagugugguggaguugcuaacauaggaggauggagaugugcuuggaccccacugccuccuuacuaagucccaauggaggcugcuuauuaccagggagggaggugugaugccccagguuccggagacgauuaaggacucagaaauccucccgguucucaugccuucaucuucacagaugagacaucguucgaagcaggcaucaaagugcagauccacagucaggacgagccuccuuucaucgaccagcugggcuuuggcguggccccaggcuuccagacguuugugucuugccaggagcagagggugaggggcugcagcagguguuggggagucgagauggaguucuggggacuggggagauggcucaguggguaaagaguuuauuaugcaagcaagaggaucucaaaugagaccccaacacccauggaaaccagaguggugcacaguuguaaccccagcucugccugggggguacagagacagguggauccuugaagcuggccagugagcugccccagauucaacaagagcuccuccuucaaaaacaauaaguagagagaaauagaggaacauauccgacaucuacgucuacuucuggacuaugcaugggggcacaaacacacacacacaugcacacacacacacacuuggcacauacaggacacauauauacacauacacuugacacauacacaugacacacacauacacacacuugacacacacacaugcacacauacuugacacauacaugcacacacacuugacacaaacacaugacacacacauacacacacuugacacacacacaugcacacauacuugacacauacaugcacacacacuugacacaaacacaugacacacacauacacacucauguccacacacgcacacucgacacacacaugcacacacacuugacacauauacacgacacacaaaugcacacucaugcacacacacacuugacacacacaugcacacacacacuugacacauagaaugacacacaaauacacacacaugacacacacaugcacacacacacucacaguggugggugaucaagaaugggaggaacacucugaaaacucugagaccuuagcgcuccagggguaagacucccaagauccauaucuuggcagagaaguccauuacggggagcuggggaaaagcccuacacuucuccagcuccccggcucucccagcagcucaucuaccugcccucccccuggggcaccugcaaugcuguuaccauggacucggauuucuucgacuccuacagcaucacggccugccggauugauugugaaacccguuaccugguggaaaacugcaacugccguauggugcacaugccaggucgggcucaagauuccgagcacagcccugggcuaucucaggcuacgcugccccucaccugugcuccgucuguauugucuuuccuaacccuggucccugaucacuucauuucuuuuguuucuggcucuugucucuuggucccugccuaugucugcagggaguaggggaggguuuuuaaaggguagacuggagaguaggucccuuccagggcaccaggguuggcuucugucccaucuuccaccuuauauaguaccacagcaucacgagacccuuuuaaucucuaccugucgugucuccuuuccuuugcaggggaugccccauacuguacuccggagcaguacaaggagugugcagacccugcccugggugagcaucucugaccugggacaguuagggggagggaagaaaaugcugucugucccaugcacaggccacugagaucaagguugaauuugauuggacaaugucuguaugcuuccaaugucugcaucugccucuaaaugccgagaacugcaccuucaaaagucucugugacgaauuaauaagagucucuugggagagccuucacccucuuucagccucagaugguugguccuuuagaacccagguuaaauacaggggcaggaaggcugggugaggaugagcugaggauagacacagggcugaggugaaugagagaggguccuagggaucucugggguaggguugguauguccauauugggaagacacuggcagaaggacaccacucagccuguucuuuucacauggguacagacuuccuaguggagaaagaccaggaauacugugugugugagaugcccugcaaccugacccgcuacggcaaggagcuguccauggucaagauccccagcaaagccucagccaaguaccuggccaagaaguucaacaaaucugaacaguacauaggguaaggugucuacugcucagggcagggcccuuguacaaggacugcagaggauacagguggacuuuaacaagagucucuggggguacagggaaguggagauaagucacagaagguccaagaggcaccugaagcguguggguuguguguguguugcggggaggggaucaagcuggaauaaguaauucaggcacucuccuccucucuccuucuuuuaucuucuaacuccaucuccaucgcuguaacugggaucgccuccacuugccagcgugcaaagugucucuuuaugcaugccauuuaauugaauccucacagcaccccuagaaggcagggcucuucauuagcaucgcaggaacagggaacacugucucagaggggcucacggcuaaggucuagaaaggggcagagguaggacuugaaccuagcuuccuuuucccccccucuccccucuguacagggagaauauucuggugcuggacauuuucuuugaaguccucaacuaugagaccaucgagcagaagaaggccuaugagaucgcagggcuuuugggugagcucgggaagggucaaccuucuccuaugccuaggauaggauacggcucccucccaccccaaacugggugcccucagccugucccauccccaggggccuuucccugagcccucugguauggcuugaaguggagaaaauggaccaggccuucucuuaggacaacguggaccagucaggcaucagaggagggguugagggauagaggcagaaccugcuccauacguccguccuuggaaagugguccagacacuaaaaaaguaguguguuuuguaaagaauuuauuuuuucuugaauaagaaacacucauuuuggggaaggaaaauacaaaaaaaagaauagagaauaaaaacccugccagagucugguugucugauccuucuguauuggggguaccaaucucagcaaacauggcuggccugccccaguccuauugagccccauagccccuugguccugaguccacuaaccucuccgaccugaccccacaggugacaucgggggccagaugggauuguucaucggggccagcauccucacagugcuggaacucuuugacuaugccuaugagguaaggagguaagggggcagggcuuggcggggccaccccggauuggggauuccgguccacccacccuacccugaacaucucccaggucauuaagcaccggcuguguagacgugggaagugccagaaggaggcuaagaggaacagcgcagauaagggcguggcgcucagccuggaugacgucaaaagacacgugagggagcaaggcagggaggcgaccuccuguguacccuucccccacagccucaaaccaacuccaucuccacaccaccugucuuuccuguaucccuuucuguaacucguuccugucuuauguccuucucuuagaaucccugcgagagccuccgaggacauccugccgggaugacguacgcugccaacauccuaccucaccaucccgcucgaggcacguuugaggacuuuaccugcuaagcccucgccagccgcuguaccaaaggccuagguggggagggcugggggagcaagggguaccuaacugcccccagcuacccuggggacuuaaacugcaucccugggcagugguucccucuugucuguggugagaaaggagucuugaccagaguccucucccagccucuaucucaucuuuuuauuuuaacaaaauuaaacuaauauaaagagagagagagagagagagagagagagagagagagagagaucagccgcgaccucaggcugccccucugcuccacgcugccgcccccagcuccaagccugaauucugucugucuggcuguaugucaucugaguguccaccuacauucugcugccuccagucaccaaagcccccuccuagugagggguggaggggaucucuagggucugaaauuuggccccaaaccagagaauguaccuuaagggagagggcuggugugggggcuucccuagccuuaagagaugcucucagccgggugacuccccacgagcccaagucuccagguaaggacuccgugcccaguuacugcucccucaagcauacggaaucuuuacggggcagaggauuuccugaagaaguagagauugggacuccauguggcccuggugcuguaggccacaucccaauaucuguaagucaccuccaccccaaagcugcuggagagagaucccaagaggcaacccucugugacaucccccagaagaccuggcugguuagcgcccggcucagggagaggggcacggccgccugaccucacuggcuucucucucagaggccuuugcagaaggccacauccauaaauuuucuuauggaacaaucccaaguccucuuccccgacgucauccgcuucucucggcaaccucaucugcauuuucuauuucuauaugauacagacucuauauuacuauaaccuuguauauacuccccuccggcccuguuugucucccccuccauucccucuugucuccaagaaccgcccucccgccccuaguucucccuucugucucucccccauucuccugucucugaaugccuuugcccguauaaagagcuggauucuccccuggugucuguacuguacuguguacacacaucccucugagaagcacaaggagaugacacgcgcauuguaaccuucgcacugucucgguggcgacauaaaggaagcugugaauuacaagcucugccucuuucuggccucgcccuuugcccccacgaccggggcacccucugcccuccccacagccuuaacauacccucuaccuugcuccaccuaucccagugcccuuugccuggcugacuguggccucccugagggaagugacugcuggagagguagcuccuacccaggaauggaggacacuaagcggagagaguuacagacgggagguggggagggaggcuggggauuggugacucccucuugcagcugggcgguggguacccacagccagaagccggagcccugacucaguggccuuucuuucuucggggugcccagggcccaguccucaccuugaugcccaggcccaccgcuugcauuuucuggugagucagggcguggucacaugaggaaagagauuggccuagagcagaaguugaaagacgugcuguugugugucccuacccuaagggggccacaaggugagguagagggccuccucaaccagacacccuucccaggccagcucuccaaucucauuccuggccuucucuguccccacugucucuuggucucuaaucccaaaacaggacuuaugggcagaucaccuguguacguuggccuggagccagagagcaaggcuuuggcaucuuugagaccucuugguucucaagaguuguuuagagaucagaacuccccagaaagaaacagggcaaagcugagaaauguacacuggcugggggggcagcaggaggggcucugggugacgcaugccucuggucuaauaaacuggguuucaaccaucucuucaguguugguuuucuguuuguuguuugguuuguuuugagacaggguuucucu

SEQ ID NO: 7995 - RNA, 8939 nt, Mus musculus
gcuccugagguguguggguccgaucucgcgaggaccuuguucuguuccgaggacagcuggccuuggacuaggacccaccaacccuuguggaaaccuacugaaccuuugagcugcuccuuaguucuaagccuacagaugccggguggccuuccaggcugggugagaacgacuugggcaaaaggaaagggcagagucaagaauaugggcugacagcccugaggacgauaaacuauaaauccuacauucuguuagacgugaaguugguggugacugcagagagaagcggccuuguggggaggacccugagaagaaaggucagcaguaggaggggcuggccggggccggagcuccugacuggggagguggacaaauaggaaggucaggggagccugagccaucugagccugcugugaaaagaguguagcucugucagcagauuagauuccugcuccccaaagagggugcuggcagcugggugcaggcaagggaaagcugggaaaggucacacaggguggggaggcccugacaaagcuccaggaaccaggaagucucugggaagaauggagcgccccagggccagagaugccuguggagagcaacucuugugccagaguagccugggggagggggaaguagaggcuucugaggaagcaaguguugcuaggagaaguuagagugggguuguuugagagcuuuguauuuuguuagcaaacagugagaucguugauguuguguggggccuggcagaggucggccaaagggucucuggggucugugucagcucaggcauccagacccuucccuuggcagccuuugccccaucuuuccuguggcugaagugcuucuucagucacuuaaugggacuugggaccgguucccagugugugugaggcagcaaccggcagcccuugacuuggcgccuucccuucccccaaccccaccccuggagcaggcaccacuggggcuuaguucuacacuucccagaggacagcaaggaaguguggauucuguggcgagcaucucuagguguguagcugagccccgcagccuccuguccucaggguccuucagagaggacucugcuagauggggaguccuggagacaguccugaugacgggugucacgugcuuccuuccgcuugucuccguuggggcaaaggggcugccuguccugggcccuggccccauucacauguguuccgggugguucugcagacagcggaugaauucgcccacuggcuggcccucauagcacacuuuguacaccgcagugaacaaggggaaccuagagaaaaagagccucagcuucacucccuacacacaguccacccucaacaugcaugcccacccagguccagacucagugcuagcucaccacuucccuagccucccgcagugggaguucagccagaagccagcucucuguugcuaccugccaggaaucugaauuccuggcccugggauuuggggucagguugccauccacucugaucuuuagcauucugcacuugcuugacucagucgcaugcaggcuuuaaauauuguuugguuuuuaacaaguaaaccauucaauucucuggaccucagugucaccgguuguaaaauggguccaguaugauaaaguagcaaagauguaguuuauguucuauauacugguauacuaagccaguuguuucuuaucauccccgcuuggcuauucccuauauccaaagccaugagccaagaaaggggagaccaugcaaaaggggcugagcagcuaguggaaagaggguggacuggcugaagauacucggcacccagacacuccaagcucucucuguccauugcacagguugugugggguucaagaggauggggaaagggguggcagucaaccugugacuccucccccaagggcgcuggcaaacacucacuuguccacaaggcccuuguguuggagaaugcugugcagcucccgggcugucuggggccccuguagcuucugcccauuuagcaucuccuucuccagcugcucaauggacuguggagaggaugccacgagaagggaagugggagagggcgcugugugagcagcaaggucgggugggaagugggaucuugagggggugaaggaguaauggccccuguuccaaacaauuucuccauucccgugguugaacgcagggccucaugcgaacucugcauagguaagugcucuaccacugagccacauuccagucagucacuguccaucugagacagggucuggcugccggaauaccugccccgcacaucaccccucccccaccuugacaucucccugccuaccuuuccaguucgagcaaaggccucugccaccuugcgguuccgccccccauagcaggucgugaugaggucugcgaccccgcagcucuccaggaagguggccgaggacacagugccacugcagaagagcuuggcgaaggcgaucaucuccaugagccccaaccggaucaccgccgccuugguguugucaccgaagccaagcccaucacagaagccagccccaacggccacuauauucuuugaggaguagagacacaggugagaaauuugccucuccagaggcuccacuuggagccuucugcaccuccccaugcugcauguaucagccuuggcaaacccaucaaugaaccauguagccuccucuuaaaccaagaucucugcuuccugcuuucccauguggugugugccuucccaacacccacgugugcgcguguguguguguguguguguguguguguguguuuguguguguguguguguguguguguguguagauauaucugugagcuuauauguguggaagugauugacaugguuuuccucuccaguguuguuaauaauaauaauaauuugccagacaggguuucacuauauaacuuuagcuggccuagaaaucucuguagaccaggcugggcucaaacucacagagaaccaccugccucuaccuccuacgugaugggauuaaaagcguaccucacgaugcccagaaaaccuugguuuugagauagcaucucucggugaaccuggagcucacugguugagcuugacucucuguccagaaggcugcaggaaccucaccccucugcuuccucacuguuggaguuaccacugagccuagcuuuucagcauggguccugggggaucaaguccucaccaggcuugugugacaagcucuuuaccaacagaaucaucucccuagccuugcuggccuugaacucagagaucugccuaccccugccuucuaagugcugggauuaaaagagugcacaccaccaucaccuggcaccuuuucuuaauuucuaucucauauuuauucuugacauucccugugagagucacucuuccccuacccccuuuuucuuuucagacagugccucacuauguagucccugacccgccacuaacucauagagaucugccuucccuccugagucccccgagugcugggauuaaaggcaugugccacuauaguucuggccaucuguucccuguuguugugugacaagcucuuuacccugacaucucuucacacuggaccaucacauagacucagggcuggauccaucucagaggaggucuaagggggguggaggaagaaggacccacugcugacugguuaagguuaagagucagcaagccuggaugcccugcucugaauggggcaguggugaugcugcccaaaugccagaguugguuccagcaaccugaaagagcucagcugggcccgcuggcgggcuucuccucacuccaaagccaucuccguauccucucaccuucaaggccccacagaucuccacuguguccaccucuuguaccacagugaugcgaaaguugggugucugcaucagguccuucaggagcugucccugggccggguccuugcagccuaaaguagagaaggggugaagcuuggagggacaaccucuuauuuugauccuuaagauggucuguuggacucuugcuguguugccuaggcuggcccagaacuccugggcuucagucuccugagaaguugggacaacaggugcaugguacaaaguaacaacucaacugucccucacauaaacaagacucacagccccauccccgaugucccacccuccccuccccuuccuuccccuccccucugaggcuuucuucuuucccugcuguggagggaccgauagcuaagggcuugggcagcagcuggggcugugugguguguacagaaaucucaccgauggucgucucacagaacuucuccucagccaccucgcuggcaauguuggcccccaucagcacgcucaugggaaugccaaggcgcuccccaaucacuucagaaaugagcuucagcccguuggggcccucgucuacccccugggcagaggguggagcucagguaagcuguccuucaggcccaucugugccccuuuccagagguucugccccaauccuacccagcccagacuugcugugagcauagcagacagcagugaccaacccaucucagcaaacucccacccacacacggcuuauccagccuaccucuuagaagcauucuacuccuuauacccccaaggaacccccuagacaccccaacccacuucuuuucuaagacaucugccuccaaagcuaucuugucuuuguuaaguagcccagcagcugacacccccccucauccccucucccucuccuucucucuuucugucuuucuuucugccucccuccucccuccccuuucuggggagauugcuagggauugaacucgggaccucaugcaugcuaggcaaacucucugccacuaagcuauacuucagccccaacugcuugcuugcuugcuugcuugcuugcuugcuuuuuuuuuggggggggggguugguuuuuuuguuuuuuuguuuuuucgagacaguguuucucuguguagcccuggguguccuggaacucacucuguagaccaggcuggccuugaacucagaaaucagccugccucugccucccaagugcugggauugaaggugugugccaccacgcccagccccaacugcuuucuuuacucucuccaaagccaaucccucccaucuccauccggguugucggucuuguucuguauauucuuuuaugugcucuucuaucuacccccacaccccacaaaaguuagcugcaccucacccccaaacaugccaaagcgucucugguaccuuaauaagagauaugccaauaguauuggccuucaaguggcccuugagcuggucacagaucuugccaaugaacugaugggguaccacaaaaaccaggaugucagcgccuguugcagccuggaccacgucugggauggccaccugugaaggagagcagaagcucucgugugccugguagaccucuccuagucccaaggggacccccuugcagaagaucuccaagccaguguuaggggagggaggguuuuugagacuuuaacaggaacuaucagaacuucuguguucccuguccccagcucuccuggggcacugaagcuuccuagaacacgccugccuccacgcugccacacguuuagcccuuggcuaugggucagugaagacugccaaaggcagccuaggccuggcagggggaagaggccaacuaagauuucaucacugcugcgucuuaggggcccgaacuuggcagugggagccccagucucccugcggacucucuguccccccuuucuaggugaggagaaugccauauggauuugaccaaagaccaaaaguccaaugaucagccuucagaucugcuaauaaccagugaaugaguaacaggguuagaguucagggcaggcaggagaaguuggaccccgaguccgggagccugagaaccagccuuugguugccauggagaccccucuuuuccaccuagcaccucuaaggggugguacauucagauuccagaaagauuccaaaagaguaauauaggggcuuaaugggggagggguacuccaggccuagagcaccccgccugcugcuccaccaagccagcgggcgccuacaguggccuccuccccuccucugggaaggaggcaccucgaagucacuuuugcguguugacugaguauacccuuuccuugccucgcucucucucucuucucacaucgaguuggagcucaccacauuggggggcagcuugugcccuggcagguauuuaacauucucgugcugaguguugaugaucucaguuagcuuucugcccccgaugucuuccucaaacacccacauggucacccgugggucaaagugugccagccggccugcauugcuacccacgaucuuggcaauggcugagccccuggcgggagaggaaacacaggaaaguggacuagggugacagggaggagggggaggaacucauaaagcuuguuggauuuuuuuuuaccuccugccucucacucucacgucacuccgccccccuacucccacccugguccccuaugaugaaugugucucccacaacuggcaauagaagauucaaucuauccagucuuugcugcuggggaggugggcuagccuucccuacaccgcgcaggcagcuucucaggcagggaaggcaacagcacucugcucaccuuccuguggugaacaggugcagcgcccaggcgggcacagccgggaggcugggcacagacuguccuguguaccguaagcacuggagacggcagcaggaguccagcuggcuccugagggcauuuccuacccucugcccgcuuccugcucacccagccucccuccgcggagccccucagcccucggagagcccuucccucccccccugcccuucacagaaccacucaccaguugccagagccgacaaugcagacuuucuugccagccauggugcugcuugcugcuucucugccccggcgggugugggcuccgaguauuuaacuccaccacacgugggugcagccaagcuccgccccugagguggcccagaggcuggcacccagggacuaggagucuggccugcagaaaggguaguaaaggggacagacagguggagaacaggacugaggcugaggccaggccagcuuuuccucucgaguucccagcugacagugcuggccagcuucuucccucguuuggccucggcuuaguucuccaccuacguauugguauugagucuggucaagaaacaguaacacccccccccccccagcuaucacacccccccccagcuaucacaccccccccccccagcuaugccuucagucuccagcacugaaauaaacugcaacugacagggcucggcaugguggugcaugucuuuaaccccagcgcuugggaagcagaggcaagagggucucgaugaguucgaggcuagucuguuucagagagagagagaaaaaagcacuagcgucagcaacagcgauguuuucaaaggcaaacgccucaucgcucucgcuagcuagcaugugccucccccagauccucagcuguuccacucccaugaugucccaugaugguagcuccaccacgggcucugggugagaggaucaagggaugugagcaccuucuagggaauaauacuacaauaccacauacacaguaaggggcugcuuugguguauacccccaccccgaccaaggauuaaaauaucucgggagaaaauggacauaguggugcacaccuuuaauccuggcguucaggaggcagagguaggugaaucucuguguguuugaggccagccuggucuacagagugaguucccagauaguggggggggggggguuacauaaagaaacccugucuuggaaaacuaaaaauaacaaggucaucuugguuacuugcaggucagggacccacagguugccccuucaccucagauaaucuccguuugaaggucucuaaagggaaggaaggucaaaggccacuggugacacguggcccacccacacuccuuccaggcuucaggaagggcagaaggugguggccagcacaugcuccuggauaagccugaucucccuucaauuucuucucucaggcucugcuuaucccacagggacccuuaaauuaaacagcugguuacagucucuagacagggccagagaagccaguuacagcagcagccucuaaaacucaaggguagccaugucuccgcagcucuguggucucugaugccgguguggguguguagcuuugggggagggggagaaaggcaggcccauauccagcaguuugggcuccauggcacccacagacaucuguuugacuaagaggaggaacucggguuuccaagucacucuggaaagcgcagcgcaggcuucucgcccuccagugcugcaccuugacccacagggcaggcgccacuguaugcucaugugcagaccuccuggcuuggcacaccacuaauggaguguugccacccacccccccaggcugccccuggccagggacaguaaucagcacuagguuagaggggagugucaccaaugccaccagcggcgaggagaaguggguaggaggucaggauuggaagcaugucuuuuucucagcucggggauuacacagaggcagccuaucauggucucgcggccaggcagucucuaaugauggggagaaucacugaaaucaaucaauagcuaguuguuuuucuucuaucagauucugccugaugcagagcuagccucccacagaccucuccuuuaucacacuggcacagagaugaaggcuccggugccaggccgccagcugggagcgcugauuacgagggguggaagagaaaggauguuccugucccuggcacauaugauaggaacccuaaagaaugggcauuuaugccugaaacggauccuuguuuuugcuuaaauacucccgccucucuuugccccuacauccuauuaggcuguguggagagacaaagcacguggccauucacgaaggaauaaagagaaugcucguuaacag

SEQ ID NO: 7996 - RNA, 8063 nt, Mus musculus
ugaaaacaucgcuguugcugacgcuagugcuuuuuucucucucucucugaaacagacuagccucgaacucaucgagacccucuugccucugcuucccaagcgcugggguuaaagacaugcaccaccaugccgagcccugucaguugcaguuuauuucagugcuggagacugaaggcauagcuggggggggggggugugauagcugggggggggugugauagcuggggggggggggguguuacuguuucuugaccagacucaauaccaauacguagguggagaacuaagccgaggccaaacgagggaagaagcuggccagcacugucagcugggaacucgagaggaaaagcuggccuggccucagccucaguccuguucuccaccugucuguccccuuuacuacccuuucugcaggccagacuccuagucccugggugccagccucugggccaccucaggggcggagcuuggcugcacccacgugugguggaguuaaauacucggagcccacacccgccggggcagagaagcagcaagcagcaccauggcuggcaagaaagucugcauugucggcucuggcaacuggugagugguucugugaagggcagggggggagggaagggcucuccgagggcugaggggcuccgcggagggaggcugggugagcaggaagcgggcagaggguaggaaaugcccucaggagccagcuggacuccugcugccgucuccagugcuuacgguacacaggacagucugugcccagccucccggcugugcccgccugggcgcugcaccuguucaccacaggaaggugagcagagugcuguugccuucccugccugagaagcugccugcgcgguguagggaaggcuagcccaccuccccagcagcaaagacuggauagauugaaucuucuauugccaguugugggagacacauucaucauaggggaccagggugggaguaggggggcggagugacgugagagugagaggcaggagguaaaaaaaaauccaacaagcuuuaugaguuccucccccuccucccugucacccuaguccacuuuccuguguuuccucucccgccaggggcucagccauugccaagaucguggguagcaaugcaggccggcuggcacacuuugacccacgggugaccauguggguguuugaggaagacaucgggggcagaaagcuaacugagaucaucaacacucagcacgagaauguuaaauaccugccagggcacaagcugccccccaauguggugagcuccaacucgaugugagaagagagagagagcgaggcaaggaaaggguauacucagucaacacgcaaaagugacuucgaggugccuccuucccagaggaggggaggaggccacuguaggcgcccgcuggcuugguggagcagcaggcggggugcucuaggccuggaguaccccucccccauuaagccccuauauuacucuuuuggaaucuuucuggaaucugaauguaccaccccuuagaggugcuagguggaaaagaggggucuccauggcaaccaaaggcugguucucaggcucccggacucgggguccaacuucuccugccugcccugaacucuaacccuguuacucauucacugguuauuagcagaucugaaggcugaucauuggacuuuuggucuuuggucaaauccauauggcauucuccucaccuagaaaggggggacagagaguccgcagggagacuggggcucccacugccaaguucgggccccuaagacgcagcagugaugaaaucuuaguuggccucuucccccugccaggccuaggcugccuuuggcagucuucacugacccauagccaagggcuaaacguguggcagcguggaggcaggcguguucuaggaagcuucagugccccaggagagcuggggacagggaacacagaaguucugauaguuccuguuaaagucucaaaaacccucccuccccuaacacuggcuuggagaucuucugcaaggggguccccuugggacuaggagaggucuaccaggcacacgagagcuucugcucuccuucacagguggccaucccagacgugguccaggcugcaacaggcgcugacauccugguuuuugugguaccccaucaguucauuggcaagaucugugaccagcucaagggccacuugaaggccaauacuauuggcauaucucuuauuaagguaccagagacgcuuuggcauguuugggggugaggugcagcuaacuuuugugggguguggggguagauagaagagcacauaaaagaauauacagaacaagaccgacaacccggauggagaugggagggauuggcuuuggagagaguaaagaaagcaguuggggcugggcgugguggcacacaccuucaaucccagcacuugggaggcagaggcaggcugauuucugaguucaaggccagccuggucuacagagugaguuccaggacacccagggcuacacagagaaacacugucucgaaaaaacaaaaaaacaaaaaaaccaacccccccccccaaaaaaaaagcaagcaagcaagcaagcaagcaagcaagcaguuggggcugaaguauagcuuaguggcagagaguuugccuagcaugcaugaggucccgaguucaaucccuagcaaucuccccagaaaggggagggaggagggaggcagaaagaaagacagaaagagagaaggagagggagaggggaugagggggggugucagcugcugggcuacuuaacaaagacaagauagcuuuggaggcagaugucuuagaaaagaaguggguuggggugucuaggggguuccuuggggguauaaggaguagaaugcuucuaagagguaggcuggauaagccgugugugggugggaguuugcugagauggguuggucacugcugucugcuaugcucacagcaagucugggcuggguaggauuggggcagaaccucuggaaaggggcacagaugggccugaaggacagcuuaccugagcuccacccucugcccaggggguagacgagggccccaacgggcugaagcucauuucugaagugauuggggagcgccuuggcauucccaugagcgugcugaugggggccaacauugccagcgagguggcugaggagaaguucugugagacgaccaucggugagauuucuguacacaccacacagccccagcugcugcccaagcccuuagcuaucggucccuccacagcagggaaagaagaaagccucagaggggaggggaaggaaggggaggggagggugggacaucggggauggggcugugagucuuguuuaugugagggacaguugaguuguuacuuuguaccaugcaccuguugucccaacuucucaggagacugaagcccaggaguucugggccagccuaggcaacacagcaagaguccaacagaccaucuuaaggaucaaaauaagagguugucccuccaagcuucaccccuucucuacuuuaggcugcaaggacccggcccagggacagcuccugaaggaccugaugcagacacccaacuuucgcaucacugugguacaagagguggacacaguggagaucuguggggccuugaaggugagaggauacggagauggcuuuggagugaggagaagcccgccagcgggcccagcugagcucuuucagguugcuggaaccaacucuggcauuugggcagcaucaccacugccccauucagagcagggcauccaggcuugcugacucuuaaccuuaaccagucagcaguggguccuucuuccuccaccccccuuagaccuccucugagauggauccagcccugagucuaugugaugguccagugugaagagaugucaggguaaagagcuugucacacaacaacagggaacagauggccagaacuauaguggcacaugccuuuaaucccagcacucgggggacucaggagggaaggcagaucucuaugaguuaguggcgggucagggacuacauagugaggcacugucugaaaagaaaaaggggguaggggaagagugacucucacagggaaugucaagaauaaauaugagauagaaauuaagaaaaggugccaggugaugguggugugcacucuuuuaaucccagcacuuagaaggcagggguaggcagaucucugaguucaaggccagcaaggcuagggagaugauucuguugguaaagagcuugucacacaagccuggugaggacuugaucccccaggacccaugcugaaaagcuaggcucagugguaacuccaacagugaggaagcagaggggugagguuccugcagccuucuggacagagagucaagcucaaccagugagcuccagguucaccgagagaugcuaucucaaaaccaagguuuucugggcaucgugagguacgcuuuuaaucccaucacguaggagguagaggcaggugguucucugugaguuugagcccagccuggucuacagagauuucuaggccagcuaaaguuauauagugaaacccugucuggcaaauuauuauuauuauuaacaacacuggagaggaaaaccaugucaaucacuuccacacauauaagcucacagauauaucuacacacacacacacacacacacacacacaaacacacacacacacacacacacacacacacacgcgcacacguggguguugggaaggcacacaccacaugggaaagcaggaagcagagaucuugguuuaagaggaggcuacaugguucauugauggguuugccaaggcugauacaugcagcauggggaggugcagaaggcuccaaguggagccucuggagaggcaaauuucucaccugugucucuacuccucaaagaauauaguggccguuggggcuggcuucugugaugggcuuggcuucggugacaacaccaaggcggcggugauccgguuggggcucauggagaugaucgccuucgccaagcucuucugcaguggcacuguguccucggccaccuuccuggagagcugcggggucgcagaccucaucacgaccugcuauggggggcggaaccgcaagguggcagaggccuuugcucgaacuggaaagguaggcagggagaugucaaggugggggaggggugaugugcggggcagguauuccggcagccagacccugucucagauggacagugacugacuggaauguggcucagugguagagcacuuaccuaugcagaguucgcaugaggcccugcguucaaccacgggaauggagaaauuguuuggaacaggggccauuacuccuucacccccucaagaucccacuucccacccgaccuugcugcucacacagcgcccucucccacuucccuucucguggcauccucuccacaguccauugagcagcuggagaaggagaugcuaaaugggcagaagcuacaggggccccagacagcccgggagcugcacagcauucuccaacacaagggccuuguggacaagugaguguuugccagcgcccuugggggaggagucacagguugacugccaccccuuuccccauccucuugaaccccacacaaccugugcaauggacagagagagcuuggagugucugggugccgaguaucuucagccaguccacccucuuuccacuagcugcucagccccuuuugcauggucuccccuuucuuggcucauggcuuuggauauagggaauagccaagcggggaugauaagaaacaacuggcuuaguauaccaguauauagaacauaaacuacaucuuugcuacuuuaucauacuggacccauuuuacaaccggugacacugagguccagagaauugaaugguuuacuuguuaaaaaccaaacaauauuuaaagccugcaugcgacugagucaagcaagugcagaaugcuaaagaucagaguggauggcaaccugaccccaaaucccagggccaggaauucagauuccuggcagguagcaacagagagcuggcuucuggcugaacucccacugcgggaggcuagggaaguggugagcuagcacugagucuggaccugggugggcaugcauguugaggguggacuguguguagggagugaagcugaggcucuuuuucucuagguuccccuuguucacugcgguguacaaagugugcuaugagggccagccagugggcgaauucauccgcugucugcagaaccacccggaacacaugugaauggggccagggcccaggacaggcagccccuuugccccaacggagacaagcggaaggaagcacgugacacccgucaucaggacugucuccaggacuccccaucuagcagaguccucucugaaggacccugaggacaggaggcugcggggcucagcuacacaccuagagaugcucgccacagaauccacacuuccuugcuguccucugggaaguguagaacuaagccccaguggugccugcuccaggggugggguugggggaagggaaggcgccaagucaagggcugccgguugcugccucacacacacugggaaccggucccaagucccauuaagugacugaagaagcacuucagccacaggaaagauggggcaaaggcugccaagggaagggucuggaugccugagcugacacagaccccagagacccuuuggccgaccucugccaggccccacacaacaucaacgaucucacuguuugcuaacaaaauacaaagcucucaaacaaccccacucuaacuucuccuagcaacacuugcuuccucagaagccucuacuucccccucccccaggcuacucuggcacaagaguugcucuccacaggcaucucuggcccuggggcgcuccauucuucccagagacuuccugguuccuggagcuuugucagggccuccccacccugugugaccuuucccagcuuucccuugccugcacccagcugccagcacccucuuuggggagcaggaaucuaaucugcugacagagcuacacucuuuucacagcaggcucagauggcucaggcuccccugaccuuccuauuuguccaccuccccagucaggagcuccggccccggccagccccuccuacugcugaccuuucuucucaggguccuccccacaaggccgcuucucucugcagucaccaccaacuucacgucuaacagaauguaggauuuauaguuuaucguccucagggcugucagcccauauucuugacucugcccuuuccuuuugcccaagucguucucacccagccuggaaggccacccggcaucuguaggcuuagaacuaaggagcagcucaaagguucaguagguuuccacaaggguugguggguccuaguccaaggccagcuguccucggaacagaacaagguccucgcgagaucggacccacacaccucaggagcuggggaacucgagggaaggacaauugaaaacugccugcccuggggugagggagaucagagggggaugggagacugcuuugcacuggcccuguuccaaaguuggguggcagcaagagaaugucacagaucagcagccuggagcgcuagcuauaaauagcuggagguuucucucuccaccaggggucuccauuuccuguguggcagcaacugggacaccguggcucuggccagcuugauauuaaacuaacacauuaaggugccaggucccucucugcuccuagccuuuaagaauuccgucuuagugaaggucagagcugucggguaaggggaagagggggggcccugucaucgaucccgacugggcuggaacccucccacgcaugacucaauucagagcuguuccccgggagacuggggcgggaugcagacagauuccaacaccuuaaccuauguuugcucagucagucaacugugaaucugaggucuucugucaggccacuugucuacccaauaaagugugguuuuuccagaaacuggaagaguugggggaguuuauguggcaguguguggggucauguaucacugcaugcauguuuuacucaauguaagacaagaaguggaaaaaaucauccuuguuuaauagcagccaca

SEQ ID NO: 7997 - RNA, 8063 nt, Mus musculus
uguggcugcuauuaaacaaggaugauuuuuuccacuucuugucuuacauugaguaaaacaugcaugcagugauacaugaccccacacacugccacauaaacucccccaacucuuccaguuucuggaaaaaccacacuuuauuggguagacaaguggccugacagaagaccucagauucacaguugacugacugagcaaacauagguuaagguguuggaaucugucugcaucccgccccagucucccggggaacagcucugaauugagucaugcgugggaggguuccagcccagucgggaucgaugacagggcccccccucuuccccuuacccgacagcucugaccuucacuaagacggaauucuuaaaggcuaggagcagagagggaccuggcaccuuaauguguuaguuuaauaucaagcuggccagagccacggugucccaguugcugccacacaggaaauggagaccccugguggagagagaaaccuccagcuauuuauagcuagcgcuccaggcugcugaucugugacauucucuugcugccacccaacuuuggaacagggccagugcaaagcagucucccaucccccucugaucucccucaccccagggcaggcaguuuucaauuguccuucccucgaguuccccagcuccugagguguguggguccgaucucgcgaggaccuuguucuguuccgaggacagcuggccuuggacuaggacccaccaacccuuguggaaaccuacugaaccuuugagcugcuccuuaguucuaagccuacagaugccggguggccuuccaggcugggugagaacgacuugggcaaaaggaaagggcagagucaagaauaugggcugacagcccugaggacgauaaacuauaaauccuacauucuguuagacgugaaguugguggugacugcagagagaagcggccuuguggggaggacccugagaagaaaggucagcaguaggaggggcuggccggggccggagcuccugacuggggagguggacaaauaggaaggucaggggagccugagccaucugagccugcugugaaaagaguguagcucugucagcagauuagauuccugcuccccaaagagggugcuggcagcugggugcaggcaagggaaagcugggaaaggucacacaggguggggaggcccugacaaagcuccaggaaccaggaagucucugggaagaauggagcgccccagggccagagaugccuguggagagcaacucuugugccagaguagccugggggagggggaaguagaggcuucugaggaagcaaguguugcuaggagaaguuagagugggguuguuugagagcuuuguauuuuguuagcaaacagugagaucguugauguuguguggggccuggcagaggucggccaaagggucucuggggucugugucagcucaggcauccagacccuucccuuggcagccuuugccccaucuuuccuguggcugaagugcuucuucagucacuuaaugggacuugggaccgguucccagugugugugaggcagcaaccggcagcccuugacuuggcgccuucccuucccccaaccccaccccuggagcaggcaccacuggggcuuaguucuacacuucccagaggacagcaaggaaguguggauucuguggcgagcaucucuagguguguagcugagccccgcagccuccuguccucaggguccuucagagaggacucugcuagauggggaguccuggagacaguccugaugacgggugucacgugcuuccuuccgcuugucuccguuggggcaaaggggcugccuguccugggcccuggccccauucacauguguuccgggugguucugcagacagcggaugaauucgcccacuggcuggcccucauagcacacuuuguacaccgcagugaacaaggggaaccuagagaaaaagagccucagcuucacucccuacacacaguccacccucaacaugcaugcccacccagguccagacucagugcuagcucaccacuucccuagccucccgcagugggaguucagccagaagccagcucucuguugcuaccugccaggaaucugaauuccuggcccugggauuuggggucagguugccauccacucugaucuuuagcauucugcacuugcuugacucagucgcaugcaggcuuuaaauauuguuugguuuuuaacaaguaaaccauucaauucucuggaccucagugucaccgguuguaaaauggguccaguaugauaaaguagcaaagauguaguuuauguucuauauacugguauacuaagccaguuguuucuuaucauccccgcuuggcuauucccuauauccaaagccaugagccaagaaaggggagaccaugcaaaaggggcugagcagcuaguggaaagaggguggacuggcugaagauacucggcacccagacacuccaagcucucucuguccauugcacagguugugugggguucaagaggauggggaaagggguggcagucaaccugugacuccucccccaagggcgcuggcaaacacucacuuguccacaaggcccuuguguuggagaaugcugugcagcucccgggcugucuggggccccuguagcuucugcccauuuagcaucuccuucuccagcugcucaauggacuguggagaggaugccacgagaagggaagugggagagggcgcugugugagcagcaaggucgggugggaagugggaucuugagggggugaaggaguaauggccccuguuccaaacaauuucuccauucccgugguugaacgcagggccucaugcgaacucugcauagguaagugcucuaccacugagccacauuccagucagucacuguccaucugagacagggucuggcugccggaauaccugccccgcacaucaccccucccccaccuugacaucucccugccuaccuuuccaguucgagcaaaggccucugccaccuugcgguuccgccccccauagcaggucgugaugaggucugcgaccccgcagcucuccaggaagguggccgaggacacagugccacugcagaagagcuuggcgaaggcgaucaucuccaugagccccaaccggaucaccgccgccuugguguugucaccgaagccaagcccaucacagaagccagccccaacggccacuauauucuuugaggaguagagacacaggugagaaauuugccucuccagaggcuccacuuggagccuucugcaccuccccaugcugcauguaucagccuuggcaaacccaucaaugaaccauguagccuccucuuaaaccaagaucucugcuuccugcuuucccauguggugugugccuucccaacacccacgugugcgcguguguguguguguguguguguguguguguguuuguguguguguguguguguguguguguguagauauaucugugagcuuauauguguggaagugauugacaugguuuuccucuccaguguuguuaauaauaauaauaauuugccagacaggguuucacuauauaacuuuagcuggccuagaaaucucuguagaccaggcugggcucaaacucacagagaaccaccugccucuaccuccuacgugaugggauuaaaagcguaccucacgaugcccagaaaaccuugguuuugagauagcaucucucggugaaccuggagcucacugguugagcuugacucucuguccagaaggcugcaggaaccucaccccucugcuuccucacuguuggaguuaccacugagccuagcuuuucagcauggguccugggggaucaaguccucaccaggcuugugugacaagcucuuuaccaacagaaucaucucccuagccuugcuggccuugaacucagagaucugccuaccccugccuucuaagugcugggauuaaaagagugcacaccaccaucaccuggcaccuuuucuuaauuucuaucucauauuuauucuugacauucccugugagagucacucuuccccuacccccuuuuucuuuucagacagugccucacuauguagucccugacccgccacuaacucauagagaucugccuucccuccugagucccccgagugcugggauuaaaggcaugugccacuauaguucuggccaucuguucccuguuguugugugacaagcucuuuacccugacaucucuucacacuggaccaucacauagacucagggcuggauccaucucagaggaggucuaagggggguggaggaagaaggacccacugcugacugguuaagguuaagagucagcaagccuggaugcccugcucugaauggggcaguggugaugcugcccaaaugccagaguugguuccagcaaccugaaagagcucagcugggcccgcuggcgggcuucuccucacuccaaagccaucuccguauccucucaccuucaaggccccacagaucuccacuguguccaccucuuguaccacagugaugcgaaaguugggugucugcaucagguccuucaggagcugucccugggccggguccuugcagccuaaaguagagaaggggugaagcuuggagggacaaccucuuauuuugauccuuaagauggucuguuggacucuugcuguguugccuaggcuggcccagaacuccugggcuucagucuccugagaaguugggacaacaggugcaugguacaaaguaacaacucaacugucccucacauaaacaagacucacagccccauccccgaugucccacccuccccuccccuuccuuccccuccccucugaggcuuucuucuuucccugcuguggagggaccgauagcuaagggcuugggcagcagcuggggcugugugguguguacagaaaucucaccgauggucgucucacagaacuucuccucagccaccucgcuggcaauguuggcccccaucagcacgcucaugggaaugccaaggcgcuccccaaucacuucagaaaugagcuucagcccguuggggcccucgucuacccccugggcagaggguggagcucagguaagcuguccuucaggcccaucugugccccuuuccagagguucugccccaauccuacccagcccagacuugcugugagcauagcagacagcagugaccaacccaucucagcaaacucccacccacacacggcuuauccagccuaccucuuagaagcauucuacuccuuauacccccaaggaacccccuagacaccccaacccacuucuuuucuaagacaucugccuccaaagcuaucuugucuuuguuaaguagcccagcagcugacacccccccucauccccucucccucuccuucucucuuucugucuuucuuucugccucccuccucccuccccuuucuggggagauugcuagggauugaacucgggaccucaugcaugcuaggcaaacucucugccacuaagcuauacuucagccccaacugcuugcuugcuugcuugcuugcuugcuugcuuuuuuuuuggggggggggguugguuuuuuuguuuuuuuguuuuuucgagacaguguuucucuguguagcccuggguguccuggaacucacucuguagaccaggcuggccuugaacucagaaaucagccugccucugccucccaagugcugggauugaaggugugugccaccacgcccagccccaacugcuuucuuuacucucuccaaagccaaucccucccaucuccauccggguugucggucuuguucuguauauucuuuuaugugcucuucuaucuacccccacaccccacaaaaguuagcugcaccucacccccaaacaugccaaagcgucucugguaccuuaauaagagauaugccaauaguauuggccuucaaguggcccuugagcuggucacagaucuugccaaugaacugaugggguaccacaaaaaccaggaugucagcgccuguugcagccuggaccacgucugggauggccaccugugaaggagagcagaagcucucgugugccugguagaccucuccuagucccaaggggacccccuugcagaagaucuccaagccaguguuaggggagggaggguuuuugagacuuuaacaggaacuaucagaacuucuguguucccuguccccagcucuccuggggcacugaagcuuccuagaacacgccugccuccacgcugccacacguuuagcccuuggcuaugggucagugaagacugccaaaggcagccuaggccuggcagggggaagaggccaacuaagauuucaucacugcugcgucuuaggggcccgaacuuggcagugggagccccagucucccugcggacucucuguccccccuuucuaggugaggagaaugccauauggauuugaccaaagaccaaaaguccaaugaucagccuucagaucugcuaauaaccagugaaugaguaacaggguuagaguucagggcaggcaggagaaguuggaccccgaguccgggagccugagaaccagccuuugguugccauggagaccccucuuuuccaccuagcaccucuaaggggugguacauucagauuccagaaagauuccaaaagaguaauauaggggcuuaaugggggagggguacuccaggccuagagcaccccgccugcugcuccaccaagccagcgggcgccuacaguggccuccuccccuccucugggaaggaggcaccucgaagucacuuuugcguguugacugaguauacccuuuccuugccucgcucucucucucuucucacaucgaguuggagcucaccacauuggggggcagcuugugcccuggcagguauuuaacauucucgugcugaguguugaugaucucaguuagcuuucugcccccgaugucuuccucaaacacccacauggucacccgugggucaaagugugccagccggccugcauugcuacccacgaucuuggcaauggcugagccccuggcgggagaggaaacacaggaaaguggacuagggugacagggaggagggggaggaacucauaaagcuuguuggauuuuuuuuuaccuccugccucucacucucacgucacuccgccccccuacucccacccugguccccuaugaugaaugugucucccacaacuggcaauagaagauucaaucuauccagucuuugcugcuggggaggugggcuagccuucccuacaccgcgcaggcagcuucucaggcagggaaggcaacagcacucugcucaccuuccuguggugaacaggugcagcgcccaggcgggcacagccgggaggcugggcacagacuguccuguguaccguaagcacuggagacggcagcaggaguccagcuggcuccugagggcauuuccuacccucugcccgcuuccugcucacccagccucccuccgcggagccccucagcccucggagagcccuucccucccccccugcccuucacagaaccacucaccaguugccagagccgacaaugcagacuuucuugccagccauggugcugcuugcugcuucucugccccggcgggugugggcuccgaguauuuaacuccaccacacgugggugcagccaagcuccgccccugagguggcccagaggcuggcacccagggacuaggagucuggccugcagaaaggguaguaaaggggacagacagguggagaacaggacugaggcugaggccaggccagcuuuuccucucgaguucccagcugacagugcuggccagcuucuucccucguuuggccucggcuuaguucuccaccuacguauugguauugagucuggucaagaaacaguaacacccccccccccccagcuaucacacccccccccagcuaucacaccccccccccccagcuaugccuucagucuccagcacugaaauaaacugcaacugacagggcucggcaugguggugcaugucuuuaaccccagcgcuugggaagcagaggcaagagggucucgaugaguucgaggcuagucuguuucagagagagagagaaaaaagcacuagcgucagcaacagcgauguuuuca

SEQ ID NO: 7998 - RNA, 15545 nt, Mus musculus
ggaggcacagaugagcaaguugagaagagagggggcucagcuagggcagagacaaccaagccucagucuuaaagcucaacucuggccuuaacucucagccugcagcugcguuccaagcagauagcgauucaagcagcagucugacccccaaggcuguagacgacaaaagacucaggaagacaaauuaaaaggguaagugucugagagcacacaguccugucuguauccaaacucuucaauuuuagguaccagccugaaucccagaaugagcuagacuuaacaugaaacggaauggggacucaaaucucagcauccauaaauaguucauuugaggcuuuuaugaacacaacucgaaucaaaagacauacuguccacacauugacugcuaaagcuggccagacguagaaaaucaaccucgguuaguacagguuuuccugcagugagcucuacacccaccgggcucuuaccuugguuugguuguguucaccuuucucaaacaucaucuucagucuauucaguggaacguuguauuucucuauuuugccugaaguuucuguguuuucgcucgucucuggcuucucugcuucaugccuggaaucucccagacaguuuuccauuuuuuggcucuccguggccugggcuuuaaaaucguggcuguucucugagcgaggauaccggcucuggauaacugcuuccggacgagauccaaaucuagguuugggcugggugugcucuucccggucagcucugacuccaggagcaggcuuguccgucacuucagcaggaggguaguccgcugugugcccacccucacugcugcuguuuggcagugagucuguguggaauucugccccagccaccggguucucccacuucuucuuuaacacagacagggucccucuucuaaagugcuggggcagacuuucaggguucuagaggaacaagaaguaaguaccaguuacaacuugccugcugcaacagccaaacaugcgucuuuguaaacugaaaguuaaaacuccaagcugugccugguccaccgucguucacacagcugugaacaguuacugcccugccacaaggagcgagcauccacccagggcccagagagaggaagagggaaaaagucaggagcugaagcaggaagugauaaaacaggauagccuuauaaggacaaagugagcagccuagaucucauguaguuacauuggaagggagagacuuuuucucucucaagacucaccaagaagaaaaggcagauggcuaggugccuucaacauuguaacuauauuugaauagaaguucacccagguaugccacaaacaacaagaguauauaaugcuaggaauucuuuccuaaccaaaaaacaaaacaaaacaaaacaaaacaaaaaaaccccaacaagacaaagauacaguaacuaugcacuucuaauuauaauuacugaggucaaugucagagacugcaccuaucuauaaggucuaaagauuuaccguuuuuugcaugggugguauuaguauauagcugauagaauuuauaaggcucgugggucaaauggggaccuuguuucauggcuggcaaaugcucuacuucugaccuguacucccagaccucagaucuuauuucugcauaacaaucuaauuuuuccuccauccuccucucuauuauuuaucuuuaucuacuuuguagcuaucuuggaaaaugcacuauuuuacagauccuuugcuugagaaauacacaggccucauaagaaaagagagccaccacccacuuugauacacagaagacauacauuuucccgcacaccuaugagaacaguucacuuucacuugggucaaaagugauauaauggauuggagaucaaccagcgagucgucagugacguuguagaauaauagugggaacaugcuuguuguaaaauuaggcauccugcgcuuucaaaguccuaaucaaaccaaacgccacaaacugcuaguaccuucuuacucuccaucccugcugccugugacuccuccggguuccaagugggaaagaaaggacaaacagcccaggacuggagaggucagagaauuaggggauuagcagcuauauugggaauuaggucucuggcuccuucuucucugaacacacuaagagccacuucaccacacagcagggagacauggacagaguuacaggagaccugauggauccucagauuuaaaccauggcuagaggcugcacauacagcucagagacggaagaaacacaaaaggcuccugccagguaugacugcacaaaucccaguuucccaguuacucguuugggaggcuguggcaggggaauuacuugaggccagggauuuaagacucacccuaugccaaaaaauaaaaauaaaaggcaucccccaaagcuaaugcuacaagcagcauugccagaccucuucccucccuccugccacagaccugaugaaucauucaggucucugccuucacuugcccugccuacuuguccugcacaggagcccugagagguagagacauauccgcuuuggugacuggacccuaccuuguucagacacacagaucacugcauuuuuacugaaaaaugcuuuucaauuaaaaaaaaaaaaggaaauuauaagucagaaagaucccauuuugagugaauauaguuaaugagcauagaaaagcagucuagaggucauccagauguuuagucauuuacuuaugugcacacguuugugugugcgcgcgugcacauguguaugugcuccugugugguggccagaagacagccucacgugucauucuucagguacuaccuaacuuuuuuuucccuaaagacaaucucucucuccccuggaacucacuaaguaggcuaggauacuggcuggacaaugaccucaggaaucauccggucuccagccuucccagaauugagauuacaagaaagauuacagcuaauuguuuuuuuuuuuuuuuuuuuuuuuuaaauuuuaauuucuuuuuuuuuuuuuugaaagauuuauuuaucuauuuauuauauguaaguacacuguagcugucuucagacacuccagaagagggcgucagaucucguuauggaugguugugagccaccaugugguugcugggauuugaacuucggaccuucggaagagcagucgggugcucuuacccacugagccaucucaccagcccccuuuuuuuuuuuuuuuuuuuuuuuuuuuuuuaaauuuuaauuucuuuuuuuuuuuuuuugaaagauuuauuuaucuauuuauuauauguaaguacacuguagcugucuucagacacuccagaagagggcgucagaucucguuauggaugguugugagccaccaugugguugcugggauuugaacuucggaccuucggaagagcagucgggugcucuuacccacugagccaucucaccagcccccuuuuuuuuuuuuuuuuuuuuaaauuuuaauuucuuuuuuuuuuuuuugaaagauuuauuuaucuauuuauuauauguaaguacacuguagcugucuucagacacuccagaagagggcgucagaucucguuauggaugguugugagccaccaugugguugcugggauuugaacuucggaccuucggaagcagcuaauuguuuuuuaaacaaggauucuaggggucgaaguccaagcccccgaaucugcaaggccagcacgcugcugagcugccucccgagggauccacucauagcuuugugcucuccuuuuguaauaaauauguuuaaacgugugacaaccgggaggacaaaccgaagcucuuuaucaccuucaccgcacaacaaacacuuucacagagacauaaauacaagucacggcuccuaugagcagugugaaaacucagcucugccuaugaugagcagaaaggggauuggguggcaaaguaccagugucccaaacaaggagaggugugauggaggacauccuguugagagagagagcaucaucuucagagagagaaagcaugcucuuuuauugaaaaguguucccuccucuuccuccuccucuuuuuuugagacaguuucucuguguagcccuagcugacuuggaacucacucuguagaccaggcuggcuuugaacucagaaacccacccuuguaccaccucaccugucucucuucuucaucuucucuuuuauaaccuguguaaccugugucuauuaccugcauucagaugacugccccccccccacccccccaaugcuuacgagugauagaaaguuaauugcuccucugguucuuaacuguaucaucguuuuucuuucuuguggugcauaaguguaaaagaauguaucugauagucagaguguaaacuccagugugaggcuccacagccgcagaauggucauucuaucucuguagcagugugcagacuugggucugcuuaauuucaguauguguuccucuuucaaaacugaauuugauuaagcaaagaggugccccugcuagaaaggaagugaaggacugcaaacccagcacuggagacagagaggucacgguaugcuuuuagcuaacgcgugagacuguaucuaagaaacagauuaaaaaaaaaaaaaacaguaacaaaaacaaaacccaggaagccaagcauauugaugcacacuugugagcccagugcuggggaggucaaacagggaggucccugggcucgcuggccagcuaggcuaguguaacuggugagugccacguggguggggccccagcaggagcagcaccuaauguguucuggccuucacauguaugggcacgugugugcacauauacaacacgcaugugcacauaggugaacauauucaaacaaacauacaucuacacacacauacucagcccaccuccccaaucagaacacauuaaaaaaaauggccucuuaaaggugcagcuucaagaguguugagagagauguggagaagcccaaggcagugugggcugacccgucauuaaaaaccccacacccauaaaccaucccugagagugagacccaggccauggcccagucuuuaggacuaggggcgagccgagauagggaagagaagaguuacaccacagaaaucaucaauaaagucaaaaaugaaaggaacguuaggcugagaggccuggcuugaccgucgaucggauagcugcuuacauagauaaccugcauccuccuucucuguauucucuacaaguaacgaguguuaucugcauacgcuacccccauccagccaugugacuuuggacaaguuguccaguuucuauaaacuauuauagacuauuucuauaaacuauaaauucuguagcuacuguacccuuuauauugagccuuuguucauguauacaauauagcguuugacaucagcaggcuucuggaaaguagugaugauauuauuaaaugagcauggccaggcuugguggcacaggccuguaaucccagcuacuggggggugggggguggcacagaugguuaccaguuaaaggccuacuuggguuacagagugacuucaagacuagcuagaacuggaacuggaguuagacaucugucuguaagcuaccguguaggugcugggaauugaaccuggguccucuggaagagcagccagugcucuuaacugcugagccaucucucucaguucuugauucacuuguugaucuuaagaaaguaccucagagcugguggugauugugugguggcgaauaccuguaguuccaguggaguucagggcuaauucugacuauaaugaguucaaagccaaucuaggccacauaaaacccuauaauaagacacuggaaaauuaaagaaaggaaggaagacagauagacagacagacagaaagaccagccauauaugaaacagauccagagcugauuacaucucgaucgggcuguucucacuacaauacuaccgcugcaguacaauucacaaucuuuucaaaaucauuacaguccuuucuuuuaagacagccuugggcuggagagauggcucagugguuaagagcacugacugcucuuccaaagguccugaguucaaaucccagcaaccacaugguggcucacgaccauccguaaugagaucugaugcccucuucuggugcgucugaagacaguguacuuacacaugauaauaaauaaaucuuugagauucaguuccucaauuccuagcucaggcugccuugaacgcacuauguagcuaagaaugacccugaacuucugacccuccugcccccuccccaaugcugggacugcaucuccaugccuugcuggcugccucugcauccccaucgcuguccugaguugcucugccugcuucugccuuuguuccuuggcaguuuaagcugggucacgucagcccuucgcacauuuccccaaaggccuguuuuucuuuggacuaaagcuccaaccuucccaaggauucugaagcccuuucucuuucuaguccuccaauguccaacaugacuucuccuugggacauuuacauguaugguucuuucugucugacuuuuuccuuggcucaugaccucagcucuggguuacuuaagucccccaagagagggccacaccuaaacuacccuuuacccuuucugcugcuuuaagccaauaguugcuaacugacgugugugugugugugugugugugugugugugugugugugugugugugugugugcauguguguccuuguuuccuccacuugaaugaaaaugccugagaagauguaguccauauuuuuaaugucuagaacagugcuuagcacauagaugcccuacaaaaaacguguuaauuaaauggguaaaaggaaaaauagggacgagagagaaggcgaaagcagccggcuguagagcagcuaauggugcuuuuuucuuucauucuguuuuuguauuuuugguuuuuugacaggguauuauacugcaagcaaggcuggucuagaacucaugucgcucagguaggccuuaaauuuacaccaauccuccugccucagcuuucugaguucuaggauuauuagcaugaaucaucaccaucaaaggcuuuuuuuuucccccuguuaaugcaccaggaagcucaacuuugaaaucacaggaagauuaagcuggagacccaguuaauacugcuccccagagagaccaaaccaacaggcaagugcuaggcacccaucuaagcuacgcuccuuugacacuaaauccuucagagcuaaggcccagggacuucucucccugaguucaaacucagccugggugcagagugagacuccauccuagaaaaagacaaaggaucuggcccagcuggaagucacagcagggagagaauggacuggcagggggcuugagcacaccccccccccgcccccccacucaggcagcugggaaacacacuaaccagacugggccagcuucaagcaaagcaccaggcagauaaacacaguugcagaguuuccuuucaaaggcagauucuuccauuuggaggcagagaugguggcaccugcucuccuuuggugggcacuucauuaagcuuagcaaagcauuuggcccuccauccuuuuuucuuaguuacaguaagggggggguugggaguggcgcccaaaaguaaaacauugaaacucagacucccugcaccuaagccaacuucucccagcaaauggcuugccaucagaccaaaugacacaaacguccagcucagcugucacggagaggagcgcaagcgccacugaggggcagguggcuaggccacgcagacugcuugagcucuacaugcccuggggccucugaguacuuacauuuuucuuccuuuccauguuggcuucuucagcagccuucugguaccuucagagaggggagagaagcgauauuuucagguuaaacuuggcucuuacuccuuucguuuuuagaaaccuauuuugcagaccuguuucugccagcuuuugucuuucaccaagucucccaggaguggcauagaaccacagcgcccacacuugaugggcccuggauggucacaugcucugcuagaacacgacgaaacagaaggaugagaucacgugagaaaacgcugcagaggguacgggguguagacgacggagcucaguugcuuacccaacaccgcacagcucugggcuccaucccggcacuguacaaacuagacaugcacuggauguccuggcaguaagguuagggucagguguucaagggcauccucagcuacacugaguuugagggccaaccuguacuacauaagaccccaaaaccaaacaaaaaaccaaagcccuuggaauuaguagucaacuacaaacagcaucccaugaauucuauugcacagaccucccccccccccccacauuuggugacgucucugaaaucuuaguugcuguugguaugucuaugagguuacucacucccugcaaugccugaacuuagaccaaguuaagguacugaucugaaagauacaaucauaccaccucauucauaugaauuugaugguaugagguuuuucaguucuucacuugcagggggaggugaaugcacgcgugcagagguacauauacccaccagagcaugugcagaggacacgaaagaucaugugaugucaucaucuauugcuuccugccuuuucccuggguacccugaacccagaaucacugauccaaccaccauccuguuucuguuuuucccagcucuguggucacagauauauggggucaugccuggcuugcuuguuuuuuuguuuuuguuuuuguuucguuuuguuuuguuuauuugagacagggacuccauguagaccagacuggccuagaacucacagagacccacuggccucugcuuccugaguguugugaucaaaggcucaguguguucagcuuuuuaugagggcgcugaggaucccaaccgaaguccucaugcaacaagagcgcuuacccacugagccccuuccccagcucuacuucuuuuccuuuuuuaaacacaaggucuagcgguuaagagcacugacugcucuuccaaagguccugaauucaauucccagcaaccacgugguggcucacaaccaucuguaacgggauccaacuucuggugugucugaagacagcuacaguguacucauaugcauaaaauaaaaaaaauaaaucuuaaaaaacaaaaugaaacaacacaaggucucaccuaauggucuaaucuggacuuccaauugugauccugcuucaacucgugugcaccacuguaaccugguuuuaucuggugcuggcauugagcccagcuggacacuggggaaucacucuacccagagcuccacaucuccagcagaacagauuuuacuuaacaaggagaaagagauuuuuuuucaaaagcaagcaugcuacacugaggaggggauggggaguggguuccauccaacacugcuggugggaaggcaaagccucuugggaagacauuugucaccuucuugccaaaacuaaacacaaaugucaacguuuacucucagacuuuaucccacagacacccuuacauaagguggugcacgccuuuaaucccagcacuugggaggcagaggcaggcgaauuucugaguucgaggccagcuuggucuacagagagagucccaagacagccagggcuaugaaaagaaacccugucucgaaacaaacaaacacaaacaaaaccuuaggggggaaaaccauacagagagaaaaacuuuaugauuggguuguuuucucuuuguuccaaaaacaucuauuuuauuuuauguguaugugugugugcuuguggauggauacauaugugagugcagggcccacagaggucagaagaagacaucagagguccuggaucugggguuaaagaugguugugagcugucugucgcaugggcgcugggaaccacacuccagaccuccauaagagcagccaggggucgcuccagcccuuccuuuuaaaacaguagaaucuugcuauauagcucacccugacuuagaauucgcuauagaccccauguuggcuuugaucuuugaccuccagacauuuuugccucagccuucccaguauaggcauugucuuagacuggguuucuauucccacacaaacaucaggaccaagaagcaaguuggggaggaaaggguuuauucagcuuucgcuuccacauugcuguucaucaccaaaggaagucaggacuggaacucaagcaggucaagaagcaggagcugaugcagaggccacggagggauauuacuuacuggcuugcuuccacuggcuuguucagccugcucucuuauagaacccaaaacuaccaacccagggauggcaccacccacaaugggcccucccacccuugaucacuaguugagaaaaugcuuuacagcuggaucucauggaggcauuuccucaaaggaggcuccuuucucuuugauaacuccagcuugugucaaguugacacacaaaaccagccaguacaggcauguaccaccaauuccagccaugacauuugauuuggcaauggcuucuuagauaugauaccaagagaauaggcaacuaaauaaaaauagaugaagugcauuucaacauaauuaaaguuggaugugcaccauagaauagcaucagcugugucaaagugccaguaggaaggaagagaacauuuggagcguauaugucuaacgaggaauuaauauccagauuacacaauaaaaacaaacaaacaaaaaccacagaaugaauucuguacggcguauucauuuuaaagauaaauucaaaacuguuauguuuucauucaaggacuaaguauuuccaggcacuggagaagcugaggaagaaggacugaagguuuaaagguaguuugcuuuuuaaaaaaaaauaaaaaguuuuuaaaaaaacccaaaaaacaacaaacaaacaaacaaagaaacaaagaaaggcugagaagcuggagagauggcucagagaucuggcucuaauuccugcucuagagauugugauucccucuuccugccuccugcgaacacugcaugcauaugguacacagacauauaugcaggcaaaacacccauaugcacaaaauaaaaaaaaaagaaagcaaaaaugaaagagaggaaggaagggggagggagcgagagagagaaagagagagaaaaggagggaggaagaaaggaaggaaggaagagagagagcgagagaagagagcgagcaaauguguauaaagccugucuagcgugcccacacacaagguuuggguaccaguaagagaaggaaggaauggagggagggagggagggaagaagaagaagaaauaguucuuggugucuacuaugucccaaacaccagggaaagaaagaaaaagcgaccaccucaccugugguagcacaaaucauuauucucagcucuugggaggcugaggcagaggucagaagccaaggccuugcacuuaccuggcaagcgaucuacuacugagcuagcaucuacaaccuggaaaaagaccguccugaguucaaagccagcauggguacugagaggcccuaucuaaaaaauggagggggaggaggaagggagaaggggaagggaaagaaagaagacagaaaggaaggaagcaggaaagaaggcaggcaggcagacagacagacagaaagaaacgaacuaaaguuaacacaaucugugcaauuuacacaggaaaaccuccacaauggggcugggggcuugauaguggcucaguugguaaaggugguuguugccugccagguuucacaagauaaaggaagagaaccuaccaagggcucuuccugacugucacauguaugcuguggcaagggcaccauggaacacauccccaaauauauacgcacagauuaauuaguuaacuaaugugauuaaaaaaaaaguucgguaauauaauuuuaaaaaacccaugcagagcuauaggguggcaguugucuagcacuugucaauaccuggauuuggacucuuaagaaagagagaaagagagagagagaggaaucuaaacaauacaucuaccuacagaaugaguccuucaaagaaaaagaacagauuguuaaugaacaacuuagucuguaggcuguaaaaguuaauguuauuauaaauguaugcaguaaauuaauauagcagcuguuuuucuuuauccuagcaugcuccccaauaaugaaacagagaguucaagauuuaucuguaacuugagcacaagaacuaggcauuguaagucuauucuaauccuuuaaucuaaucuagcuacuuccuccaagacaucugcauuuuuauauugcucuggcuuucuaggcuucagguguguucuaugaugucucucugggccccuuccuuguacugacuccccuuuucuuucuuuuuuuaaaagauuuauuuauuuauuauauauaaguacacugaaacuaucuucagacacaccagaagagggugucagaucuccaccauguggucgcugggauuugaacucaggaucucuggaagagcagucaguguucuuaaccacugagccaucucuccagcccgacuccccuuuuggcuucucucuguuucugucugucucuccguuugucucuauguguguuuuucucuguuucucucccucucccuucuuucuccuucccucccuccuuccuuccuucccuggcuggcggaagucccaccuauucuccuuguugccuuguuauuggcuucuccaguuuugauugacaaggcagagaauaaauggugagcauuguuuacacaaacuggagauaggagagucuugcagcgcguccagauagaaaccagauggugggauagagaaaagagcauuugaauagcacuagaguaaacuucacacagcgcacaauagugguaccagacaguaggcugaacugccccacucuacagcauguucaacaaaccugguuuuguuuuguuaaaaaauaaaauaaaauaaaagagccaaacuaugccuuuaauuccagcaaucaggaggcagagguaggaggaucucagugaguuggaggccggccuggcuacacagauggaguuccaggccagcuagggcuacacugagaaaccaugucucaaaaacaaaaaccaaaccaaaccaaaccaaaccaaaccaaaccaaaccagaagagccuaaggagcgcagggagaauagcucagagugcuugccugaugagcacgaaacccugcuuggcucccagcaucacaucagccgagcaugguggcauauaccuguaacuccaguacuguggaggugggggcaggagcaucagaaguucaaggccuacagaaugacuuugagacuaaccugggcugucaaacacucucaggcuucuaaaauaaaucaauggaaauaauguucacugggaaggcaaauucugaaggaagcaccuuugguaacuggguuggauaacuuugucaacuugaccuaagcuaggguuaucucagagaagggacugccaaugagaaaaugcuccuauaagauuuagcugugggcaagccggucgagcauauucuuaauuagugauugauggggaagggcccagcucacuguuggugggaccauccccgggcugguaguccuauaagaaagcaggcugagcaagccaugaggagcaagccaauaagcagcaccccuccacggccucugugucagcuccugccuccaggauggugccuuguuugaguuccuguccugacuuccuucagugauguggaaguguaaagugaauaaaugcucuccuccccagcuugcuuuggucaugguguuuuagcacagcaauaguaacccucaccagaacagagaucacgaaaagccaagcguucauugucagccauguuaaguguccaguggguggcagcuuauuacauuuaauaugcauuugugcaugcgcgcacacacacacacacacacacacacacgaggaggucacaagacaaccugcaggugcugauauucuuaaucuacuaugugcuugcuggaggucaaacucggaucauuaaccuggguggcuagugccuuuaucugcugagccaucuugcugguugguucagguaggagccaugagacacaaacgucugagugcugaagagaggcaagagccagucacaaacguuuaggccuugucugcagaaccgauagugcaagaggaugcacaagacgcagcacuggagacuuaacacuuuagcaacuuggagaggaagaagcuguuagaauggcaagggacagagaggcaggaaaaccaggggaccagcagagaugucaagggaagggugggaaacagccagagguuacaggaggacaaaggggaacuuggugacacagauguuagucuugguaguugucuuccaugauaaagagaacucuaacuuggcaccaugaccacugcuagcaccuccuucuccccacuguugcucaugcagcccaggcucacuugaaacuugguaugcauuggagggugcuugcuaauccuccugccuucgucaccguagugcaacaacaccguaguggaucaacagcaccaucaacuucaaccucaguuauuuaacggucuuugaaauuauuuccaguuuuucaucacugaaaauagugcuuuggugaaugucuauguguguauguauguaugaauauauauauauauacauauacacauauauauguguguguauguauguguauacacacacacacacauauauauacauacauauauacauacauauauacauauauauacacacacacauauauauauuuauuucauuccaacugcacuaaaaggacuuaagagacugccuuaguaggaauugagaaacacagcagauugcaguuaaacuggaacuuagaccuggccuugaacuuuuguuuccacacccugugacaaucaucuucuguuuauuauaccaauaaaucaguauagagagccagacucgaucacugcacagccagugaauuauucuuacgcugaguuugguugaauaaauauucacaggcuccuuuuucuucacuguccuaagagaaguccaaaucuugaaauuccaaauacuuugguuguuugcuucuguuuuguuuuaugaaauaggguuucauggccuucagcaugcugugcaggccaggcuggcuccgccuauguccaccuccaagugcugagugugcacuuaucaugcuugcuuuugucuuuuaaaugcugucuggcauuuagggugccugguguccgaggaggccagaagagggcaucagauccccuuggacuggaguuacagaugguugucagcugccaagaggauguugggaacugaaccugugucugcuagaagagcagcugguguccuuaaccacugauccaucucuuccuccuuaagauggcguuucucugugugguucaagcuagacuccaccuucugggcuucacugacccuucuucugugugguagcacaggcuaccacagaggcugugaagcucaagagacccaaccuuccugcagcgugcaggauuaaaccuauggccauaccugcgcugggcacgugcuccucacuggacuuucuuaccaucucucaaguguagcgccagaauucaggccucggacuuuguuug

SEQ ID NO: 7999 - RNA, 15545 nt, Mus musculus
caaacaaaguccgaggccugaauucuggcgcuacacuugagagaugguaagaaaguccagugaggagcacgugcccagcgcagguauggccauagguuuaauccugcacgcugcaggaagguugggucucuugagcuucacagccucugugguagccugugcuaccacacagaagaagggucagugaagcccagaagguggagucuagcuugaaccacacagagaaacgccaucuuaaggaggaagagauggaucagugguuaaggacaccagcugcucuucuagcagacacagguucaguucccaacauccucuuggcagcugacaaccaucuguaacuccaguccaaggggaucugaugcccucuucuggccuccucggacaccaggcacccuaaaugccagacagcauuuaaaagacaaaagcaagcaugauaagugcacacucagcacuuggagguggacauaggcggagccagccuggccugcacagcaugcugaaggccaugaaacccuauuucauaaaacaaaacagaagcaaacaaccaaaguauuuggaauuucaagauuuggacuucucuuaggacagugaagaaaaaggagccugugaauauuuauucaaccaaacucagcguaagaauaauucacuggcugugcagugaucgagucuggcucucuauacugauuuauugguauaauaaacagaagaugauugucacaggguguggaaacaaaaguucaaggccaggucuaaguuccaguuuaacugcaaucugcuguguuucucaauuccuacuaaggcagucucuuaaguccuuuuagugcaguuggaaugaaauaaauauauauauguguguguguauauauauguauauauguauguauauauguauguauauauauguguguguguguguauacacauacauacacacacauauauauguguauauguauauauauauauauucauacauacauacacacauagacauucaccaaagcacuauuuucagugaugaaaaacuggaaauaauuucaaagaccguuaaauaacugagguugaaguugauggugcuguugauccacuacgguguuguugcacuacggugacgaaggcaggaggauuagcaagcacccuccaaugcauaccaaguuucaagugagccugggcugcaugagcaacaguggggagaaggaggugcuagcaguggucauggugccaaguuagaguucucuuuaucauggaagacaacuaccaagacuaacaucugugucaccaaguuccccuuuguccuccuguaaccucuggcuguuucccacccuucccuugacaucucugcugguccccugguuuuccugccucucugucccuugccauucuaacagcuucuuccucuccaaguugcuaaaguguuaagucuccagugcugcgucuugugcauccucuugcacuaucgguucugcagacaaggccuaaacguuugugacuggcucuugccucucuucagcacucagacguuugugucucauggcuccuaccugaaccaaccagcaagauggcucagcagauaaaggcacuagccacccagguuaaugauccgaguuugaccuccagcaagcacauaguagauuaagaauaucagcaccugcagguugucuugugaccuccucgugugugugugugugugugugugugugcgcgcaugcacaaaugcauauuaaauguaauaagcugccacccacuggacacuuaacauggcugacaaugaacgcuuggcuuuucgugaucucuguucuggugaggguuacuauugcugugcuaaaacaccaugaccaaagcaagcuggggaggagagcauuuauucacuuuacacuuccacaucacugaaggaagucaggacaggaacucaaacaaggcaccauccuggaggcaggagcugacacagaggccguggaggggugcugcuuauuggcuugcuccucauggcuugcucagccugcuuucuuauaggacuaccagcccggggauggucccaccaacagugagcugggcccuuccccaucaaucacuaauuaagaauaugcucgaccggcuugcccacagcuaaaucuuauaggagcauuuucucauuggcagucccuucucugagauaacccuagcuuaggucaaguugacaaaguuauccaacccaguuaccaaaggugcuuccuucagaauuugccuucccagugaacauuauuuccauugauuuauuuuagaagccugagaguguuugacagcccagguuagucucaaagucauucuguaggccuugaacuucugaugcuccugcccccaccuccacaguacuggaguuacagguauaugccaccaugcucggcugaugugaugcugggagccaagcaggguuucgugcucaucaggcaagcacucugagcuauucucccugcgcuccuuaggcucuucugguuugguuugguuugguuugguuugguuugguuugguuuuuguuuuugagacaugguuucucaguguagcccuagcuggccuggaacuccaucuguguagccaggccggccuccaacucacugagauccuccuaccucugccuccugauugcuggaauuaaaggcauaguuuggcucuuuuauuuuauuuuauuuuuuaacaaaacaaaaccagguuuguugaacaugcuguagaguggggcaguucagccuacugucugguaccacuauugugcgcugugugaaguuuacucuagugcuauucaaaugcucuuuucucuaucccaccaucugguuucuaucuggacgcgcugcaagacucuccuaucuccaguuuguguaaacaaugcucaccauuuauucucugccuugucaaucaaaacuggagaagccaauaacaaggcaacaaggagaauaggugggacuuccgccagccagggaaggaaggaaggagggagggaaggagaaagaagggagagggagagaaacagagaaaaacacacauagagacaaacggagagacagacagaaacagagagaagccaaaaggggagucgggcuggagagauggcucagugguuaagaacacugacugcucuuccagagauccugaguucaaaucccagcgaccacaugguggagaucugacacccucuucuggugugucugaagauaguuucaguguacuuauauauaauaaauaaauaaaucuuuuaaaaaaagaaagaaaaggggagucaguacaaggaaggggcccagagagacaucauagaacacaccugaagccuagaaagccagagcaauauaaaaaugcagaugucuuggaggaaguagcuagauuagauuaaaggauuagaauagacuuacaaugccuaguucuugugcucaaguuacagauaaaucuugaacucucuguuucauuauuggggagcaugcuaggauaaagaaaaacagcugcuauauuaauuuacugcauacauuuauaauaacauuaacuuuuacagccuacagacuaaguuguucauuaacaaucuguucuuuuucuuugaaggacucauucuguagguagauguauuguuuagauuccucucucucucucuuucucucuuucuuaagaguccaaauccagguauugacaagugcuagacaacugccacccuauagcucugcauggguuuuuuaaaauuauauuaccgaacuuuuuuuuuaaucacauuaguuaacuaauuaaucugugcguauauauuuggggauguguuccauggugcccuugccacagcauacaugugacagucaggaagagcccuugguagguucucuuccuuuaucuugugaaaccuggcaggcaacaaccaccuuuaccaacugagccacuaucaagcccccagccccauuguggagguuuuccuguguaaauugcacagauuguguuaacuuuaguucguuucuuucugucugucugucugccugccugccuucuuuccugcuuccuuccuuucugucuucuuucuuucccuuccccuucucccuuccuccucccccuccauuuuuuagauagggccucucaguacccaugcuggcuuugaacucaggacggucuuuuuccagguuguagaugcuagcucaguaguagaucgcuugccagguaagugcaaggccuuggcuucugaccucugccucagccucccaagagcugagaauaaugauuugugcuaccacaggugagguggucgcuuuuucuuucuuucccugguguuugggacauaguagacaccaagaacuauuucuucuucuucuucccucccucccucccuccauuccuuccuucucuuacugguacccaaaccuugugugugggcacgcuagacaggcuuuauacacauuugcucgcucucuucucucgcucucucucuuccuuccuuccuuucuuccucccuccuuuucucucucuuucucucucucgcucccucccccuuccuuccucucuuucauuuuugcuuucuuuuuuuuuuauuuugugcauauggguguuuugccugcauauaugucuguguaccauaugcaugcaguguucgcaggaggcaggaagagggaaucacaaucucuagagcaggaauuagagccagaucucugagccaucucuccagcuucucagccuuucuuuguuucuuuguuuguuuguuuguuguuuuuuggguuuuuuuaaaaacuuuuuauuuuuuuuuaaaaagcaaacuaccuuuaaaccuucaguccuucuuccucagcuucuccagugccuggaaauacuuaguccuugaaugaaaacauaacaguuuugaauuuaucuuuaaaaugaauacgccguacagaauucauucugugguuuuuguuuguuuguuuuuauuguguaaucuggauauuaauuccucguuagacauauacgcuccaaauguucucuuccuuccuacuggcacuuugacacagcugaugcuauucuauggugcacauccaacuuuaauuauguugaaaugcacuucaucuauuuuuauuuaguugccuauucucuugguaucauaucuaagaagccauugccaaaucaaaugucauggcuggaauuggugguacaugccuguacuggcugguuuugugugucaacuugacacaagcuggaguuaucaaagagaaaggagccuccuuugaggaaaugccuccaugagauccagcuguaaagcauuuucucaacuagugaucaagggugggagggcccauuguggguggugccaucccuggguugguaguuuuggguucuauaagagagcaggcugaacaagccaguggaagcaagccaguaaguaauaucccuccguggccucugcaucagcuccugcuucuugaccugcuugaguuccaguccugacuuccuuuggugaugaacagcaauguggaagcgaaagcugaauaaacccuuuccuccccaacuugcuucuugguccugauguuugugugggaauagaaacccagucuaagacaaugccuauacugggaaggcugaggcaaaaaugucuggaggucaaagaucaaagccaacauggggucuauagcgaauucuaagucagggugagcuauauagcaagauucuacuguuuuaaaaggaagggcuggagcgaccccuggcugcucuuauggaggucuggagugugguucccagcgcccaugcgacagacagcucacaaccaucuuuaaccccagauccaggaccucugaugucuucuucugaccucugugggcccugcacucacauauguauccauccacaagcacacacacauacacauaaaauaaaauagauguuuuuggaacaaagagaaaacaacccaaucauaaaguuuuucucucuguaugguuuuccccccuaagguuuuguuuguguuuguuuguuucgagacaggguuucuuuucauagcccuggcugucuugggacucucucuguagaccaagcuggccucgaacucagaaauucgccugccucugccucccaagugcugggauuaaaggcgugcaccaccuuauguaagggugucugugggauaaagucugagaguaaacguugacauuuguguuuaguuuuggcaagaaggugacaaaugucuucccaagaggcuuugccuucccaccagcaguguuggauggaacccacuccccauccccuccucaguguagcaugcuugcuuuugaaaaaaaaucucuuucuccuuguuaaguaaaaucuguucugcuggagauguggagcucuggguagagugauuccccaguguccagcugggcucaaugccagcaccagauaaaaccagguuacaguggugcacacgaguugaagcaggaucacaauuggaaguccagauuagaccauuaggugagaccuuguguuguuucauuuuguuuuuuaagauuuauuuuuuuuauuuuaugcauaugaguacacuguagcugucuucagacacaccagaaguuggaucccguuacagaugguugugagccaccacgugguugcugggaauugaauucaggaccuuuggaagagcagucagugcucuuaaccgcuagaccuuguguuuaaaaaaggaaaagaaguagagcuggggaaggggcucaguggguaagcgcucuuguugcaugaggacuucgguugggauccucagcgcccucauaaaaagcugaacacacugagccuuugaucacaacacucaggaagcagaggccagugggucucugugaguucuaggccagucuggucuacauggagucccugucucaaauaaacaaaacaaaacgaaacaaaaacaaaaacaaaaaaacaagcaagccaggcaugaccccauauaucugugaccacagagcugggaaaaacagaaacaggauggugguuggaucagugauucuggguucaggguacccagggaaaaggcaggaagcaauagaugaugacaucacaugaucuuucguguccucugcacaugcucugguggguauauguaccucugcacgcgugcauucaccucccccugcaagugaagaacugaaaaaccucauaccaucaaauucauaugaaugaggugguaugauuguaucuuucagaucaguaccuuaacuuggucuaaguucaggcauugcagggagugaguaaccucauagacauaccaacagcaacuaagauuucagagacgucaccaaaugugggggggggggggaggucugugcaauagaauucaugggaugcuguuuguaguugacuacuaauuccaagggcuuugguuuuuuguuugguuuuggggucuuauguaguacagguuggcccucaaacucaguguagcugaggaugcccuugaacaccugacccuaaccuuacugccaggacauccagugcaugucuaguuuguacagugccgggauggagcccagagcugugcgguguuggguaagcaacugagcuccgucgucuacaccccguacccucugcagcguuuucucacgugaucucauccuucuguuucgucguguucuagcagagcaugugaccauccagggcccaucaagugugggcgcugugguucuaugccacuccugggagacuuggugaaagacaaaagcuggcagaaacaggucugcaaaauagguuucuaaaaacgaaaggaguaagagccaaguuuaaccugaaaauaucgcuucucuccccucucugaagguaccagaaggcugcugaagaagccaacauggaaaggaagaaaaauguaaguacucagaggccccagggcauguagagcucaagcagucugcguggccuagccaccugccccucaguggcgcuugcgcuccucuccgugacagcugagcuggacguuugugucauuuggucugauggcaagccauuugcugggagaaguuggcuuaggugcagggagucugaguuucaauguuuuacuuuugggcgccacucccaaccccccccuuacuguaacuaagaaaaaaggauggagggccaaaugcuuugcuaagcuuaaugaagugcccaccaaaggagagcaggugccaccaucucugccuccaaauggaagaaucugccuuugaaaggaaacucugcaacuguguuuaucugccuggugcuuugcuugaagcuggcccagucugguuaguguguuucccagcugccugagugggggggcggggggggggugugcucaagcccccugccaguccauucucucccugcugugacuuccagcugggccagauccuuugucuuuuucuaggauggagucucacucugcacccaggcugaguuugaacucagggagagaagucccugggccuuagcucugaaggauuuagugucaaaggagcguagcuuagaugggugccuagcacuugccuguugguuuggucucucuggggagcaguauuaacugggucuccagcuuaaucuuccugugauuucaaaguugagcuuccuggugcauuaacagggggaaaaaaaaagccuuugauggugaugauucaugcuaauaauccuagaacucagaaagcugaggcaggaggauugguguaaauuuaaggccuaccugagcgacaugaguucuagaccagccuugcuugcaguauaauacccugucaaaaaaccaaaaauacaaaaacagaaugaaagaaaaaagcaccauuagcugcucuacagccggcugcuuucgccuucucucucgucccuauuuuuccuuuuacccauuuaauuaacacguuuuuuguagggcaucuaugugcuaagcacuguucuagacauuaaaaauauggacuacaucuucucaggcauuuucauucaaguggaggaaacaaggacacacaugcacacacacacacacacacacacacacacacacacacacacacacacacacacgucaguuagcaacuauuggcuuaaagcagcagaaaggguaaaggguaguuuagguguggcccucucuugggggacuuaaguaacccagagcugaggucaugagccaaggaaaaagucagacagaaagaaccauacauguaaaugucccaaggagaagucauguuggacauuggaggacuagaaagagaaagggcuucagaauccuugggaagguuggagcuuuaguccaaagaaaaacaggccuuuggggaaaugugcgaagggcugacgugacccagcuuaaacugccaaggaacaaaggcagaagcaggcagagcaacucaggacagcgauggggaugcagaggcagccagcaaggcauggagaugcagucccagcauuggggagggggcaggagggucagaaguucagggucauucuuagcuacauagugcguucaaggcagccugagcuaggaauugaggaacugaaucucaaagauuuauuuauuaucauguguaaguacacugucuucagacgcaccagaagagggcaucagaucucauuacggauggucgugagccaccaugugguugcugggauuugaacucaggaccuuuggaagagcagucagugcucuuaaccacugagccaucucuccagcccaaggcugucuuaaaagaaaggacuguaaugauuuugaaaagauugugaauuguacugcagcgguaguauuguagugagaacagcccgaucgagauguaaucagcucuggaucuguuucauauauggcuggucuuucugucugucugucuaucugucuuccuuccuuucuuuaauuuuccagugucuuauuauaggguuuuauguggccuagauuggcuuugaacucauuauagucagaauuagcccugaacuccacuggaacuacagguauucgccaccacacaaucaccaccagcucugagguacuuucuuaagaucaacaagugaaucaagaacugagagagauggcucagcaguuaagagcacuggcugcucuuccagaggacccagguucaauucccagcaccuacacgguagcuuacagacagaugucuaacuccaguuccaguucuagcuagucuugaagucacucuguaacccaaguaggccuuuaacugguaaccaucugugccaccccccaccccccaguagcugggauuacaggccugugccaccaagccuggccaugcucauuuaauaauaucaucacuacuuuccagaagccugcugaugucaaacgcuauauuguauacaugaacaaaggcucaauauaaaggguacaguagcuacagaauuuauaguuuauagaaauagucuauaauaguuuauagaaacuggacaacuuguccaaagucacauggcuggauggggguagcguaugcagauaacacucguuacuuguagagaauacagagaaggaggaugcagguuaucuauguaagcagcuauccgaucgacggucaagccaggccucucagccuaacguuccuuucauuuuugacuuuauugaugauuucugugguguaacucuucucuucccuaucucggcucgccccuaguccuaaagacugggccauggccugggucucacucucagggaugguuuaugggugugggguuuuuaaugacgggucagcccacacugccuugggcuucuccacaucucucucaacacucuugaagcugcaccuuuaagaggccauuuuuuuuaauguguucugauuggggaggugggcugaguauguguguguagauguauguuuguuugaauauguucaccuaugugcacaugcguguuguauaugugcacacacgugcccauacaugugaaggccagaacacauuaggugcugcuccugcuggggccccacccacguggcacucaccaguuacacuagccuagcuggccagcgagcccagggaccucccuguuugaccuccccagcacugggcucacaagugugcaucaauaugcuuggcuuccuggguuuuguuuuuguuacuguuuuuuuuuuuuuuaaucuguuucuuagauacagucucacgcguuagcuaaaagcauaccgugaccucucugucuccagugcuggguuugcaguccuucacuuccuuucuagcaggggcaccucuuugcuuaaucaaauucaguuuugaaagaggaacacauacugaaauuaagcagacccaagucugcacacugcuacagagauagaaugaccauucugcggcuguggagccucacacuggaguuuacacucugacuaucagauacauucuuuuacacuuaugcaccacaagaaagaaaaacgaugauacaguuaagaaccagaggagcaauuaacuuucuaucacucguaagcauuggggggguggggggggggcagucaucugaaugcagguaauagacacagguuacacagguuauaaaagagaagaugaagaagagagacaggugaggugguacaaggguggguuucugaguucaaagccagccuggucuacagagugaguuccaagucagcuagggcuacacagagaaacugucucaaaaaaagaggaggaggaagaggagggaacacuuuucaauaaaagagcaugcuuucucucucugaagaugaugcucucucucucaacaggauguccuccaucacaccucuccuuguuugggacacugguacuuugccacccaauccccuuucugcucaucauaggcagagcugaguuuucacacugcucauaggagccgugacuuguauuuaugucucugugaaaguguuuguugugcggugaaggugauaaagagcuucgguuuguccucccgguugucacacguuuaaacauauuuauuacaaaaggagagcacaaagcuaugaguggaucccucgggaggcagcucagcagcgugcuggccuugcagauucgggggcuuggacuucgaccccuagaauccuuguuuaaaaaacaauuagcugcuuccgaagguccgaaguucaaaucccagcaaccacaugguggcucacaaccauccauaacgagaucugacgcccucuucuggagugucugaagacagcuacaguguacuuacauauaauaaauagauaaauaaaucuuucaaaaaaaaaaaaaagaaauuaaaauuuaaaaaaaaaaaaaaaaaaaagggggcuggugagauggcucaguggguaagagcacccgacugcucuuccgaagguccgaaguucaaaucccagcaaccacaugguggcucacaaccauccauaacgagaucugacgcccucuucuggagugucugaagacagcuacaguguacuuacauauaauaaauagauaaauaaaucuuucaaaaaaaaaaaaaaagaaauuaaaauuuaaaaaaaaaaaaaaaaaaaaaaaaaaaaaagggggcuggugagauggcucaguggguaagagcacccgacugcucuuccgaagguccgaaguucaaaucccagcaaccacaugguggcucacaaccauccauaacgagaucugacgcccucuucuggagugucugaagacagcuacaguguacuuacauauaauaaauagauaaauaaaucuuucaaaaaaaaaaaaaagaaauuaaaauuuaaaaaaaaaaaaaaaaaaaaaaaacaauuagcuguaaucuuucuuguaaucucaauucugggaaggcuggagaccggaugauuccugaggucauuguccagccaguauccuagccuacuuagugaguuccaggggagagagagauugucuuuagggaaaaaaaaguuagguaguaccugaagaaugacacgugaggcugucuucuggccaccacacaggagcacauacacaugugcacgcgcgcacacacaaacgugugcacauaaguaaaugacuaaacaucuggaugaccucuagacugcuuuucuaugcucauuaacuauauucacucaaaaugggaucuuucugacuuauaauuuccuuuuuuuuuuuuaauugaaaagcauuuuucaguaaaaaugcagugaucugugugucugaacaagguaggguccagucaccaaagcggauaugucucuaccucucagggcuccugugcaggacaaguaggcagggcaagugaaggcagagaccugaaugauucaucaggucuguggcaggagggagggaagaggucuggcaaugcugcuuguagcauuagcuuugggggaugccuuuuauuuuuauuuuuuggcauagggugagucuuaaaucccuggccucaaguaauuccccugccacagccucccaaacgaguaacugggaaacugggauuugugcagucauaccuggcaggagccuuuuguguuucuuccgucucugagcuguaugugcagccucuagccaugguuuaaaucugaggauccaucaggucuccuguaacucuguccaugucucccugcuguguggugaaguggcucuuaguguguucagagaagaaggagccagagaccuaauucccaauauagcugcuaauccccuaauucucugaccucuccaguccugggcuguuuguccuuucuuucccacuuggaacccggaggagucacaggcagcagggauggagaguaagaagguacuagcaguuuguggcguuugguuugauuaggacuuugaaagcgcaggaugccuaauuuuacaacaagcauguucccacuauuauucuacaacgucacugacgacucgcugguugaucuccaauccauuauaucacuuuugacccaagugaaagugaacuguucucauaggugugcgggaaaauguaugucuucuguguaucaaagugggugguggcucucuuuucuuaugaggccuguguauuucucaagcaaaggaucuguaaaauagugcauuuuccaagauagcuacaaaguagauaaagauaaauaauagagaggaggauggaggaaaaauuagauuguuaugcagaaauaagaucugaggucugggaguacaggucagaaguagagcauuugccagccaugaaacaagguccccauuugacccacgagccuuauaaauucuaucagcuauauacuaauaccacccaugcaaaaaacgguaaaucuuuagaccuuauagauaggugcagucucugacauugaccucaguaauuauaauuagaagugcauaguuacuguaucuuugucuuguugggguuuuuuuguuuuguuuuguuuuguuuuguuuuuugguuaggaaagaauuccuagcauuauauacucuuguuguuuguggcauaccugggugaacuucuauucaaauauaguuacaauguugaaggcaccuagccaucugccuuuucuucuuggugagucuugagagagaaaaagucucucccuuccaauguaacuacaugagaucuaggcugcucacuuuguccuuauaaggcuauccuguuuuaucacuuccugcuucagcuccugacuuuuucccucuuccucucucugggcccuggguggaugcucgcuccuuguggcagggcaguaacuguucacagcugugugaacgacgguggaccaggcacagcuuggaguuuuaacuuucaguuuacaaagacgcauguuuggcuguugcagcaggcaaguuguaacugguacuuacuucuuguuccucuagaacccugaaagucugccccagcacuuuagaagagggacccugucuguguuaaagaagaagugggagaacccgguggcuggggcagaauuccacacagacucacugccaaacagcagcagugagggugggcacacagcggacuacccuccugcugaagugacggacaagccugcuccuggagucagagcugaccgggaagagcacacccagcccaaaccuagauuuggaucucguccggaagcaguuauccagagccgguauccucgcucagagaacagccacgauuuuaaagcccaggccacggagagccaaaaaauggaaaacugucugggagauuccaggcaugaagcagagaagccagagacgagcgaaaacacagaaacuucaggcaaaauagagaaauacaacguuccacugaauagacugaagaugauguuugagaaaggugaacacaaccaaaccaagguaagagcccgguggguguagagcucacugcaggaaaaccuguacuaaccgagguugauuuucuacgucuggccagcuuuagcagucaauguguggacaguaugucuuuugauucgaguuguguucauaaaagccucaaaugaacuauuuauggaugcugagauuugaguccccauuccguuucauguuaagucuagcucauucugggauucaggcugguaccuaaaauugaagaguuuggauacagacaggacugugugcucucagacacuuacccuuuuaauuugucuuccugagucuuuugucgucuacagccuugggggucagacugcugcuugaaucgcuaucugcuuggaacgcagcugcaggcugagaguuaaggccagaguugagcuuuaagacugaggcuugguugucucugcccuagcugagcccccucucuucucaacuugcucaucugugccucc

SEQ ID NO: 8000 - RNA, 1474 nt, Mus musculus
caugggacuagcgaaugaacgaaugaugcucacuggauccggagaccccaaagaggaagaggaggaggaagaauuaguggacccccuaacaacagugagagagcacugugaacagcuggagaaguguguaaaggcccgggaacgacuagaguugugugauaagcgcgugucuucccgaucacagucagaagagggcuguacagaggagcgcuuugacuuccugcaugcacgcgaccacuguguggcccacaagcucuuuaaagacuugaguaaauaugcagauucgccugccuuggccuugucacugggaaucagggacaguuccuuauugugguuuugaacauuuguuucugaugcaguaagcucugagacccucacugauuugggcagguagcuucucuucuguguaauuagcagugauuucauccuaauaaacugauuugcaaacuugaaaaaaaaagauacggaucaaacagcuacaaauauccaagcaacaguaacacugcagcaaccugcagacagagacuaggaacaugggaagacagaauaauggcuuuaaccauaucucucugucuaaguucaaagauacauaacaaauaacaaauaauaauaacaaaauaacaacaaaucaaagaaccacaaaaaucuugaaagcagggaaagugagggguaggcacacuaagagauacuauuuauacacugaguaaaagcuuuguaaauuccauuacuacaaaaugucacagaacaaugaaucagcuagcuuccugccuagagucacuccuaaagcuuagcagccuaaaacagcaccuaaaacagucucuauggucauggcuuaggucaauuaauagcaccauacauggcugguuagcgcucaaacuguuucaugaaugugcccagggaugggcaugggaguacacaccuauaaccccagcauuugggaaguggaugccagguggagcucugugaguucgaggccacucugauccacaaaaggaguuccagguuagccagcaauacacaguaaaaccaugucccccaccucaccccauccaaaaaaaugaaggaaaagaaaaaaaggaaaaaaaaaugcuggcugcuaucaucagaaggcuugacuagggcuggggguccuuaucagcccacucagagagcuguguguuccuagagcucuggggacccuuccuaguaccuaauaauagagagucugacuuccucucagaacaaaggaucaaagggagaaagcagagcaacacgucucuuuaugaggccaccuuggaguuaaccgacuagaggcgaggcuguaaauuccacguguuucuucuuguuugcucuguguuuuguccaucagcguugaggauuaucccuggugcacacagugguguccacacugagcuaagcuacauccccagaaagucuguuccuggggucagcgagacagaugacuucaagggccagggcaagucugaucccugaa

SEQ ID NO: 8001 - RNA, 1316 nt, Mus musculus
cacuuguguucuggcucucuucucuggagcacagaugacagcggacaugguacaauggucaggaaagguaacugccaaguguuuguuacuuugguuuugaauauaauuuacuuaaauuugacuuuauggcugagcauggugugaguguaaccccaucugggcuguggacacaagagacucuuggguuucaggccagccugggcuguguagugaguucuaggucagccuaagcuacgcugcaagcugaggucuacacaaaguuacaauuuaaaucauuugaguucagauaauggcucuaacagcuguguguaaaauuuccaaguaucuaacacuuggcucucaggucaggaggaggcaguugcccgccaucccuaucacggccucagcugaucacaggaagaaaggucugaacaaaauuacuucuagucauuguauccaucuuuagacgagucaccuguucaccagacuggcuccaaacuggcuguagcuggcugaacuccuucccaauugcuuagaucacaggagugagcagccaggccucaugagaacuuugaaacagacugacccuucaaagaugucuauccgcugacaagggcucauuaccuuacgugagaaguaacuguugucagccacaucuugaggacaaggggugaucuugggugaggggugcucuuugccaaaaggaaauucccagagaaagaccagcaacaagcaagcacgagggaguguuuuaauccugagcagcaucagaggacacccagaguagccccuggggccauguaccacccagaguagcccccggggccguguaccacccagaguagcucccagggccguguacccugugguuuuauuucauuuuccguuuuggaacaaugucugucaugcuuucauugaaacuuacgguucuaucaggguauaguggaacacagcuuuaaucucagcacuggggagucagaggcaggccggucucugagaguuuggagccagacuggucuacaaaucgaguucugggacagccaguaagacuuugucucagaaaaauccaaaccaaacuaaaacaaaaacugccaaaacuucugguucuuguguguguacguagucuuuccuuauuguaguuuuagauauaauacuuuuauuguuaucauauuuuaauauaucagauuuuuuagccagcuuuuuuuuucuuuuuaauauguuuugagauuauaauuauauuguuucuuucuugcuuuuucucucucuccaaaccuucccagccacccccuucaaauucauggcuucuuuuuuuuuaaaaaaaaauuuuuuuauauaua

SEQ ID NO: 8002 - RNA, 1123 nt, Mus musculus
cgccuccuucaggagcuccauaugggacacccucggcucccucggcuccucacgccaccucagcccagcccccgacgcgccgccuucccuuucccugccgccgggggccucgacccacacaggcuccucgggccugcggagggcacagcggggcugcacggccugcacggcccaggugcugugucagccucucgucgggcuccgcggcguggacggccuggaaagucacauggcggugggaccggcccgcgccccgaacacuccggcucuucucagagcccgaccgggcgacccgagccacucaccucaacgaagagcaacaugucugcuuccgcucggcccgaucguucacgcugccgcgacuccaacuggcucccaggcccgggccccggucgguaggauaaggacacucgccuugccccuccacccggcaguggacccggcuccucccccgccgucagccgcugcgcccugacccgcccagucccuccucccgggaagcaacaacuguuuccgguucuggaggaaaacugcuuccgggggcggagggccugcccgccccugugcgugcuucgcuccggcaggcucgucuguggcggcgaaggcgaaagugugugguacgugucgcgugugggucgacgcccgggaggccgcgccgggcugugcaaaacgcucacuaaagcauuuguacuuucuaccaaaaagcugacaccgcacugcuaacccuugcgcagauucgugguuaaaaaccuagguccgauuaaaaagcgaccgagugcacccgccccugcugaugacguacuggcuccucccgccccucauuagaaaaaaaaaaaaaaaagcugaagagggagcuaagauacucuucagcuacucagugcuuguacuuuacuaagcauuuugcauaaguuaaucuuaagacccuaugaauguauuguuggaggagugcuggaacagucagauuccuuucgcuacaacuuugauaaaacuuuagcccaagccccucggaaucaggucucauuaacauaaugaugcuccgcugugaugcuuaaugcucuacuaaaaauaauuagccuagaucucuucuuuauuauguuuucauagucaaauaaaauaguauaca

SEQ ID NO: 8003 - RNA, 551 nt, Mus musculus
aagaaucuggguguccccgacgucccucuuccugccuccugugcccacuguucuuaggcaucagcauugcggguccaacgcccaguggcaccaacgugggcuccucuggccgcucuuccagcaaagcgguggccacacgggcugcaggauccacuguccggcagagaaaaaaugccagcugugggacccggagcgcaggccgcaccaccucugcagggacuggggggauguggcgaaucuacacggaagauuccccagggcucaaagggggcccugucccagugcuggugaugagucuucuguucaucgcuucuguauuuaugcuacacauuuggggcaaguacacgugaucuuagauugggcuacauccaucugucaucugaagaagaaggaggaaaaaaaacccaacauaucuuguaccaaaaguguagugauuuucuguucacguguauuauuuuacagagaauaagaauugacuuugagaaaucaguuuuuucuauggcuaauaaacuuuggaauugcuuuauauggaaaaaaaaaaagaaucuggg

SEQ ID NO: 8004 - RNA, 37177 nt, Mus musculus
cagaucacuucuuaaccugggacuugcaggaguugagcaggcacggagacucuucucugggacgcugcucagaaaacucaugguuuccagaaccgacaugcugcuuaaaugugcagccugugucggcaaucugagucagcggcucuuucuguucguucuuagguaaguacaccaguuguuuccaggaggcaacccccccgccccccuucuuucuguaagcuuucuuccuacuacacagaaaaaccccugcccuggauuucuguuuugcugccucgggacuuuuucuuuucugucggguacuaaguucugguucugcccauuuugcuccccugccuggagaucacugauugacuagcuaauggccgcccuuggcuccuucagaucuggagggagagaccagguggcguuuucaccuuuacuuugaagucuuauaaucacuucaguguggcacguacugaguggaaaauggaugugggcugucaaggcuucggguuaauugguuccaccucccuucucacagggacagaguccucugcucaucuacaguggagugagucccugaaccccagcuucaacucccaggggaguggccuccagacaaaaggcuuuacuacauuaccgccagggcacccacugcccgccuccacguccugcccugccgaauggcacauaaaugaaaucucagaagaaaacuuuuaacucaauuaauuuuuacuaauaacuaggaguggcagaaauacaauuccuccuucucauggccggucaaagaugaaauuugauuaugcuuugaagggugcgguuugaaauuuuucccucaguguugaccuaccuuaaguguucucucuagccaaggggaggcguacuccucugcauauauagaggcugcgcugcucugaaaagccaaaccaguccugcaccauggggaagaagcagccaagggcggcagcagcugcucccaacugugagcuaaguaaguggccacagcccagggacgcuggccagccgaggagcacaccuggacgcugacacaaacagaucucgccccuuucuuuucuagaugcagcggaaggucccagaagaaagguucugggcucgaaggcauuuaagaagccuuucuccaacgccacggaugagcuggagaggcggccaagauuaauuuguaguuucucuucuuucaggugacgauucuguaugaagagcagcagccccagccaggggccuuucuguuugcuuuugcugucauuuuuuuuuuuuuuuuaaaguuuccaucuuuaggguuuacccuuucuuccuaucuccguucuuaccaaauaaugaacauuucucccggcaguuucuauaugaagaaaacagggcugucaucuauacuguuguaggggaaaucgagaaguccuuuucgguggcaacuuggggcgggggguugucaggucauaaaacugcgaagaggugaggcugaggccggggauggagugggacuguuuugggggcaggcaggauaaaauguguggagaagagacagagccaggugggaucacugugagucuugggaguaggacgacgggugcagccgaacuggcuccacuggucgaaguuucucgguuccucccaggcgugggguguucuuggcgcgucagugggcaccgagcaguggcucaagaagcuaauagggacugccauggcgccuuaggaucgaguguagcuguuucucggaguuaucaucucuuaggaggaaaaaggcguguagcugccuaaaaggaaguggcgggaacuaugacaaaaauguauaugucccgagcauuccggggaugggaguugccaauauaagaacgccgaagguuugaacugcgaggaccguggcgcgcccggcggaaucacgccuccggaucagccccgcccccgcucaggccccgcccccaggcagcucggaugggcggagccuccguucccgguccgccggccacgcaaucccgcagcugcaggaguccagccaaucaggagaggggggcucccgcccggccggccaaucacgggagggcaggagguugacugggucgccgcuggcuccugggauauggagucgccggcgcggcguguguggagguggcggagccgguaagccggggugcuggcagggucagggguuacggcggcccgcugugcgcgggcgugcgagggggcucggacggcgaccuacggggcuggagcagccugcggggagggcgcagcggcgagcccggggagggaacccgguaucccgaggagaccgggagggcucccggcucagcauaggcgccgacgaucacgggccucggcucuucaccgccacccgggacaccggaccacccuuccgcggccggccggccggggggugcgaccgcagugcccucccggagccccgggugcccugcagcgcagcgcccugucagcccagcggcugcgggagcugcgcggucugcccgaaggccucaggccucgcgguugagugcugcucgguuguccggcugugugugcagccugggacccugcgccuuccaaggccucguucagggacacuugcacgcgauggauacuccccuucucagcggcguccuaggccggguaguuugcaaacucauuuguuugauauuccaccuuuggauucuuuguccguuucuuggauacaucauauuuggaagggcauccucagaaguagaguuuccgcuguauaaaauggagacacucgguuaucccuugguuuucaacggugugauuuaaggcagcaaaagcaaaauaugggagaagagcuggugagggccggugggcauccgagagcuuccaugugacccguggggaaaccacgggaaacuguccacguuguccaccguggcauucuccacccugaccaagucuccuuacuucuuggcuguguuaacuuuugguucaggcuccuuaagcuuuccugcgguccacacuuaaaggugggguggggggauggggugguggugguggugguggugaagguugggucugucagggcuguugguguuguuaguuaauacagguaaagugcuuagggcagucuccugcugaccgguauuuuuuuuuuuuaaauuacugcuugcuugugccugcuguuuccuuaaagacuuuaaccuucucaguagucuuugcccugaguccccugggcuauugccaaagguccuccaggcaaggcuuucuagccauacuguuagucugcaagugcaucuaauuacaggugaagagaugcaaggugcugacaguaccuucuuacucuuugucuuuuugagacuagaucuggcuaccucucguuaacuggccuugaacuugcaguguagaccaaauuguccucuagcuuacagugauccuccugccucugcugagaucacagacuuuuaccacucaaacuuggcuucugcugaguuuauugaauggggugguuaaguaacguuuuaggcuguuuccugcaguagcucugcugguaaauguaacauugagauuucacugguguuuuuuguuagcuauuuuacucagucuugcuugggcugaguuuauuuuggacacagaccuaaaaggcagaugacugcagcacacaugcucucucguguuccgggaaggucugugggacucagaaggggaauuccugaacaucgugucagcuccucccauugaggaauagggaagcuggaugugaaucucggagaggagagauucuacucucgggaaagcagaagcugcaucaucaaucagcagggcuagugagcagcuaugguucaguugugacucagugagugacuagagagaauuccuuccacaaaguaggaucuuuuucuguuugauuuugaagccaagagcuuguggggcggggguggugcuguuuaucagauggcuucauuucugcuacagcaagcaccuguaugugagccucaccaucaauuccguuccagugguuggagaugccaggaguaggagcagcuguugcucauugcucagcaacauuguuagggacugaauaggaaacuggaaaguggcuggucagaggcaucaagccccugcccauguguggcgcugcagguggccuaaguuuucuugcuucucuuuguauuacaacaguuuaauacuucuuuagguugaaauguauuaaaauugauauguaaugauaaggcuacaaguuaauuauuaaaauuuuauuagguuccaaagagcagaaggaagcaucuauggcuggaaaucuuuuauucuauguuggucugacuugacgcauacguuuucuuuuaagaaaagcagguaaauuucuaaggucccugcuaggacaaauggguugaaugugaucuaaggaaagauguccuucagauuuuucuggagaaaaacacuguuaaaggugggcaaagcaucuuugggugggagaggaaguaacgugcuuuguguggguuucuuuuccuucugguagagauggccuuugaaguuguucacaggaugaaggugucaggccaggugaccaaggcaacacugcugucacgcugugguuagaaggaaguuuguaggcagcuuaacucugucagaguuggaggucagaguaaacugugagcggucaggaagcagucagacccuggcugugcagagaaaaggaauaguucuuaguaguggguaccgggccugcccacacacccgcccuuucuuuuucucuuuacaauuuuauuauuuuuaauucgcucacauguguaugccuguggggugcaugucaugugugcagaugcccaucaaggcuagaagugucagaucuccaggaguuacaggcaguuguaaaccgucugauguaccugcuuggucuucuugaagagcagugaaugcucuuaaccccuaaaccaucucuccagcucaggcccuuauuaccaaagacuuaguugauaaauacuacuuuugucugacaguucaguacuugacagccaguucuuaucuucacugacacccgagcaggcaguuucauuaucaacuguauuccucuccccaggucuuuuuccccuccccuccucuccccucccuccucuccuucccucccuuuuuucuguguguggcugugugucugcagacaggaucuggcuagcuagcuuagacuggccugcagcuucucccacacuggccgggaacucuuagcucccugcuuuagucuccuaaaggccagaguuccaugacucagucaccaugcuggguuuuccuuuucuugcuucuuuaauguuuguuuguuugaggcagagucuuuauuuuguauguaguccuggcuauagcucaccauguggcuccacacuggccugcaacucacagagucugccuuugccucccacuagugcuaagauuaaaggcugccccauccccacccuguuagcuguucuuucauucucagaacugaaaaucaaaccgagguucaaagcagugcacuggguauugaguugaaauugcaguucucaaggaggacagggaggaggagaggcuagcgaaaugucagccucugugucagagagggcuggcccugauucaggcauaguggccuuguauaacaggagcaccguuugugcuuuacgagcuugcgugcuguguggaauaaaggcaucauaguaacccaggcagguagacacucacacaccaagugcugggguaaacagaccugugaugccgcggucaacuggaugcugacaaucaacaccaggacgugcacucuaccacucagcuucaucaggaagcccugaggcuuuccccuaaacuagcacaaggugcuguuauuucuucugucuugaaguagacaaaaaccauaaccugagauaaaagccauaaccugagaugaaaaccauagccugccuuuuucuuuccucaucuuuuuguuucaugucaguucuuucuguguguguguguaugugcuugcauauguaugugugugcauguguaugugcacucccgaguguguguguguauuuguuugugugagugcauguguauguauguguguguguguguguguaugugcacucacgaguguguauauauguauauguguguguauguguguauauauauauaugcaugugugugugcaugcguaugugcacucgagaguguguuuguguguauauauauauauauauauacacguguguauguauuuguguauauauauguauguguguaaauauauauauuauauaugcaugugugugcauguauauuagaggcauugugaucaaaccuauggguuuguacacacuagguaagcacuguguggcugaguuauugcccaguccucaaauucauuuucauaagagaaaauaggcuaaaacauugucauaucuuguuucuuuguugagacagagucucauguacaccagacuggcauuuggcuuacgagguagcuaaaguugagcuugaauuucuaaauuuuugaucuuccugccucuuccuccuugguccucccagugacuguaggugugaaccacagguuuacgugagugagugugugugugugugugugugugaagccaagucucuauauaccacugguagaccagacuugucucuaauucagguaugggucaacaugcucccuuuaauguaaauacuaauucuaaacuuacuaccgcagggaucuguuucuuuccccucacucccacuagguaucgacagauaccugaagauugucagaaauccuugaugggaagucugagaccgauugcuacauuagccugggauuuuaacagaaaagcagugcgcuguccuuaaagcaaggaggaaaggaggcugcccagugccucccuugcaugggccucacagggucaaggcucuggagugggcagggagggagauacacuagcagucuugaucggcucugucugcaaauaugaaaacaacagcaguuugguucccagucauucaaguggaaagaauucaguuuaugaaauccaccucaugggaagugagcguuagagaagcagguggugguuucgugggacugacuuucgcugacucggggaaaagagaaucugguaagauuugaagaucuuuuccuguuagucccuauuucacccuuuggagauaguaucucacuaagcagcugcaggguggucuugaacuugugacucaggugccucagccuccuccaugcagguguuacaggcccuucuugucuucuaaguacuagcuuugagcuagggaggugccaggcugaaucugaucuccaaagcccccaagguacaaggacagaauccacucugaaguuguccucugaccugcacaggucacacaugcacacgaccaccacacauauaaguaaauguauaaaagguuuauuauuauugcuuuguaguuuauaguuugugaucacuauguuucugaaacugacuuguguucggugaaagaauccagaaagaaagguggcuuugccgccuaccagagcguugagaguuaagaguuacggaaucuuaccaucaagggauugccggcagugguuuggcugcucguauguaaauucuguuccugcucuuugauuuuacugaaauggaaggcagaaggaaaaaagagauuugggagguggggaaauuagagaugguguacaaacaaccccaccccuccccaggaugaggacaggaaugacaaaaacuuuguucuccaugccuucaaauuaaugaaguggcuguaaaugccccccuuuuggaaacaaauauaagagaucauauuuuaaacuuaagccuuuucaacauaagaaacugauuaaguuacacguauucaguauuucauccuucauugugauucuuuaagcuaggguauuccuuuguggcccuggcucggcagaccagcuuggccucagacuuuuggcaguccuccuaccuuugccucuugagugccgggguuauaggcauguaccaccacaccugaccgaaugcgauuuuuaagguaaugacauuuucuugaaguugcagaauuguugcuaggacuguucagggaggagcugcucucgugagcacugcugacaggcugguuagcgugaggcagugggcacuggguuagcgugaggcagugggcacuggguuagcgugaggcagugggcacuggguuagcgugaggcagugggcacuggguuagcgugaggcagugggcacuggguuagcgugaggcagugggcacuggguuagcgugaggcagugggcacuggguuagugugaggcaguggguacuggguuagugugaggcagugggcacuggguuagcgugaggcagugggcacugagggcuccugggugaacagcuacuuaaccaaaguuggcucacuggaaaggagagguguauucucuguauuugaguggaaaaucgucguuucacaaucugaaccacuauguggacacuaagacagaggaggaguaaauuaagcuuuagucugucagugccugccugccugccugccagccgcagaucccccuggaagccuccaucacacaguuuguccccagugagaggcuuucugaaaagcugugacagucuauagaaguuuugagaaaauuaaauggggccuggcauagugugugugucuuggaacaccuggguuugagccucaguacuacagaaaacaacaggaaauaauacaaggaccuggugaagcauuuuuacugccagaaagauugcgagagcccagcacuggccuccaucccacccguucuuugcccccugugccucaucgcccaccugcuggccuuuccagcauaucuuccugccucccuuccaaguacuggaauuacaggugggagccuccaaaccuggcucccaacugccuuuucuucccuuaaguucucucuuucucucucuuuccccaacccuccccccccccucucugagacaagguuucucuguguggcccuggcuguucuccagaaaagaucugccugccucugccuccagaaugcugggauuaaaggccugugucaccaucaauggacuccuaaauucuuuucuuaaacauugcgugugugagagagggggguggggggaguugcaggaaggcgagggguggggggaugcguauacuuggcagcuugcaggagucaguucuguuuugcacuguccugaggauggaacucugguagguggcuuggccuugguggcaagcaccuauaccagcugagccacugcauuggcugucagccagcuguugccuuuuauauacacaggccuugaggcauuguuaucaauuuuggucuauuucuuuucccucuacaaauaauagcacacuguuuaaugaguuggcauuuucaccuggcuucaugcguugaccugcuggauggucaguauguacacgucugcuuugcuugccauggcugcgugguauucucgagagcacacagcuuguuuacgaagcuccuuacugugguccaggcguccuuagccuuuggaaugagcuacacgguugcuuagguaugucuccuuguguacauuguuaggguccauugcuguaucgugggauaugcaaacuugaauuuuuaaauaagaauguaaccugaucaucauuuuuacuuguaaaacagccuuccaacuucuguuuauuuuuaggcagggucucacugugagccuugguugggacuugauauguagaccagaugagcucacagaggucggccugcccggccugccuuccacaccuguggugauuaaguuugcugguugguucuguguccuguaucugcaucguuccuugaugcagugggaacggugacugaagcaaggagggggaaugucauggaaggcaaagccacuggacacaaguaccacccagugucccuucccaucccgucuucuacguagugaauccugcacgugcugugagcugccgcgaguaaacugugcggcagagucuguucucuuggaauagugcgcacgugagacuuccaaaaagaccacgugccuugugugucgcuggcuuucugugcacuugguguaggaaugucacuaagaaugccacuaggaaccgcagcguuuuaacucuagggucaggaggcugaugcaugaucauggccucaggucccagggcaacuugggccacaguguaaaacccugucucagaaaagcccccaaaacauagaacagauuuauccuaagauauuuacaauuuaauuaccugcaugccugccuuaggcaacuauggacaguaacaucaguuguuugauuuuuauuuuauuuuuuaagaaugugugugugugugugugugccugugugaguauaugcgcgugugcguguguguuuaguacguugaguauaggagaucagaagauaguacuaguuuguaggaguggggagucgguucuuuccuuugaccauguggauucugggauugaacucuggucgucaggcuugccagcaagcaccuuugcccacugagcccuuuugauggcccauuuuccuuuuuuaaguauaacuuuuuaaaaccuauuuuggauuuuuuuuaagucucuuucaaguguauuacauacacugaauauuguuaaacaagauaucagcccucauuaugggagcaaucugauuuacucagucuuggugacaguucucagaagggcucacaccacauggccccaagcucaccuggccccugccugauguuuguugguuccucgggacccagguuccuuugucuugugagagccacacaggaccggaucugauuuguaguuucuuauuucuugugugcuaggauuccugggugucuagccuuacuuacauagaaagacacaggcaguccuccuagcugggcugugaucugaacccgcaugagucagaugucacaggugugaaugccccagaugaggcaggguguguggaaggaagaggcuggacugaggagugcuggggguggggucuguugacugacaggcucagcugucugcugcaguaaaaagcuuggcucuggugacuguugagggaaagcuguguuuccuaaguuaacgagugaugguguguuuuauaccccagaagacugaggaaaccuaagaucuccuuuugagccuagaugauagaauucaauaacauucgaugcauugguucauaaagaauauacaacugggugauggugguacacgcuuuuaaucauagcacuugugagccagaggcagguggcucugaguuugaggcuagccugggcuacagagugaaccaggacagccagggaggaaacccuaucuugaaaaacaaaaaacaaaacaaaacaaaagaauuaaaaaaaaaaaauagagguugagacaggagcaguccacugggcaagaggagggaaauuacuuccucagggaggaggccucucccucucccucucccucucccucucccucucccucucccucucccucucccucucccucucccucucccucucccucucccucucccucucccucgcccucucccucuccuuuuacuuuggggauuuacagggguugauaaucaguaacaacguucucuuucccugugugucuggaaccaacugagacaaagaucaccuaguaagaagguccagaguuuaaaagcucagucuuuuaugggcuagugagaugguucuaagaagauaaagaccuguugccaagccgaaagcccugaccacguuccacccuagggaccuacauaguggaagaagagaaccagcucugucuggcaagucaggcugcacccacgcccuugucccuacaaaaaaauaaguaaauguaaaaaauaaguucagccuuucuggugaggucuaguugagggccuaguugaagguggcaccuucauaugccaccgcacccagagaagugccacuucccauagauggagcccagagaaucccacaaauagggccugcuggugccucagcauucucggaggcccuugggcagucugccugugagugucuggcuucucccaacuuccagagggaagugacuguagugaggcuggaagugacugugguucucccucuagggaacaguggcccuccuugaagggugccugccaugcgcuuccagaaaacugagccaugucuuucaguuguuaggugggccagagaguuccaaacuauuuuccuuuauuuuuuuauuuuuuguuuuuuugagacaggguuucucuguguagcccuggcuguccuggaacucacucuguagaccaggcuggccucgaacucagaaauccgccugccucugccucccgaguguuaaaggcgugcgccaccacaccuggcuuccuuuauuuuuuuauucauugcugcgguugcuuuguuuuguuuugagacagguucucauguaucccaggcuggccuaacacuggcuuuauagcugacggucuggaucuccuguacuccugccuccagcucccaaauuuuguuacugcaaaccuggcugcuuucuguucagcagacuauuugauagauaucaguuagauauuuggggugauauugaggcaaaguguugaugauuggcagccuguuugugcauuguaaagcagauuggcuggcuggagcgcuggcccacaggagugggacccagcacccacaagaaccaagcgugggcccccagcacugaggcgagugcacauaccucaggcugguuggggcuuguuagcccccaaccuuaccaucuuucuggccuugccuuucauuguuucugugaaugucucuaauccggaaagcagugauuauuuucugggcuagcuaacugaguuagagagauuguuucuuucuuacguaccuuguuucuuucagcuauaccuugacaaagcguuaguucuguccuggcuaauuuuccccaucucuuuucucuuacagaauccuauucuaagagcacagacccucagguaucuaccaugguguuggauccuaaagaaaagaugccagacgguaacuuacagcucugagccauuaucuacaugggaaugggcuuuaggccguccuuccuguugucuguccuaagaaguccaaucagaagucuuuuaucuggugacaggguuggaaugaaaaugaaucuggaguccuagaauucugccucauaucuuauuucuaacugccacugggucaugacuaggugauuugguuccuacagcaguaaugcuugcagggacaaggccguucauucccaggcugggcagugaccucucacgugcuugcucugucugccaguguuugaguggauggggcacaagcugauguccacgggcgagucccccaugcucugcucuaugcucaguccuucugaauaggagguccccucuaggucccgcauuucuuccugaauggugaaggaggugcagauaaguuuccuagagcucucauuuuugggguugguuauagggauuuaugggaaagagaagaaagcuuuguuuugugguucaccuagucaucugaugccuguggcuaaguggacuuuguuugcuucugguagguagauuagcccuuuucugcugggccuuccuuccuugcauuuaagauuaacuguaaaauacagaccuuguggaaacgcugcugucaggugucuaugagcccugcugucacaaggugccggcacccgugaccacuagcccuucagcccuguguaagccuuagucaggacuccuguccuuccugcuugccagugucaucuugagccugacaccgucagggcuguccaguucucuuguguugugugucauauccaagagugauccuuugaguggguccuacccagugauggcacagaggauguccuacuggacuaacuuaguuucucuuaaaaacuagauucugaguaacuagugggcgugacuagugggcgugacuagugggcuugacuagugggcgugacuagugggcgugacuagugggcgggccuccugugucaguguugagucaucggugugaguuguuuguuuuguuuuaaguccgagucuuguuaaauuguagcccagggugaccugagacucucgauuuagccucucaagcaugaaagugaggugauuuuaaaaguuaaccagugggcauagaaguguagaauaaggaaaguacugugacacugaucagagaaaacacagaguugggaggagguagggcaugggucugacaggagaaaaagggagacacagggacgagugugacccacagggacgagugugaccagugcacuguaugacauucucaaaggauuaguaagauguuacauugaacugaccuaagaccgagagcgcuccuggaggcuuuugaacuucuuuuucuuuccuuugagauagggucuagguauagcccuagcccaggcugacccugccgacucccuccucuuuccuuaccuccagcgggugacaggguaacaggcuuauaccacagucugcuugucuguccauuuccgaccaugugcacggaccaccuguggaaaauuaauucauugggcuagggacguaacauaguuacacagugcuugcccagcgugcaugaugcccugggcuuauccucagugcuacaggaaaccaggugugguggcugcgauccuagcacuugggcugggaaguaagagagagggggucacguucagagucauccugggccucggcuggucuuuacuuauuagauccucuaaguaaauguauacacguauacaugcauacauuuauuuacaauguugaugaauaaacuguuuagggcacacuguacuaaaaccacgguggucucuugugcacagagcuguaagaugauuuagcuuugggccuaagguuguugucagugacggggagggagcgaguaccagaugcgggucagguguccaucagggugaagggcuggaguucagcgucacugagaaagcuccuugguggguuuguuauguugacucagauggcgcuucuggggaccauggagacucugccagccuuggcgccaucaacccugccuacagcaacucaucccucccacauuccacuggagacucugaggagcccuucaccaccuacuuugaugagaaaauccccauuccugaggaggaggucaguggcgguccaugcagggaacccuguguccuggggagagcaagggcaaguuccgcucucggcacucaucagccgcaggucucacuuaggcagccagucucugacagcuacauuuuuuugcauuaugggaaggcuuuagacacgggugcugaguggcuuuagugagcaugguuuguuuuauuuauuuauuuauuuauuuaguguauaugagcacacacuguagcuguacagaugguugugggucuucaucugcuuguugggaauugaauuuaggaccucugcuugcuccagucaaccccacucgcugcagcccaaagauugauuuauuauuauaaauaaguacacuguagcugucuucagaagagggcgucagaucucauuacagaugguugugagucaccaugugguugcugggaauugaacucaggaccucuggaagagcaguuggcgcucucagccgcugagccaucucucuagccccuguguucuucucuuucaagugugguuuugcuccuaugugggaaguggguggguucaguuuggaccaaguugcuuauggagagcagauaaaggaaggacucccacugagagaagaggccaucuuauugguaaaaaguggacgaacuggaugugaaauggggacucgcgcagagcccacccuggcccugugccacuggggucgcuccgugaugugugauaaaauagagacguuaggacgggugacacucagaccgcucuccucucuccuuuauaguacucuuguuuuagcuuucguaaacucugggcguucacggggccuggcuuucuuaugagcauugccuaccuagacccaggaaacaucgaaucugauuugcagucuggagcaguggcuggauuuaaggugagcuacaguuuuacccuggcugaaaaacaaauuuucauuguuguuauuguuacugcuguggauggacucuuggacuucgugggcuaucuuggaugcuugcugggcucuccuugucaggcccuugcugggcucucccuguccuuuugagcauucauuaagcucucacgucccccuucucuugcucucucucucucuccuuuuuuuaaaaaaggauuuauuuauuuauuuauuauauguaaguacacuguagcugucuucagacacaccagaagagggcaucggaucccauuacagaugguugugagccaccaugugguugcugggaauugaacucaggacccuggaagagcagucagugcucucaacugcugagccaucucuccagccccuggcagucuccaaccuccugucuuaguuacuuuucuaguccuguaacaaugcugugaccaagacaacuuauaaaacaaaacaacuuaauugggcuuagaguuucagaggguuacagcccaugcugguggcagcagcaccgcugagagcucaucuugaucaccagacaggaagcaggaaggacacugggaauggcccucaacccuccccugugcacaucccccccaacaggagcacacuuuguuccuugcaagaccguuccaccaauaauucacacaugugagcccuuggccauucucacucuagucagcacaccucccuacuguccccaucugaguacacaggucugcauuggcagcgacaccugugugaaaaauacugcguggucuuuuguaauuuccuuaggagagacagcagcuaagagacacagagaugcagucgccucauaggucaccuuaaaacugaugcagagcucggguccauauuccugaccuggcuuugucuuagcugagcugucucccagcugcccagugggcauugggugugucucuccucagcucccuaaugaguguuggcuaugucuccucagcugcucugggugcuccucuuggccaccauuguggggcugcugcuccagcgccuugcagcgagacuuggaguggucaccggcuugcaucuugcugaaguaugucaccgucaguaucccaaggugagcagcauguuguccugauugucuacuaacuuggaggaaucagugugucuggcaucauaugcuggucucaauccgcacugagcaguagaggacuuggggucagugucccuggaacuaguacugaaggaauccucccaccucucucgcugucaacccaugucucuaccucacaaucuaacaugggacucaauuuuuuguuguuguuuugagauagauucauguagaacccuguacuuagccaggauggccuagaccaccuaaugucuguuucugcuuuuuagaguuacaggcgcacaguuuccuuaguaaauucugcaugagaaagcauuuaccagucacucuuguuuuugaaaaauauguuuucuuuuaauaaaguauauguuauaagagcuuuggguuugcugaauauuaucagcuuauucugccuuguuucuuccuucugcgugccuuaccaccaccuaugugaaugacugcgauuggaagacccugggggcaggugguccugcagacuaaagucaggcccguggcugagaacaguuuuaaguuaguuuaucuuggauaugaagcgggccucccuugagugugcccugaaugcugaagucguuucugacugugagcauggugguuuuguguugugguuuuucuucucgauucuccuaggcugguugguuggucagucagucaucagucagucaguaagucugucucuguguaugucugucuaacugacugucacucucccucucuguagcuugggauguucuugaacccuuggucauccugcuggaucccaaguguuggugguguaggcguggccaccaugugugauaaauuuuuaccaauguuuuagaagauuuugcuguuuuauaauucccuuuaguuucuuuuucuuugugcacauuuacuagguaaugugacaggacacuuuuuguauuuaguaucagcaggcuuucuagcgccaguaaaccaacacuaacucaguuugccuuuccacucaucugcugguccagagcuaguuuccuuguuugcuguuuucugucuauucugaacguuuacucugaucacuuuuaaaaagagacuuauuuuuauuuuguaagauuguauguauguauguauguauuucuguaugugcauaugaguguggcugucugcagagguucaaaggcuggaggugggguggguggaggcuggacccuugaaggaauugugagcugccagacaugggugcugggagcugguguuuagucuuuucaucuucugcaagagcaguacaugcuuuuagccacggagccaucuuucuaagccaagccccuucaauaccuuuuucacuuuuuguguguuguuauuaaauucaagaugauaaagucugucccguguuuguuuuauagucauaguuaugggcgaguuagaggcuuuaauuucucauuucucucuugacucccauuuugagcauauuuguauauuuauuuuccucuguagcuuuuuagcuuguuuuuaggcaagagaguaagugggaaaugaugaauagaaaccccauucuucuccugaagagcuggguuggcucccugacccugcuucacagucucccacaggaaguacuuuucuacucuguggcuguguagggcugaguucugggaguucuccagucugugacaaaaaucugaauucugaacggagaaaguucuuaucagaaccacucuuuguuuuguaggucccacggaucauccuguggcugaugguggaguuggcaaucauugguucugacaugcaggaagucauuggcucagccaucgccaucaaucuccugucugcaggaaggugggggugggacuucccucuagaacauugucaguacuaagcuggguuccaaagccagaguggaaaugaaaagccaacccuuuaguguucaagguucaacuagucuggagccgccuuaucucccagcagacguagcaugcaucuuccauucccuggcuggguuguaugcacuucuauuuaaauggaggaugcagcguucuguggcacaguuaauuauuugcaaggcugcuuauuccacugcacagugagguccuucugcauaugaugugugcuuuucagcugugucccacacaucugacacagcaagcucucagggagagcuccaguggaugggcuucagcagcugccgccucucagccacuguugcuccuccucaggaccuagcuuucccugguguuugguguuggacagggugugaagaaaucgucccuggguuuuuagucucucuucuugucucuaacccagggucccccuguggggcggaguccucaucaccaucgcagacacuuuuguguuucuuuuuuuggacaaauaugguaaggccuggggcaggugggugagucccagccggcagcuucggccacacggcuguggggaggacuggccucccugcucacuucugcacuucccccucaggcuugcggaagcuggaagcguuuuuuggcuuucucaucacuaucauggcccucacguuuggauaugaggcaagugcugcaggcuguugguuaacuguuuaaaacaaagcuucauuuugucucauuuguaaucuuuuauuauaaaagcaauaauggcagaaucagcaaaaagccagguacuucugggcugcucuggaagggauauagucuauggcaaggauucaugugcaagaaggccugaggagacuuuuuggggcaucagaaaugacuagacuccacagaaccuuucaggagugcaguuuuugguccgagguuagccacccugacauagaacagcuuuagaguggguaacgaggaggcuguggggucauugcugacugccagcucaaagacacucuguuugugcuuaccuuggccaaaauuaaucacagccugacuuuccuguauuaaagcagugauggugagcuggacagggcggugcacaccuuuucugcucaggagcugggacagccuggucucugagugugaggccaacuugaucuaccuggagaguuggauccagggcagccagggcgcagaguaagacaagaaacuauugaugagguauaggugacaaugauuuucuuggcuuguuccuuacccaucccuagggaucaauaccauuauuuguacccuuuuuaauguccaguuguuauaaacugguuuuuacauaugggccugcuuagacauuaaacagauaucuagucugugagguuaguuuucccagauugucccaagagaauucuagccugucuuucaagaggaauccugacccaagaggaaguuggagugagcagugcucgggaacaaccugagccccaccccugcacacccaugugcucagagacaaccugcccccucuucccggcacccgugugcucggagacaacccacucccacauccucacagcaggcagcaucgcugacuuccagaugggcagagaagagcagcgugggguagaccuggacuguaguugcugggccugugucggcagcuacagugaugcagauaacggcagccagaccuucccuagcuccuuaccucagaacacuguguucucugcacaucuucacuguacuuuuuaaaguguaauguaacauauucagaaaauacaggacuguauuuuccucugagccccauauuaguuaucuuuguguaauuguaaccaaaauacuguggaaaauaacaggaggagggaaggucuguuuagcuaggguuucggagggcuuggucuggccuguaguuccuugggcagaugugugugggagacucuaccucagugcagacaggaagcagggcauggcuugcccccauugaccuacaucuagguaggcuacaucugucaguguuuccaccaccucuccagauaguaaaggcagauagggcccgaguccgguuaugagccuguggcaggcaguuuauacucagaccacaucagcccuucauuccauuucacugaugaugcugaggucaaacucagggccgugcgcauucuguugaguacuugccgacuccauauucuccauauuccgggcaguuguuacagaagguggggacuaguaaaggcugccagugucugccuaggacuguucucccacuucgugcugcagugaaggcuaaugguguuguguugcuguauaguacauuacagugaagcccagccagagccaaguacucaggggcauguucgugccguccuguccagggugccgcaccccucagguggagcaggcggugggcaucgugggagcugugaucaugccgcacaacauguaccugcauucugccuuagucaaggugagccacgccccucggcaucuacuguuagagcucugaaggagcaguccuucucaggcuggcuggccaguguuuaccaccaaauugaccaggaaaugugacccacaaaaggcugggcuaguguucuucagggaaggccuggaagucuugagguggggaggaggcuugcccagcaaggcaggcaggugcuccuuugcugagccuuggagguuaguccaauagccauggcugagguuagucugugguccuuccacagucucugggcgcucaggagucacauggucacuggcucccccauuugggaguugugcaauguuuucaaaggucaaggaguccccgugacucggagcuaaggccucuuuuucgucucgucgguugucugaucagacuuucagcugacugcagacuucugaguuguuagagacuuugugccucugguggaaaugaccaccgcugcucucucucuagucuagacaggugaaucgggccaauaagcaggaagugcgggaagccaauaaguacuucuucaucgaguccugcaucgcgcucuuuguuuccuucaucaucaaugucuuugucguguccgucuuugcugaagcauuuuuugagaaaaccaacaagcagguggugagugccagggucgugggugggaggugagugccauggugaacugcaugcugggguggggcagacaagagcaauggccuggaacccaaaggaaucugucugaagccuaggugucacccacuuauuuguuacagugcagccagucuguggugggggcuguggacgccuguugggggcugggaggagcuggccuuggacucacacuugccucccgcuuucauccuggcauuucuguuccuuccuguuaacuucugccagccugucugcuccuccuaaugguugagcugaggccagguuacagggaguccucaaaacagaagcacaggcuaugcaggacaagacucgggucauuuagaauucuguguccucuuaauuccugcugccuacguauuuuguuaguuugguuuuucuuugaguuuuuuguuugggguugaauccaggacccugugcacgcauguacgguggugcuaaagcuggcguuccaccuccgccucgcccaguccuaccuagucuuaccuaccacucuuuauucuacaagaccuuugaccccugcuugugucugacuccugacaucucuuacguuugaagccuucuugaugcuuugggauaguaaagccucgggaaggguugcaggcggcugugcagucggcagugcaccggcagugcaccggcugugccugcgucguggcccuccuggggugugaccuccagcuugucucacaagacagauaagggaccucuuaucugguucuuauuucugaaauauaaauuguucuuaaacugcuucggguuuuagguugaagucugcaaaaauaacagcagcccccaugcugaccucuuucccagugacaacucuacucuggcuguggacaucuacaaagggguaagcgugcuguuugcacucucuacuuugggggagaugguagcauaaucucuggccucggaguucauuucagaucugagcauagcuccugaguauuuuauuuugggggcccauaugccaggaacauauuugggguucugugagggccgaguugggggugguagcugguagaagugggcugaaaggcugcacaguggggacacugaaguugugcagguauugauuggaauggcagaggaggagcuuggugaauuugggucacuagcucugcugggcccagcgauccguugugaccccaggaacagagugcacugucugucugucugccugccucccuccauuucccagaaaggagcaucgaggagcuuguuuugggaagugugagcucugccuccugagugugagcacagagaggagggagggcugggcugagggaugcagggcaccagcagagugaggucagaagcccccaggucugaccagagucagcgccccuuugugcagugcccagcaugauacuuggugugcggguguucccaagcagagggaggugcugcagagggcugcugcucuggguguuaccuaagcaggucacugacaagccugucucucccuccuucucccaggguguugugcuuggauguuacuucgggccugcagcucucuacaucugggcaguggggauccuggcugccggucagagcuccaccaugacuggaaccuauucuggccaguuugucauggaggugugugcuggggugaaauagagggagcuugcacagcuuggagugucuagccccacgcuucugaggguuccugacuuccccaggcaucucucucucugucacauucagucaccagcuuccaugcuuccuuccagggauuccugaaccuaaaauggucgcgcuuugcccgagugauccugacccggucuaucgccaucauccccacccugcucgucgcugucuuccaggauguggagcaccuaacggggaugaaugacuuccugaauguccugcagagcuuacaggugagcagggacccggggaagcccgugcugcacgucgccacacugacuuacccuugggugagugccaagccucacgcuggaaccugggagcuagggguggcugaggggaagaaaggggcguggagguucauuagugcagaugaugagcuaugcucaacaugcacgucgcaagguggggccaccaagacggcccaguggguaaagugcuagcugugugguuguccaagcuugaaggccuagaugugagccuaggaagaggcaguagaggggaagacagugucucacaggguugaccucugaccuccgcauucagccguggcaugggcaugcccauccacccgucccugucugucugucugucugucugccugccuaucaucuccccucacacacacagauaaguaaauuagugacacuuaaaaguccacugauuagugagccuuguagcucauuaaugcagcaggguaaaccauuaauugaguucuaagaacacugcuaaagccuguggagcuuacgaggcagucgcauccagucuguuacuuaucucuucucauuaugugugcugcguguagccuugcuaccccaccuaagcucugggaauggaccucgcuaccaacccccacccagacaauauuggauccacggauaaaaaacagacacacacauugcucaauuucaacuugccuuuuuggcacaguugcuggcguuauuuaucucccaucuggagaaaccugcccuucucagugcucuuagcuccacacugcuucaccugcccucaacuuuuuuuugguuuuucgagacaggguuucucuguguagcccuagcuguccuggaacucacuuuguagaccaggcuggccuugaacucagaaauccgccugccucugccucccuagugcugggauuaaaggcgugcgccaccacgcccggcccaccugcccucaacuuaagcugcucaguuacauuuaguuucagcucagcaucccagccaccugccuguagaaguggccuguggcuacucugcccaggaaucauauggcugcuucuuggcuuuucuccaaagcaugacaaacuuuucuccugcaugucucuugccucuggagacuaggaaguccugccugcucaucagcccagcaauuggcccagggcuucuuuaccgauagaucaagaaccaauagggaacaggaccuucguaucagaacccccccugcauaaugauuaucaguguuuuaccuuugugugugugugugugugugugugugugugugugcgcaugugcacgugagcguucaugugaguguucacgcacgugcgccugcaccuagagccaaaauuguugaggagaaggcgucagcuccccuagaaccggagucacauagacagcugugcgcugcugaguuacagacagcugugcgcugcuguguggaugcugggaacugaaccuggguccucugcaagaacagcccagcaaggguucuuaagcacugagccgucucuaguccccaguguguuguuuuuuuguucaaacaaaggcacuuaagaucaugauuagugcuggauuaaaaauaauguuuggcccaggcgaggugaucggaauagcuguuacuugugguauagguaagacagggcuugugauugcuuucugugaaccgugcagugucugugguacucacguacucugggaagcagggaugucacgugacaaagcuuccaugaggagaccgacacgucugcguaaucccucugacacgccguguaaucccugugauucuguuuuccagcuccccuuugcucucauacccauccucacguucacaagccugcggccagugaugagugaguuuuccaauggaaugugaguacacuugccgucuccagaaggcccugggagggauuuuacccaggaggcagugggaauauguccuaaagagcuaugugcuuccaggagcgaucgcuagcugcuuccucuguggcuuagaaagaaaacugcaagugugagcuucaggaaaggaggacacacuuccuucagcccucagcccuccagcuucagcugcuaauguucgaauucuguguuaaauuauccaagaaaggcacaggcugguaauagugugcaccuugaagugaucugugggcuauuggagaauuaguuauuaguauuuguaguacaagcagcuacaggcuguauucucauuccauuucugcugcugugacagacacucugccgacaggcagcacagggaaggguuauuugguuugcaguuccaaacuacuccugccugucauucugggaggagccagagcagaugcagacagcuagucaugugacauccacugucaagagcaaagggaaugaaugcgcccuuacuuguguguuugcucugagcuagcuugcucuaucuuguguuaagugugcacuggcuaggcaguggugccucccagaguggacuggucagucuaacaucaggcucuacagaugugccacaagccggccugguguucccaagugguucuugugugugacaagauggcaguuaaagucuguacuaaucaguacagauguccaugugaccggcuagguuucagagguccguaauugucaccauguuagagguggugggaccugcagagcggggccaguaagugaggcagaguaaaauaaggcagagcuuuauucagagccucagacaguuuagacucuaaggguuaagaauuacaaaguucucacggcuucaagcuguacacagucaaggaccaccagagguggcaaaugcaugcuuugccuuagagcaguauaaaggggaauuuaagcauuuagugagugaccaacagcaggcaguagugagcgaucugaaggaaacucacuccacccacuacaccagggaggagcacaaaaccauggucaguguucguucgcaggaaccguccugggucuugaagacccggccacauauuguguccuuggccuguugucacuucucucagagcucuccucacaugacuccaucccuggacgaguuccugcauacagugaauggcuuggugcauuucugacugcugauuucuagggucuuaaaugcuagguuucugugccacagaaaaggcucagaggauaagcaugcuugcagcacaagcccggcagccugagcugcaucucuggaacucauaaguggggaaggagagaacuggcugcaugugcgcgcugcggcagaugugugcccacacggugcacauauuaauagguaguuaaagacccgugugugcugcggcagacgugugcccacacggugcacauugauagguaguuaaagacuaaaguuucuguuuacucugaucccuucccucugcuucaucgcuaaucuuggccucucuacauuucccucaauccccgggaugcaguuuucuguccacaugagcuggacaacaggcacuuaccgugcucuuuguuuugcagaggcuggaggauugccgguggcauccugguccugaucgucugcuccaucaacauguacuuuguagugguuuauguccaggagcuagggcauguggcacucuaugugguggcugcagugguuagcguggcuuauuugaccuuuguguucuacuugguaaguccagugugaagggagcaggggcaccuauggugucugggaugguccaagugggacuaacuguccuucagaaacaaacaguccucaaagcacucagcgcuuuacugaggcagcuuguauggcauugucgaauuaaugguuucugaaauuucaguuaguuuuuguuguuauugguacuggagauuaaacauaaggcuuauacaaugccggugucuuaguuaggguuuuacugcagugaacagacaccaugaccaaggcaagucuuauaaggacaacauuuaauugggcugcuuacagguucagagguucaguccguuaucaucaaggugggagcagggcagcauccaggcaggcacggugcuggaagggcugagaguucuacaucuucaucugaagguugcuagaggaagacugacuuccaggcagcuaggacuaguuuauuaaagcccacgcccacagugacacacuuccuccaacaaggccacaccuaauagugccacucucuggcccaagauguaaacuaucacaccggguaaccauuccaauaccacacucuacucucaaccagauauucuuauuuugaaucaucaaguauauuuuaggguuuugcuuuuuguguuuugguguguguguguggugggggugugggaggagugggucacucucuagcccuugcuauccuggaacucgaugaucuguagcccaggcuggccucagacucacagagcugcuccugccucugcucccugagugcugggauuaaagaccugagacaccacgccuggucuacuuuuguuuuucuucucuuucauuuuuuuuuccccuugauuuuuugagauaggacuucuaugagugucccugcgugucuuggaacuccuccuauagacaggcuggccuugaacucagagaucuaccugcuucugccucccaaaugcugggguuaaagcugugugcacuacuacacccgccuccucuuuuagucuuuaauaccuaguauuuuucuauuucuguuguuguuuuuauaaggguucaguauuuaauaucuaaagggaauguuaggguguguuugagaaacagcauggcgcaaaguugcacagcaaguguaagcguuugaguucagaucccaggacccacacaaaaacacugcagugguugugugcgccuguaaccccagccuuggagagggggaggcagcaaugggaaaauggcugaggucugccagcccagcugugacagccggaaacaugcauaagaaacaugugcgcauacagauggcgaguacagauguguacgcuucucaguccuccccaugacuccacaagugagggagcugaagcagugagagcagucucaguuaucaucugcuauccaguuaucaucugcuauccaguuaucaucugcuauccaguuaucuguuauccaguuaucaucuauuauccaguuaucuguuaucuaguuaucuguuauccaguuaucuguuaucuaguuaucuauuuggugcagagguuucugaaaaauacuaaggucagggaugagaaacagcagacguuccgccauuucugcuguggaggauguugaagagggaggcuagaguccuguuuucucucaagcacgucacuccacacgugcggugucucccagcggugaggaucugacugagaagacccuugaguguguacuuuaauaugugcccuggaucaguguaucuuccuuuccuacaugucgggcacgccaggauauacugcuuaccauaagaccuuggaauuccaauaacuauguguccuuggcaggagagauggcucagagguugagaucacuggcuguucuucagagguccugaguucaauucccagcaaccacaugguggcucacagccaucugcagugggaucuggugcccucuucuggguguaggcacacauguaagcaggacaccauauacauaguaaauaaauacaucuucuaaaaaaaacauucccuuaggaauuuggccaaccuucccuucacuaaaauuggguacgaagaugcugaguugaauggggacccuaagacuagugagauugguuaagccccaguuuugaagauagagcugagucuagaucuugguuacugcucuuagcucaaagccaagagccucaccaggcagcugcccacugcuagucugcagcugcccacugcuucucugcauccacaggauguuuugacuaggacagacagcccuggaggacagaaauggacacagcugggugucuggggcaggcaggaagcagauaugccucugcauagcacuggacgagccuugcuguugggagagugacgacuguguuuuguauuccaggguuggcaguguuugauugcauugggucugucuuuccuggacuguggacgcucgguaagcaucucgaaaguccugcugagcgaagauaccagcgguggcaacauuaaguaaacacuggaucagucugucugucuuugcagggagccaucagagccaguguguuucuaugguuuacugugugaacauagccacaaguaugugcuguugcacagacugcauuuaggacucaacuguuaguugggaaacacugauguguguguguguguguguguauauguguguguguguguguguuaaggucuuuguuuccuuuuguuuuugugaaauagcaucuugcuauuaaauacuagguugccuaaaacucacuauguagcuuaggcugugcucaaaccuacagcaauccuucugaccuaagcuccugagugcugggauuccaggcacgucuaccaugccuggcucucauguaugcuuaagaugaguuuuguugggggucagggugggggguagggggucuuacccuguagcauuaggcagcaccuugaaaagguggcccuugagcuguuuuaaacacuaaguuucuaaauagcugcccaagggcaguagcuuguuuuuagucaaaagaaacgcaaccagacugucgccauccuugaauuauagaaugagacugcugccuuugaagucaggguuuuuguuuggugcauuuuguuuguuuuucaagaguuuuuucguggcuguccuggaacuuacucuguagaccaggauggcuucgaacucacagagauccuccugccucugccucugccucuaccucccgagugcuaggauuagaggcagacaccuccacugcccugcugguucaggauuuuuuuuuuuuuauuucuacuucggaauuucucaguggaaagaaaaaaaagguagggcauaagugguggguguggacagaugauggcucaccugcagugcagguuuuccuuaaggaauggagcuuagcagggagggcuucaucuuuagcccugagguuaguaacuucccugcuaauaucaagccuuccugauauguugaaucuugagcacacacagucccugaaucuuucucuucugagagagugcugccugcagaagacuguagcacucguggacugacuuuuaugaggcucuggacucggaacgagucacagagcuaacugcacuacucccaaaaguacccuucaccaaaucaugucucuggcgcugccauuccacgcccaagauaacucagaaggcaaucucaggagcucuggacccaaaccuugcaaagucaguaggugucacuggugugaaguccucucccggcaaggugggccugggcuguauccuaacagcccuuccucggagagaaagccugcugaggccagacugcgaagcucuggagucuucagcaccgaacugcugcccucaguucagcuacuucugaccugucacgggggagacgugauucugucacaucaaaugcugucugucugcuggagaggagugacacaagagugugugaucauugucuugguggcagcgggagcuagagcugcuucgaaggauguccucucugacgcuuucccuguggcgagcgggccgacaaauggccuuugcugucugugccucuguagcgcuccugcuagcauuucucacagucagaggcucagccugcauagaucuuuaugaggcauacauuaucaaucgcuguguuucacucacccacagcuaauccaacaaaaccaggucacgggucccucccagcagcauucccaaccugugguugccacccaucugcaacccuauauucgaagacauuuaccucaugauuuguaacaguagcaagauuaguuacaaaguagcaaaauuauuauugggugugacccccagcaugaggagcugacuuaaaagaguggcagcuuccggaagguggggaaccccugcacuacaggguccuccuccccccugccccccucccccacuguucccgaaggcuagaagcugagcuuuugaaccugugcagugcuugagggccaggcugacggcagcagaauuccuugcauagaugcucuagugaugucugcauuuguacagggaugggguggggcgagcagaguguauccagauucgccauacuuaaagaguccagccugaagcugcuugggaucgcgcccagggcucugccucguguguucuaggcaaggcuccguugcacaucucacuuccugccccagaauucuguuguguuauacuuguuuacaaugauagaagguuucguugugugauacggucucuucugacucucugacuacaauauuuacagugucaaaagauuaaaaauguucccuauucacuugauugucacugaaaacgguacuucaacaguacaguaaccuguaaacauuucacgccccccacgcaacucugcuaccggcauuauauuugugagccaucuuugugcauucucugaauugguccuuguucuuaugugaccugaaauaguuguccccucagugcacugggagcugacaggccggggaguagcggcagcuugucuugugagauccugccaggucggcagcaaguggcuucaaggaggcuuuagugaacuuuuuacagcuugugaacgugcugugauuaaaccagagcuucccgcuuuccuguuugguuuucuuuccuguuuggucuuuaacaccgaaaacacuuuaugauggagccuuaacaacugaaauaaagaccugccagucgccaucaggagggacacacuuuaaguuccaagcgucggugcuuggcucccuaagggacagagaaggaaauggauucauuaccccagaaagucuggauuagccguagacaccaagaggggcccagauagcuucaaaugugccaccgccaccaagccucccucacgccuggcuucgcgcuuaaugcccacguggugggaagggagaagcugcucucaguggcugucucugcccaccacaggugcuccuuggcacuugcauacucaccccacacagguacacaacaaaucacauuuuuuucagucuaaaugaaaauuaauuuauccaaaaauuaaauacuuuuguugugguuaaggccauaacuacuauuuugcaagaugaaauuuguccuaccuuccucuaagcggaguaccugccucucuguagucuugucucauuguccaagaaggauuuguugacacuaauaaaaauuuaaaaagagaaaccgaagucacuuaguuuaaaaccagacacacuuuuuggcugacccaauguaaaugcagacacuguccccgauuccguuuguaaaggaggugaaaugcuuggguuuaaggucagaacuaaucuagaaugcagaacauucucaccuuagccuuucguguuaccucacgcgugugugcaaguggcagagcuguugaaaguccuugagacagugggcugcagagauggcgcaguaaagagcgcuuaacguucuuccagaggccccaaguucuauaucagggguucacagcuacuuacauaacuccugcuucuccucuccucuuucucucucccccuguccccuucucugguuuuucaagauaagguuucucuguguagucuugguuauccuggaacucacucuguagacuaggcuggucccaaacucaaaguuccuccuaccucucccucucagguacugggauuaaaggcgugcucagucaccaccagcuugcaacaagguauucacccucuguaguaagaggagacugaacacccugaaagcuuaucugagucacauuguuaguagaagcugaguaguuuaagccaguguugagacuccagaccaucuuguauaauauaauacaacaugcccuucaaacacagugagacuccaagccaucuuguguaauauacaacacgccccuuaagcuguagugagacucccaagcuuucucaggagcaccaagacaucaaaacguuuuaaucaggugcagugacacacacuuguaaccucagcacuugagaggcguggcaagaagauggcagacagaaggccagccagagcugcacagccaggucaaggucacagugggcugcacaggaagaccuguccuagcacuuggcaguaauucugggugcucgugucaggcuuaaacgacagagagggcucucuguagcuaauuacaguaauagauacacuuguuuaucaccuccgugcaccacaagaguguuaaucuauaccuagcugcaucucucaaugucucggaacuaggcaacagaauucuccagguuaccuaagaaauaaugcucuaaaugccauggaccgaggaaguccacgugcucugcucacuugggaccgguuuccgugacuuacccaugagucugguaguguguauuaguuccucagaucuggaugucagaccugcaaguugaaugucagugucucuagcacacuggcuuggaauguuuucauccagggcaccaugcggccugugcgucuucgucacagcauuccugugaugacgcaggccauguguaacgugcucgggauaaacuugcagacgacuuggugaguuauaaucacagcgugccuggcaucuccagauggaacucacguccauucugcacacaagacgagguucggaaaguagacacaguuugugugguggugcauaacuguaauccuagcacuugugagggaucacugcaaguuccagaccagccagaacuccagaaugagacccuaaacaagggaucgggguuaguucagugcuagagcacuugccuagcccuagguuugauccucaguucugaauauaaaacuuaaaggacacauugggaggacuaacacuggguccugaaccccaacccccccacuccagugucuuuuccgauacaguauauggcucuagucccuuaauacagaucuauaguuugcacuucacauuaacacacggacuguuggugccaagggcgacaguaccauuaauaccauaacugacaugaaagcuagucauuguugcaaaguguauugcuggacaguuaagaauggcagagcacaccuuuagucccaguacuugggaggcagaggugggcaaaucucugagcucgaggccugcuagacuuauauaacaaguuccaggauagccaggguugcuuagugagacccuaacuuaaaaaacaacaaacaaacaaaaccaguauguuuuucacagaucccugcaaaccaucuaucugcauuagauucacagggaagggaacuggaaauaucuuuuuaaaacugcugaggguggggcaugguuauaaauaucuauaaucccagcaccugggaggugggggcugggauaaaucaagacagcuacgugauaccuuugaggccagcuugacugucacgaguccugcuuuuaagaaccagaaaguuauagggcgugaagacaguugugguuccugauacagccugcagacacugggacccacaggucacugcuucucagccuggcagacacugggacuugcaggucgcugcugcuucugcacacuuuucguuccccuaacuacucaggaaagggcuuuucucaagugucaaaggauaauaggaccugaauuacuggacucaggguuuagaucauuugaaaucugauuuccaguacacuguggucauauuaucuauccuaaagucccaaccuagcuucacucucgucaugagacagucagaaugcauuuagcaucauccuuaacucagcuccaucucaggcagccacgaagcacacacacugaagguuuucacccccugccuguguucuaagcacgcuuucucuggcacuccaggcugcagccuuucucuagagugcucucucuaccucaggguugcuuggcugcuguguggcugaccuccacacgcccucucuagguccaaucccaggggauccagugccucccucugaccccugugggcagcagacgugugcacacuacauacacugauguaccuaaaauaaaaaucuaaaaaguguccaugaucuuaaauaagaaccucacauaacaccauuuucuauucugaaauaaaauucaauuguacugagcaaagaggccaaaauaauguguacguccacaguguaauuccuugcuagugacacuaacugucucccugugcuuuuguccucccucaguaccgccugggacugaccgcucagccugaacucuaucuucugaacaccguggaugcugacucagugguguccagaugacuaacagcccaggagaccuuaagaacacuuucucuaagcccuuucgggccaagugccuguuagcaaaucccuuaguucggaggugagcuuguucaaagguuuuugaacaaaggagaaguucuccucacggacucaggguaaaagcugacaguugcguaugggucagagacccuucggaggcagugggccuguggcagcugugcagucccucaggcuugugucugcacuucugggguuuaaaguguaucgauauguauuuaugugaacccaaacgugccaguuuggguaagauuuuaagguuauaaaacuugauagauuuuuacaaaugccuuucaggugaguuaggucuuuguucuauuuggguaacaaaugagaaagggaccuuucugacgaugaacuuccccaaaauaacucuugaagcgcugcuuuaccacagugugugugugugugugugugugugugugugugcgcgcgcgcgugccugccugcuucugcuugugggggccacggguuggcaucaggugucuccagucucuaccacagugugugugugugugugugugugugugugugugugugugugugugugugugcgugcgcgagugccugccugcuucugcuugugggggccacggguuggcaucaggugucuccagucucucucugaacauggaguucagugugugacugagcuagccagccaguaaguucaaggauccuccuggccucgcgccccaacacuguggucccagaucagcugcuacgcccagauuuuacacagugcuggggacccaaacucaggucuuccuggacagcagguacuuuaccaacuuucccccuuugucucuacaucaagugugucuguggcuguuguuccguuggugucuguccaccugcccuuucuucccacucuacgcgcugacacuccacacacuguccucacccugucucuaagggccgcccguauguguaccgcugaguguccugaggaauuuaagcauuuuaagguguguguuagcagaggucugaggcucgcacucgaugggaacacagaccaucaguuucacuuuaagcaccgacacuccaaacgcgcgugugcagguagugaagcuuuuugguuuuugcuuuaaucccaaccagaaauaaucauccuuguuauaauaaaguucaugcuuaauagcuaaaag

SEQ ID NO: 8005 - RNA, 7923 nt, Mus musculus
acaggugucgggagagcgguguucagcacggcagcugcuacggagcaaggcagagagacaggugcucaagcgccuagccaugacgcggcacaguuccagucccaagggaucuggcacgaaaaugcccccagugggggcagugggcacggggcagcugcaauucccuugauucuugaagggcuggcacaugcaacaucucucauucccccccucccuugggucaguagacauguagguucgaggaccagagguugagucuucuugcagucuuucuuguuggucaugggguagaugcuguugaggggguaggggacagucucaggcagcuggcugaaggaaggcaggccugcuggccagcuugguguccuggccuagugugcggaggcagugcaggggcucuguggcugggugccuaugacacuggauccagaauccaggauuguugccccgggugagcagcggguucugaguccaacaugguaaauacccacucagggguugcagcauaagguggugggggucuggugcaguccuggggagaguugccguuaccuuggagaccagcuaaagguggcuugaaaguuccccccgugggagaggccgcggucaguccugggagggcagccacaguugcuguagggauuguccacacggccagccccugcugcccagccacuugaccuguaauaccgauggggauaagaagagguugaguaacagucccugcugggaccauaacuccugucagaacuguggcuaagcuuuccugagucaagaccugcaagagcaaacgagauuucaaaaagaaaagaaaagaaaaaaauaaaaauaaaaauaaaaaaucaacauccacagacagcacaaacgaggggucucugggacccacugagcacaagcaagcaucugagggcacuggggaaaaggccagaggcgggcaagugagcaaagaggcccagcggaaggccuaacccugugggugcccagaucacacuaugccacgugcagagagcuugccuccagggcagagcaagauccccagaccuggauauacauauaugauauaugauauauauguacacacauauauauguguaguauauaugcaaccuccucagucuguuuaaugucacauguauguguguuuucagagaugaccauuugguccacuguuuuguggucagggaccagggaccagaggcugcagccaaguggucaagaguccacaaaggccucuaagaagcucuagcggagggugcccuugaccagaagagaucagugcacagaacagaggucaagcaggcucugcuggccuccgggauuccucaggcagcuuuucauuggcugggcaguuuuauaacuuaacugaagaugggccauucauuuauuaacucuucaaggcaugagcccgugugcaggagggcugacaagggcgcccacucauuauuucaucugcuaagcacaaaucuucucaugaaaaaguuaacgccaguccugucaggacccaaggaaacuguccagcaaugcucaccauuuuuucugaugggccugaucuggggcagggguaaccuagagauaccuaguaggacaggcguucucucaagccacagccucaugcguuccccgaccccaugccucaugcagcuccaugcucgcuccugcccgcugcccuccguccagcucccuggugugguccuuaccuggggggcagcuuguacagccagcggcgucagggucugugaugccugaggcuggcucggggcuugguugaagguggcaaucgcuggggcaggacucggagggacuccgggcagcgacuucacuucacacgggacggagagaaagaauaagagugagucuguugugaaugaaggguggccaugcuguagccuaggacgagcugguagccuucccuggcccguggcagcuucccaaguguugcuagcaguuucuaggaagcuggguagccccaggccagaccccacaagguagguaccuuccucccaccuugaguggaaggaaauguaguucucugcaaaacuggcucccagcucaucacugccuggcucuguaugacacuguggucuguaacauagcagucacagggccugaagcaaaggcaugucagggaagagaagcuggagcagacagaaagaagcagcuauccugaguucagccagcaaccaaacuguuccuuaccccauauucaagucauguuuuuagaagcuuggggaaggggcaggucuuacaaguacaacccccugaaaacuaggcaugucacugucacagugcagggucacaggggcugcacaggccacucagcuuuucuccgcuaugcugagaagcccaaagcugagcugggcgguuucuaugagcuuccaaaagaaaggucugugaaccacaaccuuucgccuccucuugcuuggccaauucaggaaccgggcugcccugccaggaaaccacaucacggccacagaacagcgagacaaaaccuauaauuuuauaagccagacaauaacaggaaucuaaggcuggggacacagcaugaugguagacugcuugccugguucaguccccagcauggcaggccagacagacagguaggcaggcaggugauagaagagacagauauauaaauaauaagcaaacauaaauugauagauaaaugauaaauaaauagauauagauagauaaauaaguagaugacagauacacaaauaguuaaauaaacagacauauacauaguuaaauaaauaaaauaaauaaguaauagagucuaguuguuguuguguuagacauuaucaguggcuucugaacccugguugagcauauauuucuaggcccaggccugagucagaaugucaggaauagagaccaguaggcaucaaucaguugaucucucucccucuuaccgcccccucacccccauccccauuucaaagcuccuuuguuaaaacagugcucagcagaguggacugcccugaguucgaugaccuuaagacuucugucuggcucugcagcuccggaucaugcuuuuguuuauuuguuugcuguuuuguuuugagacaaggguuucucuguguagcccuggcugcccuaaaacuugcucuguagaucaggcuggccucagacucacagagauccuccuuccuuugccucccgagggcuggaaucaaaggcgugcaucaccaugugcagccccagcucaugcguuuuuguguuugggggauuuuguuuuuaaaucaacuuaaccuaagccuauagcuaaguucccagaacuuagaauaauaagacccagaaaguugaacgaaccaaagacacacagggccuuacaaacuaaaaagccacgggucagguucucuucucuguggagggagacacauugguaacugcuggggaaagccagagacggucaggauguucugaauauagggaaacuggaaaaaauuuuguuggacaaauguaaugaaauauaagaacauaggaauauggaguugacaaaauggcccagcagguaagaguucuugcugucaagccggacgaguacaguccccagaaccacagagaagcaggagagagccaaccuuguguguucucuggcuuccaugugugugcgugccaugcuuguguaugugugcgugcaauauaaauaauaauauaaauauauaauauauaaauaauaaaccaacgaagauauaaauaauaaaucacccuguggaaggcagcccaggagaaggguggaagcuacccgagaagcagacacuuguuuuaagagguccugaguucaaaucccagcaaccacaugguggcucacaaccauccauaaugagaucugaugcccuauucuggggugucugaagacagcuacaguguacuuacaaauaauaaauaaaucuuaaaaaaaaaaaaaagguccuugugccaaacuaggaccauaggcacagugugggucauaucucuagucccaguauacaggaggcccaagcaagagaauagagaagucaaaacaaauucagggcuagccugggcuacauacuaccuagcaagacaaaacagugcuugauggcacacugggauugacaguguacaccuguaagcccacugcuggacuucaugagacacuaucuccgaaaacccaaaccaaacaaaguagaagaugcacaggguccuacagaccgcuuuacagaaacaccggcaggacguuuguuucuccacuaaguuagaguagcuagcuuuugguuuuuuuuccuguugagaugaggauggggacacagggaggggagcgaggggggguucucccucuguagcccaggcugguuuugaacuuaggcuagccuugaacgguugcagaguauuugaucacacuaugagacuguguuauuugaagaaaagacugcaguguggcucagucauagcuuucuguucauuguaaacagggugaaauaaagucagccauaggucaagaggcugaacaagcaaccagcugacagggggugaacguggggggaaaaaaaaccauagagagugagaggaagucagcaggauggcuagagagacacacaggaagcggaaagagggacauucggauugagaguuuuugagcuagagaggagagggagaacuuccuuccuuucccuuuugggacgucagcagugggagaaguuuacuuaggcgcuuucucugccucucugagcuagcaccacaacaucggccacccgaguucccaucgacaaaauugaaggacuaagauuuuguuuaaaaaugacauugaaggggcuggugagauggcucaguggguaagagcacccgacugcucuuccgaagcuccagaguucaaaucccagcaaccacaugguggcucacaaccauccguaacaagaucugacucccucuucuggugugucugaagacagcuacaguguacuuacauauaauaauaaauaaaucuuuuaaaaaaaugacauggaauccucagcagcccacuugccucaguccugccuagugccucaagggcagggauuccaggugugggccacacaccuguccaagggcccuucucaguguuuuccuuggcugaacaggcgggcaaccccuuaaagccaauuguuucuucucugcuuucucauucucucucucucuuucucucucucucucucccucccucucucucuccuccccucccucuuucccuucucccucccucccucucucucucucuuucuuucucucucuuucuuucucccuuccuucucucucucucucucucucucucucuuucuuucucaagauagggucuucuauacaguccuggcuguccuggaacccacucuguagacuacacuggccuugaacuuagagcugcuucugcuucugcuuccugagugcuaggauuaaagguguguaccaccaugcccagcucgucucaucucuucuuauugauaaugaguuuguuuguuuuuuuuuaauuccauguagccgggcaguggugggacaugccuuuaauccagcacuugagagacagauuucugaauuuaaggccagccuggucuacagagugaguuccaggacagcuacgacuacacagaaaaacauugucuuaauaaaaaaaaaaaaaaaaaaaaaggccugucauuaugucacacaugggcaagggguuuguggguccuuggcccucacuaaggccacgugagcagaaagacaagacccuaaugcuaccugggcccaguagcagauuaaaacgauagccucauaccaguugccucugcagaauggucggggucacaugacccagcuucagcagguccacuggcuucaacagggccuccacucugggagccaccagcugccacacucuccaguccuuugcucuccuccucggcuggaagcugggcauccacucccaccuccaauacucggauggucucguggccugacaucacaaugaccugcaggcagaggauagggaccgugaggggaaaggggccacagcucugggaaugacuaggaggaggguggaggguggggcgcucugugagacugccagaaccuggggcaggcuaccaucccugauuuccagcaaggagcuguuagaagaagguagcccagagacagagggaaaggcugcacagagccaacccaccaggagguguuucuguucguccccugucucacacuuagcucagaaagugggaaaggguucaucuggcaagcugguaagagcauccucuuagcugccgagauuuugguacgacccacaacaagauggggacccagcagaaaucuguccuaacauuccuagacacuaccuggaggcucccuagagggagacugugggaaguggaugcucuguagugcugagccccuugagauuguauucaucauuauuaguguacgugugugcgugugcccgugugcccauguguguguguguguguauguguguguguguaugugugugucggggucugucucccuccuggcaagcuguguacccucuucagcuuccagauguucccucagcuuaaggcaggaaggcugagauuacagacacacaucaccacauccagcauuguacgugagcucugaggaucuguugucuuaugcccagaaugguuuuacccacugagccgucucucuagcccuugaguaacuuuuaaacucaggaucccagaauuucccugcaaccuaauuuccccaaagaagggucaagaagucaaucaccaaaaugccgauucuccugccucacccuggccuguuccugacccagugggcuauuacaggcauucuccaaaggccagggugcccuccaugagcccuacucaaacguccugcacuaagaucuuuauacuaucgcuucagugugccauccuggcccuuaagacucccaggugggggcuggagagauggcucaaagguuaagagcacugacugcucuuccgaagguccagaguucaaguuccagcaaccacaugguggcucacaaccaucaauaaugagaucugacuccuucuucugguguggcugaauacggcuacagcgcacuuucauauaauaaauaaauaaauaaauaaauaaauaaauaaauaaauaagacuccuaggugaauucacaggugaaaaagcuuuguuucaaccgucaaccuuccuugcccaugaacugugccuggaaccacccccaccgugagaacugacugcagccauagacaagaaaaggcaucagggagaaccauggagaagaaugaacgugcauaugaccugugagggacuucacucugauuguguuucgaggaagcuggugugcuuucuucuuuuaaggaguaaacagucauuucagaaaaagaaaguauauagaagcauaaaaaacaaaacaaaacaaaaaaacccgccaggcaugguggcgcacgccuuuaaucccagcacucgggaggcagaggcugcuggauuucugaguuugaggccagccuggucuacagagugaguuccaggacagccagggcuauacagagaaacccugucucaaaaauaaacaaacaaacaaacaaaacaaaaccccuaaaucacauguucaaacacuuaucaaguaucugugcauuuuaauagaucuuuuuggaucuuacuuuuuauuuuauguguauggguguuuugccugcauacauguaugucuguauauacaccacaugcguacagugcccuuagccccguugcaacuuaaaaaucccaaacucaaccuccgagacccuagcugacacucgcucuggagagguggacuggggugaccauaaacuuuaauaagggacaaaugaggccucauuacagcuguaucucuuggccacaccaccccucagucgggacucucaccagccccauuucucaccccagaagauaccugcucauugacagucagagaugaguccgauccagcuccggg

SEQ ID NO: 8006 - RNA, 5415 nt, Mus musculus
aggaacgcggggagagcgaggagggcggggccucgcagggagggcggggcaauuagugagggcaaagcgcgcggugagggcgaagccgcgcagggaggggcggggccgagcccagaggaggcgcgcgccgugagggcagagcgcgcggggagggcggggcuuccgagcagagcagggccgcgagcgcccuccuugccgcgacuggccggccugcgagggggcgggguuuccggcggcggcgcacucgggcaucuccugacgcagaguggacgaacgucacgugacacggaagugacuccgaacaggaagaggacgagaaaaauaaccguccgcgacgccgagugggagcggacucagagccaccaugaacagcaaaggcaaggccgggaaguggcgggggccgucggggaagcgggcggguucgggucgagcgggcugggggacgucgggccuggggcggucugugcggcucucuucagcgggccgcacagcgcggccgcaccugacguggccgccccccuccacccccacaacgcagccgcucggcccucugggccccgaccccauaaaccguguggcgcaguuuggagccgcgggcuccuguguguggggugggggggcuuuuccgugacggacagcggcuggagcgaauggcgagcuagagcagggauuuggggaagccaauggagggcgggcggaggcggggcgccgcgccucggaacaacaggccucggccgagcuuaacugcugaggugccggcuccgcugcacggcccaggcccucgaggacccguucucgcccgccggggacuucuggcgcuuccuccucggggcccggacucguagccgccccugugcguugcuaauguuugugagaacauggucgcguuccccaccccuccacccgccgcccuucucacgguuaacuuccagucacucacucuuuggaggucgaccuugacuaggaacccgugagguaaacacugagaaccgugggucccacagagucaggacugguuacagcacagcccgggggagaucacccagaggaguccccuaagacaccagcaguccggagaccccggaacggguccucagaccugcccucuauucgaaagggaacauggccaaguuagccuccaucaaucaguaugcuagugggaacggcgccuucugcccagucagaagccagcaccuucgggcgcgagggugccgagaccauccuuauuuuccuggcucuaagaaauaaggcagccuuauuugcagcucuucugcuugcuccccacccugugcacccuggcccgucuaguagcucugcuuacaaacuuguuuuuauucaaagugugccugccucugccuguguaagugucugugagugugaguguaggugcccaccaaggcagaagguagcguugaaaggagguugugucauaugugggugcugggaauagaacugggguccucaggaagagcagcacuuugucucacacacugagcaucuuuccuguuugccaccuccccuccuaaucugacagacaacaucucuccuccccuuuuguauuccaggucaauauccaacacagccuaccuacccugugcaaccuccugggaauccaguauauccucagaccuuacaucuuccucaggcuccacccuauacugaugcuccaccugcauauucagagguacugcaguuuccuagacuuguagcuaguugagaacacucuuggauccccuuguuaagucuucaaaucugacuucacaagcagaaggaugcucugugaaucaucuagaacuuaaggugaaaauuaccauuggaauugaaugcaguaucugauuaugcuauuugacacaugcugacuuaagcugaguuugggucccuugagcacaauaguagcuguggacgcaaaugacucagaauacugugugccagugacuauaaccaguguguaaucugcaaacacaagaacuaggaacaaggggcuagagagauggcucaaugguuaagagcacugcuuuuccagagguccugaguucaaaucccagcaaccacaugguggcucacaaccacugguaaugagaucugacacccucuucuggugugccugaagacagcuacaguguacuuacauauaauaaauaaaucuuaaaaaaaaaaaaaaaaaaaaaaacaacuaagaauggacucaugagccaugcguggugguacaggcgaguagucucagcauugagaggcugagucaggaggaagcugaguucaaggcugccaguauaaccaaaccccauuuccaaaaccaaacaaggggcuggggauguaccugauuugguagaaugcuugcuuagcaugcaccaagcccuagauuuggucccuagcacaaugugaacuggguuugguggcacaggcuucuaauuccauagucaagagguaaagcaggagagucaggaguucaaggucauccacuccuacauacuugaaggcuagccugagcuacaggagauggucucaauaauacuuaaagagauuccaaauaggaaugucacaaaaauaauguuuugcuuucucuucugcuucuuucagcucuaucguccaagcuuuguucauccaggggcugccacaguccccaccaugucagcugcauuuccuggcgccucauuguaucugccuauggcccagucuguggcuguugggccucuaggcuccacaauccccauggcuuauuauccaguuggucccaucuauccaccuggcucagcaguguugguggaaggaggguaugaugcaggugccagauuuggagcuggugccacugcuggcaacauuccugugaguaugccuaacugggagcucagcccuuguauacuugaacagucugaaaugacuucauauucauucuccaaccauaguggucagggcuggcacagcugcugcccucucagagcagaaauguggccgggccaaucagggcauuggacacagcccuugguuuuagaguuaaucagguugauuuguuuucuugucuuauuaaauuaguggcaucuuccuuugauccuagcacuuaggggcagagacagggggaucuccgaguuugaggccagucuggucuacagagcgaguuccaggacagccagggcaacauagagaaacccugucuauaaauuuaaaaagacugcuagcuccuuuuucaguuguucaggcacagugaacugguccaggggugcugcuuggugaguucauaagcauuuaauauuugccaugaguggggaauguacuaggaacccagaugauuaagaaaguagaaugcacggucccuaguaaguagguuuuauuuuccagguccuccugcucagugacacuguguaugggguuuguagcccacaagguucuagcaaagggcaucuucuuaggagucauucuagagugaggugacuagaaugguaucauuauuggcuuuuaacaauguuguauguuaaaaaccuaggguugcugaagauguagcccacuaguagagcauuugcuuaucuuguacaaagggcucucccccucccugguaaauaaaaccccacauucacaagagauccuguggggugggcguggcucucccugagaaggaugggaucuggauuuacaggcuacaucuuagagcuagaacacucugggugaaugacagauuuccuuuccuguuuauguccuggauucagagagaguaggcaugcucuagaacaaacuguugcaaacuuagcuccuuaaaaugcugguugcuugguacuguaguacacucgauaaucuuaacaguggggagguugaggcagcagacuuccuuugaguuuaaugucagucagggcuacauagcaugaaccagucaagugagaguuacucagacccuggguggaccuaucccacugccugcaaaaaaaaaaaaaaaagaaaaaguuaccgauuggcacauugccaucuucuuacgcagcaucugcuuccuguguucuuucccugugcccacuguaccuuguucuuuccuucuagccuccaccuccuggaugcccucccaacgcugcucagcucgcagucaugcagggagccaacguccuuguaacucagcgcaagggaaacuucuucauggguggcucagaugguggcuacaccauuuggugaggagccauggccacuccugugccggggaagacaucacauaccuucagcacuucucacaauguaacugcuuuagucauauuaaccugaaguugcaguuuagacacauguuuuuggggugucuuucugguguccaaacuuuugaggcacuuuucaaauuuaauaaggaaccauguaaggguagcagccccucccuaaagcauucugagguaaggagguauccauucuucaaaugaaugugagugaagcagcccaaggcucuuccuuaauuccucuggagugaugcugugccaugcuggucuuugcuucuaguaauaaaacaucaaauuagguuuggagggaacuuugaucuuccuaagaauuaaaguugccaaauuauucugauuggucuuuaaucuccuuaaguuuuugauuuaucuuacuugguaaaugaaaugcauuagcugucugccuuuuccuucccauccucugcccagccuguccacugucccugcuccuccacccccucccaucacuauccauagaaucaguggugcaggaccgaaagccagacucagccccuugucucccugcaccugucccacuugacauuuuuuaacucaucuuucauaaggauccucugaagcccccugugugaccugagcacagacuccauuucuucagguuuuguauaucuccaggcaaggugaaggguacccuucggacccgccucauaaaccaucucugcaucaccaugaacccagacuagcuguggugccagaaaccugaacuuaaacaacaguucucagugcaaacuguccuaggaaaauuuaaagaugacaggcaggggagaagaugcauaucaaaagcuuggcuuuaaagucuaagggaguuuuagaucaaaaacuagcuaucacuuccugagugucucauguagccacucaggcucccaggaguuuccugagguagguuaguagggucacgugaaugccucacuaugacaugacuugaguccagugagaucucauuaggauuaauauuucagggauccuuaauauuuugauuuguuuuccgagauuggauuuuauuuuaucugcuauuucaguucaucuaaaucuuguguucuguacaugugauguuugacuguaccaucgacuguuauggaaguucagcguuguaugucucucuacacuguggugcacuuaacuuguggauuuuuuauacuaaaaauguagaauaaagacuauuuugaagauuugaauaaagugaugaaguugcauuacaccucac

SEQ ID NO: 8007 - RNA, 5415 nt, Mus musculus
gugagguguaaugcaacuucaucacuuuauucaaaucuucaaaauagucuuuauucuacauuuuuaguauaaaaaauccacaaguuaagugcaccacaguguagagagacauacaacgcugaacuuccauaacagucgaugguacagucaaacaucacauguacagaacacaagauuuagaugaacugaaauagcagauaaaauaaaauccaaucucggaaaacaaaucaaaauauuaaggaucccugaaauauuaauccuaaugagaucucacuggacucaagucaugucauagugaggcauucacgugacccuacuaaccuaccucaggaaacuccugggagccugaguggcuacaugagacacucaggaagugauagcuaguuuuugaucuaaaacucccuuagacuuuaaagccaagcuuuugauaugcaucuucuccccugccugucaucuuuaaauuuuccuaggacaguuugcacugagaacuguuguuuaaguucagguuucuggcaccacagcuagucuggguucauggugaugcagagaugguuuaugaggcggguccgaaggguacccuucaccuugccuggagauauacaaaaccugaagaaauggagucugugcucaggucacacagggggcuucagaggauccuuaugaaagaugaguuaaaaaaugucaagugggacaggugcagggagacaaggggcugagucuggcuuucgguccugcaccacugauucuauggauagugaugggaggggguggaggagcagggacaguggacaggcugggcagaggaugggaaggaaaaggcagacagcuaaugcauuucauuuaccaaguaagauaaaucaaaaacuuaaggagauuaaagaccaaucagaauaauuuggcaacuuuaauucuuaggaagaucaaaguucccuccaaaccuaauuugauguuuuauuacuagaagcaaagaccagcauggcacagcaucacuccagaggaauuaaggaagagccuugggcugcuucacucacauucauuugaagaauggauaccuccuuaccucagaaugcuuuagggaggggcugcuacccuuacaugguuccuuauuaaauuugaaaagugccucaaaaguuuggacaccagaaagacaccccaaaaacaugugucuaaacugcaacuucagguuaauaugacuaaagcaguuacauugugagaagugcugaagguaugugaugucuuccccggcacaggaguggccauggcuccucaccaaaugguguagccaccaucugagccacccaugaagaaguuucccuugcgcugaguuacaaggacguuggcucccugcaugacugcgagcugagcagcguugggagggcauccaggagguggaggcuagaaggaaagaacaagguacagugggcacagggaaagaacacaggaagcagaugcugcguaagaagauggcaaugugccaaucgguaacuuuuucuuuuuuuuuuuuuuuugcaggcagugggauagguccacccagggucugaguaacucucacuugacugguucaugcuauguagcccugacugacauuaaacucaaaggaagucugcugccucaaccuccccacuguuaagauuaucgaguguacuacaguaccaagcaaccagcauuuuaaggagcuaaguuugcaacaguuuguucuagagcaugccuacucucucugaauccaggacauaaacaggaaaggaaaucugucauucacccagaguguucuagcucuaagauguagccuguaaauccagaucccauccuucucagggagagccacgcccaccccacaggaucucuugugaaugugggguuuuauuuaccagggagggggagagcccuuuguacaagauaagcaaaugcucuacuagugggcuacaucuucagcaacccuagguuuuuaacauacaacauuguuaaaagccaauaaugauaccauucuagucaccucacucuagaaugacuccuaagaagaugcccuuugcuagaaccuugugggcuacaaaccccauacacagugucacugagcaggaggaccuggaaaauaaaaccuacuuacuagggaccgugcauucuacuuucuuaaucaucuggguuccuaguacauuccccacucauggcaaauauuaaaugcuuaugaacucaccaagcagcaccccuggaccaguucacugugccugaacaacugaaaaaggagcuagcagucuuuuuaaauuuauagacaggguuucucuauguugcccuggcuguccuggaacucgcucuguagaccagacuggccucaaacucggagaucccccugucucugccccuaagugcuaggaucaaaggaagaugccacuaauuuaauaagacaagaaaacaaaucaaccugauuaacucuaaaaccaagggcuguguccaaugcccugauuggcccggccacauuucugcucugagagggcagcagcugugccagcccugaccacuaugguuggagaaugaauaugaagucauuucagacuguucaaguauacaagggcugagcucccaguuaggcauacucacaggaauguugccagcaguggcaccagcuccaaaucuggcaccugcaucauacccuccuuccaccaacacugcugagccagguggauagaugggaccaacuggauaauaagccauggggauuguggagccuagaggcccaacagccacagacugggccauaggcagauacaaugaggcgccaggaaaugcagcugacaugguggggacuguggcagccccuggaugaacaaagcuuggacgauagagcugaaagaagcagaagagaaagcaaaacauuauuuuugugacauuccuauuuggaaucucuuuaaguauuauugagaccaucuccuguagcucaggcuagccuucaaguauguaggaguggaugaccuugaacuccugacucuccugcuuuaccucuugacuauggaauuagaagccugugccaccaaacccaguucacauugugcuagggaccaaaucuagggcuuggugcaugcuaagcaagcauucuaccaaaucagguacauccccagccccuuguuugguuuuggaaaugggguuugguuauacuggcagccuugaacucagcuuccuccugacucagccucucaaugcugagacuacucgccuguaccaccacgcauggcucaugaguccauucuuaguuguuuuuuuuuuuuuuuuuuuuuuuaagauuuauuuauuauauguaaguacacuguagcugucuucaggcacaccagaagagggugucagaucucauuaccagugguugugagccaccaugugguugcugggauuugaacucaggaccucuggaaaagcagugcucuuaaccauugagccaucucucuagccccuuguuccuaguucuuguguuugcagauuacacacugguuauagucacuggcacacaguauucugagucauuugcguccacagcuacuauugugcucaagggacccaaacucagcuuaagucagcaugugucaaauagcauaaucagauacugcauucaauuccaaugguaauuuucaccuuaaguucuagaugauucacagagcauccuucugcuugugaagucagauuugaagacuuaacaaggggauccaagaguguucucaacuagcuacaagucuaggaaacugcaguaccucugaauaugcagguggagcaucaguauaggguggagccugaggaagauguaaggucugaggauauacuggauucccaggagguugcacaggguagguaggcuguguuggauauugaccuggaauacaaaaggggaggagagauguugucugucagauuaggaggggagguggcaaacaggaaagaugcucagugugugagacaaagugcugcucuuccugaggaccccaguucuauucccagcacccacauaugacacaaccuccuuucaacgcuaccuucugccuuggugggcaccuacacucacacucacagacacuuacacaggcagaggcaggcacacuuugaauaaaaacaaguuuguaagcagagcuacuagacgggccagggugcacaggguggggagcaagcagaagagcugcaaauaaggcugccuuauuucuuagagccaggaaaauaaggauggucucggcacccucgcgcccgaaggugcuggcuucugacugggcagaaggcgccguucccacuagcauacugauugauggaggcuaacuuggccauguucccuuucgaauagagggcaggucugaggacccguuccggggucuccggacugcuggugucuuaggggacuccucugggugaucucccccgggcugugcuguaaccaguccugacucugugggacccacgguucucaguguuuaccucacggguuccuagucaaggucgaccuccaaagagugagugacuggaaguuaaccgugagaagggcggcggguggagggguggggaacgcgaccauguucucacaaacauuagcaacgcacaggggcggcuacgaguccgggccccgaggaggaagcgccagaaguccccggcgggcgagaacggguccucgagggccugggccgugcagcggagccggcaccucagcaguuaagcucggccgaggccuguuguuccgaggcgcggcgccccgccuccgcccgcccuccauuggcuuccccaaaucccugcucuagcucgccauucgcuccagccgcuguccgucacggaaaagcccccccaccccacacacaggagcccgcggcuccaaacugcgccacacgguuuauggggucggggcccagagggccgagcggcugcguuguggggguggaggggggcggccacgucaggugcggccgcgcugugcggcccgcugaagagagccgcacagaccgccccaggcccgacgucccccagcccgcucgacccgaacccgcccgcuuccccgacggcccccgccacuucccggccuugccuuugcuguucaugguggcucugaguccgcucccacucggcgucgcggacgguuauuuuucucguccucuuccuguucggagucacuuccgugucacgugacguucguccacucugcgucaggagaugcccgagugcgccgccgccggaaaccccgcccccucgcaggccggccagucgcggcaaggagggcgcucgcggcccugcucugcucggaagccccgcccuccccgcgcgcucugcccucacggcgcgcgccuccucugggcucggccccgccccucccugcgcggcuucgcccucaccgcgcgcuuugcccucacuaauugccccgcccucccugcgaggccccgcccuccucgcucuccccgcguuccu

SEQ ID NO: 8008 - RNA, 1882 nt, Mus musculus
caaaguucccuccaaaccuaauuugauguuuuauuacuagaagcaaagaccagcauggcacagcaucacuccagaggaauuaaggaagagccuugggcugcuucacucacauucauuugaagaauggauaccuccuuaccucagaaugcuuuagggaggggcugcuacccuuacaugguuccuuauuaaauuugaaaagugccucaaaaguuuggacaccagaaagacaccccaaaaacaugugucuaaacugcaacuucagguuaauaugacuaaagcaguuacauugugagaagugcugaagguaugugaugucuuccccggcacaggaguggccauggcuccucaccaaaugguguagccaccaucugagccacccaugaagaaguuucccuugcgcugaguuacaaggacguuggcucccugcaugacugcgagcugagcagcguugggagggcauccaggagguggaggcuagaaggaaagaacaagguacagugggcacagggaaagaacacaggaagcagaugcugcguaagaagauggcaaugugccaaucgguaacuuuuucuuuuuuuuuuuuuuuugcaggcagugggauagguccacccagggucugaguaacucucacuugacugguucaugcuauguagcccugacugacauuaaacucaaaggaagucugcugccucaaccuccccacuguuaagauuaucgaguguacuacaguaccaagcaaccagcauuuuaaggagcuaaguuugcaacaguuuguucuagagcaugccuacucucucugaauccaggacauaaacaggaaaggaaaucugucauucacccagaguguucuagcucuaagauguagccuguaaauccagaucccauccuucucagggagagccacgcccaccccacaggaucucuugugaaugugggguuuuauuuaccagggagggggagagcccuuuguacaagauaagcaaaugcucuacuagugggcuacaucuucagcaacccuagguuuuuaacauacaacauuguuaaaagccaauaaugauaccauucuagucaccucacucuagaaugacuccuaagaagaugcccuuugcuagaaccuugugggcuacaaaccccauacacagugucacugagcaggaggaccuggaaaauaaaaccuacuuacuagggaccgugcauucuacuuucuuaaucaucuggguuccuaguacauuccccacucauggcaaauauuaaaugcuuaugaacucaccaagcagcaccccuggaccaguucacugugccugaacaacugaaaaaggagcuagcagucuuuuuaaauuuauagacaggguuucucuauguugcccuggcuguccuggaacucgcucuguagaccagacuggccucaaacucggagaucccccugucucugccccuaagugcuaggaucaaaggaagaugccacuaauuuaauaagacaagaaaacaaaucaaccugauuaacucuaaaaccaagggcuguguccaaugcccugauuggcccggccacauuucugcucugagagggcagcagcugugccagcccugaccacuaugguuggagaaugaauaugaagucauuucagacuguucaaguauacaagggcugagcucccaguuaggcauacucacaggaauguugccagcaguggcaccagcuccaaaucuggcaccugcaucauacccuccuuccaccaacacugcugagccagguggauagaugggaccaacuggauaauaagccauggggauuguggagccuagaggcccaacagccacagacugggccauaggcagauacaaugaggcgccaggaaaugcagcugacaugguggggacugug
